(12) United States Patent
Horan et al.

(10) Patent No.: US 11,339,436 B2
(45) Date of Patent: May 24, 2022

(54) METHODS FOR EARLY IDENTIFICATION OF BONE HEALING ABILITY IN INJURED PATIENTS

(71) Applicant: The Trustees of the University of Pennsylvania, Philadelphia, PA (US)

(72) Inventors: Annamarie D. Horan, Philadelphia, PA (US); Samir Mehta, Haddonfield, NJ (US); Donald A. Baldwin, Newtown Square, PA (US)

(73) Assignee: THE TRUSTEES OF THE UNIVERSITY OF PENNSYLVANIA, Philadelphia, PA (US)

( * ) Notice: Subject to any disclaimer, the term of this patent is extended or adjusted under 35 U.S.C. 154(b) by 716 days.

(21) Appl. No.: 15/548,535

(22) PCT Filed: Feb. 3, 2016

(86) PCT No.: PCT/US2016/016404
§ 371 (c)(1),
(2) Date: Aug. 3, 2017

(87) PCT Pub. No.: WO2016/126844
PCT Pub. Date: Aug. 11, 2016

(65) Prior Publication Data
US 2018/0016638 A1    Jan. 18, 2018

Related U.S. Application Data

(60) Provisional application No. 62/283,443, filed on Sep. 1, 2015, provisional application No. 62/231,935, filed on Feb. 3, 2015.

(51) Int. Cl.
*C12Q 1/6883* (2018.01)
*G01N 33/68* (2006.01)

(52) U.S. Cl.
CPC .......... *C12Q 1/6883* (2013.01); *G01N 33/68* (2013.01); *G01N 33/6887* (2013.01); *G01N 33/6893* (2013.01); *C12Q 2600/106* (2013.01); *C12Q 2600/158* (2013.01); *C12Q 2600/178* (2013.01); *G01N 2570/00* (2013.01); *G01N 2800/10* (2013.01)

(58) Field of Classification Search
CPC .............. G01N 33/68; G01N 33/6887; G01N 33/6893; G01N 2570/00; G01N 2800/10; C12Q 1/6883; C12Q 2600/106; C12Q 2600/158; C12Q 2600/178
See application file for complete search history.

(56) References Cited

U.S. PATENT DOCUMENTS

| 2011/0033516 A1 | 2/2011 | Markwald et al. |
| 2012/0213837 A1 | 8/2012 | Botchwey et al. |
| 2014/0100137 A1 | 4/2014 | Gangji et al. |

FOREIGN PATENT DOCUMENTS

| WO | 2008134054 A1 | 11/2008 |
| WO | 2014201516 A2 | 12/2014 |

OTHER PUBLICATIONS

Affymetrix, Affymetrix GeneChip Gene ST Array Package Insert, published online 2012. pp. 1-2. (Year: 2012).*
Extended European Search Report and Written Opinion for European Patent Application No. 16747207.5 dated Sep. 26, 2018.
Partial European Search Report for European Patent Application No. 16747207.5 dated Jun. 25, 2018.
Ajal, et al. Evaluation of Serum Alkaline Phosphatase as Biomarker of Healing Process Progression of Simple Diaphyseal Fractures in Adult Patients, International Research Journal of Biological Sciences 2(2) ,2013 ,40-43.
Pountos, et al., Fracture non-union: Can biomarkers predict outcome?, Injury 44(12) ,2013 ,1725-1732.
PCT International Search Report and Written Opinion for PCT International Application No. PCT/US2016/016404 dated Jun. 23, 2016.
Panteli, et al., "Biological and molecular profile of fracture non-union tissue: current insights", J Cell Mol Med. 19(4), 2015, 685-713.
Stewart, et al., "Pre-clinical evaluation of therapies to prevent or treat bone non-union: a systematic review protocol", Syst Rev. 4, 2015, 161.

* cited by examiner

*Primary Examiner* — Antonio Galisteo Gonzalez
*Assistant Examiner* — Khaleda B Hasan
(74) *Attorney, Agent, or Firm* — Saul Ewing Arnstein & Lehr LLP; Alireza Behrooz

(57) ABSTRACT

The present invention relates to the discovery that the expression levels of some RNA molecules, comprising messenger RNA (mRNA), non-coding RNA (ncRNA) and/or microRNA (miRNA), and protein can be used as a diagnostic signature to predict or monitor the bone healing ability in an acutely injured subject or in a chronic nonunion subject. In certain embodiments, the invention relates to methods and compositions useful for differentiating between a nonunion, slow healing, and/or normal healing of a fractured bone and treatment recommendations. The invention further includes a kit comprising biomarker probes for assessing the bone healing ability in an acutely injured subject or in a nonunion subject after receiving therapeutic treatment.

13 Claims, 30 Drawing Sheets
Specification includes a Sequence Listing.

Fig. 1

| RNA | SEQ ID | Time period: 1a | | | Time period: 2 | | | | Time period: 3 | | | Time period: 4 | | | Time period: 6 | | | Time period: 7 | | |
|---|---|---|---|---|---|---|---|---|---|---|---|---|---|---|---|---|---|---|---|---|
| | | Atxnorm | Atslow | Atnu | Atxnorm | Atslow | Atxnorm | Atslow | Atnu | Atxnorm | Atslow | Atnu | Atxnorm | Atslow | Atxnorm | Atslow | Atnu | Atxnorm | Atslow | Atnu |
| ANXA3 | 349 | 74 | 84 | 1,533 | -60 | -56 | | | | | | | -91 | -582 | 10,106 | 197,282 | | | | -3,453 |
| HIF8 | 194 | 58 | 31 | | | | | | | | | | -1,030 | -5,232 | 2.7 | 3.4 | | -277 | -6,145 | |
| LDHB | 125 | 24 | 31 | | | | | | | | | | -5,823 | -21,395 | | | | -1,271 | -2.9 | -4.0 |
| S100A13 | 5,618 | 6.9 | 6.7 | | | | | | | | | | -3.1 | -4.2 | | | | -2.7 | | |
| RPS27 | 347 | 1.8 | | 2.8 | 1.8 | 2.0 | | | | | | | | | | | | | | |
| CLIC2 | 512 | 1.7 | | 3.5 | 1.7 | 1.8 | | | | | | | | | | | | | | |
| SNORA19 | 78 | 1.4 | 1.5 | | | | | | | | | | | | | | | 1.8 | -1.7 | -2.0 |
| C3T7 | 293 | -1.5 | -1.5 | | | | | | | | | | | | | 1.9 | | -2.0 | -2.0 | -1.9 |
| PECAM1 | 1838 | | | | 1.6 | | | | | | | | | | 2.0 | | 2.2 | | | |
| IFIT1B | 64,654 | | | | 2.2 | 2.2 | | | | | | | | | | | | | | |
| HMR8 | 89,677 | | | | 1.6 | 1.8 | | | | | | | | | 2.1 | | | | | 3.0 |
| PFDPF | 291 | | | | 1.7 | 1.7 | | | | | | | | | 2.1 | | | | | |
| RAD23A | 239 | | | | 1.5 | 1.6 | | | | | | | | | | | | 2.2 | | |
| AIF1 | 1,515,408,512 | | | | 1.4 | 1.5 | | | | | | | | | 2.0 | | | 1.4 | | |
| RPS15 | 279 | | | | 1.4 | 1.5 | 1.4 | 1.4 | 2.0 | | 1.5 | | | | 1.8 | | | | | |
| NEUFA2 | 401 | | | | 1.3 | | 1.7 | 1.7 | | | | | | | | | | | | |
| TSTA3 | 471 | | | | | 1.8 | | | | | | | | | | | | | | |
| ANKRO22 | 75 | | | | | | | | | | | | -4.9 | -8.0 | | | | | | |
| TRMN | 7,30,497 | | | | | | 1.5 | 1.4 | 2.4 | | | | | | 2.3 | 2.0 | 3.2 | | | |
| MXD3 | 279 | | | | | | 1.4 | 1.5 | | | | | | | 1.6 | | | | | |
| RPRD1B | 293 | | | | | | 1.3 | | 1.8 | | | | | | | | | | | |
| SNORD34E | 104 | | | | | | 1.3 | 1.2 | | | | | | | | -1.3 | | | | |
| HSPD1 | 283 | | | | | | 1.2 | | | | | | | | | | | | | |
| RPL36A | 442 | | | | | | 1.2 | 1.2 | | | | | | | | | | | | |
| EIF4B | 132 | | | | | | | | 1.5 | | | | | | | | | | | |
| miR-25a stem-loop | 449 | | | | | | | | | | | | 5.7 | | | | | | | |
| IL2RB | 2 | | | | | | | | | | | | 1.3 | 1.4 | | | | 1.7 | 1.7 | 1.7 |
| MT1X | 191 | | | | | | | | | | | | -1.7 | -1.8 | | | | -2.0 | -2.4 | |
| HSPA9 | 400 | | | | | | | | | | | | | | -1.7 | -1.9 | | | | |
| ARG1 | 413 | | | | | | | | | | | | | | | 2.5 | | | | |
| CLEC4D | 109,702 | | | | | | | | | | | | | | | 2.8 | | | 6.9 | |
| FAM83A | 459 | | | | | | | | | | | | | | | | | 1.5 | | 1.3 |
| NFATC2 | 4 | | | | | | | | | | | | | | -1.6 | -1.6 | | -1.3 | -1.3 | -1.3 |
| SNORD13 | 228 | | | | | | | | | | | | | | -1.5 | -1.5 | | -1.3 | | |
| SNORD25 | 6 | | | | | | | | | | | | | | | | | | -433 | |

Fig. 2

| Within subject mRNA expression change | | | | | Average fold change | |
|---|---|---|---|---|---|---|
| from time | to time | RNA | SEQ ID | p-value | AInorm | AIslow |
| 1a | 1b | ARPP19 | 388 | 0.001 | nc | 21 |
| 1a | 1b | TRNN | 7, 30, 497 | 0.001 | nc | -11 |
| 1a | 1b | RPS15 | 279 | 0.002 | nc | -14 |
| 1a | 1b | SNORD59B | 134 | 0.003 | nc | -6.2 |
| 1a | 1b | MXD3 | 270 | 0.005 | nc | -4.1 |
| 1a | 1b | NFATC2 | 4 | 0.005 | nc | -2.3 |
| 1a | 1b | PPDPF | 291 | 0.005 | 1.6 | -4.0 |
| 1a | 1b | RPS27 | 347 | 0.006 | nc | -9.9 |
| 1a | 1b | CST7 | 290 | 0.01 | -1.6 | -4.3 |
| 1a | 1b | MT1E | 189 | 0.01 | nc | 23 |
| 1a | 1b | EIF4B | 132 | 0.01 | nc | 2.3 |
| 1a | 1b | IL2RB | 2 | 0.01 | nc | -3.0 |
| 1a | 1b | TLR5 | 53 | 0.01 | -2.7 | nc |
| 1a | 1b | MT1X | 191 | 0.02 | nc | 1.8 |
| 1a | 1b | RAD23A | 239 | 0.02 | nc | -5.2 |
| 1a | 1b | NDUFA2 | 401 | 0.02 | nc | -3.0 |
| 1a | 1b | ANKRD22 | 75 | 0.02 | -1.7 | 2.7 |
| 1a | 1b | IRF8 | 194 | 0.02 | -80.0 | 751 |
| 1a | 1b | TSTA3 | 471 | 0.03 | nc | -5.3 |
| 1a | 1b | RPL36A | 442 | 0.03 | nc | 11 |
| 1a | 1b | AIF1 | 1, 408, 513, 515 | 0.04 | -1.6 | -3.8 |
| 1a | 1b | PECAM1 | 1838 | 0.05 | -1.5 | nc |
| 1a | 2 | IRF8 | 194 | 0.04 | 5.7 | -123 |
| 1b | 2 | IRF8 | 194 | 0.03 | 18.7 | -1,513 |
| 1b | 2 | ANXA3 | 349 | 0.03 | 5.1 | -4,220 |
| 1a | 4 | IL2RB* | 2 | 0.02 | nc | 2.0 |
| 1a | 4 | LDHB | 126 | 0.04 | 39.0 | -4,339 |
| 1a | 4 | ANXA3 | 349 | 0.05 | 81.7 | -5,204 |
| 1a | 4 | PECAM1 | 1838 | 0.05 | 1.7 | -1.7 |
| 2 | 3 | MXD3 | 270 | 0.05 | -1.7 | nc |
| 2 | 4 | SNORA19 | 78 | 0.001 | 1.5 | -1.7 |
| 2 | 4 | CLEC4D | 109, 702 | 0.01 | nc | -2.6 |
| 2 | 4 | HMBS | 89, 677 | 0.03 | nc | -1.5 |
| 2 | 4 | ANKRD22 | 75 | 0.03 | 1.5 | -7.1 |
| 2 | 4 | TLR5 | 53 | 0.04 | nc | -2.0 |
| 2 | 4 | CLIC2 | 512 | 0.04 | nc | -2.2 |
| 2 | 4 | ARPP19 | 388 | 0.04 | nc | -1.5 |

Fig. 3

| Within subject miRNA expression change | | | | Average fold change | | | p-value | | |
|---|---|---|---|---|---|---|---|---|---|
| from time | to time | microRNA | SEQ ID | AInorm | AIslow | AInu | AIslow vs. AInorm | AInu vs. AInorm | AInu vs. AIslow |
| week 1 | weeks 2+3 | hsa-let-7f-5p | 518 | -3.1 | -2,353 | 49 | 0.10 | 0.27 | 0.04 |
| week 1 | weeks 2+3 | hsa-miR-551a | 549 | -2.4 | nc | 202 | 0.76 | 0.05 | 0.15 |
| week 1 | weeks 2+3 | hsa-miR-664a-5p | 552 | nc | nc | 365 | 0.78 | 0.002 | 0.01 |
| week 1 | weeks 2+3 | hsa-miR-199a-5p | 531 | nc | 2.4 | 433 | 0.70 | 0.01 | 0.05 |
| week 1 | weeks 2+3 | hsa-miR-1270 | 523 | 1.6 | 2.2 | 1,046 | 0.84 | 0.006 | 0.025 |
| 1a | 1b | hsa-let-7f-5p | 518 | -4.5 | -6,041 | 49 | 0.04 | 0.26 | 0.02 |
| 1a | 1b | hsa-miR-664a-5p | 552 | nc | 12 | 365 | 0.20 | 0.04 | 0.27 |
| 1a | 2 | hsa-miR-182-3p | 528 | -2 | -3 | 1,149 | 0.77 | 0.006 | 0.006 |
| 1a | 2 | hsa-let-7f-5p | 518 | 8.3 | -3.9 | 833,140 | 0.27 | 0.07 | 0.03 |
| 1b | 2 | hsa-miR-182-3p | 528 | nc | 2 | 3,423 | 0.57 | 0.001 | 0.003 |
| 1a+1b | 2 | hsa-miR-1270 | 523 | nc | 5.8 | nc | 0.05 | 0.95 | 0.37 |
| 1a+1b | 2 | hsa-miR-182-3p | 528 | nc | -3.1 | 2,593 | 0.34 | 0.004 | 0.002 |
| 1a | 3 | hsa-miR-1228-5p | 520 | -18 | 162 | 191 | 0.002 | 0.08 | 0.97 |
| 1a | 3 | hsa-miR-504-5p | 548 | -1.9 | -2.4 | 4,921 | 0.69 | 3.6E-06 | 3.2E-06 |
| 1a | 3 | hsa-miR-551a | 549 | -9.2 | 1.5 | 13,887 | 0.36 | 0.05 | 0.13 |
| 1a | 3 | hsa-miR-664a-5p | 552 | 2.1 | nc | 15,641 | 0.75 | 0.07 | 0.05 |
| 1a | 3 | hsa-miR-199a-5p | 531 | -2.6 | nc | 19,241 | 0.41 | 0.0001 | 0.0002 |
| 1a | 3 | hsa-miR-1270 | 523 | nc | 2.5 | 114,295 | 0.05 | 3.7E-09 | 1.3E-08 |
| 1a+1b | 3 | hsa-miR-182-3p | 528 | nc | -2.7 | -21,587 | 0.59 | 0.02 | 0.04 |
| 1a+1b | 3 | hsa-miR-18a-5p | 529, 1520 | nc | nc | -51 | 0.77 | 0.04 | 0.05 |
| 1a+1b | 3 | hsa-miR-93-5p | 556 | nc | nc | -32 | 0.95 | 0.05 | 0.05 |
| 1a+1b | 3 | hsa-miR-221-3p | 533 | nc | nc | -27 | 0.95 | 0.03 | 0.03 |
| 1a+1b | 3 | hsa-miR-1270 | 523 | nc | 2.3 | -19 | 0.07 | 0.01 | 0.002 |
| 1a+1b | 3 | hsa-miR-589-5p | 551 | nc | nc | -15 | 0.38 | 0.02 | 0.01 |
| 1a+1b | 3 | hsa-miR-584-5p | 550 | nc | 2.5 | -12 | 0.11 | 0.18 | 0.05 |
| 1a+1b | 3 | hsa-miR-1255b-5p | 522 | nc | 2.2 | -9.3 | 0.03 | 0.03 | 0.003 |
| 2 | 3 | hsa-miR-584-5p | 550 | -1.8 | nc | no data | 0.03 | | |
| 2 | 4 | hsa-miR-551a | 549 | -110 | 4.5 | 114 | 0.07 | 0.047 | 0.48 |

Fig. 4

| SEQ ID | miRNA group | AInorm | AIslow | all AI | HV | p-value |
|---|---|---|---|---|---|---|
| 528 | miR-182-3p samples | | | 22% | 0% | 0.29 |
| | miR-182-3p subjects | | | 51% | 0% | 0.016 |
| 520 | miR-1228-5p samples | 29% | 51% | | | 0.0014 |
| | miR-1228-5p subjects | 50% | 73% | | | 0.049 |
| 518 | let-7f-5p samples | 45% | 32% | | | 0.046 |
| | let-7f-5p subjects | | | 67% | 13% | 0.0076 |

Fig. 5

| | | Time period: month 1 | | month 2 | |
|---|---|---|---|---|---|
| SEQ ID | RNA | fold difference | p-value | fold difference | p-value |
| 371 | ROPN1L | 2.6 | 0.003 | | |
| 344 | S100P | 5.7 | 0.009 | | |
| 4 | NFATC2 | -1.9 | 0.018 | | |
| 126 | LDHB | | | 30.2 | 0.018 |
| 349 | ANXA3 | 387,525 | 0.020 | 4,468,533 | 0.054 |
| 2 | IL2RB | -1.8 | 0.023 | | |
| 1838 | PECAM1 | 1.6 | 0.024 | 2.3 | 0.003 |
| 388 | ARPP19 | 1.5 | 0.036 | | |
| 413 | ARG1 | 2.9 | 0.045 | | |
| 109, 702 | CLEC4D | 2.2 | 0.048 | | |
| 75 | ANKRD22 | 14.7 | 0.052 | | |
| 53 | TLR5 | 2.0 | 0.052 | | |
| 528 | hsa-miR-182-3p* | 4,233 (p 0.012) | | | |

* data pooled for months 1 and 2

Fig. 6

| SEQ ID | Protein | Time period: 1a AIslow | 1a AInu | 3 and 4 AInu | Name |
|---|---|---|---|---|---|
| 1778, 1779 | CXCL3 CXCL2 | 2.8 | | | Gro-beta/gamma |
| 1787 | CXCL6 | 2 | | | C-X-C motif chemokine 6 |
| 1699 | VWF | 2 | | | von Willebrand factor |
| 1715, 1716, 1717, 1826, 1827 | BDNF | 1.8 | 1.5 | | Brain-derived neurotrophic factor |
| 1803 | HSPA8 | 1.7 | | | Heat shock cognate 71 kDa protein |
| 1740, 1741, 1781 | LEPR | 1.7 | | | Leptin receptor |
| 1701 | IFNA2 | 1.6 | | | Interferon alpha-2 |
| 1750, 1821, 1822 | CASP2 | 1.4 | | | Caspase-2 |
| 1789 | TIMP1 | 1.3 | 1.4 | | Metalloproteinase inhibitor 1 |
| 1773, 1757 | CPB2 | 1.3 | | | Carboxypeptidase B2 |
| 1825 | ESAM | 1.2 | | | Endothelial cell-selective adhesion molecule |
| 1783 | NGF | 1.2 | 1.2 | -1.7 | beta-nerve growth factor |
| 1705, 1761, 1762 | FAM107A | -1.1 | | | protein FAM107A |
| 1777 | GAS1 | -1.2 | | | Growth arrest-specific protein 1 |
| 1793 | GZMB | -1.2 | | | Granzyme B |
| 1751, 1784 | PDE7A | -1.2 | | | High affinity cAMP-specific 3',5'-cyclic phosphodiesterase 7A |
| 1804 | LYVE1 | -1.2 | 1.3 | | Lymphatic vessel endothelial hyaluronic acid receptor 1 |
| 1809 | IL20 | -1.2 | | | Interleukin-20 |
| 1713, 1788 | TGFB2 | -1.2 | | | Transforming growht factor beta-2 |
| 1691 | APOA1 | -1.3 | -1.2 | | Apolipoprotein A-I |
| 1796 | GPC5 | -1.6 | 1.5 | | Glypican-5 |
| 1695, 1711, 1730 | CTSA | -1.6 | | | Lysosomal protective protein |
| 1698, 1703, 1753, 1756 | CGA TSHB | -2.2 | -2.4 | | Thyroid stimulating hormone |
| 1794 | PYY | -2.2 | | | Peptide YY |
| 1774 | CST5 | | 2.5 | | Cystatin-D |
| 1812 | FGF23 | | 1.6 | | Fibroblast growth factor 23 |
| 1810, 1736 | RETN | | 1.5 | | Resistin |
| 1780 | ICAM3 | | 1.3 | | Intercellular adhesion molecule 3 |
| 1776 | FGF4 | | -1.2 | | Fibroblast growth factor 4 |
| 1801, 1755 | PTK6 | | -1.2 | | Protein-tyrosine kinase 6 |
| 1724, 1733, 1759, 1692, 1758, 1760 | C2 | | -1.4 | | Complement C2 |
| 1732 | LDHB | | -1.5 | | L-lactate dehydrogenase B chain |
| 1798 | PGLYRP1 | | -1.8 | | Peptidoglycan recognition protein 1 |
| 1705, 1706, 1707, 1714, 1735, 1791, 1816 | FCGR2A FCGR2B | | | 3.3 | Low affinity immunoglobulin gamma Fc region receptor II-a/b |
| 1702, 1742, 1743, 1744 | ACY1 | | | 2.2 | Aminoacylase-1 |
| 1708, 1734, 1763, 1764, 1829 | CAST | | | 2 | Calpastatin |
| 1820 | CCL15 | | | 2 | C-C motif chemokine 15 |
| 1797 | OMD | | | 1.8 | Osteomodulin |

Fig. 7A

| SEQ ID | Protein | Time period: 1a | | 3 and 4 | Name |
|---|---|---|---|---|---|
| | | Alslow | Alnu | Alnu | |
| 1696 | TGFBI | | | 1.6 | Transforming growth factor-beta-induced protein ig-h3 |
| 1697 | AMH | | | 1.5 | Muellerian-inhibiting factor |
| 1700 | TNF | | | 1.4 | Tumor necrosis factor |
| 1807, 1754, 1710 | GP6 | | | 1.4 | Platelet glycoprotein VI |
| 1799 | EPHA1 | | | 1.4 | Ephrin type-A receptor 1 |
| 1792 | FCN2 | | | 1.3 | Ficolin-2 |
| 1824 | TNFRSF13C | | | 1.3 | Tumor necrosis factor receptor superfamily member 13C |
| 1818, 1693, 1726 | FGFR3 | | | 1.3 | Fibroblast growth factor receptor 3 |
| 1785 | DMP1 | | | 1.3 | Dentin matrix acidic phosphoprotein 1 |
| 1745, 1746, 1749, 1747, 1748, 1704 | PRLR | | | 1.2 | Prolactin receptor |
| 1813, 1729 | SPINT2 | | | 1.2 | Kunitz-type protease inhibitor 2 |
| 1738, 1805, 1786, 1739 | PRSS3 | | | 1.2 | Trypsin-3 |
| 1800, 1826, 1765, 1766 | IL12RB1 | | | 1.2 | Interleukin-12 receptor subunit beta-1 |
| 1772 | C1S | | | 1.1 | Complement C1s subcomponent |
| 1819 | SLC25A18 | | | 1.1 | Mitochondrial glutamate carrier 2 |
| 1767, 1790 | TNFRSF14 | | | 1.1 | Tumor necrosis factor receptor superfamily member 14 |
| 1802 | FGF8 | | | 1.1 | Fibroblast growth factor 8 |
| 1808 | IL1RAPL2 | | | 1.1 | X-linked interleukin-1 receptor accessory protein-like 2 |
| 1817, 1770 | LIN7B | | | -1.1 | Protein lin-7 homolog B |
| 1685, 1686, 1687, 1688, 1689, 1690 | IGHG1 IGHG2 IGHG3 IGHG4 IGK IGL | | | -1.3 | Immunoglobulin G |
| 1815 | NTN4 | | | -1.3 | Netrin-4 |
| 1731, 1694 | PLG | | | -1.3 | Angiostatin |
| 1811, 1728, 1727 | AMHR2 | | | -1.4 | Anti-Muellerian hormone type-2 receptor |
| 1712, 1806, 1752 | SPOCK2 | | | -1.5 | Testican-2 |
| 1775 | DSG2 | | | -1.5 | Desmoglein-2 |
| 1718, 1719, 1720, 1721, 1722, 1723, 1814 | CD209 | | | -1.5 | CD209 antigen |
| 1823 | FCRL3 | | | -1.5 | Fc receptor-like protein 3 |
| 1785, 1768, 1769 | PGD | | | -2.4 | 6-phosphogluconate dehydrogenase, decarboxylating |
| | | Time 1a to 2, 3 or 4 | | | |
| | | Alnorm | Alslow | Alnu | |
| 1732 | LDHB | -0.56 | 0.31 | 0.53 | L-lactate dehydrogenase B chain |
| 1783 | NGF | 0.14 | -0.1 | -0.21 | beta-nerve growth factor |
| 1796 | GPC5 | 0.07 | 0.13 | -0.18 | Glypican-5 |
| 1804 | LYVE1 | -0.12 | -0.08 | 0.52 | Lymphatic vessel endothelial hyaluronic acid receptor 1 |

Fig. 7B

| Outcome | Subjects | Paxgene blood RNA samples | | | | | |
|---|---|---|---|---|---|---|---|
| | | Time A | B | C | D | E | Total |
| AInorm | 62 | 58 | 24 | 34 | 27 | 36 | 179 |
| AInu | 8 | 6 | 3 | 3 | 4 | 21 | 37 |
| AIslow | 19 | 19 | 4 | 14 | 11 | 24 | 72 |
| AI Total | 89 | 83 | 31 | 51 | 42 | 81 | 288 |
| NUhealed | 5 | 6 | 1 | 5 | 3 | 6 | 21 |
| NUslow | 5 | 6 | 0 | 4 | 5 | 16 | 31 |
| NU Total | 10 | 12 | 1 | 9 | 8 | 22 | 52 |

Fig. 8

| Fig. 9 row | RNA | SEQ ID | log2 A/nu/A/norm | | | | log2 A/slow/A/norm | | | | log2 A/notnorm/A/norm | | | |
|---|---|---|---|---|---|---|---|---|---|---|---|---|---|---|
| | | | A | B | C | D | A | B | C | D | A | B | C | D |
| 1 | A2M | 722 | | | | | | | | | | -1.43 | | |
| 2 | A2M-AS1 | 703 | | | | | | | 1.58 | | | | | |
| 3 | A2MP1 | 724 | | | | | | | | | | | | |
| 4 | ADGRE1 | 966 | | | -1.74 | -66.02 | | | | | | | -1.51 | -28.7 |
| 5 | AIF1 | 1,498, 513, 515 | | | | | -1.51 | | | | | | | |
| 6 | ANKRD22 | 75 | | | -2.21 | | | 3.44 | -4.81 | | | 2.22 | -1.68 | |
| 7 | ANKRD36B | 1074 | | | | -278.42 | 1.57 | | 1.21 | 2.25 | 1.46 | | | -140 |
| 8 | ANPEP | 862 | | | | | 1.47 | | 2.08 | | 1.51 | | | 1.7 |
| 9 | ANXA3 | 349 | | | | | -1.7 | | -2.17 | | | | | |
| 10 | ARG1 | 413 | | | | | -2.38 | | | | | | | |
| 11 | ARPP19 | 388 | | | | | | | 1.54 | | | | | |
| 12 | ATG9A | 1080 | | | | | -1.44 | -1.62 | | | -1.51 | | | |
| 13 | C4BPA | 598 | | | -3.58 | -15800 | | | | | | | | -7970 |
| 14 | CASP5 | 193, 698 | | | -1.92 | | | | -1.87 | | | | -1.83 | |
| 15 | CCDC144A | 910, 911 | | | | | | | | | | | | |
| 16 | CCR7 | 934 | | | | | | | 2.06 | | | | | |
| 17 | CD27 | 700 | | | | | | | | | | | | |
| 18 | CES1 | 885 | 3.53 | | | | 2.25 | | 3.18 | | 2.47 | | | |
| 19 | CHRM3-AS2 | 634 | | | | -1.49E+10 | | | 1.87 | | | | | -7.44E+09 |
| 20 | CLEC1B | 124, 725 | | | -2.06 | -2.13E+08 | | | 2 | | | | | -1.07E+08 |
| 21 | CLEC4D | 109, 702 | | | | | -2.04 | 3.05 | | | | | | |
| 22 | CLEC4E | 721 | | | | | | | | | | | | |
| 23 | CLIC2 | 512 | | | | | -2.04 | | | | -2.23 | | | |
| 24 | CLU | 1382 | | -1.95 | -2.34 | | | | | 1.85 | 1.38 | | -1.78 | 1.7 |
| 25 | CMTM2 | 889 | | | | -6060 | -2.25 | | -3.18 | | -2.05 | -2.06 | -2.87 | -3030 |
| 26 | COX7B | 1431 | | | | | | | | | | | | |
| 27 | CR1 | 24, 599 | | | | | | | | 1.74 | 1.62 | | | 1.55 |
| 28 | CSNK1A1L | 753 | | | | -1046 | | | | | | | | -521 |
| 29 | CST7 | 280 | | | | | | 2.79 | 1.52 | | 1.53 | 1.85 | | |
| 30 | DSC2 | 952 | | | | -716 | 1.7 | | 4.82 | | 1.61 | | | -358 |
| 31 | DYSF | 1024 | | | | | -1.47 | -1.66 | | | | | | |
| 32 | EGF | 351, 1180 | | | -2.52 | 2.41 | | | 2.02 | | | | -1.97 | |
| 33 | EIF4B | 132 | | | | | -1.4 | -1.25 | | | | | | |
| 34 | F5 | 45, 624 | 2.38 | | | | | | 2.05 | 1.67 | | | | 1.43 |
| 35 | F8A1 | 1437 | 2.37 | | | | 1.91 | 1.44 | 2.43 | 2 | | | | 1.97 |
| 36 | FAM83A | 459 | | | | | -3.52 | -9.29 | | | -2.93 | | | |
| 37 | FLJ45858 | 106 | | | | | | | | | | | | |
| 38 | GCNT4 | 1228 | | | | | 1.58 | | 1.36 | 2.36 | 1.5 | | | |
| 39 | GPR162 | 701 | | | | -3.13E+10 | | | | 1.99 | 1.52 | | | -1.57E+10 |
| 40 | GRIK1-AS2 | 1086 | | | | | | | | | | | | |
| 41 | GYG1 | 314, 1141 | 2.28 | | | | 1.78 | 1.67 | | 1.93 | 1.88 | | | |
| 42 | GZMH | 814 | | -3.33 | -4.22 | -1.86E+13 | -2.64 | -4.27 | -4.7 | | -2.53 | -3.87 | -4.51 | -9.28E+12 |
| 43 | H1F0 | 289 | -3.02 | -2 | -1.98 | | | | | | -2.23 | | | |
| 44 | HBQ1 | 867 | | | | | -1.59 | | -1.72 | -2 | | | | |
| 45 | HIST1H2BG | 1281 | | -1.88 | | -5.61E+11 | | | | | | | | -2.81E+11 |
| 46 | HIST1H3J | 1283 | | | | -7.2 | | | | | | | | -4.34 |
| 47 | HLA-DRB1 | 1286 | 2.65 | | 2.35 | 2.58 | 2.12 | | 1.6 | 2.35 | 2.23 | | 1.74 | 1.64 |
| 48 | HMBS | 89, 677 | | | | | -1.99 | | -1.83 | | | | | |

Fig. 10A

| Fig. 9 row | RNA | SEQ ID | log2 Anu/Anorm A | B | C | D | log2 Aslow/Anorm A | B | C | D | log2 Anotnorm/Anorm A | B | C | D |
|---|---|---|---|---|---|---|---|---|---|---|---|---|---|---|
| 49 | let-7a-5p | 516 | | | | | 1.7 | | | | | | | |
| 50 | let-7d-3p | 1489 | | | | | | -2.29 | | | | | -2 | |
| 51 | let-7e-5p | 517 | | | | | | | | | | | | |
| 52 | let-7f-5p | 518 | | | | | | | | | | | | |
| 53 | miR-100-5p | 1830 | | | | | | | | | | | | |
| 54 | miR-106a-5p | 519 | | | | | | | | | | | | |
| 55 | miR-122-5p | 1831 | | | | | | -7.23 | | | | | -6.27 | |
| 56 | miR-1228-5p | 520 | | | | | | -14.71 | | | | | | |
| 57 | miR-1247-3p | 1499 | | | | | -7.4 | | | | | | | |
| 58 | miR-125b-5p | 522 | | | | | | | | | | | | |
| 59 | miR-126b-5p | 1500 | | | | | | | | | | | | |
| 60 | miR-126-3p | 1501 | | | | | | | | | | | | |
| 61 | miR-1270 | 523 | | -1.88 | | | | | | | | | | |
| 62 | miR-1303 | 1508 | | | | | | | | | | | | |
| 63 | miR-134-5p | 1512 | -8.18 | -12.75 | | | -2.36 | | | | -2.4 | -4.22 | -4.88 | |
| 64 | miR-143-3p | 1513 | | | | | | | | | | | | |
| 65 | miR-144-5p | 1514 | | | | | | | | | | | | |
| 66 | miR-146a-5p | 1832 | -2.28 | -2.05 | | | | -1.61 | | | | -1.93 | -1.6 | |
| 67 | miR-146b-5p | 1515 | -2.67 | | | | -2.12 | -1.4 | | | | -2.36 | -1.34 | |
| 68 | miR-148a-3p | 1833 | | | | | -1.98 | -2.87 | -2.53 | | -1.83 | -1.9 | -2.55 | |
| 69 | miR-151a-3p | 525 | -1.92 | | | | -1.81 | | | -2.2 | -1.68 | -1.58 | | |
| 70 | miR-154-5p | 1517 | -20.31 | | | | | -12.77 | | | | -9.71 | | |
| 71 | miR-155-5p | 526 | | | | | | | | | | | | |
| 72 | miR-17-5p | 527 | | | | | | | | | | | | |
| 73 | miR-182-3p | 528 | | -12.55 | | | | | | | | | -6.76 | |
| 74 | miR-18a-5p | 529, 1530 | | | | | | | | | | | | |
| 75 | miR-196a-5p | 1522 | | | | | | | | | | | | |
| 76 | miR-196b-5p | 1523 | | | | | | | | | | | | |
| 77 | miR-1973 | 1524 | | | | | -3.59 | -2.62 | | | -3.11 | | | |
| 78 | miR-1976 | 1526 | | | | | 1.42 | 1.39 | | | | | | 1.59 |
| 79 | miR-195a-5p | 531 | -2.52 | | | | | | | | | -1.88 | | |
| 80 | miR-19b-3p | 1527 | | | | | | | | | | -1.39 | | |
| 81 | miR-202-3p | 1528 | | | | | | 1.78 | | | | | 1.89 | |
| 82 | miR-20a-5p | 1529 | | | | | | | | | | | | |
| 83 | miR-21-5p | 1834 | | | | | | | | | | | | |
| 84 | miR-221-3p | 533 | | -2.68 | | | | | | | | | -1.69 | |
| 85 | miR-223-3p | 534 | | | | | | -1.34 | | | | | -1.52 | |
| 86 | miR-23a-3p | 535 | -8.4 | | | | | -2.82 | -4.89 | | | -2.74 | -4.19 | |
| 87 | miR-24-3p | 1835 | -2.25 | | | | | | | | | -1.52 | | |
| 88 | miR-25-3p | 1836 | | | | | | | | | | | | |
| 89 | miR-25-5p | 1531 | | | | | | -16.59 | | | | | | |
| 90 | miR-27a-3p | 539, 540 | | -1.71 | | | | | | | | | -1.77 | |
| 91 | miR-27b-3p | 541 | | -3.07 | -1.91 | | | | | | | | -1.68 | |
| 92 | miR-29a-3p | 542, 1532 | -2.61 | | | | | | | | | -1.85 | | |
| 93 | miR-29b-3p | 1534 | | | | | | | | | | | | |
| 94 | miR-29c-3p | 1535 | | | | | | | | | | | | |
| 95 | miR-29c-5p | 1536 | | | | | | -2.27 | -2.22 | | | -2.05 | -1.94 | |
| 96 | miR-3117-3p | 1539 | | | -41.18 | | | | | | | | | |
| 97 | miR-31-3p | 1837 | | | | | -4.63 | | -2.7 | | | | | |

Fig. 10B

| Fig. 9 row | RNA | SEQ ID | log2 Alnu/Alnorm | | | | log2 Alslow/Alnorm | | | | log2 Alnotnorm/Alnorm | | | |
|---|---|---|---|---|---|---|---|---|---|---|---|---|---|---|
| | | | A | B | C | D | A | B | C | D | A | B | C | D |
| 99 | miR-3156-5p | 1542 | | | | | | | 5.27 | | | | | |
| 97 | miR-31-5p | 1543 | | | | | | | | | | | | |
| 100 | miR-3176 | 1544 | | | | | | | | -2.03 | | | | |
| 101 | miR-323a-3p | 1546 | | -2.66 | -2.24 | | | | | | | | -2.44 | |
| 102 | miR-323b-3p | 1547 | | | | | 28.26 | | 8.69 | | 21.63 | | 4.13 | |
| 103 | miR-329-3p | 1548 | | -4.69 | | | | | | | | | -4.19 | |
| 104 | miR-335-5p | 543, 1549 | | | | | -1.41 | | | | -1.36 | | | |
| 105 | miR-3613-3p | 1551 | | | | | | -3.21 | -6.12 | -3.76 | | | -5.19 | |
| 106 | miR-3613-5p | 1552 | | | | | | | | | | | | |
| 107 | miR-3667-5p | 1555 | | | | | | | | -2.75 | | | | -2.25 |
| 108 | miR-374b-5p | 1561 | | | | | | | -1.89 | -1.96 | | | -1.82 | -1.69 |
| 109 | miR-376a-3p | 1562 | | -4.58 | | | | | | | | | -2.34 | |
| 110 | miR-378-5p | 1565 | | -3.81 | | | | | | | | | -2.05 | |
| 111 | miR-4284 | 1575 | | | | | | | | | | | | |
| 112 | miR-431-5p | 1576 | -3.86 | -36.17 | -10.2 | | | | | | -4.53 | -15.52 | -6.32 | |
| 113 | miR-4435 | 1579 | -3.21 | | | | | | -3.21 | -3.54 | -2.09 | | -2.72 | |
| 114 | miR-4485 | 1582 | | | | | -28.79 | -3.67 | | | | | | |
| 115 | miR-4525 | 1584 | | | | | | | | -4.01 | | | | |
| 116 | miR-4668-5p | 1585 | | | | | | | | | | | | |
| 117 | miR-4797-5p | 1588 | | | | | -3.31 | | -13.67 | | | | -11.26 | -20.88 |
| 118 | miR-485-3p | 1599 | | -9.45 | | | | | | | | | -5.11 | |
| 119 | miR-487a-5p | 1600 | | | -8.63 | | | | -5.19 | | | | -5.19 | |
| 120 | miR-487b-3p | 1601 | -1.98 | -3.23 | -2.84 | | | | | | | | -1.85 | |
| 121 | miR-495-3p | 1605 | | -2.93 | -3.49 | | | | -1.84 | | | -1.96 | -1.8 | |
| 122 | miR-504-5p | 548 | | | | | | | | 3.11 | | | | |
| 123 | miR-505-3p | 1607 | | | | | | | -2.46 | | | | -2.22 | |
| 124 | miR-5195-3p | 1608 | | -4.45 | | | | | | | | | | |
| 125 | miR-543 | 1609 | | -2.93 | -2.47 | | | | | | | | | |
| 126 | miR-548aa | 1610 | | -2.18 | | | | | -1.55 | -1.69 | | -1.78 | -1.51 | |
| 127 | miR-551a | 549 | | | | -5.74 | | | | | | | | |
| 128 | miR-584-5p | 550 | | | | | | | | | | | | |
| 129 | miR-589-5p | 551 | | | | | | | | | | | | |
| 130 | miR-654-3p | 1627 | | -4.03 | | | | | | | | | -2.47 | |
| 131 | miR-664a-5p | 552 | | | | | | | 2.26 | | | | | |
| 132 | miR-6726-3p | 1628 | -2.16 | | | | | | | | | | | |
| 133 | miR-6770-5p | 1637 | | | | | | | -2.13 | | | | -1.96 | |
| 134 | miR-6777-3p | 1640 | | | | | | | -2.47 | | -1.61 | | -2.23 | |
| 135 | miR-6818-5p | 1643 | | | -3.49 | | -1.79 | -3.42 | | -2.89 | -1.85 | -2.51 | -2.6 | |
| 136 | miR-6820-3p | 1645 | | | | | | | | | | | | |
| 137 | miR-6840-3p | 1648 | | -2.44 | | | 2.17 | | 2.4 | | | | 2.05 | |
| 138 | miR-6855-3p | 1649 | | | | | | | | | | | | |
| 139 | miR-6879-3p | 1652 | -1.99 | | | | | | -1.88 | | | | -1.7 | 1.88 |
| 140 | miR-7-5p | 553, 1656 | | | | | 1.65 | | 1.59 | | | | | 1.85 |
| 141 | miR-7641 | 1657 | | | | | | | | | | | | |
| 142 | miR-7975 | 1662 | -1.92 | -2.84 | | | | | | | | | -1.97 | |
| 143 | miR-93-5p | 555 | | | | | | | | | | | | |
| 144 | miR-98-5p | 1665 | | | | | | | | | | 3.03 | | |
| 145 | HSPA9 | 400 | | | | | | | 1.86 | | | | 1.64 | |

Fig. 10C

| Fig. 9 row | RNA | SEQ ID | log2 A(nu)/A(norm) | | | | log2 A(low)/A(norm) | | | | log2 A(notnorm)/A(norm) | | | |
|---|---|---|---|---|---|---|---|---|---|---|---|---|---|---|
| | | | A | B | C | D | A | B | C | D | A | B | C | D |
| 146 | HSPD1 | 283 | | | | | | | 1.48 | | | | 1.39 | |
| 147 | IFI44 | 573 | | | -3.71 | -4.85E+15 | | | | | | | -2.37 | -2.43E+15 |
| 148 | IFI44L | 572 | | | -4.11 | | | | | | | | -2.41 | |
| 149 | IFI6 | 609 | | | -2.46 | -7.74 | | | | | | | -1.84 | -4.52 |
| 150 | IFIT1 | 655 | | | -2.93 | | | | | | | | -1.93 | |
| 151 | IFIT1B | 64, 654 | | | | | -2.36 | -2.82 | -3.09 | | -2.42 | | | |
| 152 | IFIT2 | 652 | | | -2.18 | | | | | 2.08 | 2.35 | | -1.53 | 1.86 |
| 153 | IFIT3 | 653 | | | -2.67 | | | | | | | | -2.14 | |
| 154 | IFIT5 | 656 | | | -2.04 | -78.98 | | | | | | | -1.55 | -40 |
| 155 | IFITM3 | 682 | | | | | | | | | | -1.94 | | |
| 156 | IFNA16 | 1406 | | | | | | | 3.47E+06 | | | | 49.52 | |
| 157 | IGHA1 | 824 | | | | -2.27 | -1.8 | | | | -1.53 | | | -1.82 |
| 158 | IGKC | 1072, 1071, 1070, 1069, 1068, 1063, 1035, 1032, 1027, 1066, 1030 | -21.02 | | | -8.58 | -12.38 | -4.37E+15 | -5.31 | | -14.54 | -8.81E+10 | -5.69 | -4.31 |
| 159 | IGLC1 | 1109, 1110, 1111, 1114 | | | | -16500 | 2.37 | | | | 2.15 | | | -8260 |
| 160 | IL2RB | 2 | | | | | | | 1.63 | | | | 1.55 | |
| 161 | IL5RA | 1153 | | | -1.55 | | 1.69 | | 1.44 | | | | | |
| 162 | IRF9 | 194 | | | | | | | | | | | | |
| 163 | ITGA2B | 239, 938 | | -2.28 | -2.83 | | | | | 2.1 | | | -2.19 | |
| 164 | ITGB3 | 918 | | | -2.72 | -200 | | | | 3.05 | | | -1.99 | -101 |
| 165 | KCNJ15 | 1100 | 2.42 | | | | 2.16 | | 2.53 | 2.22 | | | | 2.21 |
| 166 | KIF13A | 1279 | | | | -431 | 1.56 | | 2.11 | 1.58 | | | | -216 |
| 167 | KIF1B | 562 | | | | | | | 2.03 | 1.51 | | | | 1.73 |
| 168 | KLK12 | 1084 | 9.59 | | | 4.77E+10 | 5.18E+14 | | 7.04E+14 | 4.77E+10 | 38.34 | | 26.47 | 4.77E+10 |
| 169 | LDH6 | 126 | | | | | | | -1.76 | | | | | |
| 170 | LEF1 | 1201 | | | | -2.08E+10 | 1.77 | | | 2.47 | 1.55 | | | -1.04E+10 |
| 171 | LGALS2 | 1126 | | | | -5.22E+09 | 1.56 | | | 2.26 | 1.48 | | | -2.61E+09 |
| 172 | LOC440300 | 850 | | | | | | | | | | | | |
| 173 | LOC646214 | 855 | | | | | | | | | | -1.99 | | |
| 174 | MANSC1 | 729 | | | | -9.07E+14 | -1.33 | | | | | | | -4.54E+14 |
| 175 | MFSD9 | 1075 | | | | | | | | | | | | |
| 176 | pre-miR29a | 449 | | | | | | | -2.01 | | | | | |
| 177 | MMP9 | 1087 | | | | | | | | | | | | |
| 178 | MT1E | 189 | | | | | | | | | | | | |
| 179 | MT1X | 191 | | | | | | | -1.27 | | | | | |
| 180 | MXD3 | 270 | | | | | | | 2.22 | 1.39 | | | 1.65 | 1.29 |
| 181 | MYL4 | 917 | | | | | | | -1.58 | | | | | |
| 182 | NDUFA2 | 401 | | | | | -1.76 | | | | -3.65 | | | |
| 183 | NFATC1 | 981 | 1.22 | | | 1.37 | 1.55 | | | 1.97 | 1.52 | | | 1.53 |
| 184 | NFATC3 | 4 | | | | | | | 1.72 | | | | 1.49 | |
| 185 | NLRC4 | 1054 | | | | -486000 | | | | 1.79 | 1.59 | | | -243000 |
| 186 | NOTCH3 | 996 | 3.15 | | | 3.14 | 1.68 | | | 2.4 | 1.91 | | | 3.75 |

Fig. 10D

| Fig. 9 row | RNA | SEQ ID | log2 Anu/Anorm | | | | log2 Alxlow/Anorm | | | | log2 Anxnorm/Anorm | | | |
|---|---|---|---|---|---|---|---|---|---|---|---|---|---|---|
| | | | A | B | C | D | A | B | C | D | A | B | C | D |
| 187 | OMG | 991 | | | | | | | | | | | | |
| 188 | RAD14 | 9,563 | | | | | | | | 2.28 | | | | |
| 189 | PDIA3P | 582 | | | | -2.6 | -2.09 | -3.81 | -3.87 | -2.35 | -2.03 | -3.36 | -3.69 | -3.05 |
| 190 | PECAM1 | 1838 | | | | | | | | | | | | |
| 191 | PET100 | 968 | | | | | | | | | | | | |
| 192 | PI3 | 1086 | | | | | | | | -1.44 | | | | |
| 193 | PPDPF | 291 | | | | | -1.87 | | -3.17 | -2.34 | -1.85 | | | |
| 194 | PRKXP1 | 864 | | | | -315000 | | | | 2.06 | | | | -158000 |
| 195 | PROS1 | 1154 | | | | | | | | 2.25 | | | | |
| 196 | PYGL | 164, 816 | | | | | 1.58 | | | 1.94 | 1.64 | | | 1.77 |
| 197 | RAB39A | 676 | 1.42 | | | 1.63 | 1.72 | | | 2.17 | 1.7 | | | 1.85 |
| 198 | RAD23A | 239 | -2.31 | | | | | | -1.89 | | -1.94 | | | |
| 199 | RBBP8 | 954 | | | | | 2.96 | | | 2.57 | 2.48 | | | 2.37 |
| 200 | ROPN1L | 371 | | | | | | 2.95 | 1.6 | | | | 1.7 | |
| 201 | RPS15 | 279 | | | | | -1.34 | -1.57 | -1.53 | -1.48 | | | | -1.31 |
| 202 | RPS27 | 347 | | | | -2.57 | -1.89 | | | | | | | |
| 203 | RUNDC3A | 915 | | | | | | | | -1.94 | | | | |
| 204 | S100A12 | 5,818 | | -2.99 | | | -1.72 | | -2.35 | | -2.07 | | | |
| 205 | S100P | 344 | | | | | -1.8 | | | | | | | |
| 206 | SELP | 625 | | -2.47 | -2.48 | -3200 | | | | 2.77 | | | -1.92 | -3200 |
| 207 | SMAD4 | 958 | | | | -6.99 | 1.52 | | | 2.08 | 1.49 | | | -3.97 |
| 208 | SMN1 | 1216 | | | | 1.73 | | | | | | | | 1.28 |
| 209 | SNORA14A | 1318 | | | | | -1.47 | | | | | | | |
| 210 | SNORD13 | 228 | | | | | | | | 1.48 | | | 1.44 | |
| 211 | SNORD14E | 184 | | | | | | | | 1.58 | | | 1.53 | |
| 212 | SNORD25 | 6,99 | | | | | -1.48 | | | | | | | |
| 213 | SNORD48 | 914 | 9.05 | | | 67.76 | 71.36 | | 90.76 | 87.16 | 26.21 | | 32.83 | 54.77 |
| 214 | SNORD59B | 134 | | | | | -5.87 | -1.73 | | | | | | |
| 215 | SPTA1 | 620 | | | | -3200 | -1.97 | | -2.38 | | -2.05 | | -1.96 | -3200 |
| 216 | THBS1 | 844 | | | | | | | | 2.26 | | | | |
| 217 | TLR5 | 53 | | | | | | 2.22 | | | | | | |
| 218 | TMEM158 | 1153 | -3.9 | | | | -4.48 | -5.86 | -6.88 | -2.78 | -4.32 | -5.05 | -5.98 | |
| 219 | TMEM176A | 1537 | | | | 4.89 | | | 3.09 | 4.21 | 2.38 | | 3.53 | 4.03 |
| 220 | TMEM176B | 1363 | | | | | | | | 3.03 | | | | 2.48 |
| 221 | TNFRSF9 | 682 | | | | | | | | 1.75 | | | | |
| 222 | TREML1 | 1288 | | -2.27 | | | | | | | | | | |
| 223 | TRNN | 7, 30, 497 | | | | | | | | | | | 1.3 | |
| 224 | TSTA3 | 471 | | -1.81 | | | -2.16 | | | | -2.14 | | | |
| 225 | TUBB2A | 1244, 1245, 1277 | | | | | | | -1.92 | | | | | |
| 226 | U388 | 1677 | | | | | -1.42 | | | | | | | |
| 227 | USP32P1 | 912 | | | | | | | | | | | | 2.33 |
| 228 | YME1L1 | 765, 771, 768, 769, 764, 760, 762, 766, 770, 777, 781, 785, 794, 788, 791 | | | | | 1.35 | | | 1.89 | 1.35 | | | |

Fig. 10E

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Anorm | Anu | Aslow | Anotnorm | Anorm | Anu | Aslow | Anotnorm | Anorm | Anu | Aslow | Anotnorm |
| 1 | A2M | 722 | | | | | 9.46E+07 | -5.03E+06 | -3.51E+08 | -2.95E+08 | 0.99 | -4.65 | -1.23 | -2.37 |
| 2 | A2M-AS1 | 703 | -0.02 | -0.45 | 0.95 | 0.25 | | | | | | | | |
| 3 | A2MP1 | 724 | | | | | -1.2 | 14.19 | 5.36 | 7.77 | | | | |
| 4 | ADGRE1 | 966 | | | | | -0.66 | 0.38 | -0.33 | -0.14 | 0.1 | -6.72 | -0.37 | -2.49 |
| 5 | AIF1 | 1,408, 513, 515 | -2.59E+11 | -5.26E+11 | -2.74E+12 | -1.85E+12 | | | | | | | | |
| 6 | ANKRD22 | 75 | | | | | | | | | | | | |
| 7 | ANKRD36B | 1074 | | | | | 0.36 | -0.11 | 0.17 | 0.09 | 1.04 | -6.34 | 0.49 | -1.79 |
| 8 | ANPEP | 862 | -0.81 | 0.95 | 0.06 | 0.51 | -0.42 | 0.43 | -0.3 | -0.1 | 0.2 | -6.93 | -0.78 | -2.83 |
| 9 | ANXA3 | 349 | -1.03E+07 | -3.87E+06 | -4.41E+07 | -2.80E+07 | | | | | | | | |
| 10 | ARG1 | 413 | | | | | -1.39 | -0.23 | -3.57 | -2.74 | | | | |
| 11 | ARPP19 | 388 | | | | | | | | | | | | |
| 12 | ATG9A | 1080 | | | | | -0.31 | -0.29 | -1.17 | -0.93 | -0.09 | -7.31 | -0.94 | -3.06 |
| 13 | C4BPA | 598 | | | | | -9.14E+09 | 3.53E+10 | 1.18E+10 | 1.76E+10 | -1.08E+11 | 3.63E+14 | -2.10E+09 | 1.21E+14 |
| 14 | CASP5 | 103, 598 | | | | | -0.46 | 1.13 | 1.35 | 1.29 | 0.24 | -5.69 | -0.06 | -1.93 |
| 15 | CCDC144A | 910, 911 | | | | | -4.68 | 0 | 3.39 | 2.47 | | | | |
| 16 | CCR7 | 934 | | | | | 0.5 | -0.13 | 0.04 | -0.01 | 1.13 | -6.8 | 0.52 | -1.82 |
| 17 | CD27 | 700 | | | | | | | | | 0.59 | -5.51 | 0.26 | -2 |
| 18 | CES1 | 885 | -1.57 | 0.23 | -0.92 | -0.34 | -1.11 | 0.36 | -0.22 | -0.06 | -0.19 | -5.85 | -0.9 | -2.55 |
| 19 | CHRM3-AS2 | 634 | | | | | | | | | 0.93 | -6.18 | 0.7 | -1.59 |
| 20 | CLEC1B | 124, 725 | | | | | -0.57 | 0.28 | -1.35 | -0.9 | -0.6 | -6.36 | -1.39 | -3.05 |
| 21 | CLEC4D | 109, 702 | -0.76 | -0.66 | -2.75 | -1.94 | -1.80E+11 | -2.32E+10 | -5.26E+11 | -4.00E+11 | | | | |
| 22 | CLEC4E | 721 | | | | | | | | | -0.03 | -7.31 | -0.99 | -3.1 |
| 23 | CLIC2 | 512 | | | | | -0.5 | -0.3 | -2.26 | -1.77 | | | | |
| 24 | CLU | 1382 | | | | | | | | | -0.42 | -7.8 | -1.09 | -3.33 |
| 25 | CMTM2 | 889 | | | | | -2.15E+07 | -7.20E+06 | 3.37E+07 | 2.39E+07 | -1.30E+11 | 1.57E+15 | -3.65E+11 | 5.23E+14 |
| 26 | COX7B | 1431 | | | | | | | | | -0.16 | -6.26 | -1.75 | -3.25 |
| 27 | CR1 | 24, 599 | | | | | -0.8 | 0.55 | -0.37 | -0.12 | -0.11 | -6.81 | -0.81 | -2.81 |
| 28 | CSNK1A1L | 753 | -0.98 | 1.29 | -0.79 | 0.25 | | | | | 0.1 | -6.19 | -0.63 | -2.48 |
| 29 | CST7 | 290 | -1.12E+12 | -6.81E+11 | -4.26E+12 | -2.83E+12 | -0.29 | 1.42 | -0.12 | 0.26 | -0.62 | 0.23 | -0.52 | -0.27 |
| 30 | DSC2 | 962 | -1.17 | 0.84 | -0.43 | 0.2 | -0.6 | 0.36 | 0.2 | 0.24 | 0.14 | -6.62 | -0.43 | -2.49 |
| 31 | DYSF | 1024 | | | | | | | | | 0.76 | -6.85 | -0.89 | -2.89 |
| 32 | EGF | 351 | | | | | | | | | 0.21 | -9.28 | -1.27 | -3.94 |
| 33 | EIF4B | 132 | | | | | -0.18 | 0.27 | -0.2 | -0.08 | | | | |
| 34 | F5 | 45, 624 | -1.25 | 0.6 | -0.58 | 0.01 | -0.88 | 0.1 | -0.53 | -0.36 | -0.2 | -6.44 | -0.97 | -2.79 |
| 35 | F8A1 | 1437 | -0.75 | 1.04 | -0.2 | 0.42 | | | | | 0.65 | -6.12 | 0.08 | -1.99 |
| 36 | FAM83A | 459 | | | | | -1.57E+10 | -1.15E+10 | -7.10E+10 | -5.51E+10 | | | | |
| 37 | FLJ45950 | 106 | | | | | | | | | | | | |
| 38 | GCNT4 | 1228 | | | | | | | | | 1.24 | -6.13 | 0.73 | -1.56 |
| 39 | GPR162 | 701 | | | | | | | | | 0.81 | -5.94 | -0.06 | -2.02 |
| 40 | GRIK1-AS2 | 1096 | | | | | | | | | | | | |
| 41 | GYG1 | 314 | | | | | -0.8 | 0.15 | -0.8 | -0.54 | -0.23 | -6.94 | -0.91 | -2.92 |

Fig. 10F

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Anorm | Anu | Aslow | Anotnorm | Anorm | Anu | Aslow | Anotnorm | Anorm | Anu | Aslow | Anotnorm |
| 42 | GZMH | 814 | | | | | | | | | 1.3 | -5.36 | 0.93 | -1.18 |
| 43 | H1F0 | 299 | | | | | | | | | | | | |
| 44 | HBQ1 | 867 | | | | | | | | | -0.77 | -8.02 | -0.97 | -3.32 |
| 45 | HIST1H2BG | 1281 | -0.7 | 0.67 | -0.36 | 0.15 | | | | | 0.78 | -6.25 | -0.6 | -2.48 |
| 46 | HIST1H3J | 1283 | | | | | | | | | 0.36 | -6.47 | 0.04 | -2.13 |
| 47 | HLA-DRB1 | 1286 | -3.30E+11 | 1.87E+11 | 1.11E+12 | 7.41E+11 | | | | | 0.99 | -7.18 | 0.36 | -2.15 |
| 48 | HMBS | 89, 577 | | | | | -0.13 | -0.17 | -1.56 | -1.22 | | | | |
| 49 | let-7a-5p | 516 | | | | | | | | | 0.96 | -7.46 | 0.79 | -1.96 |
| 50 | let-7d-3p | 1489 | | | | | | | | | 2.25 | -7.43 | 0.48 | -2.16 |
| 51 | let-7e-5p | 517 | -1.83E+12 | 8.14E+12 | 2.50E+12 | 4.76E+12 | | | | | 1.23 | -7.68 | 0.74 | -2.06 |
| 52 | let-7f-5p | 518 | | | | | | | | | | | | |
| 53 | miR-100-5p | 1830 | | | | | | | | | 1.01 | -5.9 | 0.96 | -1.33 |
| 54 | miR-106a-5p | 519 | | | | | | | | | | | | |
| 55 | miR-122-5p | 1831 | 1510 | 43.7 | -29100 | -17400 | | | | | | | | |
| 56 | miR-1228-5p | 520 | | | | | | | | | | | | |
| 57 | miR-1247-3p | 1499 | | | | | -35.8 | 261 | 0 | 85.3 | | | | |
| 58 | miR-1255b-5p | 522 | 0.09 | -0.34 | 3.36 | 1.88 | 0.11 | 1.39 | 2.05 | 1.83 | | | | |
| 59 | miR-125b-5p | 1500 | | | | | | | | | 1.45 | -6.27 | 0.71 | -1.51 |
| 60 | miR-126-3p | 1501 | | | | | | | | | 0.53 | -8.06 | 0.21 | -2.55 |
| 61 | miR-1270 | 523 | 2.29 | 17.9 | 10.18 | 13.3 | | | | | -0.72 | 5.65 | 4.13 | 4.54 |
| 62 | miR-1303 | 1508 | | | | | | | | | | | | |
| 63 | miR-134-5p | 1512 | | | | | 6.61E+07 | 6.01E+08 | 4.32E+07 | 1.83E+08 | 2.85 | -7.84 | 0.91 | -2.01 |
| 64 | miR-143-3p | 1513 | | | | | | | | | | | | |
| 65 | miR-144-5p | 1514 | | | | | | | | | 2.25 | -6.57 | 1.03 | -1.51 |
| 66 | miR-146a-5p | 1832 | -3.12E+10 | 5.92E+12 | 1.26E+12 | 3.12E+12 | | | | | 0.96 | -2.72 | 0.06 | -0.86 |
| 67 | miR-146b-5p | 1515 | -6.15E+11 | 2.55E+12 | 7.56E+11 | 1.48E+12 | | | | | 0.55 | -7.98 | -0.51 | -3 |
| 68 | miR-148a-3p | 1833 | -1.54E+11 | 8.57E+11 | 3.30E+11 | 5.41E+11 | | | | | 0.99 | -7.1 | -0.29 | -2.56 |
| 69 | miR-151a-3p | 525 | 0.21 | -0.19 | 2.89 | 1.66 | | | | | | | | |
| 70 | miR-154-5p | 1517 | 5.40E+07 | -1.18E+10 | 1.87E+08 | -4.62E+09 | -340 | -143 | 2810 | 2070 | | | | |
| 71 | miR-155-5p | 526 | | | | | | | | | 2.08 | -6.69 | 0.53 | -1.88 |
| 72 | miR-17-5p | 527 | | | | | | | | | | | | |
| 73 | miR-182-3p | 528 | | | | | -109 | 10300 | -893 | 1910 | | | | |
| 74 | miR-18a-5p | 529 | | | | | | | | | | | | |
| 75 | miR-196a-5p | 1522 | | | | | | | | | 2.02 | -4.74 | 1 | -0.91 |
| 76 | miR-196b-5p | 1523 | | | | | | | | | 1.22 | -5.9 | 0.51 | -1.53 |
| 77 | miR-1973 | 1524 | | | | | | | | | 2.94 | -3.92 | -0.16 | -1.41 |
| 78 | miR-1976 | 1526 | | | | | | | | | 2.41 | -6.66 | 1.01 | -1.55 |
| 79 | miR-199a-5p | 531 | 0.73 | 10.32 | 7.43 | 8.59 | | | | | -3.08 | 4.84 | 2.01 | 2.95 |
| 80 | miR-19b-3p | 1527 | -4.67E+13 | 1.04E+14 | -3.28E+11 | 4.14E+13 | | | | | 0.52 | -8.97 | -0.27 | -3.17 |
| 81 | miR-202-3p | 1528 | | | | | | | | | | | | |
| 82 | miR-20a-5p | 1529 | | | | | | | | | 0.33 | -8.33 | 0.09 | -2.71 |
| 83 | miR-21-5p | 1834 | -4.59E+11 | 2.39E+12 | 7.51E+11 | 1.41E+12 | | | | | 0.98 | -7.18 | 0 | -2.39 |

Fig. 10G

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Anorm | Anu | Aslow | Anotnorm | Anorm | Anu | Aslow | Anotnorm | Anorm | Anu | Aslow | Anotnorm |
| 84 | miR-221-3p | 533 | 0.87 | 2.89 | 8.83 | 6.45 | | | | | | | | |
| 85 | miR-223-3p | 534 | | | | | | | | | 0.77 | -9.42 | -0.1 | -3.21 |
| 86 | miR-23a-3p | 535 | 253000 | -845000 | 2.11E+06 | 925000 | | | | | | | | |
| 87 | miR-24-3p | 1835 | -5.93E+12 | 1.67E+13 | 2.96E+12 | 8.44E+12 | | | | | 0.43 | -8.53 | -0.55 | -3.21 |
| 88 | miR-25-3p | 1836 | -3.89E+12 | 1.49E+13 | 7.97E+12 | 1.07E+13 | | | | | 0.86 | -8.31 | 0.15 | -2.67 |
| 89 | miR-25-5p | 1531 | | | | | 1.70E+06 | 352000 | 1.19E+06 | 8.92E+07 | | | | |
| 90 | miR-27a-3p | 539, 540 | 0.56 | 2.55 | 8.46 | 6.09 | | | | | | | | |
| 91 | miR-27b-3p | 541 | 1.37 | 2.14 | 8.16 | 5.75 | | | | | | | | |
| 92 | miR-29a-3p | 542 | -6.11E+11 | 1.49E+12 | -9.20E+10 | 5.24E+11 | | | | | 0.64 | -7.95 | -0.71 | -3.13 |
| 93 | miR-29b-3p | 1534 | -82100 | 259000 | 162000 | 201000 | | | | | | | | |
| 94 | miR-29c-3p | 1535 | | | | | | | | | 0.32 | -7.77 | -0.55 | -2.96 |
| 95 | miR-29c-5p | 1536 | | | | | | | | | 0.79 | -6.06 | -0.06 | -2.06 |
| 96 | miR-3117-3p | 1539 | 0.28 | -2.54 | -4.88 | -3.71 | | | | | | | | |
| 98 | miR-31-3p | 1837 | | | | | | | | | | | | |
| 99 | miR-3156-5p | 1542 | | | | | | | | | | | | |
| 97 | miR-31-5p | 1543 | | | | | | | | | | | | |
| 100 | miR-3176 | 1544 | | | | | | | | | | | | |
| 101 | miR-323a-3p | 1546 | 6.53E+09 | 1.98E+11 | 1.19E+10 | 8.64E+10 | | | | | 541000 | -2.33E+06 | -310000 | -984000 |
| 102 | miR-323b-3p | 1547 | 1.51 | -8.96 | 4.07 | -2.45 | | | | | 1.24 | -6.22 | 3.53 | 0.28 |
| 103 | miR-329-3p | 1548 | | | | | | | | | 1.48E+09 | -7.34E+09 | 1.26E+08 | -2.36E+09 |
| 104 | miR-335-5p | 543 | | | | | | | | | | | | |
| 105 | miR-3613-3p | 1551 | 1.72E+08 | -1.41E+10 | 2.07E+08 | -5.53E+09 | 7.78E+07 | -1.68E+08 | 9.19E+06 | 6.47E+08 | 5.68 | -5.31 | 5.88 | 2.15 |
| 106 | miR-3613-5p | 1552 | | | | | 0.39 | 12.48 | -0.11 | 3.32 | | | | |
| 107 | miR-3687-5p | 1555 | | | | | | | | | 0.67 | -7.48 | 0.28 | -2.3 |
| 108 | miR-374b-5p | 1561 | | | | | | | | | 0.46 | -6.81 | 0.22 | -2.13 |
| 109 | miR-376a-3p | 1562 | | | | | -253000 | -1.19E+06 | -463000 | -644000 | | | | |
| 110 | miR-379-5p | 1565 | -3.01 | -0.46 | 9.47 | 4.5 | -6.42E+08 | 9.80E+09 | 2.65E+08 | 2.65E+08 | 5.73E+09 | -7.33E+10 | -1.28E+09 | -2.53E+10 |
| 111 | miR-4284 | 1575 | | | | | 1.54 | -1.59 | -0.29 | -0.65 | 1.66 | -1.77 | 0.08 | -0.54 |
| 112 | miR-431-5p | 1576 | | | | | 6.59E+08 | -7.04E+09 | -1.17E+09 | -2.64E+09 | -2.06 | -17.5 | -10.87 | -13.2 |
| 113 | miR-4435 | 1579 | | | | | | | | | 1.82 | -5.57 | 2.29 | -0.33 |
| 114 | miR-4485 | 1582 | | | | | | | | | 4.28 | -0.73 | 1.25 | 0.59 |
| 115 | miR-4525 | 1584 | 0 | 0 | 0.33 | 0.2 | | | | | | | | |
| 116 | miR-4668-5p | 1585 | -688000 | 0 | -6.68E+06 | -4.01E+06 | | | | | | | | |
| 117 | miR-4797-5p | 1598 | | | | | | | | | | | | |
| 118 | miR-485-3p | 1599 | 343000 | 7.82E+06 | 302000 | 3.31E+06 | | | | | 2.52 | -6.33 | 1.43 | -1.16 |
| 119 | miR-487a-3p | 1600 | | | | | | | | | 4.87 | -11.50 | 2.18 | -2.57 |
| 120 | miR-4876-3p | 1601 | | | | | 18800 | -201000 | -94400 | -146000 | | | | |
| 121 | miR-495-3p | 1605 | 4.08E+09 | 4.24E+10 | 6.21E+09 | 2.07E+10 | | | | | 158000 | -1.17E+06 | -587000 | -782000 |
| 122 | miR-504-5p | 548 | | | | | | | | | -3.02 | 4.76 | 1.38 | 2.51 |
| 123 | miR-505-3p | 1507 | | | | | 106000 | -358000 | 496000 | 283000 | 6.4 | -10.78 | -0.07 | -3.64 |
| 124 | miR-5195-3p | 1508 | -0.75 | 2.2 | -0.28 | 0.96 | | | | | | | | |
| 125 | miR-543 | 1609 | | | | | | | | | 1.79 | -7 | 0.72 | -1.86 |

Fig. 10H

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Alnorm | Alnu | Alslow | Alnotnorm | Alnorm | Alnu | Alslow | Alnotnorm | Alnorm | Alnu | Alslow | Alnotnorm |
| 126 | miR-548aa | 1810 | -3.24E+11 | 2.97E+12 | 1.20E+11 | 1.26E+12 | | | | | 0.71 | -7.73 | 0.33 | -2.35 |
| 127 | miR-551a | 549 | -3.72E+08 | 9.10E+08 | -1.84E+08 | 2.53E+08 | | | | | -6.36 | 3.55 | -0.07 | 1.14 |
| 128 | miR-584-5p | 550 | 1.51 | 2.01 | 8.2 | 5.73 | | | | | | | | |
| 129 | miR-589-5p | 551 | 0.84 | 1.84 | 6.72 | 4.77 | | | | | 0.05 | -2.59 | -0.15 | -0.97 |
| 130 | miR-664-3p | 1627 | -3.09E+08 | -2.51E+11 | 6.17E+09 | -9.67E+10 | 8320 | -209000 | -21300 | -68300 | -2650 | -223000 | -135000 | -164000 |
| 131 | miR-664a-5p | 552 | 1.3 | 9.38 | 6.52 | 7.67 | | | | | | | | |
| 132 | miR-6726-3p | 1628 | -1.11E+10 | -4.09E+11 | 1.09E+10 | -1.59E+11 | 200000 | -678000 | 465000 | 172000 | 6.50E+10 | -2.01E+11 | 2.56E+10 | -4.98E+10 |
| 133 | miR-6770-5p | 1637 | | | | | 2390 | 10200 | 35300 | 29000 | | | | |
| 134 | miR-6777-3p | 1640 | | | | | | | | | 2.73 | -2 | 1.87 | 0.58 |
| 135 | miR-6818-5p | 1643 | -6.45E+08 | -3.78E+10 | 2.16E+08 | -1.50E+10 | | | | | 4.00E+08 | -1.97E+10 | 1.68E+09 | -5.45E+09 |
| 136 | miR-6820-3p | 1645 | | | | | | | | | 2.1 | -5.24 | 1.31 | -0.87 |
| 137 | miR-6840-3p | 1648 | -1.13E+13 | 4.31E+13 | 9.05E+12 | 2.27E+13 | | | | | | | | |
| 138 | miR-6855-3p | 1649 | | | | | | | | | 2.44 | -5.04 | 0.94 | -1.06 |
| 139 | miR-6879-3p | 1652 | | | | | | | | | 3.76 | -6.47 | 1.87 | -0.91 |
| 140 | miR-7-5p | 553, 1656 | | | | | | | | | 2.19 | -6.58 | 0.73 | -1.37 |
| 141 | miR-7641 | 1657 | 6.93E+10 | 1.53E+11 | -8.04E+11 | -4.21E+11 | | | | | 0.8 | -7.99 | -1.77 | -3.84 |
| 142 | miR-7975 | 1662 | | | | | -1.10E+12 | -6.88E+12 | -2.57E+12 | -4.15E+12 | -0.58 | -6.93 | -0.91 | -2.92 |
| 143 | miR-93-5p | 556 | -0.15 | 1.06 | 3.51 | 2.53 | | | | | | | | |
| 144 | miR-98-5p | 1665 | -3.1 | -0.84 | 5.65 | 2.4 | | | | | | | | |
| 145 | HSPA9 | 400 | -0.08 | -0.54 | -0.83 | -0.72 | | | | | | | | |
| 146 | HSPD1 | 283 | | | | | | | | | | | | |
| 147 | IFI44 | 573 | | | | | -0.21 | 1.82 | 0.21 | 0.85 | 0.58 | -6.13 | -0.18 | -2.16 |
| 148 | IFI44L | 572 | | | | | -0.19 | 1.64 | 0.53 | 0.83 | 0.61 | -7.11 | 0.18 | -2.25 |
| 149 | IFI6 | 609 | | | | | -0.15 | 1.05 | 0.52 | 0.67 | 0.56 | -8.09 | 0.17 | -2.59 |
| 150 | IFIT1 | 655 | | | | | -0.21 | 1.82 | 0.46 | 0.83 | 0.41 | -7.33 | -0.15 | -2.55 |
| 151 | IFIT1B | 64, 554 | | | | | -0.52 | 0.07 | -2.26 | -1.68 | | | | |
| 152 | IFIT2 | 652 | | | | | -0.27 | 1.56 | 0.39 | 0.71 | 0.36 | -6.46 | -0.24 | -2.31 |
| 153 | IFIT3 | 653 | | | | | -0.26 | 1.81 | 0.59 | 1 | 0.4 | -7.13 | -0.24 | -2.54 |
| 154 | IFIT5 | 655 | | | | | -0.3 | 1 | 0.19 | 0.41 | 0.43 | -6.05 | -0.35 | -2.25 |
| 155 | IFITM3 | 682 | | | | | | | | | | | | |
| 156 | IFNA16 | 1406 | | | | | -0.04 | 0.11 | 5.84 | 4.28 | | | | |
| 157 | IGHA1 | 824 | | | | | 0.3 | -0.23 | -1.03 | -0.81 | 0.15 | -7.13 | -1.1 | -3.11 |
| 158 | IGKC | 1073, 1071, 1070, 1069, 1068, 1063, 1035, 1032, 1027, 1058, 1030 | | | | | | | | | 1.32 | -0.26 | -10.11 | -6.83 |
| 159 | IGLC1 | 1109, 1110, 1111, 1114, 1115 | | | | | | | | | 1.31 | -5.01 | 0.13 | -1.59 |
| 160 | IL2RB | 2 | | | | | | | | | | | | |
| 161 | IL5RA | 1151 | | | | | | | | | 1.48 | -6.11 | 0.41 | -1.76 |
| 162 | IRF8 | 194 | | | | | -3.14 | 17.6 | -0.03 | 4.38 | | | | |
| 163 | ITGA2B | 219, 938 | | | | | | | | | -0.84 | -7.4 | -1.48 | -3.45 |

Fig. 10I

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Anorm | Alnu | Aslow | Alnotnorm | Anorm | Alnu | Aslow | Alnotnorm | Anorm | Alnu | Aslow | Alnotnorm |
| 164 | ITGB3 | 918 | | | | | | | | | -0.39 | -7.51 | -1.19 | -3.3 |
| 165 | KCNJ15 | 1100 | -1.15 | 1.15 | -0.72 | 0.21 | -0.63 | 0.47 | -0.14 | 0.03 | -0.15 | -5.66 | -0.89 | -2.81 |
| 166 | KIF13A | 1279 | -0.5 | 1.32 | -0.27 | 0.52 | -0.49 | 0.37 | -0.28 | -0.1 | 0.19 | -6.01 | -0.67 | -2.45 |
| 167 | KIF1B | 562 | -0.99 | 0.92 | -0.71 | 0.1 | -0.61 | 0.57 | -0.35 | -0.1 | 0.11 | -6.06 | -0.75 | -2.52 |
| 168 | KLK12 | 1004 | | | | | | | | | | | | |
| 169 | LDHB | 126 | | | | | | | | | | | | |
| 170 | LEF1 | 1201 | | | | | | | | | 1.18 | -5.66 | 0.63 | -1.8 |
| 171 | LGALS2 | 1126 | | | | | | | | | 0.28 | -6.54 | -0.41 | -2.45 |
| 172 | LOC440200 | 850 | | | | | 5.54E+09 | 7.68E+09 | 3.57E+07 | 2.87E+07 | | | | |
| 173 | LOC646214 | 859 | | | | | | | | | | | | |
| 174 | MAN8C1 | 729 | -0.85 | 1.1 | -0.94 | 0.08 | | | | | 1.27 | 1.3 | -0.9 | 3.72 |
| 175 | MFSD9 | 1075 | -9.93E+09 | -2.33E+09 | 1.08E+10 | 5.52E+09 | | | | | 0.3 | -6.24 | -0.41 | -2.35 |
| 176 | pre-miR29a | 449 | | | | | | | | | | | | |
| 177 | MMP9 | 1087 | -1.5 | 0.82 | -0.84 | -0.01 | | | | | -0.62 | -6.83 | -2.01 | -3.62 |
| 178 | MT1E | 189 | -0.58 | -2.26 | 8.53 | 4.21 | -0.08 | -0.05 | 3.92 | 2.92 | | | | |
| 179 | MT1X | 191 | | | | | | | | | | | | |
| 180 | MXD3 | 270 | -3.79E+11 | -2.51E+11 | -1.54E+12 | -1.02E+12 | -0.43 | 0.29 | -0.36 | -0.2 | | | | |
| 181 | MYL4 | 917 | | | | | -0.3 | -0.51 | -1.42 | -1.17 | -0.7 | -7.67 | -1.22 | -3.37 |
| 182 | NDUFA2 | 401 | -1.59E+11 | -2.13E+11 | -1.43E+12 | -9.45E+11 | -1.37E+11 | -2.01E+11 | -8.88E+11 | -7.16E+11 | -2.63E+11 | -1.94E+11 | -8.19E+11 | -6.10E+11 |
| 183 | NFATC1 | 961 | -0.14 | 0.11 | 0.21 | 0.16 | | | | | 0.99 | -6.04 | 0.35 | -1.78 |
| 184 | NFATC2 | 4 | | | | | | | | | | | | |
| 185 | NLRC4 | 1054 | | | | | -0.8 | 0.34 | -0.59 | -0.34 | -0.11 | -6.76 | -0.92 | -2.87 |
| 186 | NOTCH3 | 996 | | | | | | | | | | | | |
| 187 | OMG | 931 | -0.77 | 1.05 | -0.46 | 0.3 | | | | | 0.4 | -5.73 | -0.15 | -2.01 |
| 188 | PAQR4 | 5, 563 | -0.8 | 0.92 | -0.45 | 0.24 | | | | | -0.14 | -7.33 | -1.39 | -3.37 |
| 189 | PDIA3P | 582 | | | | | -7.49E+09 | 2.39E+11 | 8.47E+10 | 1.23E+11 | 1.25 | -6.59 | 0.16 | -1.75 |
| 190 | PECAM1 | 1838 | | | | | | | | | | | | |
| 191 | PET100 | 968 | -0.92 | 0.54 | 0.15 | 0.34 | | | | | 0.12 | -6.33 | -0.82 | -2.65 |
| 192 | PI3 | 1085 | | | | | | | | | 0.28 | -6.87 | -0.1 | -2.36 |
| 193 | PPOPF | 291 | | | | | | | | | | | | |
| 194 | PRKXP1 | 864 | | | | | | | | | 1.07 | -5.69 | 0.7 | -1.43 |
| 195 | PROS1 | 1154 | | | | | | | | | -0.04 | -7.12 | -1.57 | -3.42 |
| 196 | PYGL | 164, 819 | | | | | -0.68 | 0.42 | -0.5 | -0.25 | -0.12 | -7.07 | -0.92 | -2.97 |
| 197 | RAB39A | 675 | -2.11E+09 | -3.62E+08 | 3.87E+08 | 3.77E+07 | -1.94E+09 | -3.73E+07 | 5.98E+08 | 4.39E+08 | 0.76 | -5.43 | -0.61 | -2.22 |
| 198 | RAD23A | 239 | | | | | 0.06 | 0.31 | -0.88 | -0.58 | | | | |
| 199 | RBBP8 | 954 | | | | | | | | | 0.11 | -6.85 | -0.67 | -2.73 |
| 200 | ROPN1L | 371 | | | | | -1.31E+11 | 6.34E+10 | -1.78E+11 | -1.17E+11 | | | | |
| 201 | RPS15 | 279 | | | | | | | | | | | | |
| 202 | RPS27 | 347 | 1.01E+10 | -7.10E+12 | -2.31E+13 | -1.57E+13 | -1.40E+12 | -4.69E+12 | -1.28E+13 | -1.08E+13 | | | | |
| 203 | RUNDC3A | 915 | | | | | | | | | -0.49 | -7.73 | -0.61 | -2.98 |
| 204 | S100A12 | 5, 618 | -1.39 | -0.69 | -3.52 | -2.38 | -1.13E+12 | -7.36E+11 | -4.55E+12 | -3.60E+12 | | | | |
| 205 | S100P | 344 | | | | | | | | | | | | |

Fig. 10J

| Fig. 9 row | RNA | SEQ ID | log2 B/A | | | | log2 C/A | | | | log2 D/A | | | |
|---|---|---|---|---|---|---|---|---|---|---|---|---|---|---|
| | | | Alnorm | Alnu | Alslow | Alnotnorm | Alnorm | Alnu | Alslow | Alnotnorm | Alnorm | Alnu | Alslow | Alnotnorm |
| 206 | SELP | 625 | | | | | | | | | -0.74 | -19.57 | -0.97 | -7.17 |
| 207 | SMAD4 | 958 | | | | | | | | | 0.54 | -6.73 | -0.27 | -2.43 |
| 208 | SMN1 | 1215 | -5.95E+09 | -6.32E+09 | 4.26E+10 | 2.30E+10 | 0.04 | -0.4 | 0 | -0.11 | 0.79 | -6.56 | 0.16 | -2.08 |
| 209 | SNORA14A | 1318 | -2.86E+08 | -9.02E+09 | 9.57E+10 | 5.38E+10 | | | | | 0.61 | -6.39 | 0.08 | -2.08 |
| 210 | SNORD13 | 228 | | | | | | | | | | | | |
| 211 | SNORD14E | 104 | | | | | | | | | | | | |
| 212 | SNORD25 | 6, 99 | | | | | | | | | | | | |
| 213 | SNORD4B | 914 | | | | | | | | | -0.4 | -7.83 | 0.25 | -2.45 |
| 214 | SNORD59B | 134 | 7.97E+10 | -4.49E+11 | -5.49E+13 | -2.31E+13 | 0.56 | -0.01 | -0.87 | -0.65 | | | | |
| 215 | SPTA1 | 620 | | | | | -2.13E+10 | -4.78E+10 | -1.06E+11 | -3.12E+10 | -6.14E+10 | 2.29E+14 | -1.06E+11 | 7.64E+12 |
| 216 | THBS1 | 844 | -0.78 | 1.25 | 0.83 | 1.04 | | | | | 0.9 | -6.84 | -0.79 | -2.8 |
| 217 | TLR5 | 53 | | | | | -0.79 | 1.29 | -0.36 | 0.06 | | | | |
| 218 | TMEM158 | 1153 | -3.99E+09 | -8.30E+07 | -1.67E+11 | -1.01E+11 | -1.76E+10 | 9.74E+09 | -1.35E+11 | -9.90E+10 | 1.2 | -5.74 | -1.49 | -2.91 |
| 219 | TMEM175A | 1337 | | | | | -9.29E+10 | 3.08E+09 | -1.08E+10 | -7.33E+09 | 1.18 | -8.72 | -0.4 | -3.17 |
| 220 | TMEM175B | 1363 | | | | | | | | | | | | |
| 221 | TNFRSF9 | 602 | | | | | | | | | 0.47 | -5.93 | -0.25 | -2.14 |
| 222 | TREML1 | 1288 | | | | | -6.27E+10 | 8.15E+09 | -2.24E+11 | -1.66E+11 | | | | |
| 223 | TRNN | 7, 20, 497 | -5.16E+12 | -2.01E+12 | -7.75E+13 | -4.73E+13 | | | | | | | | |
| 224 | TSTA3 | 471 | -7.01E+11 | -1.98E+12 | -8.75E+12 | -6.03E+12 | -3.35E+08 | -9.05E+07 | -9.43E+08 | -7.30E+08 | -3.47E+12 | -2.16E+12 | -1.06E+13 | -7.76E+12 |
| 225 | TUBB2A | 1244, 1245, 1277 | -0.7 | 1.05 | -0.51 | 0.27 | | | | | | | | |
| 226 | U38B | 1677 | | | | | | | | | 1.87 | -5.93 | -0.28 | -2.15 |
| 227 | USP32P1 | 912 | | | | | | | | | 0.76 | -6.32 | -0.43 | -2.4 |
| 228 | YME1L1 | 765, 771, 768, 769, 764, 760, 762, 766, 770, 777, 781, 785, 794, 789, 791 | -6.99E+10 | -1.70E+10 | 1.19E+11 | 6.44E+10 | | | | | 0.46 | -6.9 | -0.25 | -2.47 |

Fig. 10K

| Fig. 9 row | RNA | SEQ ID | log2 C/B ||||log2 D/B ||||log2 D/C ||||
|---|---|---|---|---|---|---|---|---|---|---|---|---|---|---|
| | | | Alnorm | Alnu | Alslow | Alnotnorm | Alnorm | Alnu | Alslow | Alnotnorm | Alnorm | Alnu | Alslow | Alnotnorm |
| 1 | A2M | 722 | | | | | -0.26 | -10.58 | -0.37 | -7.17 | 0.76 | -5.82 | -1.1 | -2.87 |
| 2 | A2M-AS1 | 703 | | | | | 0.19 | -9.82 | 0.71 | -6.31 | 0.62 | -5.08 | 0.16 | -1.81 |
| 3 | A2MP1 | 724 | | | | | | | | | | | | |
| 4 | ADGRE1 | 966 | | | | | 0.06 | -14.5 | 0.49 | -9.5 | 0.57 | -9.03 | -0.75 | -3.85 |
| 5 | AIF1 | 1, 408, 513, 515 | | | | | | | | | | | | |
| 6 | ANKRD22 | 75 | | | | | | | | | 0.56 | -0.88 | -2.06 | -1.62 |
| 7 | ANKRD36B | 1074 | | | | | 0.57 | -14.17 | 0.85 | -9.16 | 0.7 | -8.16 | 0.24 | -2.91 |
| 8 | ANPEP | 862 | | | | | 0.3 | -15.82 | 0.12 | -10.5 | 0.64 | -9.66 | -1.01 | -4.28 |
| 9 | ANXA3 | 348 | | | | | | | | | | | | |
| 10 | ARG1 | 413 | | | | | | | | | | | | |
| 11 | ARPP19 | 388 | | | | | 0.33 | 1.06 | -2.86 | -0.25 | | | | |
| 12 | ATG9A | 1080 | | | | | 0.01 | -15.54 | 0.35 | -10.25 | 0.46 | -8.97 | -0.46 | -3.65 |
| 13 | C4BPA | 598 | | | | | -0.12 | -11.59 | 0.44 | -7.58 | 0.51 | -6.72 | -1.23 | -3.29 |
| 14 | CASP5 | 103, 698 | | | | | 0.47 | -12.33 | 0.38 | -8.09 | 0.56 | -8.62 | -0.77 | -3.71 |
| 15 | CCDC144A | 910, 911 | | | | | | | | | 1.63 | 0 | -9.09 | -5.68 |
| 16 | CCR7 | 934 | | | | | 0.37 | -14.61 | 0.56 | -9.55 | 0.67 | -8.91 | -0.02 | -3.36 |
| 17 | CD27 | 700 | | | | | 0.08 | -14.07 | 0.32 | -9.27 | 0.08 | -8 | -0.05 | -3.03 |
| 18 | CE81 | 885 | | | | | 0.11 | -12.59 | 0.33 | -8.28 | 0.99 | -8.25 | -1.37 | -3.95 |
| 19 | CHRM3-AS2 | 634 | | | | | 0.57 | -13.86 | 0.52 | -9.07 | 0.56 | -7.79 | 0.26 | -2.76 |
| 20 | CLEC1B | 124, 725 | | | | | -0.08 | -13.54 | -0.16 | -9.14 | 0.07 | -8.51 | -0.87 | -3.74 |
| 21 | CLEC4D | 109, 702 | | | | | | | | | | | | |
| 22 | CLEC4E | 721 | | | | | -0.08 | -15.1 | 0.38 | -9.94 | 0.45 | -9.49 | -0.91 | -4.13 |
| 23 | CLIC2 | 512 | | | | | | | | | | | | |
| 24 | CLU | 1382 | | | | | 0.14 | -15.91 | -0.03 | -11.29 | 0.23 | -10.57 | -0.98 | -4.58 |
| 25 | CMTM2 | 868 | -7.15E+06 | -6.48E+06 | 3.32E+07 | 2.33E+07 | -1.97E+11 | 3.14E+15 | -2.27E+11 | 2.06E+15 | -6.82E+10 | 2.06E+15 | -9.02E+10 | 7.85E+14 |
| 26 | COX7B | 1431 | | | | | -0.52 | -11.05 | 0.19 | -7.3 | 0.63 | -7.39 | -1.06 | -3.44 |
| 27 | CR1 | 24, 599 | | | | | 0.16 | -15.16 | 0.33 | -9.99 | 0.53 | -9.54 | -1.23 | -4.35 |
| 28 | CSNK1A1L | 753 | | | | | 0.57 | -14.24 | 0.78 | -9.23 | 0.38 | -8.43 | -0.39 | -3.41 |
| 29 | CST7 | 298 | | | | | -0.12 | 1.42 | -1.37 | 0.48 | | | | |
| 30 | DSC2 | 962 | | | | | 0.3 | -14.52 | 0.61 | -9.48 | 0.56 | -9.08 | -1.16 | -4.13 |
| 31 | DYSF | 1024 | | | | | 0.1 | -15.09 | 0.41 | -9.92 | 0.7 | -9.24 | -1.09 | -4.15 |
| 32 | EGF | 351 | -0.7 | -0.99 | 0.81 | 0.44 | -0.07 | -14.2 | -0.16 | -9.52 | 0.34 | -8.62 | -1.16 | -2.97 |
| 33 | EIF4B | 132 | | | | | | | | | | | | |
| 34 | F5 | 46, 624 | | | | | 0.33 | -13.94 | 0.25 | -9.21 | 0.47 | -8.53 | -1.14 | -3.91 |
| 35 | F8A1 | 1427 | | | | | 0.77 | -14.36 | -0.09 | -9.6 | 0.74 | -8.78 | -0.42 | -3.56 |
| 36 | FAM83A | 459 | 0 | -1.51 | -8.25 | -6.57 | | | | | -1.70E+09 | -8.47E+08 | 5.29E+09 | 2.99E+09 |
| 37 | FLJ45950 | 106 | | | | | 0.88 | 1.91 | -5.92 | -0.7 | | | | |
| 38 | GCNT4 | 1228 | | | | | 0.47 | -13.49 | 0.37 | -8.87 | 0.61 | -8.05 | -0.15 | -3.11 |
| 39 | GPR162 | 701 | | | | | 0.4 | -13.16 | 0.71 | -8.53 | 0.65 | -7.92 | -0.36 | -3.19 |
| 40 | GRIK1-AS2 | 1098 | -177 | 0 | 1520 | 1140 | | | | | 2.50E+06 | 3.37E+06 | -4.98E+06 | -1.85E+06 |
| 41 | GYG1 | 314 | | | | | 0.07 | -14.91 | 0.28 | -9.85 | 0.59 | -9.13 | -0.68 | -3.85 |

Fig. 10L

| Fig. 9 row | RNA | SEQ ID | log2 C/B Anorm | log2 C/B Alnu | log2 C/B Alslow | log2 C/B Alnotnorm | log2 D/B Anorm | log2 D/B Alnu | log2 D/B Alslow | log2 D/B Alnotnorm | log2 D/C Anorm | log2 D/C Alnu | log2 D/C Alslow | log2 D/C Alnotnorm |
|---|---|---|---|---|---|---|---|---|---|---|---|---|---|---|
| 42 | GZMH | 814 | | | | | -0.44 | -11.66 | 0.03 | -7.77 | 1.23 | -6.96 | -0.13 | -2.72 |
| 43 | H1F0 | 299 | -2.04E+07 | -2.54E+08 | -1.11E+08 | -1.47E+08 | | | | | | | | |
| 44 | H6Q1 | 867 | | | | | -0.78 | -16.56 | -0.04 | -11.06 | -0.15 | -9.2 | -0.51 | -3.77 |
| 45 | HIST1H2BG | 1281 | -0.53 | -0.83 | 0.95 | 0.51 | 0.01 | -13.9 | -0.22 | -9.34 | 0.42 | -6.15 | -0.76 | -3.53 |
| 46 | HIST1H3I | 1283 | -0.18 | -1.27 | 1.55 | 0.92 | -0.08 | -12.49 | 0.04 | -8.21 | 0.36 | -7.76 | -0.13 | -2.99 |
| 47 | HLA-DRB1 | 1286 | | | | | 0.13 | -15.91 | 0.45 | -10.48 | 0.53 | -9.67 | -0.24 | -3.77 |
| 48 | HMBS | 89, 677 | | | | | | | | | | | | |
| 49 | let-7a-5p | 516 | | | | | -0.03 | -15.39 | 0.23 | -10.18 | -1.05 | -9.72 | -0.52 | -3.97 |
| 50 | let-7d-3p | 1499 | | | | | -1.15 | -13.37 | 1.1 | -6.55 | -0.01 | -14 | 0.28 | -5.08 |
| 51 | let-7e-5p | 517 | 2.16E+12 | -1.33E+13 | 3.76E+12 | -5.11E+11 | 0.1 | -18.46 | 0.62 | -10.77 | -0.9 | -10.31 | -0.5 | -4.18 |
| 52 | let-7f-5p | 518 | | | | | 1.07E+10 | -3.55E+10 | -2.24E+10 | -3.12E+10 | | | | |
| 53 | miR-100-5p | 1830 | | | | | 0.26 | -11.22 | 0.92 | -7.17 | -0.68 | -6.91 | 0.58 | -2.23 |
| 54 | miR-106a-5p | 519 | | | | | 0.94 | -6.14 | 2.09 | -3.39 | 0.65 | -2.93 | -0.22 | -1.24 |
| 55 | miR-122-5p | 1831 | | | | | | | | | | | | |
| 56 | miR-1228-5p | 520 | 8.02E+07 | 0 | -7.12E+08 | -5.34E+08 | -6.12E+08 | 8.52E+06 | 1.75E+09 | 5.89E+08 | | | | |
| 57 | miR-1247-3p | 1499 | | | | | | | | | -4.66 | -261.23 | 0 | -97.96 |
| 58 | miR-1255b-5p | 522 | | | | | 0.55 | -3.84 | 2.15 | -1.85 | | | | |
| 59 | miR-125b-5p | 1500 | | | | | -0.42 | -12.62 | 0.7 | -8.18 | -0.42 | -12.01 | 0.08 | -4.45 |
| 60 | miR-126-3p | 1501 | | | | | 0.53 | -16.99 | 0.87 | -11.04 | -0.2 | -10.76 | -0.3 | -4.22 |
| 61 | miR-1270 | 523 | | | | | 0.22 | -4.84 | 2.41 | -2.42 | -2.03E+09 | -8.41E+09 | 2.31E+10 | 1.13E+10 |
| 62 | miR-1303 | 1508 | 0.61 | 5.77 | 1.36 | 2.47 | | | | | -0.59 | -7.15 | 1.19 | -1.94 |
| 63 | miR-134-5p | 1512 | -4.21E+07 | 1.29E+09 | -1.14E+07 | 3.13E+08 | -1.23 | -12.41 | 2.2 | -7.54 | 0.02 | -10.6 | 2.29 | -2.53 |
| 64 | miR-143-3p | 1513 | | | | | 2.63 | -13.18 | -0.02 | -8.79 | 0.44 | -12.6 | -0.61 | -5.11 |
| 65 | miR-144-5p | 1514 | | | | | 1.56 | -14.95 | 0.9 | -9.67 | 0.13 | -10.41 | 0.02 | -3.89 |
| 66 | miR-146a-5p | 1832 | -4.00E+10 | -7.00E+12 | 6.57E+11 | -1.26E+12 | 0.27 | -5.61 | 1.05 | -3.39 | 0.14 | -3.77 | 0.29 | -1.23 |
| 67 | miR-146b-5p | 1515 | 2.15E+11 | -5.25E+12 | 4.08E+11 | -1.01E+12 | 0.05 | -15.72 | 0.41 | -10.34 | -0.66 | -9.45 | -0.13 | -3.66 |
| 68 | miR-148a-3p | 1833 | 5.51E+10 | -1.32E+12 | -1.35E+11 | -4.30E+11 | 0.05 | -14.99 | 0.49 | -9.83 | -0.61 | -12.13 | -0.43 | -5.19 |
| 69 | miR-151a-3p | 525 | | | | | 0.13 | -3.53 | 0.72 | -2.11 | | | | |
| 70 | miR-154-5p | 1517 | -0.39 | -29.36 | 8.17 | -1.21 | | | | | | | | |
| 71 | miR-155-5p | 526 | | | | | 1.54 | -12.91 | 1.03 | -8.27 | 1.03 | -8.27 | 1.13 | -2.39 |
| 72 | miR-17-5p | 527 | | | | | 0.88 | -6.04 | 1.92 | -3.38 | 0.64 | -2.95 | -0.31 | -1.3 |
| 73 | miR-182-3p | 528 | 2.00E+06 | 1.63E+08 | 6.14E+07 | 8.68E+07 | | | | | | | | |
| 74 | miR-18a-5p | 529 | | | | | 1.56 | -3.25 | -1.29 | -2.6 | | | | |
| 75 | miR-196a-5p | 1522 | -0.19 | 4.78 | -0.35 | 0.93 | 0.22 | -8.37 | 0.55 | -5.39 | 0.55 | -7.51 | 0.44 | -2.54 |
| 76 | miR-196b-5p | 1523 | | | | | 0.53 | -12.6 | 0.46 | -8.25 | -0.7 | -8.15 | -0.24 | -3.21 |
| 77 | miR-1973 | 1524 | | | | | | | | | | | | |
| 78 | miR-1976 | 1526 | | | | | -0.03 | -13.75 | 0.99 | -8.84 | 0.08 | -14.63 | 0.37 | -5.26 |
| 79 | miR-199a-5p | 531 | | | | | 0.71 | -5.5 | 0.93 | -3.34 | | | | |
| 80 | miR-19b-3p | 1527 | 8.75E+12 | -1.62E+14 | 2.67E+13 | -2.06E+13 | 0.53 | -18.1 | 0.95 | -11.89 | -0.61 | -11.55 | 0.76 | -3.86 |
| 81 | miR-202-3p | 1528 | | | | | | | | | -24800 | 15900 | 40200 | 31100 |
| 82 | miR-20a-5p | 1529 | | | | | 0.55 | -17.44 | 1.04 | -11.28 | -0.78 | -10.79 | -0.63 | -4.44 |
| 83 | miR-21-5p | 1834 | | | | | 1 | -15.65 | 0.01 | -10.43 | -0.49 | -9.54 | 0.09 | -3.52 |

Fig. 10M

| Fig. 9 row | RNA | SEQ ID | log2 C/B | | | | log2 D/B | | | | log2 D/C | | | |
|---|---|---|---|---|---|---|---|---|---|---|---|---|---|---|
| | | | Alnorm | Alnu | Alslow | Alnotnorm | Alnorm | Alnu | Alslow | Alnotnorm | Alnorm | Alnu | Alslow | Alnotnorm |
| 84 | miR-221-3p | 533 | | | | | 0.84 | -1.63 | -2.07 | -1.91 | 0.49 | -2.91 | 0.03 | -1.07 |
| 85 | miR-223-3p | 534 | | | | | -0.1 | -17.88 | 0.65 | -11.71 | -0.45 | -12.08 | 0.21 | -4.4 |
| 86 | miR-23a-3p | 535 | | | | | -1.44E+10 | -1.79E+11 | 0 | -1.19E+11 | | | | |
| 87 | miR-24-3p | 1835 | 9.99E+11 | -2.79E+13 | 9.80E+12 | -2.55E+12 | 0.19 | -17.04 | 0.73 | -11.12 | -0.81 | -10.58 | 0.04 | -3.94 |
| 88 | miR-25-3p | 1836 | 4.30E+12 | -2.62E+13 | 1.16E+13 | 2.18E+12 | -0.73 | -16.47 | 1 | -10.65 | -1.48 | -10.25 | 0.32 | -3.65 |
| 89 | miR-25-5p | 1531 | 746 | -22.9 | 7040 | 5280 | | | | | | | | |
| 90 | miR-27a-3p | 539, 540 | | | | | 0.53 | -1.39 | -1.78 | -1.52 | 0.34 | -2.79 | 0.29 | -0.87 |
| 91 | miR-27b-3p | 541 | | | | | 0.43 | -4.83 | 1.11 | -2.59 | 1.06E+10 | -6.50E+10 | 1.21E+10 | -1.69E+10 |
| 92 | miR-28a-3p | 542 | -4.73E+10 | -2.71E+12 | 4.28E+11 | -3.55E+11 | 0.3 | -15.86 | 0.75 | -10.32 | -0.81 | -8.94 | 0.62 | -2.96 |
| 93 | miR-29b-3p | 1534 | | | | | 144000 | -514000 | -391000 | -473000 | | | | |
| 94 | miR-29c-3p | 1535 | -6.50E+10 | -2.97E+12 | -2.36E+11 | -9.20E+11 | -0.36 | -15.16 | 0.23 | -10.03 | -0.69 | -13.5 | -0.27 | -5.22 |
| 95 | miR-29c-5p | 1536 | | | | | -0.55 | -11.03 | 1.43 | -6.86 | -0.21 | -11.3 | 0.87 | -3.68 |
| 98 | miR-3117-3p | 1539 | | | | | | | | | | | | |
| 96 | miR-31-3p | 1837 | | | | | 4250 | -5750 | 56700 | 15100 | -0.42 | -0.31 | 1.08 | 0.56 |
| 99 | miR-3156-5p | 1542 | | | | | 5.15 | -17.5 | -0.78 | -11.9 | -119000 | -109000 | 132000 | 41500 |
| 97 | miR-31-5p | 1543 | | | | | 3.34 | -12.24 | 1.01 | -7.82 | | | | |
| 100 | miR-317b | 1544 | | | | | | | | | -6.29 | -5.05 | 4.35 | 0.83 |
| 101 | miR-323a-3p | 1546 | -1.93E+09 | -3.22E+11 | 1.52E+10 | -6.91E+10 | -0.03 | -6.83 | 0.24 | -4.48 | -0.14 | -3.52 | 0.51 | -1 |
| 102 | miR-323b-3p | 1547 | -2.04 | -0.53 | 6.12 | 4.46 | | | | | -0.97 | -6.9 | 5.34 | 0.75 |
| 103 | miR-329-3p | 1548 | 1.97E+08 | -8.34E+09 | 2.72E+08 | -1.88E+09 | 1.07E+07 | -5.94E+09 | 6.37E+08 | -3.75E+09 | -2.08 | -3.1 | 6.66 | 3 |
| 104 | miR-335-5p | 543 | | | | | 0.44 | 0.63 | -2.74 | -0.49 | | | | |
| 105 | miR-3613-3p | 1551 | | | | | -1.70E+08 | -6.54E+07 | 1.04E+09 | 3.08E+08 | | | | |
| 106 | miR-3613-5p | 1552 | | | | | 1.19E+08 | -1.70E+09 | 7.07E+09 | 1.22E+09 | | | | |
| 107 | miR-3667-5p | 1555 | | | | | -1.83 | -13.76 | 0.95 | -8.86 | 0.44 | -13.5 | 0.54 | -4.72 |
| 108 | miR-374b-5p | 1561 | | | | | -0.26 | -12.42 | 0.38 | -8.15 | -0.39 | -9.52 | -0.72 | -4.02 |
| 109 | miR-376a-3p | 1562 | 139000 | -2.66E+06 | -69300 | -716000 | -164000 | -2.51E+06 | 385000 | -1.54E+06 | | | | |
| 110 | miR-379-5p | 1565 | | | | | 1.78E+09 | -1.33E+10 | 7.43E+09 | -6.36E+09 | | | | |
| 111 | miR-4284 | 1575 | | | | | 0.7 | -4.4 | 1.03 | -2.59 | | | | |
| 112 | miR-431-5p | 1576 | 6.46E+08 | -1.84E+11 | -1.18E+08 | -4.62E+10 | 3.52 | -22.29 | 0 | -14.86 | -1.47E+09 | -1.50E+10 | -1.59E+08 | -6.72E+09 |
| 113 | miR-4435 | 1579 | | | | | | | | | | | | |
| 114 | miR-4485 | 1582 | | | | | -1.12E+09 | 2.34E+08 | 8.28E+09 | 2.92E+09 | | | | |
| 115 | miR-4525 | 1584 | | | | | | | | | -1.76 | 5.61 | 6.51 | 6.17 |
| 116 | miR-4668-5p | 1585 | 1.79 | 11.84 | 0 | 2.96 | | | | | | | | |
| 117 | miR-4797-5p | 1598 | -5.89E+06 | -9.32E+07 | -4.12E+07 | -5.42E+07 | -1.48 | -6.93 | -15.53 | -9.8 | | | | |
| 118 | miR-485-3p | 1599 | 3760 | -1.10E+07 | 541000 | -2.35E+06 | 728000 | -8.65E+06 | 1540 | -5.77E+06 | -0.93 | -7.63 | 2.08 | -1.57 |
| 119 | miR-487a-3p | 1600 | -271 | 1840 | 183 | 596 | | | | | | | | |
| 120 | miR-487b-3p | 1601 | -1.93E+09 | -5.66E+10 | 3.08E+09 | -1.18E+10 | -9.00E+07 | -6.50E+10 | 3.98E+09 | -4.20E+10 | -1.63E+09 | -2.08E+10 | 1.29E+09 | -7.01E+09 |
| 121 | miR-495-3p | 1605 | 3.33E+09 | -4.06E+10 | 2.56E+08 | -9.96E+09 | -0.09 | -7.71 | -0.41 | -5.28 | 2.05E+08 | -2.45E+10 | 1.55E+09 | -7.96E+09 |
| 122 | miR-504-5p | 548 | 0.17 | -1.42 | 1.94 | 1.1 | -0.58 | 1.16 | 3.27 | 1.86 | | | | |
| 123 | miR-505-3p | 1607 | | | | | 0.43 | -22.7 | 0.19 | -15.1 | | | | |
| 124 | miR-5195-3p | 1608 | 0.11 | -4.59 | -0.12 | -1.24 | 0.63 | -7.34 | -0.78 | -5.15 | | | | |
| 125 | miR-543 | 1609 | | | | | -1 | -12.61 | -0.31 | -8.51 | -0.78 | -12.1 | 0.3 | -4.04 |

Fig. 10N

| Fig. 9 row | RNA | SEQ ID | log2 C/B | | | | log2 D/B | | | | log2 D/C | | | |
|---|---|---|---|---|---|---|---|---|---|---|---|---|---|---|
| | | | Alnorm | Alnu | Alslow | Alnotnorm | Alnorm | Alnu | Alslow | Alnotnorm | Alnorm | Alnu | Alslow | Alnotnorm |
| 126 | miR-548aa | 1610 | 1.11E+11 | -4.02E+12 | 8.13E+11 | -3.96E+11 | 0.16 | -15.88 | 1.42 | -10.12 | -0.82 | -9.78 | 0.89 | -3.11 |
| 127 | miR-551a | 549 | -2.33E+08 | -2.23E+09 | 2.23E+08 | -3.91E+08 | 8.73E+07 | -1.23E+09 | 1.54E+09 | -3.06E+09 | | | | |
| 128 | miR-584-5p | 550 | | | | | -0.05 | -3.78 | 1.95 | -1.87 | -2.39E+10 | -7.16E+09 | 1.12E+11 | 6.75E+10 |
| 129 | miR-589-5p | 551 | | | | | 0.68 | -6.12 | 2.42 | -3.27 | | | | |
| 130 | miR-654-3p | 1627 | | | | | 9.88E+08 | -2.53E+10 | 3.96E+09 | -1.57E+10 | | | | |
| 131 | miR-664a-5p | 552 | 0.21 | -0.59 | -7.6 | -5.95 | 1.27 | -8.57 | -3.65 | -6.92 | | | | |
| 132 | miR-6726-3p | 1628 | | | | | | | | | | | | |
| 133 | miR-6770-5p | 1637 | | | | | | | | | | | | |
| 134 | miR-6777-3p | 1640 | -0.72 | 3.29 | 0.73 | 1.37 | | | | | 0.91 | -2.07 | 1.74 | 0.31 |
| 135 | miR-6818-5p | 1643 | | | | | 91 | -13100 | 30300 | 1390 | | | | |
| 136 | miR-6820-3p | 1645 | -1.84E+09 | 6.99E+09 | 1.32E+10 | 1.16E+10 | 0.04 | -9.95 | 2.8 | -5.71 | | | | |
| 137 | miR-6840-3p | 1648 | 3.99E+12 | -8.92E+13 | 1.05E+12 | -2.15E+13 | -0.13 | -3.48 | -1.56 | -2.87 | | | | |
| 138 | miR-6855-3p | 1649 | | | | | | | | | 1.21 | -5.36 | 2.41 | -0.51 |
| 139 | miR-6879-3p | 1652 | | | | | -0.21 | -11.55 | 1.59 | -7.04 | -0.54 | -7.65 | 1.33 | -2.03 |
| 140 | miR-7-5p | 553, 1656 | | | | | 1.22 | -13.21 | 0.1 | -8.77 | -0.64 | -7.9 | 0.51 | -2.54 |
| 141 | miR-7641 | 1657 | | | | | -1 | -14.29 | 0.67 | -9.2 | -0.6 | -12.2 | 0.51 | -4.26 |
| 142 | miR-7975 | 1662 | | | | | -0.59 | -11.87 | 1.18 | -7.52 | -1.05 | -7.33 | 0.39 | -2.5 |
| 143 | miR-93-5p | 556 | | | | | 0.75 | -2.25 | -0.03 | -1.51 | 0.52 | -3.34 | 0.22 | -1.11 |
| 144 | miR-98-5p | 1665 | | | | | 6.19 | -9.48 | -4 | -7.65 | | | | |
| 145 | HSPA9 | 400 | | | | | | | | | 0.24 | -0.04 | -0.31 | -0.21 |
| 146 | HSPD1 | 283 | | | | | | | | | | | | |
| 147 | IFI44 | 573 | | | | | 0.07 | -12.36 | -0.49 | -8.4 | 0.83 | -8.97 | -1.54 | -4.7 |
| 148 | IFI44L | 572 | | | | | -0.08 | -13.41 | -0.07 | -8.86 | 0.75 | -10.69 | -1.21 | -4.76 |
| 149 | IFI6 | 609 | | | | | -0.05 | -15.61 | 0.4 | -10.27 | 0.56 | -11.11 | -0.82 | -4.58 |
| 150 | IFIT1 | 655 | | | | | 0.21 | -14.73 | -0.19 | -9.88 | 0.59 | -11.89 | -1.77 | -5.41 |
| 151 | IFIT1B | 64, 654 | | | | | | | | | | | | |
| 152 | IFIT2 | 652 | | | | | 0.43 | -14.75 | -0.51 | -10.01 | 0.6 | -10.49 | -1.75 | -5.08 |
| 153 | IFIT3 | 653 | | | | | 0.09 | -15.32 | -0.2 | -10.28 | 0.54 | -11.07 | -1.59 | -5.14 |
| 154 | IFIT5 | 656 | | | | | -0.06 | -12.42 | -0.2 | -8.34 | 0.59 | -8.69 | -1.42 | -4.15 |
| 155 | IFITM3 | 682 | 3.29 | -26.59 | 1.07 | -5.87 | | | | | | | | |
| 156 | IFNA16 | 1406 | | | | | | | | | | | | |
| 157 | IGHA1 | 824 | | | | | 0.36 | -16.23 | -0.38 | -10.94 | 0.25 | -8.98 | -1.22 | -4.13 |
| 158 | IGKC | 1073, 1071, 1070, 1069, 1068, 1063 | 0 | 0 | 8.89 | 6.66 | 2.57 | -13.83 | -25.07 | -17.58 | 9.77E+09 | 9.64E+10 | 1.01E+08 | 3.68E+10 |

Fig. 10O

| Fig. 9 row | RNA | SEQ ID | log2 C/B | | | | log2 D/B | | | | log2 D/C | | | |
|---|---|---|---|---|---|---|---|---|---|---|---|---|---|---|
| | | | Anorm | Au | Aslow | Anotnorm | Anorm | Au | Aslow | Anotnorm | Anorm | Au | Aslow | Anotnorm |
| 159 | IGLC1 | 1109, 1110, 1111, 1114, 1115 | | | | | 0.67 | -11.06 | 0.35 | -7.28 | 0.47 | -5.79 | 0.52 | -1.85 |
| 160 | IL2RB | 2 | | | | | | | | | | | | |
| 161 | IL5RA | 1151 | | | | | 0.23 | -13.74 | 1.26 | -8.74 | 0.45 | -8.41 | -0.59 | -3.52 |
| 162 | IRF8 | 194 | | | | | 7.89 | -12.24 | -23.44 | -15.98 | 5.36 | -10.5 | -7.27 | -6.61 |
| 163 | ITGA2B | 215, 938 | | | | | 0.19 | -16.17 | 0.21 | -10.71 | 0.23 | -10.26 | -1.62 | -4.86 |
| 164 | ITGB3 | 918 | | | | | 0.42 | -16.88 | 0.23 | -11.18 | 0.27 | -10.77 | -1.52 | -4.98 |
| 165 | KCNJ15 | 1100 | | | | | 0.52 | -15.58 | 0.79 | -10.12 | 0.29 | -9.4 | -1.23 | -4.29 |
| 166 | KIF13A | 1279 | | | | | 0.38 | -14.09 | 0.31 | -9.29 | 0.71 | -8.29 | -1.08 | -3.77 |
| 167 | KIF1B | 562 | | | | | 0.38 | -14.23 | 0.61 | -9.28 | 0.69 | -8.52 | -1.04 | -3.85 |
| 168 | KLK12 | 1004 | | | | | -7.64E+08 | -8.19E+10 | 0 | -5.44E+10 | | | | |
| 169 | LDHB | 126 | | | | | | | | | 0.55 | 0.73 | -1.37 | -0.58 |
| 170 | LEF1 | 1201 | | | | | 0.66 | -15.26 | 0.73 | -9.93 | 0.68 | -9.21 | -0.31 | -3.65 |
| 171 | LGALS2 | 1126 | | | | | 0.1 | -13.39 | 0.14 | -8.88 | 0.49 | -8.16 | -0.67 | -3.48 |
| 172 | LOC440300 | 850 | | | | | | | | | | | | |
| 173 | LOC646214 | 855 | | | | | 0.49 | -3.32 | 0.45 | -2.06 | 0.81 | -1.63 | 0.24 | -0.46 |
| 174 | MANSC1 | 729 | | | | | 0.21 | -13.94 | 0.61 | -9.09 | 0.53 | -8.13 | -0.99 | -3.67 |
| 175 | MFSD9 | 1075 | | | | | -0.06 | -13.85 | 0 | -9.23 | 0.56 | -8.18 | -0.59 | -3.44 |
| 176 | pre-miR29a | 449 | | | | | | | | | | | | |
| 177 | MMP9 | 1087 | | | | | 0.17 | -15.24 | -0.59 | -10.36 | 0.53 | -9.02 | -1.79 | -4.5 |
| 178 | MT1E | 189 | | | | | 0 | 1.9 | -3.62 | 0.06 | | | | |
| 179 | MT1X | 191 | | | | | 0.32 | 0.92 | -2.06 | -0.08 | | | | |
| 180 | MXD3 | 270 | | | | | 0.19 | 0.67 | -1.64 | -0.1 | | | | |
| 181 | MYL4 | 917 | | | | | -0.46 | -15.93 | 0.23 | -10.54 | -0.06 | -8.85 | -0.73 | -3.78 |
| 182 | NDUFA2 | 401 | | | | | | | | | | | | |
| 183 | NFATC1 | 961 | | | | | 0.52 | -13.93 | 0.32 | -9.18 | 0.8 | -8.24 | -0.21 | -3.22 |
| 184 | NFATC2 | 4 | | | | | | | | | | | | |
| 185 | NLRC4 | 1054 | | | | | 0.17 | -14.57 | 0.1 | -8.68 | 0.73 | -9.04 | -0.89 | -3.96 |
| 186 | NOTCH3 | 996 | | | | | 0.25 | -10.47 | -0.14 | -7.02 | 0.84 | -6.23 | -0.97 | -2.94 |
| 187 | OMG | 931 | | | | | 0.19 | -13.03 | 0.55 | -8.5 | 0.65 | -7.65 | -0.29 | -3.05 |
| 188 | PAQR4 | 9, 563 | | | | | 0.1 | -15.83 | 0.28 | -10.47 | 0.56 | -9.28 | -1.01 | -4.11 |
| 189 | PDIA3P | 582 | | | | | -0.36 | -12.72 | 0.33 | -8.37 | 1.52 | -7.85 | -0.58 | -3.23 |
| 190 | PECAM1 | 1838 | | | | | | | | | -0.08 | 0.16 | -0.51 | -0.26 |
| 191 | PET100 | 968 | | | | | 0.28 | -13.27 | -0.21 | -8.91 | 0.53 | -8.06 | -0.86 | -3.57 |
| 192 | PI3 | 1086 | 0.01 | -0.28 | 1.7 | 1.21 | 0.4 | -15.35 | 1.48 | -9.74 | 0.51 | -9.08 | 0.25 | -3.25 |
| 193 | PPDPF | 291 | | | | | -1.10E+08 | -2.12E+08 | -6.13E+08 | -3.46E+08 | | | | |
| 194 | PRKXP1 | 864 | | | | | 0.98 | -12.82 | 0.19 | -8.48 | 0.95 | -7.9 | -0.29 | -3.14 |
| 195 | PROS1 | 1154 | | | | | -0.33 | -14.29 | 0.19 | -9.47 | 0.12 | -8.85 | -1.04 | -3.97 |

Fig. 10P

| Fig. 9 row | RNA | SEQ ID | log2 C/B Anorm | log2 C/B Alnu | log2 C/B Alslow | log2 C/B Anotnorm | log2 D/B Anorm | log2 D/B Alnu | log2 D/B Alslow | log2 D/B Anotnorm | log2 D/C Anorm | log2 D/C Alnu | log2 D/C Alslow | log2 D/C Anotnorm |
|---|---|---|---|---|---|---|---|---|---|---|---|---|---|---|
| 196 | PYGL | 164, 815 | | | | | 0.36 | -15.82 | 0.29 | -10.45 | 0.44 | -9.59 | -1.06 | -4.3 |
| 197 | RAB39A | 579 | | | | | -0.01 | -11.45 | -0.08 | -7.65 | 0.74 | -6.6 | -0.8 | -2.98 |
| 198 | RAD23A | 239 | | | | | | | | | | | | |
| 199 | RBBP8 | 954 | | | | | -0.47 | -13.73 | 0.21 | -9.08 | 0.07 | -8.18 | -0.72 | -3.52 |
| 200 | ROPN1L | 371 | | | | | | | | | | | | |
| 201 | RPS15 | 279 | | | | | 0.03 | 1.48 | -1.72 | 0.41 | | | | |
| 202 | RPS27 | 347 | | | | | -0.13 | 3.05 | -1.51 | 1.53 | | | | |
| 203 | RUNDC3A | 915 | | | | | -0.68 | -15.64 | 0.43 | -10.95 | -0.14 | -9.09 | -0.41 | -3.67 |
| 204 | S100A12 | 5, 618 | -3.22E+10 | -3.19E+12 | 3.50E+10 | -7.70E+11 | | | | | 0.07 | -0.06 | -1.18 | -0.76 |
| 205 | S100P | 344 | | | | | | | | | | | | |
| 206 | SELP | 825 | | | | | -2.5 | -27.87 | -0.18 | -18.64 | -3.27E+09 | 3.50E+14 | -2.04E+10 | 1.91E+14 |
| 207 | SMAD4 | 958 | | | | | 0.28 | -14.88 | 0.37 | -9.8 | 0.64 | -8.88 | -0.51 | -3.65 |
| 208 | SMN1 | 1216 | 0.04 | -0.35 | 0.1 | -0.01 | 0.37 | -13.85 | 0.59 | -9.04 | 0.68 | -7.98 | 0 | -2.99 |
| 209 | SNORA14A | 1318 | | | | | -0.51 | -13.61 | 0.21 | -9.01 | 0.4 | -8.03 | 0.4 | -2.77 |
| 210 | SNORD13 | 228 | | | | | | | | | | | | |
| 211 | SNORD14E | 104 | | | | | | | | | | | | |
| 212 | SNORD25 | 6, 99 | | | | | 2.25E+09 | 3.16E+10 | 4.51E+08 | 2.12E+10 | | | | |
| 213 | SNORD49 | 914 | | | | | 0.4 | -15.52 | 0.4 | -10.88 | -0.25 | -8.92 | 0.07 | -3.67 |
| 214 | SNORD59B | 134 | | | | | | | | | | | | |
| 215 | SPTA1 | 620 | | | | | -0.66 | -14.8 | 0.58 | -9.67 | -0.05 | -7.67 | -1.42 | -3.76 |
| 216 | THBS1 | 844 | | | | | 0.39 | -15.7 | -0.16 | -10.52 | 0.47 | -9.01 | -1.54 | -4.68 |
| 217 | TLR5 | 53 | | | | | | | | | 0.43 | -0.27 | -0.9 | -0.66 |
| 218 | TMEM158 | 1153 | | | | | -0.49 | -12.35 | -0.33 | -8.34 | 1.03 | -7.05 | -1.29 | -3.45 |
| 219 | TMEM176A | 1337 | | | | | 0.7 | -13.16 | 0.89 | -8.48 | 0.74 | -7.72 | -0.39 | -3.13 |
| 220 | TMEM176B | 1363 | | | | | 0.26 | -15.51 | 0.69 | -10.11 | 0.18 | -8.42 | -0.33 | -2.74 |
| 221 | TNFRSF9 | 602 | | | | | 0.51 | -13.04 | 0.42 | -8.56 | 0.64 | -7.81 | -0.61 | -3.31 |
| 222 | TREML1 | 1288 | | | | | -0.35 | -14.84 | 0.64 | -9.42 | 0.15 | -8.71 | -0.61 | -2.64 |
| 223 | TRNN | 7, 30, 497 | | | | | -0.05 | 1.68 | -1.61 | 0.58 | | | | |
| 224 | TSTA3 | 471 | | | | | | | | | | | | |
| 225 | TUB2A | 1244, 1245, 1277 | | | | | 0.02 | -12.39 | -0.5 | -8.42 | 0.32 | -7.06 | -0.86 | -3.18 |
| 226 | U3BB | 1577 | | | | | 0.13 | -11.86 | 1.31 | -7.47 | | | | |
| 227 | USP32P1 | 912 | | | | | 0.49 | -13.22 | 0.01 | -8.81 | 0.61 | -7.7 | -0.4 | -3.14 |
| 228 | YME1L1 | 765, 771, 768, 769, 764, 760, 762, 766, 770, 777 | | | | | 0.17 | -14.94 | 0.19 | -9.9 | 0.61 | -9.12 | -0.49 | -3.72 |

Fig. 10Q

| Fig. 11 row | Gene symbol | SEQ ID | log2 NUhealed/NUslow | | | log2 C/A | | AI biomarker |
| --- | --- | --- | --- | --- | --- | --- | --- | --- |
| | | | A | C | D | NUhealed | NUslow | |
| 1 | ANKRD36B | 1074 | 1.60 | | | | | x |
| 2 | A2M-AS1 | 703 | | 1.42 | | | | x |
| 3 | ADGRE1 (EMR1) | 966 | | | | 0.15 | -0.56 | x |
| 4 | ANXA3 | 349 | -5.23 | | | | | x |
| 5 | ARPP19 | 388 | -2.26 | -1.43 | | | | |
| 6 | CLEC4D | 109, 702 | -3.49 | | | | | x |
| 7 | CMTM2 | 889 | -2.58 | | | | | x |
| 8 | EC8P | 759 | | | 1.90 | | | |
| 9 | EIF4B | 132 | | | -1.35 | | | x |
| 10 | F8A1 | 1437 | | | -1.88 | | | x |
| 11 | G2MH | 814 | 5.71 | 2.59 | 4.95 | | | x |
| 12 | H1F0 | 289 | | -1.92 | -2.57 | | | x |
| 13 | HIST1H2BG | 1281 | | -2.17 | | | | x |
| 14 | hsa-let-7a-5p | 518 | | | -3.66 | -0.31 | 0.63 | x |
| 15 | hsa-miR-106a-5p | 519 | | | -3.53 | | | x |
| 16 | hsa-miR-125b-5p | 522 | 1.74 | | | -0.35 | 0.79 | x |
| 17 | hsa-miR-126-3p | 1501 | | | -8.88 | | | x |
| 18 | hsa-miR-143-3p | 1513 | | | -4.49 | | | |
| 19 | hsa-miR-146a-5p | 1832 | | | -4.36 | | | |
| 20 | hsa-miR-146b-5p | 1515 | | | -4.33 | | | x |
| 21 | hsa-miR-148a-3p | 1833 | | | -5.10 | | | x |
| 22 | hsa-miR-17-5p | 527 | | | -3.72 | | | x |
| 23 | hsa-miR-197-3 | 1524 | -3.46 | | | | | x |
| 24 | hsa-miR-197-6 | 1526 | | | -2.18 | | | |
| 25 | hsa-miR-19b-3p | 1527 | | | -3.86 | | | |
| 26 | hsa-miR-202-3p | 1528 | | | -2.72 | | | |
| 27 | hsa-miR-20a-5p | 1529 | | | -6.18 | | | |
| 28 | hsa-miR-21-5p | 1834 | | | -6.98 | | | x |
| 29 | hsa-miR-223-3p | 534 | | 1.62 | -2.79 | | | x |
| 30 | hsa-miR-24-3p | 1835 | | -1.92 | -4.36 | | | x |
| 31 | hsa-miR-25-3p | 1836 | | | -2.70 | | | x |
| 32 | hsa-miR-27b-3p | 541 | | | -3.32 | | | x |
| 33 | hsa-miR-29a-3p | 542 | | | -3.10 | | | x |
| 34 | hsa-miR-31-3p | 1837 | | -8.85 | -5.35 | | | |
| 35 | hsa-miR-323b-3p | 1547 | -4.61 | | | | | x |
| 36 | hsa-miR-329-3p | 1548 | | 5.41 | | 4.45E+04 | -1.04E+04 | x |
| 37 | hsa-miR-3667-5p | 1555 | 7.56 | 8.45 | | 3.36E+06 | -8.40E+04 | x |
| 38 | hsa-miR-374b-5p | 1561 | | -3.95 | -3.76 | -4.30E+06 | 9.52E+06 | x |
| 39 | hsa-miR-3934-5p | 1568 | | | -13.55 | | | |
| 40 | hsa-miR-4284 | 1575 | | | 11.33 | | | x |
| 41 | hsa-miR-4485 | 1582 | -3.85 | | | | | x |
| 42 | hsa-miR-4781-3p | 1597 | | -2.12 | -4.69 | | | |
| 43 | hsa-miR-505-3p | 1607 | | | -2.94 | | | x |
| 44 | hsa-miR-551a | 549 | | -3.80 | | | | x |
| 45 | hsa-miR-589-5p | 551 | | | -3.23 | | | x |
| 46 | hsa-miR-6770-5p | 1637 | | | -6.52 | | | |
| 47 | hsa-miR-6820-3p | 1645 | | | -4.33 | | | x |

Fig. 12A

| Fig. 11 row | Gene symbol | SEQ ID | log2 NUhealed/NUslow A | log2 NUhealed/NUslow C | log2 NUhealed/NUslow D | log2 C/A NUhealed | log2 C/A NUslow | AI biomarker |
|---|---|---|---|---|---|---|---|---|
| 48 | hsa-miR-6855-3p | 1649 | | | -3.10 | | | x |
| 49 | hsa-miR-6879-3p | 1652 | | | -3.52 | | | x |
| 50 | hsa-miR-93-5p | 556 | | | -2.85 | | | x |
| 51 | hsa-miR-98-5p | 1665 | | | -6.74 | | | x |
| 52 | HSPD1 | 283 | | -1.60 | | -0.68 | 0.08 | x |
| 53 | IL5RA | 1151 | | | 1.73 | | | x |
| 54 | KIF13A | 1279 | -1.65 | | | | | x |
| 55 | KIR2DL3 | 985 | 4.90 | 2.49 | 2.51 | | | |
| 56 | LGALS2 | 1126 | | | 2.49 | | | x |
| 57 | LOC440300 | 850 | | | 20.49 | | | x |
| 58 | LOC646214 | 855 | | | -3.23 | | | x |
| 59 | MANSC1 | 729 | | | -2.14 | | | x |
| 60 | MXD3 | 270 | -1.79 | -1.51 | | | | x |
| 61 | NDUFA2 | 401 | -1.72 | | | | | x |
| 62 | NOTCH3 | 996 | | | -5.05 | | | x |
| 63 | PECAM1 | 1838 | -2.36 | | -1.99 | | | x |
| 64 | PPDPF | 281 | | | -2.00 | | | x |
| 65 | PRKXP1 | 864 | | -1.81 | | -0.27 | 0.46 | x |
| 66 | ROPN1L | 371 | -4.43 | | | | | x |
| 67 | RPRD1B | 293 | | | -1.52 | | | |
| 68 | S100A12 | 5, 618 | -4.47 | | | | | x |
| 69 | S100P | 344 | -6.70 | | | | | x |
| 70 | SCARNA5 | 1051 | | | 3.70 | | | |
| 71 | SNORA14A | 1318 | | | 2.67 | | | x |
| 72 | SNORD14E | 104 | 1.46 | | 1.70 | | | x |
| 73 | SNORD59B | 134 | | | 3.51 | | | |
| 74 | THBS1 | 844 | | -2.13 | | | | x |
| 75 | TRNN | 7, 30, | -1.48 | | | | | x |
| 76 | U38B | 1677 | | | 6.37 | | | x |

Fig. 12B

METHODS FOR EARLY IDENTIFICATION OF BONE HEALING ABILITY IN INJURED PATIENTS

CROSS-REFERENCE TO RELATED APPLICATIONS

The present application is a 35 U.S.C. § 371 national phase application from, and claims priority to, International Application No. PCT/US2016/016404, filed Feb. 3, 2016, which claims priority under 35 U.S.C. § 119(e) to U.S. Provisional Patent Application No. 62/231,935 filed Feb. 3, 2015 and U.S. Provisional Patent Application No. 62/283,443, filed Sep. 1, 2015, all of which applications are incorporated herein by reference in their entireties.

STATEMENT REGARDING FEDERALLY SPONSORED RESEARCH OR DEVELOPMENT

This invention was made with government support under grant P30AR050950 awarded by National Institute of Health and National Institute of Arthritis and Musculoskeletal and Skin Diseases (NIH-NIAMS). The government has certain rights in the invention.

STATEMENT REGARDING SEQUENCE LISTING SUBMITTED ELECTRONICALLY VIA EFS-WEB

The content of the electronically submitted sequence listing in ASCII text file (Name: 046483-7061US1_SequenceListingTXT; Size: 5,169,590 bytes; Date of Creation: Aug. 3, 2017) is herein incorporated by reference in its entirety.

BACKGROUND OF THE INVENTION

In some patients, fractures of the bone heal very slowly or fail to heal at all (known as "nonunion," and patients who experience this are known as "nonunions"), requiring revision surgeries to perform repairs and transplants, provide mechanical support, and apply therapeutic orthobiologics. In the United States, about 700,000 patients (5-10% of the 8 million annual fracture cases) experience nonunion, with cases of femur or tibia fracture having the highest rates of nonunion at 10 to 46%. The signs and symptoms of nonunion include pain at the fracture site, inability to bear weight, impaired mobility, depression, hardware failure, soft tissue wounds, and pseudoarthrosis in extreme cases. Ongoing clinical care of nonunions adds $1.2 billion to the annual $44 billion cost of new fracture injuries. As the length of time spent with a nonunion increases, the negative impacts of these comorbidities and associated economic costs also increase, including societal impact.

In the normal healing process, a bone fracture initiates a sequence of inflammation, repair, and remodeling that can restore the injured bone to its original state. In humans, the inflammatory phase lasts about 5 to 7 days; it begins with the development of a hematoma and is followed by the invasion of inflammatory cells. These cells, in association with local cells, secrete cytokines, chemokines and growth factors to promote the recruitment of osteogenic progenitor cells and endothelial progenitor cells, essential to initiate the repair process. The recruitment of progenitor cells is divided in four phases: mobilization, migration, invasion and engraftment of the cells to the fracture site. Impairment of one or more of the above processes can result in impaired bone fracture healing. Average normal healing times vary depending on the location of the fracture and range between 3 weeks (phalanges) to 12 weeks (femoral neck or shaft or tibia). A slow healing fracture can take twice as much time as the normal healing and a nonunion does not show signs of healing 6-9 months after injury or if three successive months go by without an interval of healing.

The standard of care to assess fracture healing versus nonunion is "watchful waiting" that includes physical exams and serial radiographs over six to nine months allowing ample time for conservative care. FDA guidelines suggest a diagnosis of nonunion at nine months if union has not occurred or if three successive months go by without signs of progression of bone of formation. After nonunion diagnosis, the patient may undergo nonsurgical interventions such as ultrasound or electrical stimulators, with intervals of watchful waiting. If these conservative treatments fail, revision surgery is performed for debridement, hardware replacement, and/or application of orthobiologics. Watchful waiting resumes after the revision procedures are complete.

Current investigations to identify early molecular markers of fracture healing are mainly restricted to the study of individual proteins with known musculoskeletal association, such as bone turnover markers. These are highly important for the development of future therapeutics that will enhance the healing process, but are not reliable and easily accessible molecular biomarkers of fracture healing. Most recently, genomics techniques such as RNA profiling by microarrays and deep sequencing have been used to identify panels of clinical biomarkers from messenger RNA (mRNA) and microRNA (miRNA) samples. Circulating miRNA profiles were shown to be useful for detecting various pathologies such as traumatic brain injury or poor fracture healing in patients with osteoporosis, however RNA biomarkers that consistently identify and differentiate slow healing and nonunion patients remain unknown.

There is a need in the art of fracture management for a prognostic test that discriminates cases of slow healing and nonunion from those with productive healing. This test should indicate the need for more aggressive therapy or revision surgery within weeks of the injury, reducing the average monitoring period. The present invention addresses this need.

BRIEF SUMMARY OF THE INVENTION

The invention provides a method of identifying a subject with a fractured bone as a candidate for nonunion-mitigating intervention, or an additional intervention following a nonunion-mitigating intervention. The invention further provides a method of promoting bone healing to a subject with a fractured bone. The invention further provides a kit for diagnosing the ability of normal healing, slow healing or no healing of a fractured bone in a subject. The invention further provides a kit for diagnosing the ability of normal healing or slow healing of a fractured bone in a subject. The invention further provides a kit for diagnosing the ability of normal healing or slow healing of a nonunion fractured bone in a subject after a nonunion-mitigating treatment.

In certain embodiments, the method comprises at least one of the following steps: comparing the level of at least one RNA in a sample from the subject to a baseline level of the at least one RNA in a reference sample, wherein a difference in level of the at least one RNA in the subject's sample as compared to the reference sample is indicative of a nonunion or slow healing of the fractured bone in the subject; and, comparing the change of the level of at least one RNA between samples collected from the subject at two or more different times to a baseline change of the level of the at least one RNA in reference samples collected at different times, wherein a difference in the amount of change of the at least one RNA in the subject's samples as compared to the reference samples is indicative of a nonunion or slow healing of the fractured bone in the subject. In other embodiments, the method comprises recommending a nonunion-mitigating intervention for the subject. In yet other embodiments, the method further comprises determining the level of the at least one RNA molecule in a sample from the subject before performing the comparing step(s).

In certain embodiments, the method comprises providing a nonunion-mitigating intervention to the subject if a difference in level, or a difference in change of level, of the at least one RNA in a subject's sample as compared to a reference sample is indicative of a nonunion or slow healing of the fractured bone in the subject.

In certain embodiments, the level, or change in level, of the at least one RNA is at least 1.1-fold higher or lower than the level, or change in level, of the at least one RNA in the reference.

In certain embodiments, the method comprises at least one of the following steps: comparing the level of at least one protein in a sample from the subject to a baseline level of the at least one protein in a reference sample, wherein a difference in level of the at least one protein in the subject's sample as compared to the reference sample is indicative of a nonunion or slow healing of the fractured bone in the subject; and, comparing the change of the level of at least one protein between samples collected from the subject at two or more different times to a baseline change of the level of the at least one protein in reference samples collected at different times, wherein a difference in the amount of change of the at least one protein in the subject's samples as compared to the reference samples is indicative of a nonunion or slow healing of the fractured bone in the subject. In other embodiments, the method further comprises recommending a nonunion-mitigating intervention for the subject. In yet other embodiments, the method further comprises determining the level of the at least one protein in a sample from the subject before performing the comparing step(s).

In certain embodiments, the method comprises providing a nonunion-mitigating intervention to the subject if a difference in level, or a difference in change of level, of the at least one protein in a subject's sample as compared to a reference sample is indicative of a nonunion or slow healing of the fractured bone in the subject.

In certain embodiments, the bone healing does not occur or initiate about 9 months or less after injury or after a nonunion-mitigating intervention. In other embodiments, the bone healing does not occur or initiate about 4 months or less after injury or after a nonunion-mitigating intervention. In yet other embodiments, the bone healing does not occur or initiate about 2 weeks after injury or after a nonunion-mitigating intervention.

In certain embodiments, the bone healing ability is assessed at one or more time periods. In other embodiments, the assessment is done during or before the fourth month of healing.

In certain embodiments, the nonunion-mitigating intervention or the additional intervention comprises an invasive surgical treatment comprising bone graft, removal of scar tissue, application of therapeutic drugs or biologics, and/or immobilization of the fracture with metal plates, rods and/or pins. In other embodiments, the nonunion-mitigating intervention or the additional intervention is a non-invasive treatment comprising electrical stimulation, ultrasound, treatment with therapeutic drugs or biologics, and/or immobilization of the fracture with specialized braces.

In certain embodiments, the at least one RNA is at least one selected from the group consisting of a messenger RNA, a non-coding RNA, and a microRNA.

In certain embodiments, the at least one RNA is selected from the group consisting of SEQ ID NOs: 1-1684 and 1830-1838. In other embodiments, the at least one RNA selected from the group consisting of SEQ ID NOs: 1, 2, 3, 4, 5, 6, 7, 30, 31, 53, 64, 75, 78, 89, 104, 106, 109, 126, 132, 134, 189, 191, 194, 228, 233, 239, 270, 279, 283, 290, 291, 293, 299, 344, 347, 349, 371, 388, 400, 401, 408, 413, 442, 449, 453, 459, 471, 497, 512, 513, 515, 518, 519, 520, 521, 522, 523, 525, 527, 528, 529, 531, 533, 539, 540, 541, 543, 548, 549, 550, 551, 552, 554, 556, 618, 654, 677, 702, 1520, 1549 and 1838 indicates nonunion, slow healing or normal healing after acute injury, and/or indicates successful, no or slow healing after a nonunion-mitigating intervention.

In certain embodiments, the level of the at least one RNA being at least 1.1-fold higher or lower than the level of the RNA in the reference indicates nonunion, slow healing or normal healing after acute injury, and/or indicates successful, no or slow healing after a nonunion-mitigating intervention.

In certain embodiments, the at least one RNA selected from the group consisting of SEQ ID NOs: 9, 24, 45, 103, 124, 164, 219, 314, 351, 516, 517, 526, 534, 535, 542, 553, 562, 563, 572, 573, 582, 598, 599, 602, 609, 619, 620, 624, 625, 634, 652, 653, 655, 656, 676, 682, 698, 700, 701, 703, 721, 722, 723, 724, 725, 729, 753, 759, 760, 762, 764, 765, 766, 768, 769, 770, 771, 777, 781, 785, 789, 791, 794, 806, 814, 816, 824, 844, 850, 855, 862, 864, 867, 885, 889, 910, 911, 912, 914, 915, 917, 918, 931, 934, 938, 954, 958, 961, 962, 966, 968, 985, 996, 1004, 1024, 1027, 1030, 1032, 1035, 1051, 1054, 1063, 1066, 1068, 1069, 1070, 1071, 1073, 1074, 1075, 1080, 1086, 1087, 1096, 1100. 1109, 1110, 1111, 1114, 1115, 1126, 1141, 1151, 1153, 1154, 1180, 1201, 1216, 1228, 1244, 1245, 1277, 1279, 1281, 1283, 1286, 1288, 1293, 1318, 1337, 1363, 1382, 1405, 1406, 1431, 1437, 1489, 1493, 1499, 1500, 1501, 1502, 1506, 1508, 1512, 1513, 1514, 1515, 1516, 1517, 1522, 1523, 1524, 1526, 1527, 1528, 1529, 1531, 1532, 1533, 1534, 1535, 1536, 1539, 1541, 1542, 1543, 1544, 1546, 1547, 1548, 1551, 1552, 1554, 1555, 1561, 1562, 1565, 1568, 1575, 1576, 1579, 1582, 1584, 1585, 1597, 1598, 1599, 1600, 1601, 1605, 1607, 1608, 1609, 1610, 1626, 1627, 1628, 1637, 1640, 1643, 1645, 1648, 1649, 1652, 1654, 1656, 1657, 1662, 1665, 1677, 1830, 1831, 1832, 1833, 1834, 1835, 1836, and 1837 indicates nonunion, slow healing or normal healing after acute injury, and/or indicates successful, no or slow healing after a nonunion-mitigating intervention.

In certain embodiments, the level of the at least one RNA being at least 1.1-fold higher or lower than the level of the RNA in the reference indicates nonunion, slow healing or normal healing after acute injury, and/or indicates successful, no or slow healing after a nonunion-mitigating intervention.

In certain embodiments, the differential expression of at least one RNA selected from the group consisting of SEQ ID NOs: 1, 2, 4, 5, 6, 7, 9, 24, 30, 45, 53, 64, 75, 78, 89, 99, 103, 104, 109, 124, 126, 132, 134, 164, 191, 194, 219, 228, 239, 270, 279, 283, 290, 291, 293, 299, 314, 344, 347, 349, 351, 371, 388, 400, 401, 408, 413, 442, 449, 459, 471, 497, 512, 513, 515, 516, 518, 519, 520, 522, 523, 525, 527, 528, 529, 531, 533, 534, 535, 539, 540, 541, 542, 543, 548, 549, 551, 552, 553, 556, 562, 563, 572, 573, 582, 598, 599, 602, 609, 618, 620, 624, 625, 634, 652, 653, 654, 655, 656, 676, 677, 682, 698, 701, 702, 703, 722, 725, 729, 753, 759, 760, 762, 764, 765, 766, 768, 769, 770, 771, 777, 781, 785, 789, 791, 794, 814, 816, 824, 844, 850, 855, 862, 864, 867, 885, 889, 912, 914, 915, 917, 918, 934, 938, 954, 958, 961, 962, 966, 985, 996, 1004, 1024, 1027, 1030, 1032, 1035, 1051, 1054, 1063, 1066, 1068, 1069, 1070, 1071, 1073, 1074, 1080, 1086, 1100, 1109, 1110, 1111, 1114, 1115, 1126, 1141, 1151, 1153, 1154, 1180, 1201, 1216, 1228, 1244, 1245, 1277, 1279, 1281, 1283, 1286, 1288, 1318, 1337, 1363, 1382, 1406, 1437, 1489, 1499, 1501, 1512, 1513, 1515, 1517, 1520, 1524, 1526, 1527, 1528, 1529, 1531, 1532, 1536, 1539, 1542, 1544, 1546, 1547, 1548, 1549, 1551, 1555, 1561, 1562, 1565, 1568, 1575, 1576, 1579, 1582, 1584, 1597, 1598, 1599, 1600, 1601, 1605, 1607, 1608, 1609, 1610, 1627, 1628, 1637, 1640, 1643, 1645, 1648, 1649, 1652, 1656, 1662, 1665, 1677, 1831, 1832, 1833, 1834, 1835, 1836, 1837 and 1838 indicates nonunion, slow healing or normal healing after acute injury, and/or indicates successful, no or slow healing after a nonunion-mitigating intervention.

In certain embodiments, the differential expression of at least one RNA selected from the group consisting of SEQ ID NOs: 1, 2, 4, 5, 6, 7, 9, 24, 30, 45, 53, 64, 75, 78, 89, 99, 103, 104, 109, 124, 126, 132, 134, 164, 191, 194, 219, 228, 239, 270, 279, 283, 290, 291, 293, 299, 314, 344, 347, 349, 351, 371, 388, 400, 401, 408, 413, 442, 449, 459, 471, 497, 512, 513, 515, 516, 518, 519, 520, 522, 523, 525, 527, 528, 529, 531, 533, 534, 535, 539, 540, 541, 542, 543, 548, 549, 551, 552, 553, 556, 562, 563, 572, 573, 582, 598, 599, 602, 609, 618, 620, 624, 625, 634, 652, 653, 654, 655, 656, 676, 677, 682, 698, 701, 702, 703, 722, 725, 729, 753, 759, 760, 762, 764, 765, 766, 768, 769, 770, 771, 777, 781, 785, 789, 791, 794, 814, 816, 824, 844, 850, 855, 862, 864, 867, 885, 889, 912, 914, 915, 917, 918, 934, 938, 954, 958, 961, 962, 966, 985, 996, 1004, 1024, 1027, 1030, 1032, 1035, 1051, 1054, 1063, 1066, 1068, 1069, 1070, 1071, 1073, 1074, 1080, 1086, 1100, 1109, 1110, 1111, 1114, 1115, 1126, 1141, 1151, 1153, 1154, 1180, 1201, 1216, 1228, 1244, 1245, 1277, 1279, 1281, 1283, 1286, 1288, 1318, 1337, 1363, 1382, 1406, 1437, 1489, 1499, 1501, 1512, 1513, 1515, 1517, 1520, 1524, 1526, 1527, 1528, 1529, 1531, 1532, 1536, 1539, 1542, 1544, 1546, 1547, 1548, 1549, 1551, 1555, 1561, 1562, 1565, 1568, 1575, 1576, 1579, 1582, 1584, 1597, 1598, 1599, 1600, 1601, 1605, 1607, 1608, 1609, 1610, 1627, 1628, 1637, 1640, 1643, 1645, 1648, 1649, 1652, 1656, 1662, 1665, 1677, 1831, 1832, 1833, 1834, 1835, 1836, 1837 and 1838 indicates nonunion, slow healing or normal healing after acute injury.

In certain embodiments, the level of the at least one RNA being at least 1.1-fold higher or lower than the level of the RNA in the reference indicates nonunion, slow healing or normal healing after acute injury.

In certain embodiments, the differential expression of at least one RNA selected from the group consisting of SEQ ID NOs: 2, 4, 5, 7, 30, 53, 75, 104, 109, 126, 132, 134, 270, 283, 291, 293, 299, 344, 349, 371, 388, 401, 413, 497, 516, 519, 522, 527, 528, 534, 541, 542, 549, 551, 556, 618, 702, 703, 729, 759, 814, 844, 850, 855, 864, 889, 985, 996, 1051, 1074, 1126, 1151, 1279, 1281, 1318, 1437, 1501, 1513, 1515, 1524, 1526, 1527, 1528, 1529, 1532, 1547, 1548, 1555, 1561, 1568, 1575, 1582, 1597, 1607, 1637, 1645, 1649, 1652, 1665, 1677, 1832, 1833, 1834, 1835, 1836, 1837 and 1838 indicates successful, no or slow healing after a nonunion-mitigating intervention.

In certain embodiments, the level of the at least one RNA being at least 1.1-fold higher or lower than the level of the RNA in the reference indicates successful, no or slow healing after a nonunion-mitigating intervention.

In certain embodiments, the change of expression over time of at least one
RNA selected from the group consisting of SEQ ID NOs: 1, 2, 4, 7, 24, 30, 53, 75, 78, 89, 103, 109, 126, 132, 134, 189, 191, 194, 219, 239, 270, 279, 283, 290, 291, 347, 349, 388, 401, 408, 442, 449, 471, 497, 512, 513, 515, 516, 518, 520, 522, 523, 528, 529, 531, 533, 548, 549, 550, 551, 552, 556, 562, 572, 582, 599, 652, 653, 655, 656, 677, 698, 702, 722, 844, 864, 885, 938, 966, 996, 1054, 1074, 1154, 1520, 1528, 1542, 1546, 1548, 1561, 1584, 1605 and 1838 indicates nonunion, slow healing or normal healing after acute injury, and/or indicates successful, no or slow healing after a nonunion-mitigating intervention.

In certain embodiments, the change of expression over time of at least one RNA selected from the group consisting of SEQ ID NOs: 1, 2, 4, 7, 24, 30, 53, 75, 78, 89, 103, 109, 126, 132, 134, 189, 191, 194, 219, 239, 270, 279, 290, 291, 347, 349, 388, 401, 408, 442, 449, 471, 497, 512, 513, 515, 518, 520, 522, 523, 528, 529, 531, 533, 548, 549, 550, 551, 552, 556, 562, 572, 582, 599, 652, 653, 655, 656, 677, 698, 702, 722, 844, 885, 938, 966, 996, 1054, 1074, 1154, 1520, 1528, 1542, 1546, 1584, 1605 and 1838 indicates nonunion, slow healing or normal healing after acute injury.

In certain embodiments, the change of expression over time of the at least one RNA being at least 1.1-fold higher or lower than the change of expression over time of the RNA in the reference indicates nonunion, slow healing or normal healing after acute injury.

In certain embodiments, the change of expression over time of at least one RNA selected from the group consisting of SEQ ID NOs: 283, 516, 864, 966, 1548 and 1561 indicates successful, no or slow healing after a nonunion-mitigating intervention.

In certain embodiments, the change of expression over time of the at least one RNA being at least 1.1-fold higher or lower than the change of expression over time of the RNA in the reference indicates successful, no or slow healing after a nonunion-mitigating intervention.

In certain embodiments, the at least one RNA is selected from the group consisting of SEQ ID NOs: 8-556.

In certain embodiments, the differential expression of at least one RNA from the group of SEQ ID NOs: 8-556 indicates either acute injury or no injury.

In certain embodiments, the level of the at least one RNA being at least 1.1-fold higher or lower than the level of the RNA in the reference indicates either acute injury or no injury.

In certain embodiments, the differential expression of at least one RNA from the group of SEQ ID NOs: 8, 10, 12, 13, 15, 16, 18, 19-23, 26, 9, 30-33, 35-37, 41, 43, 44, 46, 48-52, 54-56, 61, 63-65, 67-69, 73, 74, 77-79, 81, 82, 86, 88-92, 95-102, 104, 106, 107, 108, 110, 119-122, 126-128, 130-132, 134, 135, 137, 139, 140, 144 147-150, 152, 156-158, 161, 162, 167-170, 172, 175, 179-183, 187-201, 203-207, 209-212, 215, 216, 217, 218, 220, 222-228, 231-237, 239, 240, 242, 247, 249, 251-253, 256, 258-266, 268-273, 275-277, 279, 280, 283, 285, 286, 288, 291, 293, 295-306, 308, 310, 311, 321, 322, 324, 327, 331, 333, 335, 338-341, 343, 347, 348, 352, 354, 357, 358, 364, 365, 367, 371, 372, 375, 378, 383, 386, 388, 390, 396-401, 403, 404, 407, 408, 415, 417, 420, 421, 423, 425, 428, 431, 433-435, 438, 441, 442, 444, 446-449, 451, 453, 454, 459, 461, 462, 467, 472, 474-478, 480, 486, 487, 495, 496, 497, 500, 502, 503, 505, 506, 508, 510, 511, 513-515, 519, 520, 525, 527-530, 533 and 556 indicates either nonunion or no injury.

In certain embodiments, the level of the at least one RNA being at least 1.1-fold higher or lower than the level of the RNA in the reference indicates either nonunion or no injury.

In certain embodiments, the differential expression of at least one RNA from the group of SEQ ID NOs: 25, 53, 58 105, 124, 143, 229, 289, 290, 292, 309, 328, 332, 334, 336, 344, 349, 385, 405, 406, 422, 471, 489 and 512 allows differentiating between acute injury and no injury or between nonunion and no injury.

In certain embodiments, the level of the at least one RNA being at least 1.1-fold higher or lower than the level of the RNA in the reference indicates acute injury or nonunion differentiated from no injury.

In certain embodiments, the level or change in level of the at least one protein is higher or lower by at least 1.1-fold than the level or change in level of the at least one protein in the reference.

In certain embodiments, the bone healing does not occur or initiate about 9 months or less after injury or after a nonunion-mitigating intervention. In other embodiments, the bone healing does not occur or initiate about 4 months or less after injury or after a nonunion-mitigating intervention. In yet other embodiments, the bone healing does not occur or initiate about 2 weeks after injury or after a nonunion-mitigating intervention.

In certain embodiments, the bone healing ability is assessed at one or more time periods. In other embodiments, the assessment is done during or before the fourth month of healing.

In certain embodiments, the nonunion-mitigating intervention or the additional intervention comprises an invasive surgical treatment comprising bone graft, removal of scar tissue, application of therapeutic drugs or biologics, and/or immobilization of the fracture with metal plates, rods or pins.

In certain embodiments, the nonunion-mitigating intervention or the additional intervention is a non-invasive treatment comprising electrical stimulation, ultrasound, treatment with therapeutic drugs or biologics, or immobilization of the fracture with specialized braces.

In certain embodiments, the at least one protein is selected from the group consisting of SEQ ID NOs: 1685-1829.

In certain embodiments, the differential expression of at least one protein selected from the group consisting of SEQ ID NOs: 1695, 1696, 1697, 1698, 1699, 1701, 1702, 1703, 1705, 1706, 1707, 1708, 1711, 1712, 1714, 1715, 1716, 1717, 1718, 1719, 1720, 1721, 1722, 1723, 1730, 1732, 1734, 1735, 1736, 1740, 1741, 1742, 1743, 1744, 1752, 1753, 1756, 1763, 1764, 1768, 1769, 1774, 1775, 1778, 1779, 1781, 1783, 1785, 1787, 1791, 1794, 1796, 1797, 1798, 1803, 1806, 1810, 1812, 1814, 1816, 1820, 1823, 1827, 1828 and 1829 indicates nonunion, slow healing or normal healing after acute injury.

In certain embodiments, the level of the at least one protein being at least 1.1-fold higher or lower than the level of the protein in the reference indicates nonunion, slow healing or normal healing after acute injury.

In certain embodiments, the change of expression over time of at least one protein selected from the group consisting of SEQ ID NOs: 1732, 1783, 1796 and 1804 indicates nonunion, slow healing or normal healing after acute injury.

In certain embodiments, the change of expression over time of the at least one protein being at least 1.1-fold higher or lower than the change of expression over time of the protein in the reference indicates nonunion, slow healing or normal healing after acute injury.

In certain embodiments, the at least one RNA is selected from the group consisting of SEQ ID NOs: 1-1684 and 1830-1838.

In certain embodiments, the at least one RNA is a mRNA or ncRNA selected from the group consisting of SEQ ID NOs: 1-515, 557-1471, and 1838.

In certain embodiments, the at least one RNA is a miRNA selected from the group consisting of SEQ ID NOs: 516-556, 1472-1684, and 1830-1837.

In certain embodiments, the at least one protein is selected from the group consisting of SEQ ID NOs: 1685-1829.

In certain embodiments, determining the level of the at least one RNA comprises at least one technique selected from the group consisting of reverse transcription, PCR, microarray, next generation sequencing, nuclease protection, probe hybridization to one or more molecular copies of the at least one RNA, pyrosequencing, and primer extension.

In certain embodiments, determining the level of the at least one protein comprises at least one technique selected from the group consisting of western blot, immunoprecipitation, immunoassay, immunohistochemistry, immunofluorescence and radioimmunoassay, chemical assay, enzyme assay, mass spectrometry, chromatography, electrophoresis, biosensor, antibody microarray, multiplex aptamer-based assay, agglutination assay, turbidity assay and nephelometric assay.

In certain embodiments, the sample is at least one selected from the group consisting of blood, peripheral blood, serum, plasma, urine, stool samples, saliva, biological fluid gathered from an anatomic area in proximity to the fractured bone, biological fluid from fractured hone, primary cells, and cultured cells.

In certain embodiments, the comparison of level of RNA and/or protein expression is computed using at least one statistical method selected from the group consisting of pairwise and multi-class ANOVA tests, t-tests, chi-square tests, Bayesian tests, machine learning algorithms, and Extraction of Differential Gene Expression (EDGE) tool analysis.

In certain embodiments, the ratios, sums, products or other mathematical combinations of expression level of at least two RNAs as compared to the corresponding expression levels in reference samples are used to calculate a score or composite score that characterizes the bone healing ability in the subject.

In certain embodiments, the ratios, sums, products or other mathematical combinations of expression level of at least two proteins as compared to the corresponding expression levels in reference samples are used to calculate a score or composite score that characterizes the bone healing ability in the subject.

In certain embodiments, the subject is a mammal. In other embodiments, the mammal is a human.

In certain embodiments, the kit comprises one or more probes that detect at least one isolated RNA selected from the group consisting of SEQ ID NOs: 1, 2, 4, 5, 6, 7, 9, 24, 30, 45, 53, 64, 75, 78, 89, 99, 103, 104, 109, 124, 126, 132, 134, 164, 189, 191, 194, 219, 228, 239, 270, 279, 283, 290, 291, 293, 299, 314, 344, 347, 349, 351, 371, 388, 400, 401, 408, 413, 442, 449, 459, 471, 497, 512, 513, 515, 516, 518, 519, 520, 522, 523, 525, 527, 528, 529, 531, 533, 534, 535, 539, 540, 541, 542, 543, 548, 549, 550, 551, 552, 553, 556, 562, 563, 572, 573, 582, 598, 599, 602, 609, 618, 620, 624, 625, 634, 652, 653, 654, 655, 656, 676, 677, 682, 698, 701, 702, 703, 722, 725, 729, 753, 759, 760, 762, 764, 765, 766, 768, 769, 770, 771, 777, 781, 785, 789, 791, 794, 814, 816, 824, 844, 850, 855, 862, 864, 867, 885, 889, 912, 914, 915, 917, 918, 934, 938, 954, 958, 961, 962, 966, 985, 996, 1004, 1024, 1027, 1030, 1032, 1035, 1051, 1054, 1063, 1066, 1068, 1069, 1070, 1071, 1073, 1074, 1080, 1086, 1100, 1109, 1110, 1111, 1114, 1115, 1126, 1141, 1151, 1153, 1154, 1180, 1201, 1216, 1228, 1244, 1245, 1277, 1279, 1281, 1283, 1286, 1288, 1318, 1337, 1363, 1382, 1406, 1437, 1489, 1499, 1501, 1512, 1513, 1515, 1517, 1520, 1524, 1526, 1527, 1528, 1529, 1531, 1532, 1536, 1539, 1542, 1544, 1546, 1547, 1548, 1549, 1551, 1555, 1561, 1562, 1565, 1568, 1575, 1576, 1579, 1582, 1584, 1597, 1598, 1599, 1600, 1601, 1605, 1607, 1608, 1609, 1610, 1627, 1628, 1637, 1640, 1643, 1645, 1648, 1649, 1652, 1656, 1662, 1665, 1677, 1831, 1832, 1833, 1834, 1835, 1836, 1837 and 1838.

In certain embodiments, the kit comprises one or more probes that detect at least one isolated protein selected from the group consisting of SEQ ID NOs: 1695, 1696, 1697, 1698, 1699, 1701, 1702, 1703, 1705, 1706, 1707, 1708, 1711, 1712, 1714, 1715, 1716, 1717, 1718, 1719, 1720, 1721, 1722, 1723, 1730, 1732, 1734, 1735, 1736, 1740, 1741, 1742, 1743, 1744, 1752, 1753, 1756, 1763, 1764, 1768, 1769, 1774, 1775, 1778, 1779, 1781, 1783, 1785, 1787, 1791, 1794, 1796, 1797, 1798, 1803, 1804, 1806, 1810, 1812, 1814, 1816, 1820, 1823, 1827, 1828, 1829.

In certain embodiments, the kit comprises one or more probes that detect at least one isolated RNA selected from the group consisting of SEQ ID NOs: 2, 4, 5, 7, 30, 53, 75, 104, 109, 126, 132, 134, 270, 283, 291, 293, 299, 344, 349, 371, 388, 401, 413, 497, 516, 519, 522, 527, 528, 534, 541, 542, 549, 551, 556, 618, 702, 703, 729, 759, 814, 844, 850, 855, 864, 889, 966, 985, 996, 1051, 1074, 1126, 1151, 1279, 1281, 1318, 1437, 1501, 1513, 1515, 1524, 1526, 1527, 1528, 1529, 1532, 1547, 1548, 1555, 1561, 1568, 1575, 1582, 1597, 1607, 1637, 1645, 1649, 1652, 1665, 1677, 1832, 1833, 1834, 1835, 1836, 1837 and 1838.

In certain embodiments, the kit comprises a plurality of oligonucleotides that detect at least one RNA selected from the group consisting of SEQ ID NOs: 1-1684 and 1830-1838.

In certain embodiments, the kit comprises a plurality of amino acids that detect at least one protein selected from the group consisting of SEQ ID NOs: 1685-1829.

BRIEF DESCRIPTION OF THE DRAWINGS

For the purpose of illustrating the invention, there are depicted in the drawings certain embodiments of the invention. However, the invention is not limited to the precise arrangements and instrumentalities of the embodiments depicted in the drawings.

FIG. 1 is a table listing the fold-differences for blood mRNAs or ncRNAs significantly different (ANOVA $p<0.05$) between AInorm and AIslow, AInu or AInotnorm. Time periods for FIGS. 1-4 and 7 were 1a: 0-2 weeks after acute injury or nonunion diagnosis, 1b: 3-4 weeks, 2: 5-8 weeks, 3: 9-12 weeks, 4: 13-16 weeks, 5: 17-20 weeks, 6: 21-24 weeks, 7: 25 or more weeks. Fold differences were positive for lower expression in AInorm and negative for higher expression in AInorm.

Figure 2:
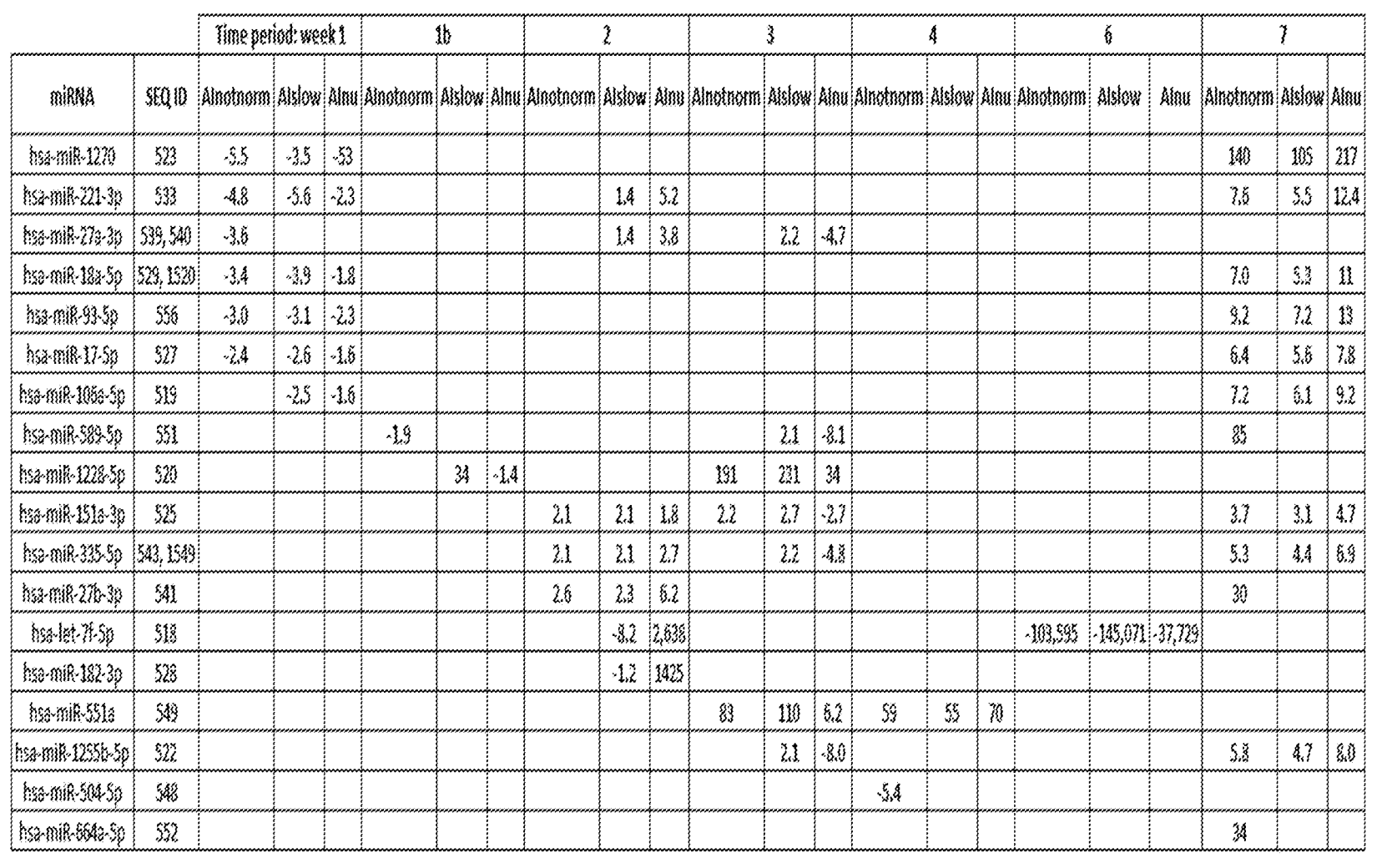

FIG. 2 is a table listing the fold-differences for blood microRNAs that were significantly different (ANOVA $p<0.05$) between AInorm and AIslow, AInu or AInotnorm.

FIG. 3 is a table listing mRNA or ncRNA abundance changes over healing time intervals. The ANOVA p-value indicates significance of difference between AInorm and AIslow for the observed changes between time periods. p 0.04, nonunion average fold-change 2.1 from 1a to 4 (n=3). p: ANOVA p-value, nc: no change with magnitude $>1.5\times$.

FIG. 4 is a table listing microRNA abundance changes over healing time intervals. nc: no change with magnitude $>1.5\times$.

FIG. 5 is a table listing microRNA detection rates across samples or subjects. The p-value is from a chi-square test for independent distributions in the outcome categories.

FIG. 6 is a table listing the fold-differences for blood RNAs in nonunion patients with slow or no healing relative to healed nonunion patients.

FIGS. 7A-7B are a series of tables listing protein biomarkers for healing ability with average abundance fold-differences that are greater than 1.5 in absolute magnitude compared to AInorm, and a significant difference by ANOVA ($p<0.05$). Protein expression levels were measured using the SOMAscan screening assay for serum. Values are the average of AIslow/AInorm or AInu/AInorm within time periods (negative indicates inverse ratio, AInorm higher), or log2 of average time 2, 3 or 4/1a for change over time intervals.

FIG. 8 is a table listing the number of subjects and blood RNA samples used for time course profiling of fracture healing by RT-qPCR. The time periods for FIGS. 8-12B were A: 0-2 weeks after acute injury or nonunion diagnosis, B: 3-4 weeks, C: 5-10 weeks, D: 11-16 weeks.

FIGS. 10A-10Q are a series of tables listing blood RNA biomarker RT-qPCR data for acute injury outcomes over four months of fracture healing. Values are shown if a difference met the ANOVA $p<0.05$ threshold. Values in standard format are from global normalization and are log2 of the ratios indicated in column headers. Values in scientific notation are from alternative analyses using reference gene normalization, subtraction of expression values rather than ratios to calculate difference, or both.

FIGS. 12A-12B are a series of tables listing blood RNA biomarker RT-qPCR data for nonunion outcomes over four months of healing after therapeutic intervention. Values are shown if a difference met the ANOVA p<0.05 threshold. Values in standard format are from global normalization and are log2 of the ratios indicated in column headers. Values in italics are from alternative analyses using reference gene normalization, subtraction of expression values rather than ratios to calculate difference, or both.

DETAILED DESCRIPTION OF THE INVENTION

Figure 9A:
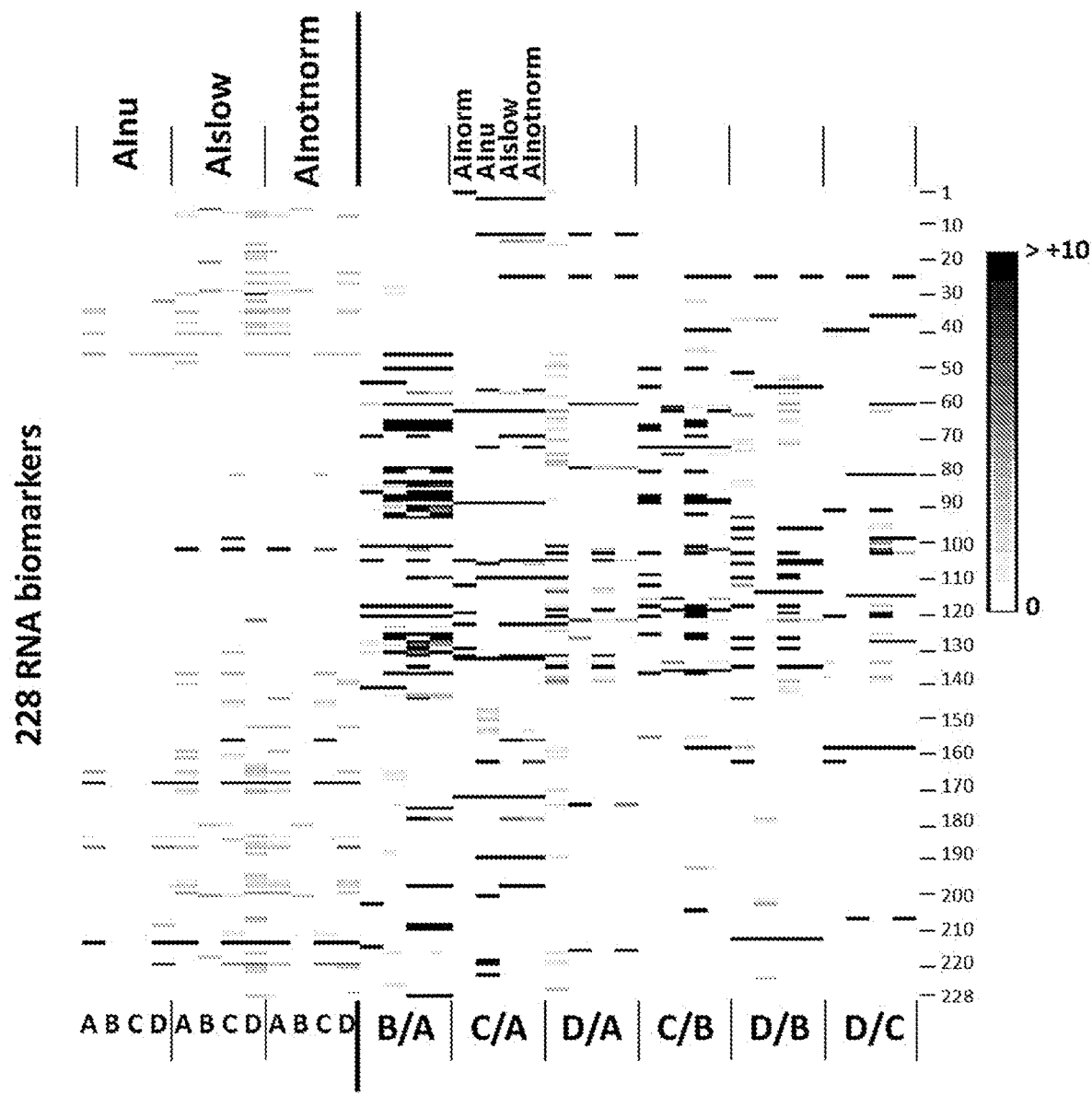
FIGS. 9A-9B are a set of heatmaps depicting blood RNA biomarker expression differences between acute injury outcomes over four months of fracture healing, measured by RT-qPCR. ANOVA was used to test for differences between AInorm patients and AInu, AIslow or AInotnorm patients during the four healing time periods A-D (left set of columns). Each row represents an RNA target (numbered on right, recited in FIGS. 10A-10Q), a shaded block is present if the target showed a statistically significant difference ($p<0.05$) compared to AInorm, and the shading levels (grayscale bars) represent the log2 ratio of the average difference with positive values for higher expression than in AInorm (FIG. 9A) and negative values for lower expression (FIG. 9B). Similar ANOVA testing was performed for expression changes between time periods (right set of columns). For each of the indicated time intervals (from A to B: B/A, and so forth), the average log2 ratio of change over time is shown for patients in each healing outcome category. A shaded block is present if the target's magnitude of change was significantly different ($p<0.05$) compared to AInorm (FIGS. 10A-10Q); positive values (FIG. 9A) are abundance increases from the earlier to later time period and negative values (FIG. 9B) are abundance decreases from earlier to later times.

The present invention relates to the discovery that the expression levels of certain RNA molecules, comprising messenger RNA (mRNA), non-coding RNA (ncRNA) and/or microRNA (miRNA), and protein can be used as a diagnostic signature to predict or monitor the bone healing ability in an acutely injured subject or in a subject undergoing treatment for a diagnosed nonunion. In various embodiments described herein, the invention relates to compositions useful for differentiating between a nonunion, slow healing, or normal healing of a fractured bone, methods using same, and treatment recommendations. The invention further includes a kit comprising candidate biomarkers for assessing the bone healing ability in an acutely injured or nonunion subject, thereby allowing the medical provider the ability to counsel and manage the patient in a more appropriate fashion.

The full disclosures of the priority documents U.S. Provisional Patent Application No. 62/231,935, filed Feb. 3, 2015, and U.S. Provisional Patent Application No. 62/283,443, filed Sep. 1, 2015, are incorporated by reference in their entireties herein.

Definitions

Unless defined otherwise, all technical and scientific terms used herein have the same meaning as commonly understood by one of ordinary skill in the art to which the invention pertains. Although any methods and materials similar or equivalent to those described herein may be used in the practice for testing of the present invention, specific materials and methods are described herein. In describing and claiming the present invention, the following terminology will be used.

It is also to be understood that the terminology used herein is for the purpose of describing particular embodiments only, and is not intended to be limiting.

As used herein, the articles "a" and "an" are used to refer to one or to more than one (i.e., to at least one) of the grammatical object of the article. By way of example, "an element" means one element or more than one element.

As used herein when referring to a measurable value such as an amount, a temporal duration, and the like, the term "about" is meant to encompass variations of ±20% or ±10%, more specifically ±5%, even more specifically ±1%, and still more specifically ±0.1% from the specified value, as such variations are appropriate to perform the disclosed methods.

As used herein, the term "acute injury" refers to the initial or primary bone fracture and the time period from 0-14 days after such fracture occurred.

As used herein, the term "AInorm" refers to biomarkers for acute injury that healed in a normal time (AInorm). As used herein, the term "AIslow" refers to biomarkers for acute injury that healed slowly (i.e., requiring more time than the normal time noted in the art; AIslow). As used herein, the term "AInu" refers to biomarkers for acute injury that did not significantly heal and was later diagnosed as a nonunion (AInu). As used herein, the term "AInotnorm" refers to biomarkers for acute injury which was either AIslow or AInu (AInotnorm).

The term "ameliorating" or "treating" means that the clinical signs and/or the symptoms associated with the disease or disorder are lessened as a result of the actions performed. The signs or symptoms to be monitored will be characteristic of a particular disease or disorder and will be well known to the skilled clinician, as will the methods for monitoring the signs and conditions.

As used herein the term "amount" refers to the abundance or quantity of a constituent in a mixture.

As used herein, the term "amplicon" or "PCR products" or "PCR fragments" or "amplification products" refers to extension products that comprise the primer and the newly synthesized copies of the target sequences.

As used herein, the term "biomarker" includes a polynucleotide or polypeptide molecule that is present or absent or increased or decreased in quantity or activity in subjects having the diseases or conditions contemplated herein as compared to subjects not affected with such diseases or conditions.

As used herein, the term "biomarkers for diagnosis" or "diagnosis signature" includes a group of markers such as mRNA or ncRNA or miRNA or protein, the quantity or activity of each member of which is correlated with subjects having the diseases or conditions contemplated herein as compared to subjects not affected with such diseases or conditions. In certain embodiments, the diagnosis signature may include only those markers. In certain embodiments, the signature includes one, two, three, four, five, six, seven, eight, or nine or more proteins or RNAs that may be mRNAs, ncRNAs, miRNAs or any combination of classes.

The term "biopsy" refers to a specimen obtained by removing tissue from living patients for diagnostic examination. The term includes aspiration biopsies, brush biopsies, chorionic villus biopsies, endoscopic biopsies, excision biopsies, needle biopsies (specimens obtained by removal by aspiration through an appropriate needle or trocar that pierces the skin, or the external surface of an organ, and into the underlying tissue to be examined), open biopsies, punch biopsies (trephine), shave biopsies, sponge biopsies, and wedge biopsies. Biopsies also include a fine needle aspiration biopsy, a minicore needle biopsy, and/or a conventional percutaneous core needle biopsy.

The term "concentration" refers to the abundance of a constituent divided by the total volume of a mixture. The term concentration can be applied to any kind of chemical mixture, but most frequently it refers to solutes and solvents in solutions.

As used herein, the term "control" refers to a nucleic acid or peptide with known or substantially non-varying concentrations throughout a set of samples.

The term "diagnosis" is used herein to refer to the identification or classification of a molecular or pathological state, disease or condition.

The term "expression" as used herein is defined as the transcription and/or translation of a particular nucleotide sequence.

"Level," "abundance" and "expression level" as used herein describe the absolute or relative concentrations of a biomarker in a sample, regardless of whether the synthesis or degradation of the biomarker occur in cells within the sample or occur in non-sampled cells, tissues or organs that subsequently release the biomarker into the sample.

The terms "dysregulated" and "dysregulation" as used herein describes a decreased (down-regulated) or increased (up-regulated) level of expression of an RNA or protein present and detected in a sample obtained from a subject as compared to the level of expression of that RNA or protein present in a reference sample, such as a reference sample obtained from one or more normal, not-at-risk subjects, or from the same subject at a different time point. In certain instances, the level of RNA or protein expression is compared with an average value obtained from more than one not-at-risk individuals. In other instances, the level of RNA or protein expression is compared with a RNA or protein level assessed in a sample obtained from one normal, not-at-risk subject.

"Differentially increased expression" or "upregulation" refers to expression levels which are at least 10% or more, for example, 20%, 30%, 40%, or 50%, 60%, 70%, 80%, 90% higher or more, and/or 1.1 fold. 1.2 fold, 1.4 fold, 1.6 fold, 1.8 fold, 2.0 fold higher or more, and any and all whole or partial increments therebetween, than a reference sample.

"Differentially decreased expression" or "down regulation" refers to expression levels which are at least 10% or more, for example, 20%, 30%, 40%, or 50%, 60%, 70%, 80%, 90% lower or less, and/or 2.0 fold, 1.8 fold, 1.6 fold, 1.4 fold, 1.2 fold, 1.1 fold or less lower, and any and all whole or partial increments therebetween, than a reference sample.

As used herein, "isolated" means altered or removed from the natural state through the actions, directly or indirectly, of a human being. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "measuring" according to the present invention relates to determining the amount or concentration, preferably semi-quantitatively or quantitatively. Measuring can be done directly and/or indirectly.

The terms "messenger RNA" and "message RNA" herein refer to RNA polynucleotides in which two or more consecutive portions of the sequence of bases are consistent with codons of the genetic code, and the polynucleotide is capable of being translated by ribosomes into a polypeptide. "Non-coding RNA" herein refers to all other RNA polynucleotides of any length that are not messenger RNA.

As used herein, "microRNA" or "miRNA" describes RNA molecules, generally about 15 to about 50 nucleotides in length, preferably 17-23 nucleotides, which can play a role in regulating gene expression through, for example, a process termed RNA interference (RNAi). RNAi describes a phenomenon whereby the presence of an RNA sequence that is complementary or antisense to a sequence in a target gene messenger RNA (mRNA) results in inhibition of expression of the target gene. miRNAs are processed from hairpin precursors of about 70 or more nucleotides (pre-miRNA) which are derived from primary transcripts (pri-miRNA) through sequential cleavage by RNase III enzymes.

The term "next-generation sequencing" (NGS), also known as high-throughput sequencing, is used herein to describe a number of different modem sequencing technologies that allow sequencing of DNA and RNA (as cDNA) templates much more quickly and cheaply than the previously used Sanger sequencing (Metzker, 2010, Nature Reviews Genetics 11.1: 31-46). It is based on micro- and nanotechnologies to reduce the size of sequencing reactions, leverage reagent costs across more templates and samples, and to enable massively parallel sequencing reactions. It can be highly multiplexed, allowing simultaneous sequencing and analysis of 96 or more samples. NGS includes first, second, third as well as subsequent next generation sequencing technologies.

As used herein, the term "nonunion" refers to bone fractures that fail to heal within six to nine months after the acute injury or have clinical signs and symptoms consistent with a nonunion. "Slow healing" is defined as successful healing reached after a prolonged period significantly longer than observed in a normal healing population of patients with the same type of bone fracture.

As used herein, the term "nonunion-mitigating intervention" refers to procedures that help fracture healing in nonunion subjects. Such interventions include for example nonsurgical interventions such as ultrasound and/or electrical stimulators and/or specialized braces, with intervals of watchful waiting. Invasive interventions further include revision surgery, surgical removal of dead tissue, insertion of internal brace (e.g., rod, plate or screw), insertion of bone graft, application of therapeutic drugs or biologics including but not limited to injection of one or more bone morphogenetic proteins (BMPs), amputation to prevent further injury, and/or application of orthobiologics.

As used herein, the term "NUhealed" refers to a nonunion subject who successfully healed after nonunion-mitigating intervention. "NUslow" refers to a nonunion subject who experienced no or slow healing after nonunion-mitigating intervention, By "nucleic acid" is meant any nucleic acid, whether composed of deoxyribonucleosides or ribonucleosides, and whether composed of phosphodiester linkages or modified linkages such as phosphodiester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil).

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "oligonucleotide" typically refers to short polynucleotides, generally no greater than about 60 nucleotides. It will be understood that when a nucleotide sequence is represented by a DNA sequence (i.e., A, T, G, C), this also includes an RNA sequence (i.e., A, U, G, C) in which "U" replaces "T".

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that may comprise a protein or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "polynucleotide" includes cDNA, RNA, DNA/RNA hybrid, anti-sense RNA, siRNA, miRNA, snoRNA, ncRNA, linc-RNA, snRNA, genomic DNA, synthetic forms, and mixed polymers, both sense and antisense strands, and may be chemically or biochemically modified to contain non-natural or derivatized, synthetic, or semisynthetic nucleotide bases. Also, included within the scope of the invention are alterations of a wild type or synthetic gene, including but not limited to deletion, insertion, substitution of one or more nucleotides, or fusion to other polynucleotide sequences.

Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

A "primer" is an oligonucleotide, usually of about 15, 20, 25, 30, 35, 40, 45 or 50 nucleotides in length, that is capable of hybridizing in a sequence specific fashion to the target sequence and being extended during the PCR.

As used herein, the term "reference" refers to a sample or set of samples used as a standard for comparison to a patient sample. Both reference samples and patient samples may contain control nucleic acids and peptides.

The term "RNA" as used herein is defined as ribonucleic acid.

The term "sample" or "biological sample" refers to a sample obtained from an organism or from components (e.g., cells) of an organism, A "sample" or "biological sample" as used herein means a biological material from a subject, including but is not limited to organ, tissue, exosome, blood, plasma, saliva, urine and other body fluid. A sample can be any source of material obtained from a subject.

A "subject" or "patient" as used herein may he a human or non-human mammal. Non-human mammals include, for example, livestock and pets, such as ovine, bovine, porcine, canine, feline and murine mammals. In certain embodiments, the subject is human.

The term "therapeutic" as used herein means a treatment and/or prophylaxis. A therapeutic effect is obtained by suppression, remission, or eradication of a disease state.

As used herein, to "treat" means reducing the frequency with which symptoms of a disease, disorder, or adverse condition, and the like, are experienced by a subject.

The term "treatment" as used within the context of the present invention is meant to include therapeutic treatment as well as prophylactic, or suppressive measures for the disease or disorder. Thus, for example, the term treatment includes the administration of an agent prior to or following the onset of a disease, condition or disorder thereby preventing or removing all signs of the disease, condition or disorder. As another example, administration of the agent after clinical manifestation of the disease to combat the symptoms of the disease comprises "treatment" of the disease.

As used herein, "10% greater" refers to expression levels that are at least 10% or more, for example, 20%, 30%, 40%, or 50%, 60%, 70%, 80%, 90% higher or more, and/or 1.1 fold, 1.2 fold, 1.4 fold, 1.6 fold, 1.8 fold, 2.0 fold higher or more, and any and all whole or partial increments there between, than a control or a reference sample.

As used herein, "10% lower" refers to expression levels that are at least 10% or more, for example, 20%, 30%, 40%, or 50%, 60%, 70%, 80%, 90% lower or more, and/or 1.1 fold, 1.2 fold, 1.4 fold, 1.6 fold, 1.8 fold, 2.0 fold lower or more, and any and all whole or partial increments there between, than a control or a reference sample.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6, and so forth, as well as individual numbers within that range, for example, 1, 2, 2.7, 3, 4, 5, 5.3, and 6. This applies regardless of the breadth of the range.

Description

The present invention relates to the discovery that the level of expression of certain RNA molecules, comprising messenger RNA (mRNA), non-coding RNA (ncRNA) and/or microRNA (miRNA), and certain proteins can be used as a diagnostic signature to predict or monitor the bone healing ability in an acutely injured subject. In certain embodiments, the level of expression of certain RNA molecules is used as a diagnostic signature to predict and/or monitor the bone healing ability in a nonunion subject.

In certain embodiments, the invention relates to a method of identifying a subject with a fractured bone as a candidate for nonunion-mitigating intervention, and/or an additional intervention, following a nonunion-mitigating intervention. In other embodiments, the method of the invention comprises: (a) comparing the level of at least one RNA in a sample from the subject to a baseline level of the at least one RNA in a reference sample, wherein a difference in level of the at least one RNA in the subject's sample as compared to the reference sample is indicative of a nonunion or slow healing of the fractured bone in the subject; and/or comparing the change of the level of at least one RNA between samples collected from the subject at two or more different times to a baseline change of the level of the at least one RNA in reference samples collected at different times, wherein a difference in the amount of change of the at least one RNA in the subject's samples as compared to the reference samples is indicative of a nonunion or slow healing of the fractured bone in the subject; and (b) recommending a nonunion-mitigating intervention for the subject.

In certain embodiments, the invention relates to a method of identifying a subject with a fractured bone as a candidate for nonunion-mitigating intervention, or an additional intervention following a nonunion-mitigating intervention. In other embodiments, the method of the invention comprises: (a) comparing the level of at least one protein in a sample from the subject to a baseline level of the at least one protein in a reference sample, wherein a difference in level of the at least one protein in the subject's sample as compared to the reference sample is indicative of a nonunion or slow healing of the fractured bone in the subject; and/or comparing the change of the level of at least one protein between samples collected from the subject at two or more different times to a baseline change of the level of the at least one protein in reference samples collected at different times, wherein a difference in the amount of change of the at least one protein in the subject's samples as compared to the reference samples is indicative of a nonunion or slow healing of the fractured bone in the subject; and (b) recommending a nonunion-mitigating intervention for the subject.

In certain embodiments, the invention relates to a method of detecting, predicting or monitoring the bone healing ability in an acutely injured subject. In other embodiments, the bone fracture healing is at least one selected from the group consisting of nonunion, slow healing, and normal healing. In yet other embodiments, the method of the invention comprises determining the level of expression of at least one RNA or protein in a sample from the subject. In yet other embodiments, the method of the invention comprises comparing the level of the at least one RNA or protein in the sample from the subject relative to a baseline level in a reference wherein a difference in the level of RNA or protein in the sample from the RNA or protein level in the reference is indicative of a nonunion, slow healing, or normal healing of the fractured bone. In yet other embodiments, the method of the invention comprises recommending and/or administering a treatment for the subject in need thereof.

In certain embodiments, the subject with nonunion or slow bone fracture healing is known or expected to be at risk of developing a poor (i.e., less than normal) bone healing ability. Non-limiting examples of risk factors associated with poor bone healing ability include lifestyle and health factors that may interfere with bone healing, such as smoking, excessive alcohol use, poor nutritional status, poor general health, fitness deficits, and diabetes; factors that may contribute to loss of bone strength, such as use of non-steroidal anti-inflammatory drugs (NSAID), use of immunosuppressive drugs, other drugs such as anticonvulsants, and the thyroid hormone replacement, thyroxine; type and site of fracture, such as fracture in a poorly vascularized site, instability at the fracture site, high energy trauma, and poor condition of the soft tissues around the bone; ancestry, such as individuals of European or Asian ancestry who have increased risk for osteoporosis; age, such as elderly individuals who are at increased risk for poor bone healing; women who have experienced early menopause, late menarche, or the loss of their ovaries.

In certain embodiments, the bone healing does not occur or initiate about 1, 2, 3, or 4 week(s) after injury. In other embodiments, the bone healing does not occur or initiate about 1, 2, 3, 4, 5, 6, 7, 8, 9, 10, 11 or 12 month(s) after injury. In yet other embodiments, the bone healing does not occur or initiate about 1 year or more after injury.

In certain aspects of the invention, the bone healing ability is assessed at one or more time periods often during or before the fourth month of healing.

In some embodiments, the treatments of the nonunion or slow healing fracture include, but are not limited to, non-invasive treatments such as electrical stimulation, ultrasound or specialized braces, and invasive measures, such as surgical removal of dead tissue, insertion of internal brace (e.g., rod, plate or screw), insertion of bone graft, application of therapeutic drugs or biologics including but not limited to injection of one or more bone morphogenetic proteins (BMPs), and/or amputation to prevent further injury.

Control and Reference Amounts of Expression of the RNA or Protein Marker(s):

The method of the invention includes comparing the measured amount of expression of a RNA biomarker(s) in a biological sample from a subject to a control amount of expression of another (i.e., a different) RNA marker(s) in the same biological sample from the same subject.

In certain embodiments, the RNA comprises a messenger RNA (mRNA) and/or non-coding RNA (ncRNA). In other embodiments, the RNA comprises a microRNA (miRNA).

In certain embodiments, the control amount of expression of the RNA is a value for expression of the RNA that is accepted in the art (e.g., spiked-in). Non-limiting examples of control RNA include GAPDH, TBP, β-actin, RNU6-6P (hsa-RNU6b) and/or miR-450a-5p.

In one aspect, the method of the invention includes comparing the measured amount of expression of a protein biomarker(s) in a biological sample from a subject to a control amount of expression of a different protein marker(s) in the same biological sample from the same subject.

In certain embodiments, the reference level of expression of the RNA(s) or protein(s) may be obtained by measuring the expression level of a RNA or a protein in a healthy subject. For example, the healthy subject may include a non-injured healthy subject. In certain embodiments, the healthy subject is a subject of similar age, gender, race as the acutely injured subject. In other embodiments, the healthy subject includes a bone injured subject with normal healing ability, as recognized in the art.

In certain embodiments, finding a deviation or no deviation of the biomarker RNA level between the measured RNA in the injured subject and the reference subject(s) allows attributing the deviation or no deviation to a particular diagnosis, prediction and/or prognosis of impaired bone fracture healing in the subject. In other embodiments, finding a deviation or no deviation of the protein biomarker level is similarly used for diagnosis, prediction and/or prognosis of impaired bone fracture healing in the subject. The method may also be performed for a subject at two or more successive time points; the respective outcomes at said successive time points may be compared, whereby the presence or absence of a change between the diagnosis, prediction and/or prognosis of impaired fracture healing at said successive time points is determined. When so applied, the method can monitor a change in the diagnosis, prediction and/or prognosis of the fracture healing in the subject over time.

Figure 9B:
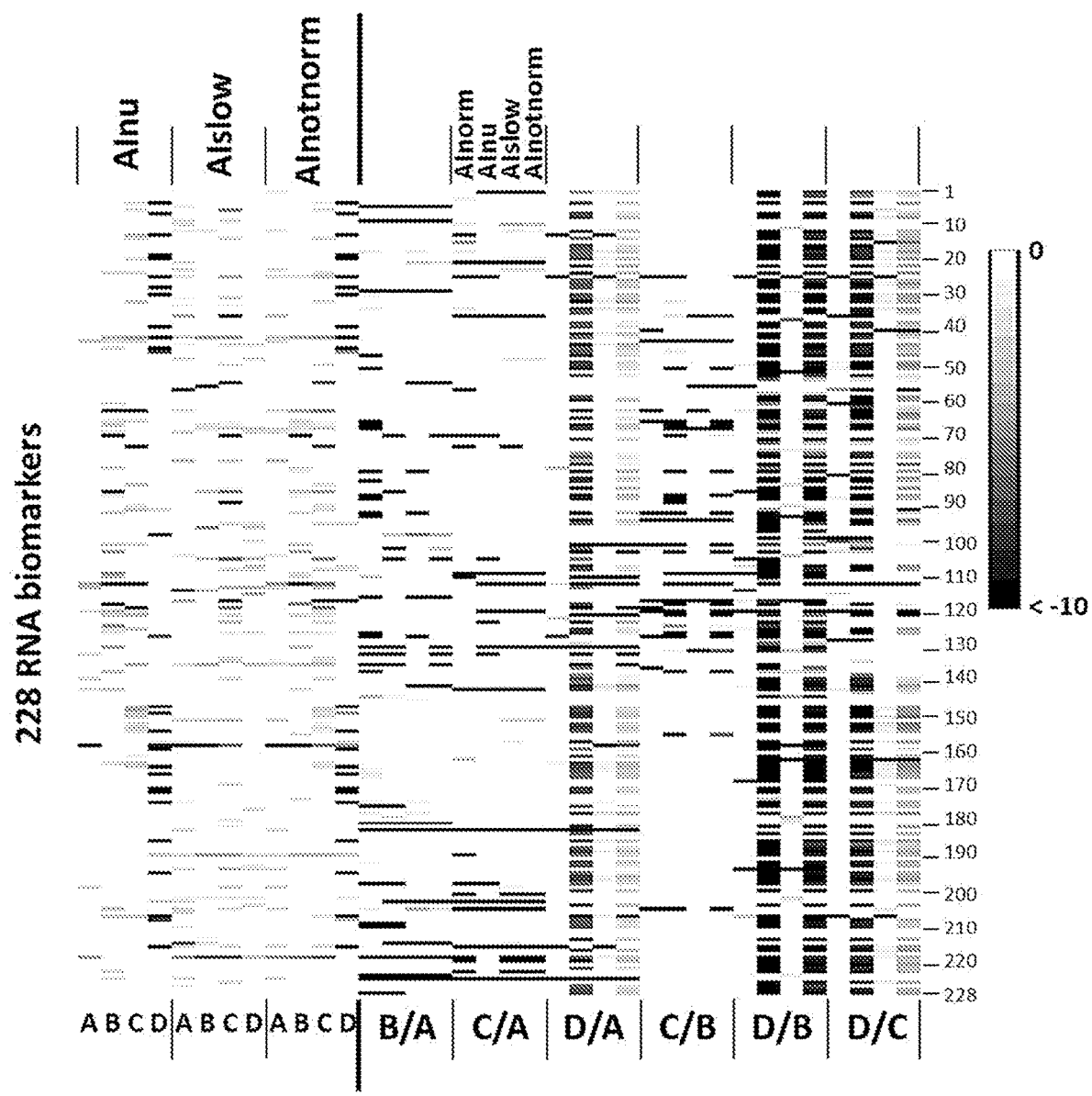
Figures 11A, 11B:
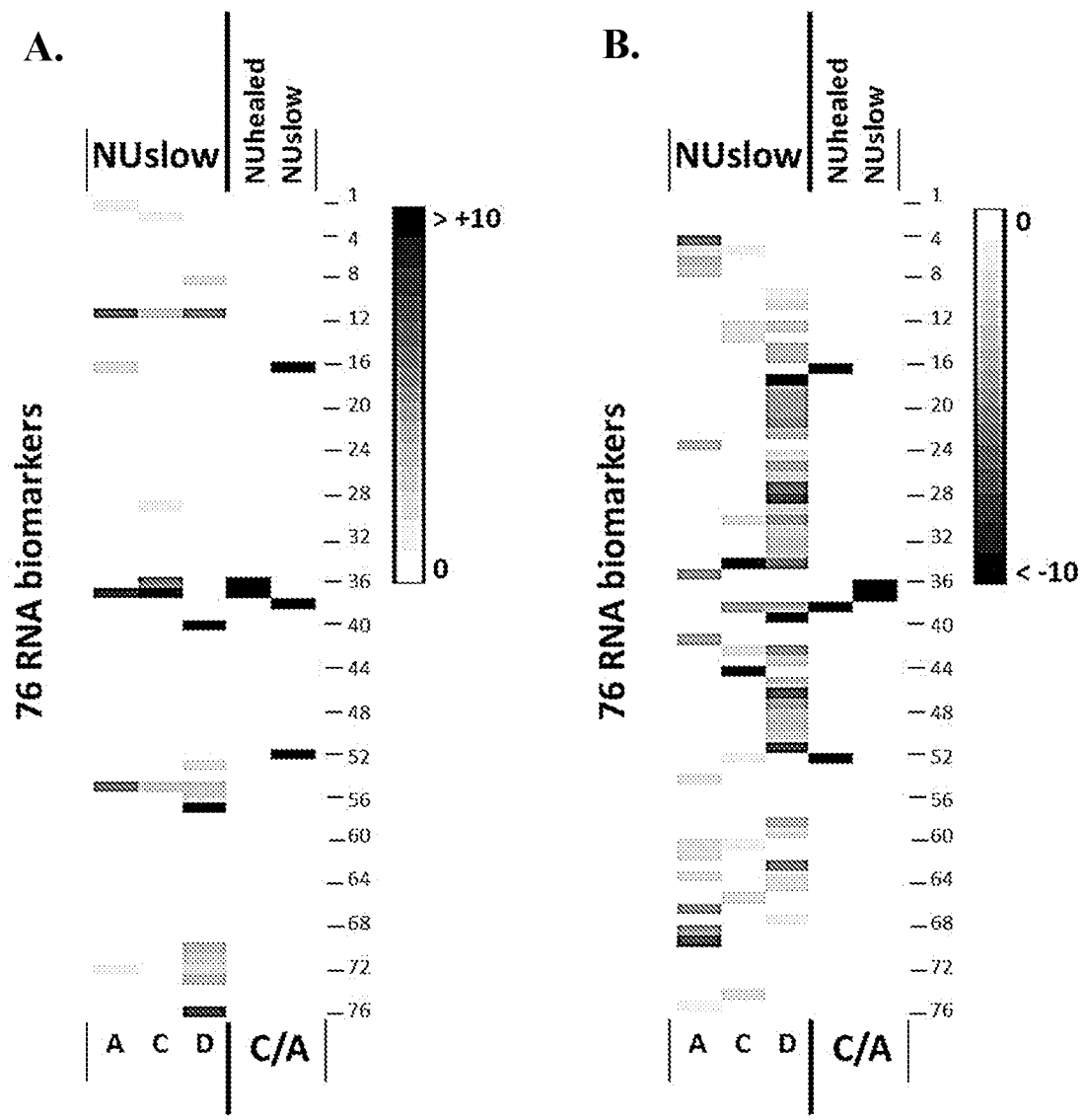
FIGS. 11A-11B are a set of heatmaps illustrating blood RNA biomarker expression differences between nonunion outcomes over four months of healing after therapeutic intervention, measured by RT-qPCR. All methods and the data presentation are as described for FIGS. 9A-9B. Significant differences within time periods (left columns) are shown for NUslow compared to NUhealed. Significant differences in magnitudes of change between time periods A to C are shown in the right columns. Row numbers refer to RNA biomarkers recited in FIGS. 12A-12B.

In certain embodiments, a deviation of the quantity of at least one RNA biomarker, as for example recited in FIGS. 9A-12B, in a sample from a subject, as compared to a reference value representing the prediction or diagnosis of a healthy subject or with normal healing ability, can be indicative of the subject's nonunion or slow healing ability.

In certain embodiments, a deviation of the quantity of at least one RNA biomarker as recited in FIGS. 1-6 (as well as in FIGS. 7-12, 16, and 18-24 of U.S. Provisional Patent Application No. 62/283,443, filed Sep. 1, 2015), in a sample from a subject, as compared to a reference value representing the prediction or diagnosis of a healthy subject or with normal healing ability, can be indicative of the subject's nonunion or slow healing ability.

In certain embodiments, a deviation of the quantity of at least one protein biomarker as recited in FIGS. 7A-7B (as well as in FIGS. 31-48 and 168-170 of U.S. Provisional Patent Application No. 62/283,443), in a sample from a subject, as compared to a reference value representing the prediction or diagnosis of a healthy subject or with normal healing ability, can be indicative of the subject's nonunion or slow healing ability. In other embodiments, the absence of such deviation from the reference value representing the prediction or diagnosis of bone fracture healing can be indicative of a good prognosis for bone fracture healing in the subject. In yet other embodiments, the presence or absence of such deviation allows determining whether a subject is or is not respectively in need of a therapeutic or prophylactic treatment of nonunion or slow fracture healing.

Comparison of the Measured Amount of Expression of the RNA or Protein Marker for Detecting, Predicting or Monitoring the Bone Healing Ability:

The method includes comparing the measured amount of expression of the RNA or protein to the reference amount of expression of the RNA or protein. A measured or reference RNA or protein amount may be an absolute quantitation of RNA molecules or protein, or may be a relative quantitation to one or more control RNA or protein levels.

In certain embodiments, the RNA marker is a mRNA, ncRNA and/or a miRNA selected from FIGS. 10A-10Q and 12A-12B. In other embodiments, the RNA marker is a mRNA, ncRNA and/or a miRNA selected from FIGS. 1-6 (as well as FIGS. 7-12, 16, and 18-24 in U.S. Provisional Patent Application No. 62/283,443). In yet other embodiments, the RNA marker is at least one selected from the group consisting of SEQ ID NOs: 1-556, as recited in FIGS. 26 and 27 of U.S. Provisional Patent Application No. 62/283,443. In yet other embodiments, the RNA marker is at least one selected from the group consisting of SEQ ID NOs: 1-1684 and 1830-1838 (as recited in FIGS. 26, 27, 163 and 164 in U.S. Provisional Patent Application No. 62/283,443). In yet other embodiments, the at least one RNA is a mRNA or a ncRNA selected from the group consisting of SEQ ID NOs: 1-515, 557-1471 (as recited in FIGS. 26 and 163 in U.S. Provisional Patent Application No. 62/283,443), and 1838. In yet other embodiments, the at least one RNA is a miRNA selected from the group consisting of SEQ ID NOs: 516-556, 1472-1684 (as recited in FIGS. 27 and 164 in U.S. Provisional Patent Application No. 62/283,443), and 1830-1837.

In certain embodiments, the RNA marker used to differentiate between a slow healing and normal healing or between a nonunion and normal healing is at least one selected from the group consisting of SEQ ID NOs: 1, 2, 4-7, 24, 53, 64 75, 78, 89, 103, 104, 109, 126, 132, 134, 189, 191, 194, 219, 222, 228, 239, 270, 279, 283, 290, 291, 293, 299, 344, 347, 349, 371, 388, 400, 401, 413, 442, 449, 459, 471, 512, 516, 518, 519, 520, 522, 523, 525, 527-529, 531, 533, 534, 539, 541, 543, 548-552, 556, 562, 572, 582, 599, 618, 652, 653, 655, 656, 698, 702, 703, 722, 814, 844, 864, 885, 889, 914, 938, 954, 966, 985, 996, 1054, 1074, 1126, 1153, 1154, 1286, 1501, 1512, 1515, 1526, 1528, 1529, 1542, 1546-1548, 1555, 1561, 1562, 1568, 1584, 1597, 1605, 1607, 1610, 1627, 1637, 1649, 1652, 1662, 1665, 1677, 1832, 1834-1836, and 1838. In other embodiments, the level of expression of the RNA marker representative of nonunion, slow healing or normal healing after acute injury is a least 1.1-fold higher or lower than the level of the corresponding reference RNA.

In certain embodiments, the differential expression of at least one RNA selected from the group consisting of SEQ NOs: 5, 24, 103, 126, 194, 219, 239, 290, 347, 349, 449, 520, 562, 572, 582, 599, 618, 652, 653, 655, 656, 698, 722, 844, 885, 914, 938, 954, 966, 996, 1054, 1074, 1153, 1154, 1286, 1512, 1528, 1542, 1546, 1561, 1562, 1584, 1605, 1607, 1610, 1627, 1637 and 1662, and the level of the at least one RNA being at least 1.1-fold higher or lower than the level of the RNA in the reference, indicates nonunion, slow healing or normal healing after acute injury.

In certain embodiments, the differential expression of at least one RNA selected from the group consisting of SEQ ID NOs: 1, 2, 4-7, 53, 64, 75, 78, 89, 104, 109, 126, 132, 134, 189, 191, 194, 222, 228, 239, 270, 279, 283, 290, 291, 293, 344, 347, 349, 371, 388, 400, 401, 413, 442, 449, 459, 471 and 512, and the level of the at least one RNA being at least 1.1-fold higher or lower than the level of the RNA in the reference, indicates nonunion, slow healing or normal healing after acute injury.

In certain embodiments, the differential expression of at least one RNA selected from the group consisting of SEQ ID NOs: 518, 519, 520, 522, 523, 525, 527-529, 531, 533, 539, 541, 543, 548-552 and 556, and the level of the at least one RNA being at least 1.1-fold higher or lower than the level of the RNA in the reference, indicates nonunion, slow healing or normal healing after acute injury.

In certain embodiments, the differential expression of at least one RNA selected from the group consisting of SEQ ID NOs: 24, 103, 219, 290, 347, 349, 449, 520, 562, 572, 582, 599, 652, 653, 655, 656, 698, 722, 844, 885, 938, 954, 966, 996, 1054, 1074, 1154, 1512, 1528, 1542, 1546, 1584, 1605 and 1637, and the change of level between two times of the at least one RNA being at least 1.1-fold higher or lower than the change of level between two times of the RNA in the reference, indicates nonunion, slow healing or normal healing after acute injury.

In certain embodiments, the differential expression of at least one RNA selected from the group consisting of SEQ ID NOs: 1, 2, 4, 7, 53, 75, 78, 89, 109, 126, 132, 134, 189, 191, 194, 222, 239, 270, 279, 290, 291, 347, 349, 388, 401, 442, 471 and 512, and the change of level between two times of the at least one RNA being at least 1.1-fold higher or lower than the change of level between two times of the RNA in the reference, indicates nonunion, slow healing or normal healing after acute injury.

In other embodiments, the differential expression of at least one RNA selected from the group consisting of SEQ ID NOs: 518, 520, 522, 523, 528, 529, 531, 533 and 548-552, and the change of level between two times of the at least one RNA being at least 1.1-fold higher or lower than the change of level between two times of the RNA in the reference, indicates nonunion, slow healing or normal healing after acute injury.

In yet further embodiments, the measured presence or absence of at least one RNA selected from the group consisting of SEQ ID NOs: 194, 518, 520 and 528 indicates nonunion, slow healing or normal healing after acute injury.

In certain embodiments, the RNA marker used to differentiate between slow healing or successful healing after a nonunion-mitigating intervention is at least one selected from the group consisting of SEQ ID NOs: 5, 109, 270, 283, 299, 344, 349, 371, 516, 534, 618, 702, 703, 814, 864, 889, 966, 985, 996, 1074, 1126, 1501, 1515, 1526, 1528, 1529, 1547, 1548, 1555, 1561, 1568, 1597, 1607, 1637, 1649, 1652, 1665, 1677, 1832, 1834, 1835, 1836 and 1838, and the level of the at least one RNA being at least 1.1-fold higher or lower than the level of the RNA in the reference indicates slow or no healing or successful healing.

In certain embodiments, the RNA marker used to differentiate between slow healing or successful healing after a nonunion-mitigating intervention is at least one selected from the group consisting of SEQ ID NOs: 2, 4, 53, 75, 109, 126, 222, 344, 349, 371, 388, 413 and 528. In other embodiments, the level of expression of the RNA marker representative of slow healing or successful healing after a nonunion-mitigating intervention is a least 1.1-fold higher or lower than the level of the corresponding reference RNA.

In certain embodiments, the differential expression of at least one RNA selected from the group consisting of SEQ ID NOs: 283, 516, 864, 966, 1548 and 1561, and the change of level between two times of the at least one RNA being at least 1.1-fold higher or lower than the change of level between two times of the RNA in the reference, indicates no or slow healing, or successful healing, after a nonunion-mitigating intervention.

In some embodiments, the RNA marker used to differentiate between acute injury or no injury is at least one selected from the group consisting of SEQ ID NOs: 8-556. In other embodiments, the level of expression of the RNA marker representative of acute injury or no injury is a least 1.1-fold higher or lower than the level of the corresponding reference RNA.

In certain embodiments, the RNA marker used to differentiate between nonunion, and no injury is at least one selected from the group consisting of SEQ ID NOs: 8, 10, 12, 13, 15, 16, 18, 19-23, 26, 29, 30-33, 35-37, 41, 43, 44, 46, 48-52, 54-56, 61, 63-65, 67-69, 73, 74, 77-79, 81, 82, 86, 88-92, 95-102, 104, 106, 107, 108, 110, 119-122, 126-128, 130-132, 134, 135, 137, 139, 140, 144, 147-150, 152, 156-158, 161, 162, 167-170, 172, 175, 179-183, 187-201, 203-207, 209-212, 215, 216, 217, 218, 220, 222-228, 231-237, 239, 240, 242, 247, 249, 251-253, 256, 258-266, 268-273, 275-277, 279, 280, 283, 285, 286, 288, 291, 293, 295-306, 308, 310, 311, 321, 322, 324, 327, 331, 333, 335, 338-341, 343, 347, 348, 352, 354, 357, 358, 364, 365, 367, 371, 372, 375. 378, 383, 386, 388, 390, 396-401, 403, 404. 407, 408, 415, 417, 420, 421, 423, 425, 428, 431, 433-435, 438, 441, 442, 444, 446-449, 451, 453, 454, 459, 461, 462, 467, 472, 474-478, 480, 486, 487, 495, 496, 497, 500, 502, 503, 505, 506, 508, 510, 511, 513-515, 519, 520, 525, 527-530, 533 and 556. In other embodiments, the level of expression of the RNA marker representative of nonunion and no injury is a least 1.1-fold higher or lower than the level of the corresponding reference RNA.

In certain embodiments, the RNA marker used to differentiate between acute injury and no injury or between nonunion and no injury is at least one selected from the group consisting of SEQ ID NOs: 25, 53, 58, 105, 124, 143, 229, 289, 290, 292, 309, 328, 332, 334, 336, 344, 349, 385, 405, 406, 422, 471, 489 and 512. In other embodiments, the level of expression of the RNA marker representative of acute injury or nonunion differentiated from no injury is a least 1.1-fold higher or lower than the level of the corresponding reference RNA.

In certain embodiments, the protein marker is at least one selected from the group consisting of SEQ ID NOs: 1685-1829 (FIGS. 7A-7B, as well as FIG. 165 in U.S. Provisional Patent Application No. 62/283,443), in other embodiments, the protein marker is at least one selected from the group consisting of BDNF, CGA/TSHB, TIMP1, GPC5, LYVE1, NGF, APOA1, IL20, PYY. GAS1, CASP2, TGFB2, LEPR, ESAM, IFNA2, PDE7A, CXCL2/CXCL3, GZMCB2, MMP1, CTSA, HSPA8, VWF, CXCL6, and FAM107A (as recited in FIG. 168 in U.S. Provisional Patent Application No. 62/283,443), wherein the at least one protein is from a sample collected 2 weeks or less after bone fracture and is indicative of a slow healing of the fractured bone in the subject. In yet other embodiments, the protein marker is at least one selected from the group consisting of BDNF, CGA/TSFIB, CST5, TIMP1, LDHB, FGF23, GPC5, LYVE1, FGF4, PGLYRP1, NCF, ICAM3, PTK6, C2, APOA1 and RETN (as recited in FIG. 169 in U.S. Provisional Patent Application No. 62/283,443), wherein the at least one protein is from a sample collected 2 weeks or less after bone fracture and is indicative of a nonunion of the fractured bone in the subject. In yet other embodiments, the protein marker is at least one selected from the group consisting of FGFR3, EPHA1, FCN2, CAST, IGHG1/IGHG2/IGHG3/IGHG4, DSG2, IL12RB1, TNFRSF13C, FCGR2A/FCGR2B, CD209, SPOCK2, PGD, TGFBI, NGF, AMHR2, ACY1, CCL15, FGF8, IL1RAPL2, FCRL3, OMD, TNFRS14, AMR NTN4, GP6, C1S, TNF, SLC25A18, LIN7B, PRLR, SPINT2, DMP1, FGF23, PLG, EREG, TNFRS17 and PRSS3 (as recited in FIG. 170 in U.S. Provisional Patent Application No. 62/283,443), wherein the at least one protein is from a sample collected 3-4 months after bone fracture and is indicative of a nonunion of the fractured bone in the subject. In yet other embodiments, the protein marker is at least one selected from the group consisting of LDHB, NGF, GPC5 and LYVE1 (as recited in FIGS. 34, 38 and 48 in U.S. Provisional Patent Application No. 62/283,443), wherein the at least one protein is from two or more samples collected at different times from the same subject, and the change in protein expression between times is indicative of normal healing, slow healing or nonunion in the subject when compared to the protein expression change in a normal healing reference.

In certain aspects of the present invention, the level of RNA or protein expression is determined for at least one RNA in a sample obtained from a subject. The sample can be a fluid sample such as a blood sample, blood sample containing peripheral blood mononuclear cells (PBMCs), a blood serum sample, a urine sample, a stool sample, a sample from biological fluid gathered from an anatomic area in proximity to the fractured bone, and biological fluid from fractured bone, or any other body fluid in addition to those recited herein. In certain embodiments, the sample can be cultured osteoblastic cells or mesenchymal stem cells obtained from the subject. The RNA or protein biomarkers may be measured in primary and/or further (e.g., secondary, tertiary, and so forth) cultures of the cells. These cells may be obtained from the site of the nonunion or slow healing fractured bone in the subject, or from a site distant from the nonunion or slow healing fractured bone.

Any method known to those in the art can be employed for determining the level of RNA expression. For example, a microarray can be used (e.g. Affymetrix GeneChip microarray). Microarrays are known in the art and consist of a surface to which probes that correspond in sequence to gene products (e.g. mRNAs, polypeptides, fragments thereof and so forth) can be specifically hybridized or bound to a known position. To detect at least one RNA of interest, a hybridization sample is formed by contacting the test sample with at least one nucleic acid probe. One probe for detecting RNA is a labeled nucleic acid probe capable of hybridizing to RNA. The nucleic acid probe can be, for example, a full-length nucleic acid molecule, or a portion thereof, such as an oligonucleotide of at least 10, 15, or 20 nucleotides in length and sufficient to specifically hybridize under stringent conditions to appropriate RNA. The hybridization sample is maintained under conditions which are sufficient to allow specific hybridization of the nucleic acid probe to a RNA target of interest. Specific hybridization can be performed under high stringency conditions or moderate stringency conditions, as appropriate. In certain embodiments, the hybridization conditions for specific hybridization are high stringency. Specific hybridization, if present, is then detected using standard methods. If specific hybridization occurs between the nucleic acid probe and a RNA in the test sample, the sequence that is present in the nucleic acid probe is also present in the RNA of the subject. More than one nucleic acid probe can also be used. Hybridization intensity data detected by the scanner are automatically acquired and processed by microarray softwares (e.g. MAS, RMA). Raw data is normalized to expression levels using a given target intensity. An alternate method to measure RNA expression profiles of a small number of different genes is by e.g. classical TaqMan® Gene Expression Assays, TaqMan® Low Density Array-micro fluidic cards (Applied Biosystems), or any quantitative PCR (qPCR) system known in the art. The transcriptional state of a sample, particularly RNAs, may also be measured by other nucleic acid expression technologies known in the art.

In certain embodiments, the RNAs, such as mRNAs and miRNAs, are detected in a sample from the subject under examination. Any method known to those in the art can be employed for determining the level of RNAs (particularly, the mRNAs, ncRNAs and miRNAs provided herein in FIGS. 1-6 and 9A-12B, as well as FIGS. 7-12, 16, and 18-24 in U.S. Provisional Patent Application No. 62/283,443). RNA can be isolated from the sample using any method known to those in the art. Non-limiting examples include commercial kits, such as the miRNeasy® commercially available from Qiagen (Netherlands) or the Mini Kit TRI Reagent® commercially available from Molecular Research Center, Inc. (Cincinnati, Ohio).

Generally, the isolated RNA may be amplified using methods known in the art. Amplification systems utilizing, for example, PCR or RT-PCR methodologies, are known to those skilled in the art. For a general overview of amplification technology, see, for example, Dieffenbach et al., PCR Primer: A Laboratory Manual, Cold Spring Harbor Laboratory Press, New York (1995).

An alternative method for determining the level of RNAs includes the use of molecular beacons and other labeled probes useful in, for example multiplex PCR. In a multiplex PCR assay, one PCR mixture contains primers and probes to amplify and detect multiple selected mRNAs, ncRNAs or miRNAs. Typically, different fluorochromes are used to discriminate each RNA's PCR product in the assay. The molecular beacon or probe is detected to determine the level of RNA. Molecular beacons are described, for example, by Tyagi and Kramer (Nature Biotechnology 1996; 14, 303-308) and by Andrus and Nichols (U.S. Patent Application Publication No. 20040053284).

Another accurate method for profiling RNA expression can be the use of next generation sequencing (NGS) including first, second, third as well as subsequent NGS technologies. Non-limiting examples could be the nanopore or semiconductor technologies (e.g. Oxford Nanopore Technologies, United Kingdom) or the Illumina RNA-Seq and micmRNA-Seq methodologies for HiSeq or MiSeq instruments (Chu and Corey, Nucleic Acid Ther. 2012; 22(4): 271-274; Luo, Methods Mol Biol. 2012; 822:183-8).

Any method known to those in the art can be employed for determining the level of protein. Methods for assaying for a protein include but are not limited to Western blot, immunoprecipitation, immunoassay, immunohistochemistry, immunofluorescence and radioimmunoassay. The proteins analyzed may be localized intracellularly (most commonly an application of immunohistochemistry) or extracellularly.

The identification of biomarkers of the present invention may be accomplished using various suitable assays. A suitable assay may include one or more of a chemical assay, an enzyme assay, an immunoassay, mass spectrometry, chromatography, electrophoresis, a biosensor, an antibody microarray or any combination thereof. Most commonly if an immunoassay is used it may be an enzyme-linked immunosorbant assay (ELISA), a sandwich assay, a competitive or a non-competitive assay, a radioimmunoassay (RIA), a lateral flow immunoassay, a Western Blot, an electro-chemilumescent assay, a magnetic particle assay, an immunoassay using a biosensor, a bead-based array assay (e.g. Luminex, Milliplex or Bioplex), a multiplex aptamer-based assay (e.g. SOMAscan), an immunoprecipitation assay, an agglutination assay, a turbidity assay or a nephelometric assay.

In certain embodiments, upregulation of RNA or protein level includes an increase above a baseline level of 1-, 2-, 3-, 4-, 5-, 6-, 7-, 8-, 9-, 10-, 11-, 12-, 13-, 14-, 15-, 16-, 17-, 18-, 19-, 20-fold, or more and any and all partial integers therebetween. In other embodiments, downregulation of RNA or protein level includes a decrease below a baseline level of 1-, 2-, 3-, 4-, 5-, 6-, 7-, 8-, 9-, 10-, 11-, 12-, 13-, 14-, 15-, 16-, 17-, 18-, 19-, 20-fold, or more and any and all partial integers therebetween.

In certain embodiments, the presence of at least one of the RNA or protein biom.arkers of the present invention allows a diagnosis or prognosis of bone healing ability with a sensitivity and/or specificity of at least 50%, at least 60%, at least 70%, at least 80%, at least 90%, at least 95% or at least 99%.

In certain embodiments, the level of expression is determined using log-transformed RNA or protein levels. The log transformation of RNA or protein levels substantially reduces the positive skew in the data. In certain embodiments, the level of expression is determined using log-transfortned RNA or protein levels relative to a normalizing RNA or protein level.

In certain embodiments, for interpretation of quantitative nucleic acid or protein expression measurements, a normalizer may be needed to correct expression data for differences in sample input, RNA or protein quality, reverse transcription (RT) efficiency, and other assay efficiencies between samples. In certain embodiments, to accurately assess whether increased or decreased RNA or protein is significantly different, the RNA or protein expression can be normalized to accurately compare levels of expression between samples, e.g., a control level is used to adjust the RNA or protein expression measurement. In quantitative assays, such as for example, reverse transcription quantitative real-time PCR (RT-qPCR), normalization can be performed using spiked-in markers or endogenous markers as controls for the expression level of a RNA under investigation. Normalization includes rendering the measurements of different arrays or PCR or in particular RT-qPCR experiments comparable by reducing or removing the technical variability. Within these experiments there exists a multiplicity of sources capable of falsifying the measurements. Possible technical sources of interference are: different efficiency in reverse transcription, labeling or hybridization reactions, as well as problems with the arrays, batch effects in reagents, or lab-specific conditions. By normalization a more robust detection of RNA expression can occur. Typically, RNA (mRNA, ncRNA or miRNA) normalization involves use of spiked-in markers that have known input abundances that are correlated to the observed fractional cycle number or detection threshold crossing point of an RT-qPCR assay. A spiked-in marker exhibits minimum change of abundance across different RNA samples and thus serves as a control for the technical sources of variation in measurements across different samples. RNA normalization may also involve the use of one or more endogenous RNAs that naturally occur in all subjects' samples. An endogenous control marker exhibits minimum change of abundance across RNA samples from normal, slow and nonunion healing abilities and thus serves as a control for the biological sources of variation in measurements across different samples, such as the subject's overall production of RNA and the efficiency of RNA extraction from the subject's samples. Multiple spiked-in markers, endogenous markers, or markers from both classes may be used separately or combined during the normalization adjustments of an RNA expression measurement.

In certain embodiments, to characterize the bone healing ability in an acutely injured subject, the level of RNA or protein expression in a sample taken from the subject is compared to a reference sample or set of samples by computational methods known to those skilled in the art. Non-limiting examples of computational and statistical methods comprise pairwise and multi-class ANOVA tests, Partek ANOVA t-tests and Extraction of Differential Gene Expression (EDGE) to test for statistically significant differences between the acutely injured subject and previously measured populations of subjects with normal, slow or nonunion healing ability.

In yet another aspect, the invention provides a score or composite score that can be used to characterize the bone healing ability in an acutely injured subject. In another aspect, the invention provides a score or composite score that can be used to characterize the bone healing ability in a nonunion subject before or after a nonunion-mitigating intervention, For example, the expression levels of at least 2 biomarkers in a sample taken from the subject are compared to the expression levels of the at least 2 biomarkers in one or more reference samples. The ratio of expression level of each biomarker in the subject's sample in relation to the reference sample(s) is then multiplied by an independently selected multiplying factor. The resulting values are combined as to arrive at the score or composite score useful to characterize the bone healing ability in the subject. The score or composite score may be derived from the same or different RNA or protein biomarkers measured at one or more times, from biomarker(s) change(s) between two or more times, or any combination thereof. The score or composite score may be indicative of AInorm, AIslow, AInu or AInotnorm healing ability after acute injury, or no or slow healing or successful healing before or after a nonunion-mitigating intervention.

Compositions:

In certain embodiments, the invention includes a set of preferred probes or primers, either labeled (e.g., fluorescer, quencher, and so forth) or unlabeled, that are useful for detecting or predicting or monitoring the ability of normal healing, slow healing or no healing of a fractured bone in a subject.

In certain embodiments, a plurality of RNAs is selected from the group consisting of SEQ ID NOs: 1, 2, 4-7, 24, 53, 64, 75, 78, 89, 103, 104, 109, 126, 132, 134, 189, 191, 194, 219, 222, 228, 239, 270, 279, 283, 290, 291, 293, 299, 344, 347, 349, 371, 388, 400, 401, 413, 442, 449, 459, 471, 512, 516, 518, 519, 520, 522, 523, 525, 527-529, 531, 533, 534, 539, 541, 543, 548-552, 556, 562, 572, 582, 599, 618, 652, 653, 655, 656, 698, 702, 703, 722, 814, 844, 864, 885, 889, 914, 938, 954, 966, 985, 996, 1054, 1074, 1126, 1153, 1154, 1286, 1501, 1512, 1515, 1526, 1528, 1529, 1542, 1546-1548, 1555, 1561, 1562, 1568, 1584, 1597, 1605, 1607, 1610, 1627, 1637, 1649, 1652, 1662, 1665, 1677, 1832, 1834-1836 and 1838. In other embodiments, a plurality of RNAs is selected from the group consisting of SEQ ID NOs: 1-1684 and 1830-1838. In yet other embodiments, a plurality of polypeptides (or proteins) is selected from the group consisting of SEQ ID NOs: 1685-1829.

In certain embodiments, specific probe sets comprise probes that are capable of detecting at least one RNA selected from the group consisting of SEQ ID NOs: 1, 2, 4-7, 24, 53, 64, 75, 78, 89, 103, 104, 109, 126, 132, 134, 189, 191, 194, 219, 222, 228, 239, 270, 279 283, 290, 291, 293, 299, 344, 347, 349, 371, 388, 400, 401, 413, 442, 449, 459, 471, 512, 516, 518, 519, 520, 522, 523, 525, 527-529, 531, 533, 534, 539, 541, 543, 548-552, 556, 562, 572, 582, 599, 618, 652, 653, 655, 656, 698, 702, 703, 722, 814, 844, 864, 885, 889, 914, 938, 954, 966, 985, 996, 1054, 1074, 1126, 1153, 1154, 1286, 1501, 1512, 1515, 1526, 1528, 1529, 1542, 1546-1548, 1555, 1561, 1562, 1568, 1584, 1597, 1605, 1607, 1610, 1627, 1637, 1649, 1652, 1662, 1665, 1677, 1832, 1834-1836 and 1838 for detecting or predicting or monitoring normal healing, slow healing or no healing of a fractured bone in a subject.

In certain embodiments, specific probe sets comprise probes that are capable of detecting at least one RNA selected from the group consisting of SEQ ID NOs: 1-1684 and 1830-1838.

In certain embodiments, a plurality of polypeptides (or proteins) selected from the aroup consisting of SEQ ID NOs: 1685-1829.

In yet other embodiments, the invention includes a set of preferred probes or primers, either labeled (e.g., fluorescer, quencher, and so forth) or unlabeled, that are useful for detecting or predicting or monitoring the ability of normal healing or slow healing of a nonunion fractured bone in a subject after a nonunion-mitigating treatment.

In certain embodiments, a plurality of RNAs is selected from the group consisting of SEQ ID NOs: 5, 109, 270, 283, 299, 344, 349, 371, 516, 534, 618, 702, 703, 814, 864, 889, 966, 985, 996, 1074, 1126, 1501, 1515, 1526, 1528, 1529, 1547, 1548, 1555, 1561, 1568, 1597, 1607, 1637, 1649, 1652, 1665, 1677, 1832, 1834, 1835, 1836 and 1838.

In other embodiments, specific probe sets comprise probes that are capable of detecting at least one RNA selected from the group consisting of SEQ ID NOs: 5, 109, 270, 283, 299, 344, 349, 371, 516, 534, 618, 702, 703, 814, 864, 889, 966, 985, 996, 1074, 1126 1501, 1515, 1526, 1528, 1529, 1547, 1548, 1555, 1561, 1568, 1597, 1607, 1637, 1649, 1652, 1665, 1677, 1832, 1834, 1835, 1836 and 1838 to measure the ability of normal healing or slow healing of a nonunion fractured bone in a subject after a nonunion-mitigating treatment.

In certain embodiments, the invention includes a set of preferred antibodies, RNA aptamers, or other protein binding molecules, either labeled or unlabeled, that are useful for detecting or predicting or monitoring the ability of normal healing, slow healing or no healing of a fractured bone in a subject.

In certain embodiments, a plurality of polypeptides or proteins is selected from the group consisting of ACY1, AMH, AMHR2, APOA1, BDNF, C1S, C2, CASP2, CAST, CCL15, CD209, CGA/TSHB, CST5, CTSA, CXCL2/CXCL3, CXCL6, DMP1, DSG2, EPHA1, EREG, ESAM, FAM107A, FCGR2A/FCGR2B, FCN2, FCRL3, FGF23, FGF4, FGF8, FGFR3, GAS1, GP6, GPC5, GZMCB2, HSPA8, ICAM3, IFNA2, IGHG1/IGHG2/IGHG3/IGHG4, IL12RB1, IL1RAPL2, IL20, LDHB, LEPR, LIN7B, LYVE1, MMP1, NCF, NGF, NTN4, OMD, PDE7A, PGD, PGLYRP1, PLG, PRLR, PRSS3, PTK6, PYY, RETN, SLC25A18, SPINT2, SPOCK2, TGFB2, TGFBI, TIMP1, TNF, TNFRS14, INFRS17, TNFRSF13C, and VWF.

In certain embodiments, a plurality of polypeptides or proteins is selected from the group consisting of ACY1, AMH, AMHR2, APOA1, BDNF, C1S, C2, CASP2, CAST, CCL15, CD209, CGA/TSHB, CST5, CTSA, CXCL2/CXCL3, CXCL6, DMP1, DSG2, EPHA1, EREG, ESAM, FAM107A, FCGR2A/FCGR2B, FCN2, FCRL3, FGF23, FGF4, FGF8, FGFR3, GAS1, GP6, GPC5, GZMCB2, HSPA8, ICAM3, IFNA2, IGHG1/IGHG2/IGHG3/IGHG4, IL12RB1, IL1RAPL2, IL20, LDHB, LEPR, LIN7B, LYVE1, MMP1, NCF, NGF, NTN4, OMD, PDE7A, PGD, PGLYRP1, PLG, PRLR, PRSS3, PTK6, PYY, RETN, SLC25A18, SPINT2, SPOCK2, TGFB2, TGFBI, TIMP1, TNF, TNFRS14, TNFRS17, TNFRSF13C, and VWF.

Kits

In certain embodiments, kits are provided. Commercially available kits for use in these methods are, in view of this specification, known to those of skill in the art. In general, kits will comprise a detection reagent that is suitable for detecting the presence of a polypeptide or nucleic acid, or RNA of interest.

In other embodiments, there is a panel of probe sets. Preferred probe sets are designed to detect expression of one or more RNAs or protein and provide information about the bone healing ability in an acutely injured subject. Probe sets are particularly useful because they are smaller and cheaper than probe sets that are intended to detect as many mRNAs, ncRNAs, miRNAs and proteins as possible in a particular genome. The probe sets are targeted at the detection of mRNAs, ncRNAs, miRNAs and proteins that are informative about diagnosis or prediction of normal, slow or no bone healing ability in an acutely injured subject. Probe sets may also comprise a large or small number of probes that detect RNAs or proteins that are not informative about bone healing ability in an acutely injured subject. Such probes are useful as controls and for normalization (e.g., spiked-in and endogenous markers). Probe sets may be a dry mixture or a mixture in solution. In certain embodiments, probe sets can be affixed to a solid substrate to form an array of probes. It is anticipated that probe sets may also be useful for multiplex PCR. The probes may be nucleic acids (e.g., DNA, RNA, chemically modified forms of DNA and RNA), LNAs (locked nucleic acids), or PNAs (peptide nucleic acids), amino acids, peptides, antibodies or any other polymeric compound capable of specifically interacting with the desired nucleic acid or amino acid sequences.

It is contemplated that kits may be designed for isolating and/or detecting RNA or protein in essentially any sample (e.g. blood, urine, and so forth), and a wide variety of reagents and methods are, in view of this specification, known in the art.

Those skilled in the art will recognize, or be able to ascertain using no more than routine experimentation, numerous equivalents to the specific procedures, embodiments, claims, and examples described herein. Such equivalents were considered to be within the scope of this invention and covered by the claims appended hereto. For example, it should be understood, that modifications in reaction conditions, including but not limited to reaction times, reaction size/volume, and experimental reagents, such as solvents, catalysts, pressures, atmospheric conditions, e.g., nitrogen atmosphere, and reducing/oxidizing agents, with art-recognized alternatives and using no more than routine experimentation, are within the scope of the present application.

It is to be understood that wherever values and ranges are provided herein, all values and ranges encompassed by these values and ranges, are meant to be encompassed within the scope of the present invention. Moreover, all values that fall within these ranges, as well as the upper or lower limits of a range of values, are also contemplated by the present application.

The following examples further illustrate aspects of the present invention. However, they are in no way a limitation of the teachings or disclosure of the present invention as set forth herein.

EXAMPLES

The invention is now described with reference to the following Examples. These Examples are provided for the purpose of illustration only and the invention should in no way be construed as being limited to these Examples, but rather should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

The materials and methods employed in the experiments disclosed herein are now described.

Materials and Methods

Patient Enrollment:

Patients in the University of Pennsylvania Orthopaedic Trauma and Fracture Service, and healthy volunteers, were evaluated for inclusion/exclusion criteria and enrolled in an ongoing study approved by the Penn Institutional Review Board. Adult skeletally mature human subjects (age 18 or older) from three clinical categories (healthy, acute injury, and chronic nonunion) were recruited for this investigation. Healthy subjects were eligible if they had not suffered a fracture within 12 months of enrollment, and any prior fracture had healed completely in a normal time period. Acute injury subjects who underwent an inpatient stay provided blood samples once per day for up to 10 days while hospitalized, and nonunion subjects were enrolled and provided samples upon diagnosis. Additional blood samples from the same patients were collected during follow-up clinical visits.

RNA Extraction:

Whole blood collected in PAXgene Blood RNA tubes was processed according to the vendor's protocol (PreAnalytiX/Qiagen, Valencia Calif., USA) for purification of total RNA including miRNA. RNA quality and quantity were assessed by spectrophotometry, fluorometry (Qubit RNA HS, Life Technologies, Grand Island N.Y., USA) and Bioanalyzer RNA LabChips (Agilent Technologies, Santa Clara Calif., USA).

RNA Profiling by Microarrays:

RNA assays were conducted according to the vendors' instructions in the Penn Molecular Profiling Facility. Transcriptome amplification was perthrmed with 50 ng of total RNA using the Ovation WT Pico kit (NuGEN Technologies, San Carlos Calif., USA), providing linear expansion of all transcripts without interference from ribosomal or globin RNAs. The resulting cDNA was labeled with biotin and hybridized to Human Gene 2.0ST Arrays (Affymetrix, Santa Clara Calif., USA). Separately, 500 ng of total RNA was labeled with biotin using the FlashTag Biotin HSR kit (Affymetrix) for miRNA hybridization to GeneChip miRNA 4.0 Arrays (Affymetrix).

Microarray Data Analysis:

mRNA and miRNA data sets were independently analyzed using Partek Genomics Suite (Partek, St. Louis Mo., USA).

After normalization by the RMA algorithm (Irizarry et al., Biostatistics 2003; 4 (2):249-264) and log2 transformation, pairwise and multi-class ANOVA tests with multiple testing correction were used to identify ilaicroarray probesets that displayed differences between each clinical condition: acute injury which healed in a normal time (AInorm), healed slowly (AIslow), or did not heal and was later diagnosed as a nonunion (AInu). Thresholds for designating a difference as statistically significant were a p-value less than 0.05 and absolute value of signal fold-difference greater than 1.5. Normalized data outputs from the SomaScan serum protein assay (SomaLogic, Boulder Colo., USA) were similarly analyzed using Partek Genomics Suite. Gene lists were analyzed for enrichment of biological process categories using DAVID tools (Huang da et al., NatProtoc 2009; 4 (1):44-57; Huang da et al., Nucleic Acids Res 2009; 37 (1):1-13).

Protein Profiling:

Whole blood collected in BD Vacutainer Serum Separation Tubes (Fisher Scientific, Pittsburgh Pa., USA) was processed according to the manufacturer's instructions and the aliquoted serum samples were flash frozen before storage at −80° C. Serum samples were submitted to Soma-Logic, Inc. (Boulder Colo., USA) for protein screening using the SOMAscan assay (www.somalogic.com). Normalized data outputs from the SOMAscan assay were analyzed using Partek Genomics Suite using the same statistical approach described for microarray data.

Biomarker Panel Development:

Development of custom RNA biomarker panels and methods for high-throughput RT-qPCR screening are described in Baldwin et al. (J. Biomol. Tech. 2016; in press). Microarray data were analyzed for differential RNA expression between patients in different clinical categories. Biomarker candidates were ranked by false discovery rate adjusted p-values after multi-class ANOVA, and included 30 long mRNAs, 12 long noncoding RNAs, 22 microRNAs, and 5 short noncoding RNAs. The "short" class includes small nuclear and nucleolar RNAs (snRNA, snoRNA) that are typically longer than microRNAs and can be reverse transcribed by random priming. Two endogenous reference targets were added to the panel, human TBP for mRNA and RNU6-6P for short RNA, as well as two synthetic spike-in references, lacZ in *E. coli* plasmid pUC19 (New England BioLabs, Ipswich Mass., USA) and an oligonucleotide for human miRNA hsa-miR-450a-5p (IDT Integrated DNA Technologies, Coralville Iowa, USA). miR-450a-5p was chosen as a synthetic reference because it had not been detected in any of the blood RNA samples screened by microarrays. For RT-qPCR detection of the 73 targets, 60 TaqMan assays were ordered (Thermo Fisher Scientific) and 13 custom primer pairs with hydrolysis probes incorporating 5' 6-FAM/ZEN and 3' Iowa Black fluorescence quencher were synthesized (IDT).

Reverse Transcription:

These and subsequent reactions were assembled in 8-tube strips or 96-well plates by multi-channel pipetting, and performed in a PTC 225 Tetrad Thermal Cycler (MJ Research, now Bio-Rad Laboratories, Hercules Calif., USA). Long RNA targets were reverse transcribed by random priming, using up to 750 ng of total RNA and the High Capacity cDNA Reverse Transcription Kit (4374966, Thermo Fisher Scientific). A reaction master mix was assembled and added to each RNA sample along with sufficient water for a final volume of 10 ul, followed by incubation in a thermal cycler at 25° C. for 10 min, 37° C. for 120 min, 85° C. for 5 min and hold at 4° C. A no-template control (long NTC) that contained no RNA was included among these reverse transcription reactions.

miRNA targets were reverse transcribed with a pool of the RT primers taken from TaqMan Small RNA Assays (Thermo Fisher Scientific) and up to 350 ng of total RNA using the TaqMan MicroRNA Reverse Transcription Kit (4366596, Thermo Fisher Scientific). A reaction master mix was assembled, spiked with 0.05 fmole/reaction synthetic miR-450a-5p, and added to each RNA sample along with sufficient water for a final volume of 12 ul. Reactions were held on ice for at least 5 min, followed by incubation in a thermal cycler at 16° C. for 30 min, 42° C. for 30 min, 85° C. for 5 min and hold at 4° C. A micro-NTC that contained no sample RNA was included among these reverse transcription reactions. cDNA products from long and short RNA reverse transcription were stored at −20° C.

Pre-Assay cDNA Amplification:

Custom synthesized primer and probe oligonucleotides were combined in TE buffer to create assay mixes for each target, containing 18 uM of each of the two primers and 5 uM of the hydrolysis probe (equivalent to a 20× TaqMan assay mix). A diluted primer pool was created (also containing probes) by combining 10 ul of each long RNA assay and 6 ul of each miRNA assay for all targets in the panel. The resulting concentration of each assay was determined, and used to calculate the dilution factor necessary for a final concentration of 0.05× for long RNA primers and 0.03× for miRNA primers. cDNA amplifications were performed in 7 ul reactions using TaqMan PreAmp Master Mix (Thermo Fisher Scientific), 1.1 ul of the primer pool, 1.2 ul of long cDNA or reverse transcription long NTC and 1.2 ul of micro-cDNA or reverse transcription micro-NTC. The thermal cycler program was 95° C. for 10 min, 55° C. for 2 min and 72° C., for 2 min, followed by 15 cycles of 95° C. for 15 sec and 60° C. for 4 min, and completed with 99.9° C. for 10 min and hold at 4° C. A 5 ul aliquot of the amplification product was archived at −20° C. The remaining 2 ul were mixed with 29 pg of pUC19 (2 ul), and 16 ul of TE buffer was added to dilute the amplified cDNA 1:10 before storage at −20° C.

Quantitative PCR:

Real-time, quantitative fluorescence detection of PCR products was performed in a Fluidigm system consisting of a BioMark HD instrument, IFC MX and HX Controllers, and 48×48 or 96×96 Dynamic Arrays using the manufacturer's protocols for standard TaqMan assays (PN 68000089 H1, 68000130 D1 and 68000088 J1, Fluidigm, South San Francisco Calif., USA). A pilot 48×48 array (Fluidigm integrated fluidic circuit, IFC) tested a subset of the target panel, 47 amplified cDNA samples, and one NTC from pre-assay amplification. A set of 285 amplified cDNA samples (including the pilot 47, IFC 2-4), and a subsequent set of 631 amplified cDNA samples (including all previous samples, IFC 5-25), were assayed on 96×96 arrays with an NTC on each array. Assays on these arrays included "panel 1": the pilot 48 target panel supplemented with 25 additional candidate RNA biomarkers (IFC 5-11), or a separate "panel 2" of 192 candidate RNA biomarkers (IFC 12-25).

RT-qPCR Data Analysis:

BioMark HD data processing parameters were Linear (Derivative) for the baseline correction method and Auto (Global) for the Ct threshold method, software version 4.1.3. Technical performance was assessed using the Ct Value column from BioMark HD output tables (rawCt). RawCt values of 38 or higher were designated as no detection. Targets with rawCt<38 in at least 90% of cDNA samples were designated as consistently detected. Biomarker expression was normalized to reference genes by the ΔCt method (normCt) (Schmittgen T D and Livak K J, Nat Protoc 2008; 3 (6):1101-1108) and transfotmed to linear scale before statistical testing. ANOVA t-tests in Partek Genomics Suite (Partek, St. Louis Mo., USA) were used to test for likelihood of differences between healing outcome classes, and the significance threshold was set at 0.05 for unadjusted p-values and the stepup false discovery rate (FDR, an adjusted p-value incorporating multiple test correction).

The results of the experiments are now described in the following examples.

Example 1: Patient Demographics and Clinical Outcomes

Study enrollments include 127 acute injury (AI) subjects admitted to the hospital for bone fracture(s), 35 nonunion (NU) patients diagnosed with little to no healing of a fracture that occurred six to nine months before entering the study, and 56 healthy volunteers (HV). Subject age, gender, race/ethnicity and fracture locations are summarized in FIG. 17 in U.S. Provisional Patent Application No. 62/283,443. Approximately 64% of AI patients healed their fractures in a normal time (AI norm), while 7% reached a clinical diagnosis of nonunion (AI nu). The remaining 29% of AI subjects have been classified as slow healers (AI slow) that either resolved their fracture after substantially delayed healing or continue in the study with ongoing monitoring for suspected nonunion. Healing outcomes for NU patients after diagnosis and therapy for nonunion included successful healing (NUhealed) or no or slow healing (NUslow).

Example 2: Global RNA Screening to Identify Panel 1 Biomarkers

As a preliminary screen to characterize blood samples obtained soon after the study was opened, microarray hybridizations were performed to quantify the expression levels of all annotated human genes and microRNAs. Multiple samples from each of seven AI patients and two NU patients were used, along with samples from two of the AI patients taken after their fractures had healed. The resulting RNA profiles were compared to blood RNA expression levels in 23 HV. Principal component analysis indicated that summarized mRNA expression patterns distinguish AI and NU samples from HV, and post-healing samples from AI patients produced profiles more like HV than the within-subject counterparts collected soon after fracture (FIG. 1A in U.S. Provisional Patent Application No. 62/283,443). Global miRNA profiles did not separate AI from HV samples, but NU samples formed a clearly distinct cluster (FIG. 1B in U.S. Provisional Patent Application No. 62/283,443).

Multi-class and pairwise ANOVA with correction for multiple testing was used to identify RNAs with significantly different blood expression levels in the microarray data sets. At a fold-difference threshold of 1.5 and false discovery rate <10%, 508 mRNAs were altered in samples from AI only, AI and NU, or NU only compared to HV (FIGS. 18-20 in U.S. Provisional Patent Application No. 62/283,443).

A similar data analysis strategy was used for miRNA array data, and identified 34 miRNAs that were differentially expressed in AI only or NU only compared to HV (FIGS. 22-23 in U.S. Provisional Patent Application No. 62/283, 443).

As predicted by principal components analysis, the lists of AI and NU genes that are significantly different from HV include a shared but small subset, and the AI and NU micmRNA sets have no overlap (FIG. 1C in U.S. Provisional Patent Application No. 62/283,443). No RNAs from the healed fracture samples were significantly different from HV. Lists of AI and NU candidate biomarker mRNAs derived with a higher significance threshold (false discovery rate <5%) were used for over-representation analysis of Gene Ontology biological process categories. Seventeen biological processes are enriched with statistical significance among the biomarker mRNA annotations, and the process categories are for the most part unique to AI or NU. Acute injury genes are predominantly involved in immune and wound responses, while nonunion genes are distributed into more generalized categories for macromolecular metabolism and transport (FIG. 25 in U.S. Provisional Patent Application No. 62/283,443).

Example 3: Healing Time Course Profiling of Panel 1 RNA Biomarkers

The preliminary microarray screening produced three classes of potential biomarkers: AI-only, which are over- or under-expressed compared to HV in the week following fracture, may return to HV levels with healing, and may show delayed changes in patients with slow or no healing; NU-only, which are not different from HV immediately after injury but become different at some later time, perhaps only in nonunion cases, and AI+NU, which are different from HV after injury and may have divergent expression profiles during normal vs. slow/no healing. Candidate RNA biomarkers were therefore selected for RT-gPCR profiling of AI blood prospectively collected throughout the healing time course.

Blood samples from 88 AI subjects who were not included in the microarray screening (FIG. 17 in U.S. Provisional Patent Application No. 62/283,443) generated 240 RNA samples distributed over seven or more months of healing and divided into eight time periods (FIG. 2A in U.S. Provisional Patent Application No. 62/283,443). Subject enrollments and fracture locations were evenly distributed across calendar months and weather seasons (FIG. 13A-13B in U.S. Provisional Patent Application No. 62/283,443). To control for variations in input RNA and reaction efficiency, each RT-qPCR assay was normalized to endogenous TBP mRNA levels or RNU6-6P short RNA levels in each sample. Samples were also spiked with synthetic templates for the *E. coli* lacZ gene and human miR-450a-5p, a microRNA not detected by microarrays in any of the previously profiled blood samples. RT-qPCR data for these four controls showed no significant differences across time or between subject categories which would introduce artifactual changes in normalized biomarker profiles (FIG. 2B in U.S. Provisional Patent Application No. 62/283,443). The multi-class ANOVA p-values for differences between time periods or patient outcomes, or a time and outcome interaction, were respectively 0.98, 0.77 and 0.47 for TBP, 0.84, 0.62 and 0.34 for lacZ, 0.85, 0.58 and 0.50 for RNU6-6P, and 0.83, 0.68 and 0.19 for miR-450a-5p.

Data for 47 mRNAs and 27 miRNAs were tested by ANOVA in two analysis strategies. First, average expression levels were calculated for all AI norm, AIslow and AInu samples within a time period and tested for significant differences (p<0.05) between AI outcome categories. A second analysis was performed by determining the within-subject change in expression over various time intervals, calculating the average change across patients in each AI category, and testing each time interval for significant differences between categories. Test results were then summarized in plots of average expression levels (normalized cycle threshold, Ctn) at each time period for AInorm and AIslow (linear scale fold-difference=2^[Ctn difference]). Six AI patients, five of whom provided samples during more than one time period, were later diagnosed with nonunions, and individual data points for these AI nu samples were overlayed on the summary plots (FIGS. 3-4 in U.S. Provisional Patent Application No. 62/283,443). Some candidate biomarkers showed significant differences early or late in the time course (reflecting the design of the microarray screening experiment), but had generally similar profiles over healing time. However, 37 mRNAs (FIG. 1) and 18 miRNAs (FIG. 2) were differentially expressed between AI slow and AI norm at one or more time periods, often during or before the fourth month of healing. Some of these RNAs were also different in AI nu compared to AI norm at time periods 1a, 4 or 7 (which had sufficient AI nu samples to power ANOVA tests), and ARPP19 and several miRNAs could discriminate AI nu from AI slow.

Many RNA expression levels naturally vary across the human population, so averages within a healing time period may be difficult to translate into prognostic biomarkers applicable to individual patients if their baseline expression starts at an outlier value. Within-subject between-time analyses control for such variation by measuring the direction and magnitude of change, metrics that are independent of the expression levels' distances from population averages. Each patient's RNA expression changes were measured over a variety of time intervals, and the average fold-change was calculated for each subject category. Twenty-eight mRNAs changed during one or more intervals in the first four months of healing and had average changes that were significantly different comparing AInorm to AIslow (FIG. 3). FIG. 4 describes a similar analysis fiver miRNAs, five of which had different profiles in AInorm vs. AIslow within the first three months of healing. Overall expression behavior across a time course can be modeled using spline-based methods (Storey et al., Proc Natl Acad Sci USA 2005; 102 (36):12837-12842), so the EDGE analysis tool was applied to test for profile differences between AInorm and AIslow. Five mRNAs (IL2RB, FAM83A, LDHB, IRF8, IFIT1B) and two miRNAs (hsa-miR-1255b-5p, hsa-miR-664a-5p) were significantly different with EDGE p-values ranging from 0.014 to 0.052.

Examination of the profile summary graphs for all RNAs tested revealed notable patterns. Average mRNA levels for ANKRD22, ANXA3 and LDHB appear to cycle between low and high amounts over time in AI norm, and the cycle phasing is offset by one to two months in AI slow. The RNA from which the miR-29 precursor stem-loop is cleaved was consistently elevated in AIslow and AInu compared to AInorm, and its mature product hsa-miR-29a-3p was detected at higher levels in AI than HV by microarrays (FIG. 22 in U.S. Provisional Patent Application No. 62/283,443). Other mature miRNAs such as hsa-miR-1270 and hsa-miR-18a-5p were significantly different between AIslow and AInorm at early time periods, and had diminished or missing changes in AIslow during the time intervals that showed more dynamic expression in AInorm. Three miRNAs, hsa-let-7f-5p, hsa-miR-1228-5p and hsa-miR-182-3p, demonstrated large and sustained differences between AIslow and AInorm and/or large differences between AInu and AInorm. The average values for these miRNAs were heavily influenced by lack of detection at any measurable amount in a number of blood samples, suggesting "on or off" expression states. The data were therefore transformed into binary classes of detected (at any level) or undetected for each sample, and subjects were similarly classified by detection (in at least one sample from any time) or no detection. Chi-square tests were then performed for differences in the outcome distributions of these binary classes (FIG. 5). Detection rates for miR-182-3p were significantly different (p<0.05) in all AI subjects vs. HV, but significance was lost at the sample level because most AI subjects had expression in only one or a few of their samples. Subjects and samples were both significantly different between AInorm and AIslow for miR-1228-5p detection, with expression occurring more often in AIslow. Detection rates were not as dramatically different among samples for hsa-let-7f-5p and detection occurred more often in AInorm, but all AI subjects combined were much more likely to show let-7f expression than were HV.

Biomarker panel 1 targets were also measured by RT-qPCR in fracture patients after they were diagnosed with nonunion and received an initial therapeutic intervention. Twelve mRNAs and one miRNA were expressed at significantly different levels in blood from NUslow subjects compared to NUhealed subjects (FIG. 6).

The average AInorm expression levels for sixteen miRNAs produced time course profiles that share an "M" shape, centered around healing month four (FIG. 5 in U.S. Provisional Patent Application No. 62/283,443). While individual miRNAs have different magnitudes of change, the general pattern suggests early increases of expression between time periods 1a and 1b, followed by reductions to levels at or below the starting point, and then a second increase/decrease cycle around time period 6. The "M" profiles are flattened in AIslow, with early increases that persist into months two and three and overall expression levels that remain elevated relative to their starting points.

Example 4: Interpretation and Use of Panel 1 RNA Biomarkers

Interpretation of long-term time course data collected from human subjects can be challenging due to the many environmental, genetic and epigenetic variables that may affect a phenotype, and due to the inability to control, or even account for, these variables. Blood RNA biomarkers that appear to cycle in abundance with periodicities of one or more months were observed. Circadian rhythm genes are perhaps the best-characterized time-related molecular system in humans, but most patient samples were drawn during appointments scheduled throughout normal business hours on weekdays and this system seems unlikely to have influenced the fracture healing biomarkers. The menstrual cycle roughly operates with monthly periodicity, but no gender effect was observed in data analyses and synchronized menstruation among AInorm patients but different from AIslow patients is also unlikely. The sole synchronizing event experienced by all of the AI patients was bone fracture, and the fractures occurred throughout the range of seasonal conditions typical for the Northeast region. If fracture healing outcomes were influenced by season (e.g. ice slip and fall, reduced exercise in winter, organized sports schedules), the dates of injury and healing might be biased toward different months among AInorm vs. AIslow, but this was not observed (FIG. 13A in U.S. Provisional Patent Application No. 62/283,443). The months in which blood samples were drawn also appear to have similar distributions for AI norm and AI slow (FIG. 13B in U.S. Provisional Patent Application No. 62/283,443), as do gender, age and race (FIG. 17 in U.S. Provisional Patent Application No. 62/283,443).

RNA biomarker candidates were chosen after microarray screening of blood samples taken soon after injury or after chronic non-healing compared to healthy volunteers. RT-qPCR time course profiling mostly confirmed differences from the HV average at time periods 1a or 7, but expression levels across time were within the same range observed for HV. This might be expected for RNAs that naturally cycle; a group of randomly sampled, unsynchronized HV should produce levels that reflect the cycle's amplitude range, and the difference between AInorm and AIslow is less due to aberrant magnitudes of expression and more influenced by altered timing after injury. Other RNAs (ANKRD22 and ANXA3 in AInu, miR-182-3p in all AI) had expression levels outside the HV range and may reflect injury-specific responses. Without wishing to be limited by any theory, in either case, altered tuning or induced/repressed expression may be the result of transcription regulation mechanisms that could be investigated by promoter analyses of the genes reported here. Without wishing to be limited by any theory, miRNAs may also be subject to regulatory events that coordinate expression after fracture, including precursor transcript production, splicing and maturation, and perhaps release into blood as extracellular RNA. Without wishing to be limited by any theory, one or more of these mechanisms may be altered in patients who heal slowly, and for some RNAs it appears that nonunion is a condition distinct from both normal and slow healing.

Time course profiling of miR-27a-3p confirmed that early expression in AInorm and AIslow was higher than in HY and indicated that during healing week 1, miR-27a-3p was lower in AIslow than in AInorm but became higher than AInorm in months 2 and 3 (FIG. 2). The miR-23a-27a-24-2 cluster inhibits osteoblast differentiation, so the initial induction observed in response to injury may repress normal osteoblast differentiation, allowing a pool of precursor cells to accumulate and be recruited to the fracture site. Subsequent drops in miR-27a-3p levels would release this repression and promote differentiation at the fracture where osteoblasts are needed, and this process is delayed or attenuated in slow healers. Similarly, miR-93-5p inhibits osteoblast differentiation and showed less expression in AIslow than AInorm at week 1 but greater expression in month 7.

This invention is the first to prospectively profile patients' blood RNA collected during the bone fracture healing time course. The resulting candidate biomarkers for rate of healing can now be examined for prognostic efficacy, whether individually, in combined biomarker panels, or integrated with other biochemical or clinical metrics. For example, discrimination of AIslow from AInorm is demonstrated using a score that combines LDHB and ANXA3 expression measures (FIG. 6A in U.S. Provisional Patent Application No. 62/283,443). This score incorporates within-patient changes in expression over time, an attractive strategy that avoids comparison of a patient's data to the population averages of unrelated people. However, comparisons of averages can also be useful, especially for biomarkers that exhibit detected/undetected states and as shown for the combination of pre-miR-29 and miR-1228-5p to discriminate AI nu from AI norm (FIG. 6B in U.S. Provisional Patent Application No. 62/283,443). The utility of the candidate biomarkers may extend to related applications; RT-qPCR profiling of NU at enrollment and after revision therapy suggests that a score combining ANXA3 and miR-182-3p expression levels can discriminate nonunion patients who will heal their fractures from those who will continue to experience slow or no healing (FIGS. 6C-6D in U.S. Provisional Patent Application No. 62/283,443).

Orthopaedic genomics studies and the availability of RNA or protein biomarkers should improve test performance, as would integration with clinical measures (for example hospital length-of-stay for AI, FIG. 17 in U.S. Provisional Patent Application No. 62/283,443) and advanced imaging. The biomarkers of the present invention allow an early assessment of risk for nonunion, especially those with signals within the first two months of healing, and offer a means to more rapidly evaluate how well new drugs or therapeutic treatments are promoting positive healing outcomes.

Example 5: Global RNA and Protein Screening to Identify Panel 2 Biomarkers

RNA and proteins circulating in blood were prospectively collected from patients with recent fractures, and screened for differences between subjects who healed normally and those who showed delayed healing or were later diagnosed with nonunion. Twenty-four serum samples from 12 subjects were tested, as were 51 RNA samples from 21 subjects. Twenty-five serum proteins, 213 microRNAs, and 915 mRNAs (857 genes) were identified by SomaLogic SOMAscan protein profiling or Affymetrix GeneChip microarray RNA profiling respectively. The biomarkers exhibited differences between patient outcomes within one or more healing times, and/or differences in the abundance changes that occur between healing times. See FIG. 7, as well as U.S. Provisional Patent Application No. 62/231,935 and U.S. Provisional Patent Application No. 62/283,443, for further details on the data and annotations of these biomarkers.

Example 6: Healing Time Course Profiling of Panel 2 RNA Biomarkers

Reverse transcription quantitative PCR (RT-qPCR) was completed for a subset of candidate RNA biomarkers discovered by microarray screening described herein. These results used an independent measurement method to confirm the differences in blood RNA abundances between fracture healing outcomes initially observed by microarray assays, and extended the findings to additional patient samples. RT-qPCR assays for 122 mRNAs, 18 long noncoding RNAs, 7 short noncoding RNAs, and 111 microRNAs were performed on each of the blood RNA samples recited in FIG. 8.

Of the 258 biomarker RNAs tested, 234 showed a significant difference in at least one relevant healing outcome comparison: AInorm vs. AIslow, AInorm vs. AInu, or NUhealed vs. NUslow. Differences were observed for various subsets of biomarkers within each time period, and in the magnitudes by which biomarker levels changed between time periods (FIGS. 9A-12B). In certain embodiments, the remaining 24 RNAs, other microarray RNAs not tested by RT-qPCR, and serum proteins recited in U.S. Provisional Patent Application Nos. 62/231,935 and 62/283,443 are further candidate biomarkers. In other embodiments, these are added to the diagnostic test panel to replace the primary biomarkers listed in this example.

RNA expression measurements were normalized by two methods. In the first approach, the average of all qPCR signals for all detected targets across all samples was determined, and each target's signal within a sample was multiplied by a scale factor that adjusted the sample's average to the global average. This method provides a robust normalization that is not sensitive to fluctuations in a reference gene, but requires a sufficiently large number of target measurements per sample and may be less effective for diagnostic testing of individual samples and a limited target panel. The second approach was normalization of long RNA signals to the endogenous reference gene TBP and of microRNA signals to the synthetic spike-in reference hsa-miR-450a-5p. This more traditional method of qPCR normalization can increase measurement noise due to fluctuations of the reference analyte and differences in qPCR amplification efficiency, but provides a within-sample normalization that can be applied each time an individual diagnostic test is performed. For the large majority of results described here, the two normalization methods produced similar data.

Two hundred twenty-eight RNAs showed blood expression differences among acute injury patients (FIGS. 9A-10Q). Seventy-six RNAs showed blood expression differences among diagnosed nonunion patients, (FIGS. 11A-12B), of which 71 were in common with the acute injury biomarkers.

The disclosures of each and every patent, patent application, and publication cited herein are hereby incorporated herein by reference in their entireties.

While the present invention has been disclosed with reference to specific embodiments, it is apparent that other embodiments and variations of the present invention may be devised by others skilled in the art without departing from the true spirit and scope of the invention. The appended claims are intended to be construed to include all such embodiments and equivalent variations.

SEQUENCE LISTING (1838 sequences)

SEQ ID NO: 1 - RNA, 1491 nt, Homo Sapiens
ggggaaguuugggaggaaggcuucugagaagacuggugggagagaaggagagccugcagacagaggccuccagcuuggaggaaaagcuuucggacugcugaaggcccagcaggaagagaggcuggaugagaucaacaagcaauuccuagacgaucccaaauauagcagugaugaggaucugcccuccaaacuggaaggcuucaaaggugagggggaaacuguaggcgguggagacagggcuggggguaggaggguuaggauuuccacaagaacaaggcaggaacagcagagauaaaaaguuuacuuuugugguagcaaaaggggaaccugccuuuauugcccuccugccacacugcggucccuuucccgggccugccucucucagcauccccucuagcuccuuacacccuagcggggccccucaacuccccaaccccacuuccucugccugccccuccuccuccuuccacguugucuccuccaccuagcaguugguuggcaaccccuuccucaguccccugcugaaaacccuccagucagcgcuuaucccuucugcucucuccccucacccagagaaauacauggaguuugaccuuaauggaaauggcgauauuggugagaaacgggugauuugcgggggcaggguggugugcaggccuaagaagacagaggucucuccuacaugcuccauuccucaugauuugggagggggcccaccuaccacagugggaggaaggagaauggggaugcggaagugggagaggagagagagggucuccccaccuucuccccauccccauccucugcccccagauaucaugucccugaaacgaaugcuggagaaacuuggaguccccaagacucaccuagagcuaaagaaauuaauuggagagguguccaguggcuccggggagacguucagcuacccugacuuucucaggaugaugcugggcaagagaucugccauccuaaaaaugugagugucaauuuccaaccuccccuguacuuaccuguuuucuccucccccaucccuacccuuguccacaggcucaacauuucuacacguugcccaucaucccuucuuccauccuuagagggacccuuccaaggucccgaccccaucccuauccauaguccugguccccagaaacuccaaccccugcccuuccucuucccccuuccacccucacauccccauccccuucuagccuuuccuagcacccuaugauuuauucccuugagaggaguguucccugaucccugugccucuucccaucucaaccaggauccugauguaugaggaaaaagcgagagaaaaggaaaagccaacaggccccccagccaagaaagcuaucucugaguugcccugauuugaagggaaaagggaugaugggauugaaggggcuucuaaugacccagauauggaaacagaagacaaaauuguaagccagagucaacaaauuaaauaaauuacccccuccuccagaucaa

SEQ ID NO: 2 - RNA, 4050 nt, Homo Sapiens
gcagccagagcucagcagggcccuggagagauggccacggucccagcaccggggaggacuggagagcgcgcgcugccaccgccccaugucucagccagggcuuccuuccucggcuccacccuguggauguaauggcggccccugcucuguccuggcgucugccccuccucauccuccuccugccccuggcuaccucuugggcaucugcagcggugaauggcacuucccaguucacaugcuucuacaacucgagagccaacaucuccugugucuggagccaagauggggcucugcaggacacuuccugccaaguccaugccuggccggacagacggcgguggaaccaaaccugugagcugcuccccgugagucaagcauccugggccugcaaccugauccucggagccccagauucucagaaacugaccacaguugacaucgucacccugagggugcugugccgugagggggugcgauggagggugauggccauccaggacuucaagcccuuugagaaccuucgccugauggcccccaucucccuccaaguuguccacguggagacccacagaugcaacauaagcugggaaaucucccaagccucccacuacuuugaaagacaccuggaguucgaggcccggacgcuguccccaggccacaccugggaggaggccccccugcugacucucaagcagaagcaggaauggaucugccuggagacgcucaccccagacacccaguaugaguuucaggugcgggucaagccucugcaaggcgaguucacgaccuggagccccuggagccagccccuggccuucaggacaaagccugcagcccuugggaaggacaccauuccguggcucggccaccuccucgugggccucagcggggcuuuuggcuucaucaucuuaguguacuugcugaucaacugcaggaacaccgggccauggcugaagaagguccugaaguguaacaccccagaccccucgaaguucuuuucccagcugagcucagagcauggaggagacguccagaaguggcucucuucgcccuuccccucaucguccuucagcccuggcggccuggcaccugagaucucgccacuagaagugcuggagagggacaaggugacgcagcugcuccugcagcaggacaaggugccugagcccgcauccuuaagcagcaaccacucgcugaccagcugcuucaccaaccaggguuacuucuucuuccaccucccggaugccuuggagauagaggccugccagguguacuuuacuuacgaccccuacucagaggaagacccugaugaggguguggccggggcacccacagggucuuccccccaaccccugcagccucugucaggggaggacgacgccuacugcaccuuccccuccagggaugaccugcugcucuucucccccagucuccucgguggccccagccccccaagcacugccccugggggcaguggggccggugaagagaggaugcccccuucuuugcaagaaagaguccccagagacugggacccccagccccuggggccucccaccccaggagucccagaccugguggauuuucagccacccccugagcuggugcugcgagaggcuggggaggaggucccugacgcuggccccagggagggagucaguuuccccugguccaggccuccugggcagggggaguucagggcccuuaaugcucgccugccccugaacacugaugccuacuugucccuccaagaacuccagggucaggacccaacucacuugguguagacagauggccagggugggaggcaggcagcugccugcucugcgccgagccucagaaggacccuguugaggguccucaguccacugcugaggacacucaguguccaguugcagcuggacuucuccacccggauggcccccacccaguccugcacacuugguccauccauuuccaaaccuccacugcugcucccggguccugcugcccgagccaggaacuguguguguugcaggggggcaguaacuccccaacucccucguuaaucacaggaucccacgaauuuaggcucagaagcaucgcuccucuccagcccugcagcuauucaccaauaucaguccucgcggcucuccagggcucccugcccugaccucuucccuggguuuucugccccagccuccuccuucccuccccuccccguccacagggcagccugagcgugcuuuccaaaacccaaauauggccacgcucccccucgguucaaaaccuugcacaggucccacugcccucagccccacuucucagccugguacuuguaccuccggugucguguggggacauccccuucugcaauccucccuaccguccuccugagccacucagagcucccucacacccccucuguugcacaugcuauucccuggggcugcugugcgcucccccucaucuaggugacaaacuucccugacucuucaagugccgguuuugcuucuccuggagggaagcacugccucccuuaaucugccagaaacuucuagcgucagugcuggagggagaagcugucagggacccagggcgccuggagaaagaggcccuguuacuauuccuuugggaucucugaggccucagagugcuuggcugcuguaucuuuaaugcuggggcccaaguaagggcacagauccccccacaaaguggaugccugcugcaucuucccacaguggcuucacagacccacaagagaagcugauggggaguaaacccuggaguccgaggcccaggcagcagccccgccuaguggugggcccugaugcugccaggccugggaccucccacugcccccuccacuggaggggucuccucugcagcucagggacuggcacacuggccuccagaagggcagcuccacagggcagggccucauuauuuuucacugccccagacacagugcccaacaccccgucguauacccuggaugaacgaauuaauuaccuggcaccaccucgucugggcucccugcgccugacauucacacagagaggcagagucccgugcccauuaggucuggcaugcccccuccugcaaggggcucaacccccuaccccgaccccuccacguaucuuuccuaggcagaucacguugcaauggcucaaacaacauuccaccccagcaggacagugaccccagucccagcuaacucugaccugggagcccucaggcaccugcacuuacaggccuugcucacagcugauugggcaccugaccacacgcccccacaggcucugaccagcagccuaugaggggguuuggcaccaagcucuguccaaucagguaggcugggccugaacuagccaaucagaucaacucugucuugggcguuugaacucagggagggaggcccuugggagcaggugcuuguggacaaggcuccacaagcguugagccuuggaaagguagacaagcguugagccacuaagcagaggaccuuggguucccaauacaaaaauaccuacugcugagagggcugcugaccauuuggucaggauuccuguugccuuuauauccaaaauaaacuccccuuucuugagguugucugagucuugggucuaugccuugaaaaaagcugaauuauuggacagucucaccuccugccauaggguccugaauguuucagaccacaaggggcuccacaccuuugcuguguguucuggggcaaccuacuaauccucucugcaagucggucuccuuauccccccaaauggaaauuguauuugccuucuccacuuugggaggcucccacuucuugggaggguuacauuuuuuaagucuuaaucauuugugacauauguaucuauacauccguaucuuuuaaugauccguguguaccaucuuugugauuauuuccuuaauauuuuuucuuuaagucaguucauuuucguugaaauacauuuauuuaaagaaaaaucuuuguuacucuguaaaugaaaaaacccauuuucgcuauaaauaaaagguaacuguacaaaauaaguacaaugcaacaaaaaaaaa

SEQ ID NO: 3 - RNA, 1309 nt, Homo Sapiens
aggccggucucaaacuccugggcucaagcaguccuuccaucucagccucccaaacuguugggauuacaggcaugaacuaccaugcccugcugcuuaaaguucuuuauaugaaaaguagagauaaugggcugggcgcaguggcucaugccuguaaucccagcacucugggaggccgaggcggguggaucacgaggucagggguuugagaccagccugaccaacauggcgaaaucccaugucuacuaaaaauacaaaauuagccaggcguaguggcaggcaccuguaaucccagcuacucaggaggcugaggcaagagaaucgcuugaacccaggaagcggagguugcagugagcugagaucacuccauugcacugcagcuugggcaacaagagugaaacuuuguuucaaaaaaaugaaaaaaaaaaaaaaccuagaugugguggugggcgccuauaaucccagcuacucaggagccugaggcacaagaaucauuugaaccuaggagguggaaguugcagugagccgaaauuguggcacugcacuucagccugggcaacacagugagacucuagcucaaaaaacaaaacaaaacaaaaaaaacuaaggcgagcucagggaggacagaaaccucccguggagcagaagggcaaaagcucgcuugauguugauuuuuaguacgaauacagaccgugaaagcagagccucaugaaaaaaaagaaaaaaagaaaaacaaaguagagauaaacauuaucuuccucaugggcuuauaauaaagguuaaauuaauuaauacauguaaaacauuuaaaagagugccuggcauguaguagaauuacuuaauagauguuagucauuauuaucaaggcuucuuaauuuggaauguauagaggagcuugaaugcucugaaaauauuuuaaauauguuaaauagauuacuuuaaauaucuauuaucuuuauuuuaaaauagucuggccuggacuggaaggaaacacaccaauaaauauuaauaagaguuaucgugaaauauuauuuguucauugguuauuuuaaauuuuauaguuuaaauuuucuguacuuuccaaauguuugguaaucuccaaucuuacuuuuauaaucagaaguuuuaaauauuuuaaggacagaaaaaagaaaucucacagauauugagacacuuuauuuaaaaugacuacaucugagaaaaugaaucaaauaucaucauacuucucuacuuuaacaccaagugccaaaauacagugaaguaacaucugcgaaguuugagggaaaaugauugugacccaagaauccuguac

SEQ ID NO: 4 - RNA, 7452 nt, Homo Sapiens
ucuggaguaagccggaucgcggagccgcgccgacuccgccgagccgggagccgggaggcgcgcagcucccgggucgcuccgaggcuccucggccagggcagccccgcgggcacgcgguagagaagacggcguccccucggcugcuggucgauacaaacagaucccccuuuccaaacacgcgccaaguccccgugcccuccagaugcagagagaggcugcguucagacuggggcacugccauccccuccgcaucauggggucuguggaccaagaagagccgaaugcacauaaggucgccagcccacccuccggacccgcauaccccgaugauguccuggacuauggccucaagccauacagcccccuugcuagucucucuggcgagccccccggccgauucggagagccggauaggguagggccgcagaaguuucugagcgcggccaagccagcaggggccucgggccugagcccucggaucgagaucacuccgucccacgaacugauccaggcaguggggccccuccgcaugagagacgcgggccuccugguggagcagccgccccuggccgggguggccgccagcccgagguucacccugcccgugcccggcuucgagggcuaccgcgagccgcuuugcuugagccccgcuagcagcggcuccucugccagcuucauuucugacaccuucucccccuacaccucgcccugcgucucgcccaauaacggcgggcccgacgaccuguguccgcaguuucaaaacaucccugcucauuauucccccagaaccucgccaauaaugucaccucgaaccagccucgccgaggacagcugccugggccgccacucgcccgugccccguccggccucccgcuccucaucgccuggugccaagcggaggcauucgugcgccgaggccuugguugcccugccgcccggagccucaccccagcgcucccggagccccucgccgcagcccucaucucacguggcaccccaggaccacggcuccccggcuggguaccccccuguggcuggcucugccgugaucauggaugcccugaacagccucgccacggacucgccuugugggaucccccccaagauguggaagaccagcccugaccccucgccggugucugccgccccauccaaggccggccugccucgccacaucuacccggccguggaguuccuggggcccugcgagcagggcgagaggagaaacucggcuccagaauccauccugcugguuccgcccacuuggcccaagccgcuggugccugccauucccaucugcagcaucccagugacugcaucccucccuccacuugaguggccgcuguccagucagucaggcucuuacgagcugcggaucgaggugcagcccaagccacaucaccgggcccacuaugagacagaaggcagccgaggggcugucaaagcuccaacuggaggccacccugugguucagcuccauggcuacauggaaaacaagccucugggacuucagaucuucauugggacagcugaugagcggauccuuaagccgcacgccuucuaccaggugcaccgaaucacggggaaaacugucaccaccaccagcuaugagaagauagugggcaacaccaaaguccuggagauacccuuggagcccaaaaacaacaugagggcaaccaucgacugugcggggaucuugaagcuuagaaacgccgacauugagcugcggaaaggcgagacggacauuggaagaaagaacacgcgggugagacugguuuuccgaguucacaucccagaguccaguggcagaaucgucucuuuacagacugcaucuaaccccaucgagugcucccagcgaucugcucacgagcugcccaugguugaaagacaagacacagacagcugccuggucuauggcggccagcaaaugauccucacggggcagaacuuuacauccgaguccaaaguuguguuuacugagaagaccacagauggacagcaaauuugggagauggaagccacgguggauaaggacaagagccagcccaacaugcuuuuuguugagaucccugaauaucggaacaagcauauccgcacaccuguaaaagugaacuucuacgucaucaaugggaagagaaaacgaagucagccucagcacuuuaccuaccacccagucccagccaucaagacggagcccacggaugaauaugaccccacucugaucugcagccccacccauggaggccuggggagccagccuuacuacccccagcacccgaugguggccgagucccccuccugccucguggccaccauggcucccugccagcaguuccgcacggggcucucauccccugacgcccgcuaccagcaacagaacccagcggccguacucuaccagcggagcaagagccugagccccagccugcugggcuaucagcagccggcccucauggccgccccgcugucccuugcggacgcucaccgcucugugcuggugcacgccggcucccagggccagagcucagcccugcuccaccccucuccgaccaaccagcaggccucgccugugauccacuacucacccaccaaccagcagcugcgcugcggaagccaccaggaguuccagcacaucauguacugcgagaauuucgcaccaggcaccaccagaccuggcccgcccccggucagucaaggucagaggcugagcccggguuccuaccccacagucauucagcagcagaaugccacgagccaaagagccgccaaaaacggacccccggucagugaccaaaaggaaguauuaccugcgggggugaccauuaaacaggagcagaacuuggaccagaccuacuuggaugaugagcugauagacacacaccuuagcuggauacaaaacauauuaugaaacagaaugacugugaucuuugauccgagaaaucaaaguuaaaguuaaugaaauuaucaggaaggaguuuucaggaccuccugccagaaaucagacguaaaagaagccauuauagcaagacaccuucuguaucugaccccucggagcccuccacagccccucaccuucugucuccuuucauguucaucucccagcccggaguccacacgcggaucaauguaugggcacuaagcggacucucacuuaaggagcucgccaccucccucuaaacaccagagagaacucuucuuuucgguuuauguuuuaaaucccagagagcauccugguugaucuuaaugguguuccguccaaauaguaagcaccugcugaccaaaagcacauucuacaugagacaggacacuggaacucuccugagaacagagugacuggagcuuggggggauggacgggggacagaagaugugggcacugugauuaaaccccagcccuugcguucguuuuuccaggucacagauacagcuccuguaccuuuugaaggcaaggaguucucagagcaaccaaaggaacgugacccaagagcccagcuuacaggcugaagaaacccaaaacccucgauagagacagaaacugaacugucaguccuuagagcucgcccaguccaugccacaacugggccacagcuaaagcuuuauuuuugaauucucauuccaaaaccaaacugucuugcccagacaagaucaccuguuaagacuucuuggcguuaaguuaugacauguauacgcguuuguuauuauuauuuuuucugcuuuaaaaggcugaccagggcaccuagcccuggagcugucuuggcgagcuguucuuuaaccccugcagcacgcaguccugcuaacacaauuuccauagacuuggggggcugacccaggcugcagagagcaagcaccugucugcugcagcuguacaaccuggaugcuuugcaagguuccggcuugcuuucuuccuagcagccagagugcuuuuccguaaagcgguggagaaucucaagcaugugcauuuaauugaggaauagcagaagggcuaaagcaaccaagaaaagaaguguggguauuuuuguuaaguaaaacagcccaagugcuucuggagguggguuucuaccaagauagaggaaaagggcugaauucccucuaagugggacagccgagcucaggaugugcuucccagcuucacugguuaauuugaccugaaccuauuuaaagaucccuucugccccugaagaccuauccgcacucaaauucuaacaugaagaaaucuacucgaaugcauccuuuacuuugaaugagcucuauucgguugcauguuauaugugauuuccuuccucccaacuguuuccacugagcgcacccagucuccccuagucuuccucugugggugugauuuuugugauuuuuacaaacaaaacccuugaaguucuuggcagauguguuuguuucuguuugcauguacugcagauaccccaggacaagcgggggauucauuuuucagccauucaguuguuuccucaauaauccgcagcaaagugaaaauauucuuagcacucagacuguacuuagaguguuuucucaguccagucuguacagucuguaggcagaaggccucagaagaaagucauggccacucagugcccacugugggcuuuguaaguccuggcucucccgucaagguuacccagagguaaaagcuuccugggaguggggccagguguguuuggcacuccagauagaaggcaaaaugcucagauucgggccugugcacuuguaugcaaccugucggucgauaccuagcauuuauuuuucccugacaaugaacgaccuuucccucacccacccuaagcucaaagaguuuagcaaaauucucuuuuaaauaaacagaaugccaguaagagguugaccccuaccauggaacuucugggaugcuaaauacuuccucaugaacaaaauaaguuccuuauuauaaguuccuuauacuagcagcuucaccuaaagaauuuucucuccagcaauauugacuucacuggggaaaagccaagaguguguggugagugauuuguucucacucgaccuggcuaggacuggcuaggagcuguuuuuuguacaugagggaauuugggcuuuccucaguuaucugaauguuuuacccaagugccuuccugcuauuguagcaaaguagcucagcuuccuuguccacagggugaaaaaggacuaaugcauuuuccaucaguuuucuaacuauguuagcaaaaacggccuccugguagcucaaccuccuguacgcguguguguguguaauacacacacaaauaaaccccucuguuuuucuaagacaucuuagcuggauauuauaggaagcacuuucauaaacaacuguaacaaaucgcaaaggaaagagaaacaaaagcauuagauuugagacauaaacaggcaagagaaaguguauuaggaacugacagcuaucaaggaaguuuugucaguuacaaaugcuaggaggaaauuuugccaagaaggauggcucaugaaauauuuccaguacgggaagaggcaauaagauccucuaagagaaugagaaaguaggggugucuaaaugguaaagauggguguguugcacguguguuagaaggaucucaguugagugaagguuugcacugcuacaucuaaguuaauguaaauauguagcacucugacaggucuaccguguugcugaauguaguauauuuccaaaguuugcaagucuuccuguauuguacaaagaugcugcugcuugauaauauguauagcaauccagauuaguauguuauuaaauuuuauuuucuuaccuguauuuuuaugcuuuuuaccuguccucaaaauauuacaccccuguuggaauuagauuuauauuuauaaauggucagaaaucuuuuuaagugucucuuuuuacacauagguugauuuuuuuuucuuaagagaaaugauguauucuugaaacauuuguuacucauuccaggaaacaaaaacccauauaauaaaacccccacucagagccuguuagucaccucucuagaagauggcaucucaggagaaggaauggcuuuguggaagaaggaaucaccuuuuucuugcucaagaauuaugcugacuucagcccugagccuggaucuggucacugagaaucaucaagugucuagauccuccccccaaaauaacuaauuuaguaggugauuuugauuuuaaaaaauugacaccaaaacccugccugcauuguaauggaauucgaaaagaauucauguucacagaacucaacguucaggcuaauauuuacagaagggaccaaaucuaaauccugguagauaacuccuguaugcuuuauccaaaggacacccacaguuuuccagcauagauauaaccaaggaugaauugauuccuucaaagaacugggaggcacggauauugcauuuuuuguuuacauccaguagccaagacgccucagugagccagucuugggcagaggcugucacauuuaggcagauuggaaguugguauguucuaauucucacucuggacuacagugaggcugaauuuaucaugucaaaaaaaaaaaaaaaaaaagaccuuuccaagugcuuucuauugcucagaauugaaagaauguuuucauuucaaguuuacaagaggcauggauggaguugugacguucuugacaagcugggcuaaccuuucccgaacuuguuucccggaggcaaggugcucggugacccagcgcaucuuaaccuugggucuccuaggcucgaggcuagggcauuacguuucguggaaccaaagcagccaauugcauagcaaguauuuuccugcauuccaauuaaaugcuuaagaaaaagcagcauccuauaaaauugugaucauaaacauccauuucccucagcuuuugugagugccuugacuuacagccaacaucacuguuuaacucagucuguuuaaaaacaaacuuuucuggugguugauaacagagaguugcucccugagccaucaggguccugggagcuggaagugaaaggguuauuaacauucuaccuuuaugcagcuguuggcugaccagaauaaacucccugcugaguucaagcuuugaauggaauggaugcaaaugauguuguuuccauuagagcaggugcucacagcauucugauuggccugagcagaccgaggcuauggcuguugggacaagcuuagcauccuggacaucuugucaaagaaccucacucaccccucuggccucuacagcccucagaggagagaaaaccaauucuccaacaaacaggucucuccaacaugguggugcuggcaggcuuagguuuagaaaauccugacuguuaaaggcguuugaauacaucacauuccuaugcaaauguuuuuaaucuccaguuuaauguaguuuauuuuuccuauauguaaaguauuuuuauacggcuuguaucaugauaguuuagcaauaaaacaguuggaagcaacaucuaaaaaa

SEQ ID NO: 5 - RNA, 466 nt, Homo Sapiens
accacugcuggcuuuuugcuguagcuccacauuccugugcauugagggguuaacauuaggcugggaagaugacaaaacuugaagagcaucuggagggaauugucaauaucuuccaccaauacucaguucggaaggggcauuuugacacccucucuaagggugagcugaagcagcugcuuacaaaggagcuugcaaacaccaucaagaauaucaaagauaaagcugucauugaugaaauauuccaaggccuggaugcuaaucaagaugaacaggucgacuuucaagaauucauaucccugguagccauugcgcugaaggcugcccauuaccacacccacaaagaguagguagcucucugaaggcuuuuuacccagcaauguccucaaugagggucuuuucuuucccucaccaaaacccagccuugcccguggggaguaagaguuaauaaacacacucacgaaaaguu

SEQ ID NO: 6 - RNA, 2768 nt, Homo Sapiens
cucauuuuucuacugcucgugguaaguggcuucguggucuuuauagcuguuacucuuuuguacuuugucuuuuucuuuuauuuucuuuugagcgauugugcgaacauagcauagcacgcacuaugccuucuguguuguagcugccuggccagggcgacuggcggauaaggucuugugcguggccucgaggcuuaaaaguagcaguggggcuuugugaaggacaaaauggcgauggcgggccguguaggucccccuuccuaugaugaggaccuuuucacagaccuguacugagcuccgugaggauaaauaacucugaggagaugggcccugcaagccucuugcuuagccgucuguucagaaaauagcguuuucgaaaugcccugaguugaccuaaugucuuauugggcuccugucugcaggauuuacgcgcacguuggaaccgaagagagcucuguuguugcaguaaguucuuacggccauuucuuaaucucugcucuuucguugaguguguggaaguugcuacggggaugauuuuacgaacugaacucucucuuucugauggauuaguggagaaaacagaaaauucugaguagcacuguacuguacgcaacaaaugucagggcccuauugauuugucugagguguuagugaaggguguuauuuuuucagauguucagcccacaagagcuuacuggugaaggaaugggacaagacccaucuuuaugcaaagccagcguuacaguaauguuccagguagguguacaugguuuaugcucuuacagaggagaccuuguagauaaccacuccaugaugaacacaaaaugacaagcauauggcugaacuuucaagugaugucaucuuacuacugagaagugagagagaggucuuaaggggucuuugaaugacuauuuuuagguacauaaaaugcuuuccucuguugucuacagcaucucauaaucuauccuggggaauucagcugccucccagggugaauacagguauuccugaugacagucugccucuaucuuacagagcagcuuguugcuauauaccauugaaaagccuucagagcugagagguuaguugauauuuuuuguuccuuacagcuuaugccaccaaguaggcaguuucuaugaugaaucaaacuagcucacuaugaccgacagugaaaauacaugaacaccugagaaacuggagaacgcagggagugggggguaaccaugucugaggaaucuuucacccacagcuuuguuuuucucuagguacuacuaaccaauaaccugcuuggcucaaagggccagcaccuucucucuaaagcccaagaggaguuugagguaaauggcuuugcaauaguuaccaucaauggcugcuauauaaaauuuucugugauuuuugugugugauagcacuguggucugggugaauguacacagacauaacuggcuuaacccaaagucuuugaucuccugaaccaccagugaugaauugcugcucaccagugaugaguugaauaccgccccagucugaucaaugugugacugaaagguauuuucugagcugugagccugccuuccagugacauguucuaaaaauugcaaguuauuugaggaggcuuuacagccaauaggaaguucuugggcuaaguaguguuuccuauaaaaugugcccugaaacuucuuucugccaagcaauagauacaauugagagauuguaaaaugugacauagaaugaaagucucucaagacuacauuuuucuuucuugauuuugcaggaaaacuaggugucuguguucacuccaggcugaaguuacaggugaguaaaccuaaauguaagguggacuaugcuaaaaauucccaaugaagaaacuuucacaugucuuacucucuguccuagucccagagccuguaaaggugaacccacugggacuggcugggggagaagaggaagauuuguuccagaaggaacugucugagggaugauaaagauuucuauacagagaaagggaguaaucaucacuuguugaaaacauugguuuuauuuuuuccaggucugagcaaauaagguguauaaaaaauggaaucugucuuggaggacaucagaaggugaauuuuccaaguucuuggacaaccuagcuguugaaaagcuuucuggguuugggggguauuucagauguaccuuaaaguguuagcagacacagauuaagacacugggagccaaugaaacagcaguugaggguuugcuguguaucacauuucuguauuuuaucacccccuuccugcaacauuauuuaucuggaaucuaccugcccuuuuguuuuuuagauacaagggcuugguuuuguuacccaggcugguuucaaggccauagcuuuaagagauccucucaccacagauuuccaaagugcugggauugcaggugugauucauggcacccagacuuugcugccuuucuuacaugauccaggcccagaacccaaacucaggcacuguauagaugaccacuuucguaaacuacugaccuagcuuguugccaauuguugauugaacuucccauaacuccacuucgugucuguuccucuguauacagccaccuucuguucccgucaugagccuuuaggucuccauuugcauauugcaaauacuauguuccauguagguagcucauucagggccuugcucuucacuucaaaaaagguucccuugaggacuggcugucaauuuguguugcuguguugguuguugaugaaaauaauaaaaugauugauuacau

SEQ ID NO: 7 - RNA, 16571 nt, Homo Sapiens
gaucacaggucuaucacccuauuaaccacucacgggagcucuccaugcauuugguauuuucgucuggggggugugcacgcgauagcauugcgagacgcuggagccggagcacccuaugucgcaguaucugucuuugauuccugccucauucuauuauuuaucgcaccuacguucaauauuacaggcgaacauaccuacuaaaguguguuaauuaauuaaugcuuguaggacauaauaauaacaauugaaugucugcacagccgcuuuccacacagacaucauaacaaaaaauuuccaccaaaccccccccuccccccgcuucuggccacagcacuuaaacacaucucugccaaaccccaaaaacaaagaacccuaacaccagccuaaccagauuucaaauuuuaucuuuaggcgguaugcacuuuuaacagucaccccccaacuaacacauuauuuuccccucccacucccauacuacuaaucucaucaauacaacccccgcccauccuacccagcacacacacaccgcugcuaaccccauaccccgaaccaaccaaaccccaaagacaccccccacaguuuauguagcuuaccuccucaaagcaauacacugaaaauguuuagacgggcucacaucaccccauaaacaaauagguuugguccuagccuuucuauuagcucuuaguaagauuacacaugcaagcauccccguuccagugaguucacccucuaaaucaccacgaucaaaagggacaagcaucaagcacgcagcaaugcagcucaaaacgcuuagccuagccacacccccacgggaaacagcagugauuaaccuuuagcaauaaacgaaaguuuaacuaagcuauacuaaccccaggguuggucaauuucgugccagccaccgcggucacacgauuaacccaagucaauagaagccggcguaaagaguguuuuagaucacccccuccccaauaaagcuaaaacucaccugaguuguaaaaaacuccaguugacacaaaauagacuacgaaaguggcuuuaacauaucugaacacacaauagcuaagacccaaacugggauuagauaccccacuaugcuuagcccuaaaccucaacaguuaaaucaacaaaacugcucgccagaacacuacgagccacagcuuaaaacucaaaggaccuggcggugcuucauaucccucuagaggagccuguucuguaaucgauaaaccccgaucaaccucaccaccucuugcucagccuauauaccgccaucuucagcaaacccugaugaaggcuacaaaguaagcgcaaguacccacguaaagacguuaggucaagguguagcccaugagguggcaagaaaugggcuacauuuucuaccccagaaaacuacgauagcccuuaugaaacuuaagggucgaagguggauuuagcaguaaacugagaguagagugcuuaguugaacagggcccugaagcgcguacacaccgcccgucacccuccucaaguauacuucaaaggacauuuaacuaaaaccccuacgcauuuauauagaggagacaagucguaacaugguaaguguacuggaaagugcacuuggacgaaccagaguguagcuuaacacaaagcacccaacuuacacuuaggagauuucaacuuaacuugaccgcucugagcuaaaccuagccccaaacccacuccaccuuacuaccagacaaccuuagccaaaccauuuacccaaauaaaguauaggcgauagaaauugaaaccuggcgcaauagauauaguaccgcaagggaaagaugaaaaauuauaaccaagcauaauauagcaaggacuaaccccuauaccuucugcauaaugaauuaacuagaaauaacuuugcaaggagagccaaagcuaagacccccgaaaccagacgagcuaccuaagaacagcuaaaagagcacacccgucuauguagcaaaauagugggaagauuuauagguagaggcgacaaaccuaccgagccuggugauagcugguuguccaagauagaaucuuaguucaacuuuaaauuugcccacagaacccucuaaauccccuuguaaauuuaacuguuaguccaaagaggaacagcucuuuggacacuaggaaaaaaccuuguagagagaguaaaaaauuuaacacccauaguaggccuaaaagcagccaccaauuaagaaagcguucaagcucaacacccacuaccuaaaaaaucccaaacauauaacugaacuccucacacccaauuggaccaaucuaucacccuauagaagaacuaauguuaguauaaguaacaugaaaacauucuccuccgcauaagccugcgucagaucaaaacacugaacugacaauuaacagcccaauaucuacaaucaaccaacaagucauuauuacccucacugucaacccaacacaggcaugcucauaaggaaagguuaaaaaaaguaaaaggaacucggcaaaccuuaccccgccuguuuaccaaaaacaucaccucuagcaucaccaguauuagaggcaccgccugcccagugacacauguuuaacggccgcgguacccuaaccgugcaaagguagcauaaucacuuguuccuuaaauagggaccuguaugaauggcuccacgaggguucagcugucucuuacuuuuaaccagugaaauugaccugcccgugaagaggcgggcaugacacagcaagacgagaagacccuauggagcuuuaauuuauuaaugcaaacaguaccuaacaaacccacagguccuaaacuaccaaaccugcauuaaaaauuucgguuggggcgaccucggagcagaacccaaccuccgagcaguacaugcuaagacuucaccagucaaagcgaacuacuauacucaauugauccaauaacuugaccaacggaacaaguuacccuagggauaacagcgcaauccuauucuagaguccauaucaacaauaggguuuacgaccucgauguuggaucaggacaucccgauggugcagccgcuauuaaagguucguuuguucaacgauuaaaguccuacgugaucugaguucagaccggaguaauccaggucgguuucuaucuacuucaaauuccucccuguacgaaaggacaagagaaauaaggccuacuucacaaagcgccuucccccguaaaugauaucaucucaacuuaguauuauacccacacccacccaagaacaggguuuguuaagauggcagagcccgguaaucgcauaaaacuuaaaacuuuacagucagagguucaauuccucuucuuaacaacauacccauggccaaccuccuacuccucauuguacccauucuaaucgcaauggcauuccuaaugcuuaccgaacgaaaaauucuaggcuauauacaacuacgcaaaggccccaacguuguaggccccuacgggcuacuacaacccuucgcugacgccauaaaacucuucaccaaagagccccuaaaacccgccacaucuaccaucacccucuacaucaccgccccgaccuuagcucucaccaucgcucuucuacuaugaaccccccuccccauacccaacccccuggucaaccucaaccuaggccuccuauuuauucuagccaccucuagccuagccguuuacucaauccucugaucagggugagcaucaaacucaaacuacgcccugaucggcgcacugcgagcaguagcccaaacaaucucauaugaagucacccuagccaucauucuacuaucaacauuacuaauaaguggcuccuuuaaccucuccacccuuaucacaacacaagaacaccucugauuacuccugccaucaugacccuuggccauaauaugauuuaucuccacacuagcagagaccaaccgaacccccuucgaccuugccgaaggggaguccgaacuagucucaggcuucaacaucgaauacgccgcaggccccuucgcccuauucuucauagccgaauacacaaacauuauuauaauaaacacccucaccacuacaaucuuccuaggaacaacauaugacgcacucuccccugaacucuacacaacauauuuugucaccaagacccuacuucuaaccucccuguucuuaugaauucgaacagcauacccccgauuccgcuacgaccaacucauacaccuccuaugaaaaaacuuccuaccacucacccuagcauuacuuauaugauaugucuccauacccauuacaaucuccagcauucccccucaaaccuaagaaauaugucugauaaaagaguuacuuugauagaguaaauaauaggagcuuaaacccccuuauuucuaggacuaugagaaucgaacccaucccugagaauccaaaauucuccgugccaccuaucacaccccauccuaaaguaaggucagcuaaauaagcuaucgggcccauaccccgaaaauguugguuauacccuucccguacuaauuaauccccuggcccaacccgucaucuacucuaccaucuuugcaggcacacucaucacagcgcuaagcucgcacugauuuuuuaccugaguaggccuagaaauaaacaugcuagcuuuuauuccaguucuaaccaaaaaaauaaacccucguuccacagaagcugccaucaaguauuuccucacgcaagcaaccgcauccauaauccuucuaauagcuauccucuucaacaauauacucuccggacaaugaaccauaaccaauacuaccaaucaauacucaucauuaauaaucauaauggcuauagcaauaaaacuaggaauagcccccuuucacuucugagucccagagguuacccaaggcaccccucugacauccggccugcuucuucucacaugacaaaaacuagcccccaucucaaucauauaccaaaucucucccucacuaaacguaagccuucuccucacucucucaaucuuauccaucauagcaggcaguugagguggauuaaaccaaacccagcuacgcaaaaucuuagcauacuccucaauuacccacauaggaugaauaauagcaguucuaccguacaacccuaacauaaccauucuuaauuuaacuauuuauauuauccuaacuacuaccgcauuccuacuacucaacuuaaacuccagcaccacgacccuacuacuaucucgcaccugaaacaagcuaacaugacuaacacccuuaauuccauccacccuccucucccuaggaggccugcccccgcuaaccggcuuuuugcccaaaugggccauuaucgaagaauucacaaaaaacaauagccucaucauccccaccaucauagccaccaucacccuccuuaaccucuacuucuaccuacgccuaaucuacuccaccucaaucacacuacuccccauaucuaacaacguaaaaauaaaaugacaguuugaacauacaaaacccaccccauuccuccccacacucaucgcccuuaccacgcuacuccuaccuaucuccccuuuuauacuaauaaucuuauagaaauuuagguuaaauacagaccaagagccuucaaagcccucaguaaguugcaauacuuaauuucugcaacagcuaaggacugcaaaaccccacucugcaucaacugaacgcaaaucagccacuuuaauuaagcuaagcccuuacuagaccaaugggacuuaaacccacaaacacuuaguuaacagcuaagcacccuaaucaacuggcuucaaucuacuucucccgccgccgggaaaaaaggcgggagaagccccggcagguuugaagcugcuucuucgaauuugcaauucaauaugaaaaucaccucggagcugguaaaaagaggccuaaccccugucuuuagauuuacaguccaaugcuucacucagccauuuuaccucacccccacugauguucgccgaccguugacuauucucuacaaaccacaaagacauuggaacacuauaccuauuauucggcgcaugagcuggaguccuaggcacagcucuaagccuccuuauucgagccgagcugggccagccaggcaaccuucuagguaacgaccacaucuacaacguuaucgucacagcccaugcauuuguaauaaucuucuucauaguaauacccaucauaaucggaggcuuuggcaacugacuaguuccccuaauaaucggugcccccgauauggcguuuccccgcauaaacaacauaagcuucugacucuuaccucccucucuccuacuccugcucgcaucugcuauaguggaggccggagcaggaacagguugaacagucuacccucccuuagcagggaacuacucccacccuggagccuccguagaccuaaccaucuucuccuuacaccuagcaggugucuccucuaucuuaggggccaucaauuucaucacaacaauuaucaauauaaaacccccugccauaacccaauaccaaacgccccucuucgucugauccguccuaaucacagcaguccuacuucuccuaucucucccaguccuagcugcuggcaucacuauacuacuaacagaccgcaaccucaacaccaccuucuucgaccccgccggaggaggagaccccauucuauaccaacaccuauucugauuuuucggucacccugaaguuuauauucuuauccuaccaggcuucggaauaaucucccauauuguaacuuacuacuccggaaaaaaagaaccauuuggauacauagguauggucugagcuaugauaucaauuggcuuccuaggguuuaucgugugagcacaccauauauuuacaguaggaauagacguagacacacgagcauauuucaccuccgcuaccauaaucaucgcuauccccaccggcgucaaaguauuuagcugacucgccacacuccacggaagcaauaugaaaugaucugcugcagugcucugagcccuaggauucaucuuucuuuucaccguagguggccugacuggcauuguauuagcaaacucaucacuagacaucguacuacacgacacguacuacguuguagcucacuuccacuauguccuaucaauaggagcuguauuugccaucauaggaggcuucauucacugauuuccccuauucucaggcuacacccuagaccaaaccuacgccaaaauccauuucacuaucauauucaucggcguaaaucuaacuuucuucccacaacacuuucucggccuauccggaaugccccgacguuacucggacuaccccgaugcauacaccacaugaaacauccuaucaucuguaggcucauucauuucucuaacagcaguaauauuaauaauuuucaugauuugagaagccuucgcuucgaagcgaaaaguccuaauaguagaagaacccuccauaaaccuggagugacuauauggaugccccccacccuaccacacauucgaagaacccguauacauaaaaucuagacaaaaaaggaaggaaucgaaccccccaaagcugguuucaagccaaccccauggccuccaugacuuuuucaaaaagguauuagaaaaaccauuucauaacuuugucaaaguuaaauuauaggcuaaauccuauauaucuuaauggcacaugcagcgcaaguaggucuacaagacgcuacuuccccuaucauagaagagcuuaucaccuuucaugaucacgcccucauaaucauuuuccuuaucugcuuccuaguccuguaugcccuuuuccuaacacucacaacaaaacuaacuaauacuaacaucucagacgcucaggaaauagaaaccgucugaacuauccugcccgccaucauccuaguccucaucgcccucccaucccuacgcauccuuuacauaacagacgaggucaacgaucccucccuuaccaucaaaucaauuggccaccaaugguacugaaccuacgaguacaccgacuacggcggacuaaucuucaacuccuacauacuucccccauuauuccuagaaccaggcgaccugcgacuccuugacguugacaaucgaguaguacucccgauugaagcccccauucguauaauaauuacaucacaagacgucuugcacucaugagcuguccccacauuaggcuuaaaaacagaugcaauucccggacgucuaaaccaaaccacuuucaccgcuacacgaccggggguauacuacggucaaugcucugaaaucuguggagcaaaccacaguuucaugcccaucguccuagaauuaauuccccuaaaaaucuuugaaauagggcccguauuuacccuauagcacccccucuacccccucuagagcccacuguaaagcuaacuuagcauuaaccuuuuaaguuaaagauuaagagaaccaacaccucuuuacagugaaaugccccaacuaaauacuaccguauggcccaccauaauuacccccauacuccuuacacuauuccucaucacccaacuaaaaauauuaaacacaaacuaccaccuaccucccucaccaaagcccauaaaaauaaaaaauuauaacaaacccugagaaccaaaaugaacgaaaaucuguucgcuucauucauugcccccacaauccuaggccuacccgccgcaguacugaucauucuauuucccccucuauugauccccaccuccaaauaucucaucaacaaccgacuaaucaccacccaacaaugacuaaucaaacuaaccucaaaacaaaugauagccauacacaacacuaaaggacgaaccugaucucuuauacuaguauccuuaaucauuuuuauugccacaacuaaccuccucggacuccugccucacucauuuacaccaaccacccaacuaucuauaaaccuagccauggccauccccuuaugagcgggcgcagugauuauaggcuuucgcucuaagauuaaaaaugcccuagcccacuucuuaccacaaggcacaccuacaccccuuauccccauacuaguuauuaucgaaaccaucagccuacucauucaaccaauagcccuggccguacgccuaaccgcuaacauuacugcaggccaccuacucaugcaccuaauuggaagcgccacccuagcaauaucaaccauuaaccuucccucuacacuuaucaucuucacaauucuaauucuacugacuauccuagaaaucgcugucgccuuaauccaagccuacguuuucacacuucuaguaagccucuaccugcacgacaacacauaaugacccaccaaucacaugccuaucauauaguaaaacccagcccaugaccccuaacaggggcccucucagcccuccuaaugaccuccggccuagccaugugauuucacuuccacuccauaacgcuccucauacuaggccuacuaaccaacacacuaaccauauaccaaugguggcgcgauguaacacgagaaagcacauaccaaggccaccacacaccaccuguccaaaaaggccuucgauacgggauaauccuauuuauuaccucagaaguuuuuuucuucgcaggauuuuucugagccuuuuaccacuccagccuagccccuaccccccaacuaggagggcacuggcccccaacaggcaucaccccgcuaaauccccuagaagucccacuccuaaacacauccguauuacucgcaucaggaguaucaaucaccugagcucaccauagucuaauagaaaacaaccgaaaccaaauaauucaagcacugcuuauuacaauuuuacugggucucuauuuuacccuccuacaagccucagaguacuucgagucucccuucaccauuuccgacggcaucuacggcucaacauuuuuuguagccacaggcuuccacggacuucacgucauuauuggcucaacuuuccucacuaucugcuucauccgccaacuaauauuucacuuuacauccaaacaucacuuuggcuucgaagccgccgccugauacuggcauuuuguagaugugguuugacuauuucuguaugucuccaucuauugaugagggucuuacucuuuuaguauaaauaguaccguuaacuuccaauuaacuaguuuugacaacauucaaaaaagaguaauaaacuucgccuuaauuuuaauaaucaacacccuccuagccuuacuacuaauaauuauuacauuuugacuaccacaacucaacggcuacauagaaaaauccaccccuuacgagugcggcuucgacccuauaucccccgcccgcgucccuuucuccauaaaauucuucuuaguagcuauuaccuucuuauuauuugaucuagaaauugcccuccuuuuaccccuaccaugagcccuacaaacaacuaaccugccacuaauaguuaugucaucccucuuauuaaucaucauccuagcccuaagucuggccuaugagugacuacaaaaaggauuagacugagccgaauugguauauaguuuaaacaaaacgaaugauuucgacucauuaaauuaugauaaucauauuuaccaaaugccccucauuuacauaaauauuauacuagcauuuaccaucucacuucuaggaauacuaguauaucgcucacaccucauauccucccuacuaugccuagaaggaauaauacuaucgcuguucauuauagcuacucucauaacccucaacacccacucccucuuagccaauauugugccuauugccauacuagucuuugccgccugcgaagcagcggugggccuagcccuacuagucucaaucuccaacacauauggccuagacuacguacauaaccuaaaccuacuccaaugcuaaaacuaaucgucccaacaauuauauuacuaccacugacaugacuuuccaaaaagcacauaauuugaaucaacacaaccacccacagccuaauuauuagcaucaucccccuacuauuuuuuaaccaaaucaacaacaaccuauuuagcuguuccccaaccuuuuccuccgacccccuaacaaccccccuccuaauacuaacuaccugacuccuaccccucacaaucauggcaagccaacgccacuuauccagcgaaccacuaucacgaaaaaaacucuaccucucuauacuaaucucccuacaaaucuccuuaauuauaacauucacagccacagaacuaaucauauuuuauaucuucuucgaaaccacacuuauccccaccuuggcuaucaucacccgaugaggcaaccagccagaacgccugaacgcaggcacauacuuccuauucuacacccuaguaggcucccuuccccuacucaucgcacuaauuuacacucacaacacccuaggcucacuaaacauucuacuacucacucucacugcccaagaacuaucaaacuccugagccaacaacuuaauaugacuagcuuacacaauagcuuuuauaguaaagauaccucuuuacggacuccacuuaugacucccuaaagcccaugucgaagcccccaucgcugggucaauaguacuugccgcaguacucuuaaaacuaggcggcuaugguauaauacgccucacacucauucucaacccccugacaaaacacauagccuaccccuuccuuguacuaucccuaugaggcauaauuauaacaagcuccaucugccuacgacaaacagaccuaaaaucgcucauugcauacucuucaaucagccacauagcccucguaguaacagccauucucauccaaacccccugaagcuucaccggcgcagucauucucauaaucgcccacggacucacauccucauuacuauucugccuagcaaacucaaacuacgaacgcacucacagucgcaucauaauccucucucaaggacuucaaacucuacucccacuaauagcuuuuugaugacuucuagcaagccucgcuaaccucgccuuaccccccacuauuaaccuacugggagaacucucugugcuaguaaccacguucuccugaucaaauaucacucuccuacuuacaggacucaacauacuagucacagcccuauacucccucuacauauuuaccacaacacaauggggcucacucacccaccacauuaacaacauaaaacccucauucacacgagaaaacacccucauguucauacaccuaucccccauucuccuccuaucccucaaccccgacaucauuaccggguuuuccucuuguaaauauaguuuaaccaaaacaucagauugugaaucugacaacagaggcuuacgaccccuuauuuaccgagaaagcucacaagaacugcuaacucaugcccccaugucuaacaacauggcuuucucaacuuuuaaaggauaacagcuauccauuggucuuaggccccaaaaauuuuggugcaacuccaaauaaaaguaauaaccaugcacacuacuauaaccacccuaacccugacuucccuaauuccccccauccuuaccacccucguuaacccuaacaaaaaaaacucauacccccauuauguaaaauccauugucgcauccaccuuuauuaucagucucuuccccacaacaauauucaugugccuagaccaagaaguuauuaucucgaacugacacugagccacaacccaaacaacccagcucucccuaagcuucaaacuagacuacuucuccauaauauucaucccuguagcauuguucguuacaugguccaucauagaauucucacugugauauauaaacucagacccaaacauuaaucaguucuucaaauaucuacucauuuuccuaauuaccauacuaaucuuaguuaccgcuaacaaccuauuccaacuguucaucggcugagagggcguaggaauuauauccuucuugcucaucaguugaugauacgcccgagcagaugccaacacagcagccauucaagcaguccuauacaaccguaucggcgauaucgguuucauccucgccuuagcaugauuuauccuacacuccaacucaugagacccacaacaaauagcccuucuaaacgcuaauccaagccucaccccacuacuaggccuccuccuagcagcagcaggcaaaucagcccaauuaggucuccaccccugacuccccucagccauagaaggccccaccccagucucagcccuacuccacucaagcacuauaguuguagcaggaaucuucuuacucauccgcuuccacccccuagcagaaaauagcccacuaauccaaacucuaacacuaugcuuaggcgcuaucaccacucuguucgcagcagucugcgcccuuacacaaaaugacaucaaaaaaaucguagccuucuccacuucaagucaacuaggacucauaauaguuacaaucggcaucaaccaaccacaccuagcauuccugcacaucuguacccacgccuucuucaaagccauacuauuuaugugcuccggguccaucauccacaaccuuaacaaugaacaagauauucgaaaaauaggaggacuacucaaaaccauaccucucacuucaaccucccucaccauuggcagccuagcauuagcaggaauaccuuuccucacagguuucuacuccaaagaccacaucaucgaaaccgcaaacauaucauacacaaacgccugagcccuaucuauuacucucaucgcuaccucccugacaagcgccuauagcacucgaauaauucuucucacccuaacaggucaaccucgcuuccccacccuuacuaacauuaacgaaaauaaccccacccuacuaaaccccauuaaacgccuggcagccggaagccuauucgcaggauuucucauuacuaacaacauuucccccgcaucccccuuccaaacaacaaucccccucuaccuaaaacucacagcccucgcugucacuuuccuaggacuucuaacagcccuagaccucaacuaccuaaccaacaaacuuaaaauaaaauccccacuaugcacauuuuauuucuccaacauacucggauucuacccuagcaucacacaccgcacaauccccuaucuaggccuucuuacgagccaaaaccugccccuacuccuccuagaccuaaccugacuagaaaagcuauuaccuaaaacaauuucacagcaccaaaucuccaccuccaucaucaccucaacccaaaaaggcauaauuaaacuuuacuuccucucuuucuucuucccacucauccuaacccuacuccuaaucacauaaccuauucccccgagcaaucucaauuacaauauauacaccaacaaacaauguucaaccaguaaccacuacuaaucaacgcccauaaucauacaaagcccccgcaccaauaggauccucccgaaucaacccugaccccucuccuucauaaauuauucagcuuccuacacuauuaaaguuuaccacaaccaccaccccaucauacucuuucacccacagcaccaauccuaccuccaucgcuaaccccacuaaaacacucaccaagaccucaaccccugacccccaugccucaggauacuccucaauagccaucgcuguaguauauccaaagacaaccaucauucccccuaaauaaauuaaaaaaacuauuaaacccauauaaccucccccaaaauucagaauaauaacacacccgaccacaccgcuaacaaucaguacuaaacccccauaaauaggagaaggcuuagaagaaaaccccacaaaccccauuacuaaacccacacucaacagaaacaaagcauacaucauuauucucgcacggacuacaaccacgaccaaugauaugaaaaaccaucguuguauuucaacuacaagaacaccaaugaccccaauacgcaaaauuaacccccuaauaaaauuaauuaaccacucauucaucgaccuccccaccccauccaacaucuccgcaugaugaaacuucggcucacuccuuggcgccugccugauccuccaaaucaccacaggacuauuccuagccauacacuacucaccagacgccucaaccgccuuuucaucaaucgcccacaucacucgagacguaaauuauggcugaaucauccgcuaccuucacgccaauggcgccucaauauucuuuaucugccucuuccuacacaucgggcgaggccuauauuacggaucauuucucuacucagaaaccugaaacaucggcauuauccuccugcuugcaacuauagcaacagccuucauaggcuauguccucccgugaggccaaauaucauucugaggggccacaguaauuacaaacuuacuauccgccaucccauacauugggacagaccuaguucaaugaaucugaggaggcuacucaguagacagucccacccucacacgauucuuuaccuuucacuucaucuuacccuucauuauugcagcccuagcagcacuccaccuccuauucuugcacgaaacgggaucaaacaacccccuaggaaucaccucccauuccgauaaaaucaccuuccacccuuacuacacaaucaaagacgcccucggcuuacuucucuuccuucucuccuuaaugacauuaacacuauucucaccagaccuccuaggcgacccagacaauuauacccuagccaaccccuuaaacaccccuccccacaucaagcccgaaugauauuuccuauucgccuacacaauucuccgauccgucccuaacaaacuaggaggcguccuugcccuauuacuauccauccucauccuagcaauaauccccauccuccauauauccaaacaacaaagcauaauauuucgcccacuaagccaaucacuuuauugacuccuagccgcagaccuccucauucuaaccugaaucggaggacaaccaguaagcuacccuuuuaccaucauuggacaaguagcauccguacuauacuucacaacaauccuaauccuaauaccaacuaucucccuaauugaaaacaaaauacucaaaugggccuguccuuguaguauaaacuaauacaccagucuuguaaaccggagacgaaaaccuuuuuccaaggacaaaucagagaaaaagucuuuaacuccaccauuagcacccaaagcuaagauucuaauuuaaacuauucucuguucuuucauggggaagcagauuuggguaccacccaaguauugacucacccaucaacaaccgcuauguauuucguacauuacugccagccaccaugaauauuguacgguaccauaaauacuugaccaccuguaguacauaaaaacccaacccacaucaaaccccccccccccaugcuuacaagcaaguacagcaaucaaccuucaacuaucacacaucaacugcaacuccaaagccaccccucacccacuaggauaccaacaaaccuacccacccuuaacaguacauaguacauaaagucauuuaccguacauagcacauuacagucaaaucccuucucguccccauggaugaccccccucagauaggggucccuugaccaccauccuccgugaaaucaauaucccgcacaagagugcuacucuccucgcuccgggcccauaacacuuggggguagcuaaagugaacuguauccgacaucugguuccuacuucagggccauaaagccuaaauagcccacacguuccccuuaaauaagacaucacgaug

SEQ ID NO: 8 - RNA, 2454 nt, Homo Sapiens
ucuucauuacagaugugcagcaccaugagggcccuggugcuucugcugucccuguuccugcuggguggccaggcccagcaugugucugacuggaccuacucagaaggggcacuggacgaagcgcacuggccacagcacuaccccgccugugggggccagagacagucgccuaucaaccuacagaggacgaaggugcgguacaaccccuccuugaaggggcucaauaugacaggcuaugagacccaggcaggggaguuccccauggucaacaauggccacacagauuggcaggcggaacucuuccuccccuccuuguccucuccuuguggagaaggggcgaagcacaaaggccaaaggcaguggcuuuguucacccucccuggacagcuggugggaagcaaucauugauggaggaucucuaugggcaacgcuugcugagugcgggcuucgugcugagggcccagaagagggaaggcauauggaagagaagagcccagcuucccaaggggcuugcagcggcucccgccucccaauuuccagaggacccuguaccuucuuccuuuagggcucugcucaaauuucugugguccggaagccuguuccuuugggguucucaccucacacgacagcaugucggacauuagaguggacccaaaguucacauuaauuauauauauauuaaaaacaauuuuuuuuuuugagauggagucuugcucugucaccccggcuggagugcaguggugcaaucuuggcucacugaaaccuccacuucccagauucaagcaauucuccugccucagcuucccugguaccugggacuacaggcaugugccaccacgcccagcuaauuuuuguauuuuuaguagagaugcgguuuugucauacuggccagucuggucucgaacuccuugccucaagugcucugcccaccuuggccucccaaacuuggccucccaaaguguugagauuauaugcauaagccaccgugcccagccugauauaaaguauuuugaaagauuuuuauaauuuagcuuuugaaguuauuuggcuauugccauuggcuacuuuucagcaagcuccaagcacauucaggaauucuacugaagggggaaaaaaagcuaaucuacaaacuuugaaucuaaugagauuuugaugaacacuaagcuuaacaguaaaguugacaugacguauuaaagauuuguuaauuuuuugcagaucagccugcccuccaccaugcgcaugacaguggcugacggcacuguauacauagcccagcagaugcacuuucacuggggaggugcguccucggagaucagcggcucugagcacaccguggacgggaucagacaugugaucgagauucacauuguucacuacaauucuaaauacaagagcuaugauauagcccaagaugcgccggaugguuuggcuguacuggcagccuucguugaggugaagaauuacccugaaaacacuuauuacagcaacuucauuucucaucuggccaacaucaaguacccaggacaaagaacaacccugacuggccuugacguucaggacaugcugcccaggaaccuccagcacuacuacaccuaccauggcucacucaccacgccucccugcacugagaacguccacugguuugugcuggcagauuuugucaagcucuccaggacacagguuuggaagcuggagaauuccuuacuggaucaccgcaacaagaccauccacaacgauuaccgcaggacccagccccugaaccacagagugguggaauccaacuucccgaaucagggcaagggccacggggggcaucgugggagaagccaaaauccaagaguacagcccaccucaacacgccaccccuuggcucugggcagcuuagaagccugaaugcggguauggugucuggccgucccccuucucuguuuuugugaggacuguacaagguuuaaccauuuccgacuaacucuucuuuuuacagaauacacucuaggcucugaauuccaguuuuaccuacauaagauugaggaaauucuugacuacuuaagaagagcauugaacugaggaaagcuaagaggaagauucaauauuaacuagcuugaagccugaccuagccagaagugccuguccgcugcagccgcacccuaccuugucuaagaaaccaugugugucuggaacacgcugcucccccuggggcagcuguugggauucugauuaaaagaggggaaacgaucauccuggacaggaagugagauggcuucaguucaugagacgggaucugaguuagacaucaccaguggaaauugauuggaauagaaacuuaaaggaaauggaacccuaacuauucucccaucaaaucauauauguugaccugucugaauuauaaaccagccugaccuuuccuuuagcauuagauguaauaaaauaacuuuggaaauuugucauuuaaaaa

SEQ ID NO: 9 - RNA, 2742 nt, Homo Sapiens
acagccagagggacgagcuagcccgacgauggcccaggggacauugauccgugugaccccagagcagcccacccaugccgugugugugcugggcaccuugacucagcuugacaucugcagcucugccccugaggacugcacguccuucagcaucaacgccuccccagggguggucguggauauugcccacggcccuccagccaagaagaaauccacagguuccuccacauggccccuggacccugggguagaggugacccugacgaugaaaguggccagugguagcacaggcgaccagaagguucagauuucauacuacggacccaagacuccaccagucaaagcucuacucuaccucaccgggguggauggagucucacccugucacccaggcuggagugcaauggcaugaucucggcucacugcaaccugcgucucccagguucaagcgauccuccugcuucagcgucccuaguagcugggacuacaggcgcuugccaccacgccuggcuaauuuuuguauuuuuaguagagauggaguuucaccauguuggccaggcuggucucgaacuucugaccucaggugaucugccugccucaggcucccaaagugcucggauuacuggcaugaaccacugcgccaggcccucuauuccuuuuugauaccucaaauaucuauaacaaaaaguagauaaugacacugucuuauacaagaauauagauaguguuccucaaauuccauuauuuauaucucaucuucaccauuucugccauaucaaugauccaccuauacucauauuuauguaauguucuucuuuaaauaaaauccauucuuaaacuuaaaucuccuugugcgcagacaucacccgcaccggcaaagugaagccaaccagagcugugaaagaucagaggaccuggaccuggggcccuuguggacagggugccauccugcuggugaacugugacagagacaaucucgaaucuucugccauggacugcgaggaugaugaagugcuugacagcgaagaccugcaggacaugucgcugaugacccugagcacgaagacccccaaggacuucuucacaaaccauacacuggugcuccacguggccaggucugagauggacaaagugaggguguuucaggccacacggggcaaacuguccuccaagugcagcguagucuugggucccaaguggcccucucacuaccugaugguccccgguggaaagcacaacauggacuucuacguggaggcccucgcuuucccggacaccgacuucccggggcucauuacccucaccaucucccugcuggacacguccaaccuggagcuccccgaggcugugguguuccaagacagcguggucuuccgcguggcgcccuggaucaugacccccaacacccagcccccgcaggagguguacgcgugcaguauuuuugaaaaugaggacuuccugaagucagugacuacucuggccaugaaagccaagugcaagcugaccaucugcccugaggaggagaacauggaugaccaguggaugcaggaugaaauggagaucggcuacauccaagccccacacaaaacgcugcccguggucuucgacucuccaaggaacagaggccugaaggaguuucccaucaaacgcgugauggguccagauuuuggcuauguaacucgagggccccaaacaggggguaucaguggacuggacuccuuugggaaccuggaagugagccccccagucacagucaggggcaaggaauacccgcugggcaggauucucuucggggacagcuguuaucccagcaaugacagccggcagaugcaccaggcccugcaggacuuccucagugcccagcaggugcaggccccugugaagcucuauucugacuggcuguccgugggccacguggacgaguuccugagcuuugugccagcacccgacaggaagggcuuccggcugcuccuggccagccccagguccugcuacaaacuguuccaggagcagcagaaugagggccacggggaggcccugcuguucgaagggaucaagaaaaaaaaacagcagaaaauaaagaacauucugucaaacaagacauugagagaacauaauucauuuguggagagaugcaucgacuggaaccgcgagcugcugaagcgggagcugggccuggccgagagugacaucauugacaucccgcagcucuucaagcucaaagaguucucuaaggcggaagcuuuuuuccccaacauggugaacaugcuggugcuagggaagcaccugggcauccccaagcccuucgggcccgucaucaacggccgcugcugccuggaggagaagguguguucccugcuggagccacugggccuccagugcaccuucaucaacgacuucuucaccuaccacaucaggcauggggaggugcacugcggcaccaacgugcgcagaaagcccuucuccuucaagugguggaacauggugcccugagcccaucuucccuggcguccucucccuccuggccagaugucgcuggguccucugcaguguggcaagcaagagcucuugugaauauuguggcucccugggggcggccagcccucccagcaguggcuugcuuucuucuccugugaugucccaguuucccacucugaagaucccaacaugguccuagcacugcacacucaguucugcucuaagaagcugcaauaaaguuuuuuuaagucacuuuguacauga

SEQ ID NO: 10 - RNA, 6440 nt, Homo Sapiens
aagcccggccuggcggcggcgguggcgguagcugccguggcggccucugcgcaugcuccgucgccugcccgcccuggccgcucgccgcccgcccgcccgacggagacgcagucccagcuaucugacuucaugugaaagauggcuaaugcagaagugagugucccagugggggaugugguugugguaccuacugaaggaaaugaaggggagaauccugaagacacuaaaacccaagugauuuugcaguuacagccugugcaacaagguuuguuuaucgauggacacuuuuacaacaggauuuaugaagcugggucggagaacaacacggcaguuguagcaguagaaacucacacgauacacaaaauugaagaagggauugauacaggcacuauagaagcaaaugaggauauggaaauugcuuaccccauaacuuguggggagagcaaagccauccuccucuggaagaaguuuguauguccaggaauaaacgugaagugugucaaguucaaugaucaguugaucagccccaagcacuuuguucaucuggcuggcaaguccacucugaaggacuggaagagagcuauucgucugggugggaucaugcucaggaaaaugauggacuccggacagauugauuuuuaccaacaugacaaaguuugcuccaauaccugcagaagcaccaaauuugaucuucugaucagcagugcaagagcuccagugccaggacagcagacaaguguggugcagacacccacuucggcugaugguagcaucacgcagauugccaucucagaagagagcauggaagaggcagggcuggaauggaacucagcucucaccgcugcugucaccauggccacggaggaggguguaaagaaagacucagaggaaauuucagaggacacuuugauguucuggaaaggaauagcugauguagggcugauggaagagguugucugcaauauacagaaggaaauagaggagcuacucaggggaguucagcagcggcucauccaggcucccuuccaagucacagaugcugcuguucucaacaauguagcacacacauuuggccuaauggacacagucaagaagguuuuagacaacagaaggaaccaaguagagcagggagaagaacaguuucucuauacucugacagacuuggaacgccaguuggaggagcagaagaagcaaggccaggaucacaggcugaaaucucagacaguucaaaaugugguacugaugccugugagcacuccuaagccuccaaaaaggccccggcuccagcggccagccuccaccacugucuugagcccuucuccuccuguccagcagccucaguucacagucaucucacccaucaccaucaccccagugggucagucauuuuccaugggcaauauuccaguggccacccucagccagggcuccaguccugugacuguccacacacugccuucuggcccucagcucuuccgcuaugccacaguggucuccucugccaagagcagcucaccagacacagugaccauccacccuucaucuagcuuggcgcugcugagcucuacugccaugcaggaugggaguacacugggcaacaugaccaccaugguuagcccuguggaauugguggccauggaguccggccuaaccucggcaauucaggcuguugaaagcaccucagaggaugggcagaccaucauugagauugauccagccccggacccagaagcugaagauacugagggcaaagcagucaucuuggagacagagcugaggacugaggagaaaguuguggcugagauggaagaacaccagcaucaaguucacaauguggagauuguggucuuagaggauuaacuggggaucucagggccaggaguuauguuuugauuuggaauuuuaauuauuuguuuauuuuuaucauugucccacucauuuccacauaggacccuuuuuuaaaaaaaaaaaaacaaaaucuuauuguuguaacugaaaauguuggguucuucccacucccucauugaaaaauggacaaaacaagcugcccuuccagaaguugagaguaggucauucaauguccuaaucaucuuacaccaagaaaguaauuucuuuuaggggaagugucaagauaacaaguaacccuguccagaaagccauuuccaggcucgucuguguguguaggcaugugguuuuauucuuguaaagaugcauugaccaaacucuggaacacagaucugacacuggaaggcaacccacucgcauguggaugcugaagggcacuuuauuuuguauccugaaaagggccuacagaggccaguacaaaacucucaaacaaaaggaaguugacucugcuuugaggggaagguggcaugccagcacuagcuuaaaaagggaagugcuagccgggcgugguggcucacgccugcaaucccagcacuuugggaggccgaggcggguggaucacgaggucaggaguuugagaccagccuggccaacauggugaaaccccguaucuacuaaaaauacgaaaaaaaaauuagccgggugugguggcgggagccuguaaucccagcuauucaggaggccaaggcaggagaaucgcuugaaccugggaaggcagagguugcagugagccaagaucgcaccacugcacuccagccugggcaacaagagcgagacuccaucucaaaaaaaaaaaaaaaaaaaagugcuuuggcaaguauggggcagggaaaucaucuuacuuccagaggugcaacugacgccucuggagaucuccaaaaguuaguaccgugagugccauuuugagaagaaggugguaauaaguggaagguacaucuccacagagcaaguggcagcaguggccugugguuuugcagaaauggaaagccaaggccgggugcgguggcucaugccuguaaucccagcacuuugggaggccgaggugggugaaucaccugaggucaggaguuugaggccagccuggccaacauggugaaaccccgucucuacugaaaauacaaaaaaaaaaaauuagcugggcaugguggcacgcgccuguaaucccagcuacuugggaggcugaggcaggagaauugcuugaaccugggaggcggagguugcagugagcugagaucaugccauugcacucuagccugggcgaggagugaaacuccgucucaaaaaaaaagaaagaaauggaaagccaaggaugcugcagcugugcuuugggguucaagguaauagcuuaccuuguuccacacuuugucaaagcacucacccuccuaagcuaggaccaguccauucauuugaaacugugcaaugugauguaaauggcucugguucuuagacuguggcugucacagggauggggcuccaaggccaucauuuucauugcauggcuccaagagcagggaguuccucaaugaaaccagcugccuuuuuugguggggccauuuuuuuggcuuuggaacccaaagcagccacucauuuggugcuuccucuuguucugcccuccaucccucaacucuuaauggcaucugucuccuagaacccacgcucuucagcuuuuuggcugauuuggagaacagugacaggugccugccugccuucguccccuuuuagauucauuuauaccacagauguuucugugagauacugagaucauaaaaagcuuuaggcuuggcagagaggacucaacacccccaggcuuuccugaggcaccaacuagaugucucuugagugagcuggacucccugggaaagaagcauugucugcaacauuauauuauaggaaauguaccaggaaugucaauaauaaugcuuuggggggggggguuauuuuguuuuguuuuguuuuuaauguuguuuguauauuuagagcugggccauuuuccgugcugcgauuucuucucuuugacccucuucaguguuuggggcaagaguggacccugguuuuuauuucuuugauugcauuguuuacugcacuaggaaaaauauagagauacagggaaacuacagacaaauuuaaggaaaaauaggucaaaaaagaaagcacacaccuuaagagugggaggaauauuuuuauuaaaaacaaaacuuggaccuguaguuuuuuuuuuucuuuuuuauuuuuaagaaggcaccuuucagaagccauguuucuuccaacagauguuggaaaccccaucgagcaaguaaaaguugcauucuccaucccucagauggcuguauguagucaaagaaacccuguaacaugguaagguugcuguuuuuuuuuuuuuuuucuuuuugagauggagucuugcucuguagcccaggcuggagugcaauggugugaucucagcucacugcaaccuccgccuccuugguucaagugauucuccugccucagccuccugaguagcugggauuacaggcucccaccaccacgcccggguaauuuuuguauuuuuaguagagacgggguuuugccauguuggccaggcuggucuugaacuccugaccucaagcgauccgcccgccuuggccucccaaaguguugggauuacaggcaugagccaccgcacccagccugaaggugacucuuaagaaugagauuuaugaacuccauacaguuguagauuucaguuuuuaaauagucugggguuuuauuuuucuuuucaaaauaucuaauagacuuagcaaucaauuuagaacaaauauuuggcccuuaauauaucuuuagugagggaaguagcuuuuauuuccugcuuguuuagguuuucuguugguacauaaaaacaaaauugcugucucagacugaaucuacuugaaucuaggaaggcacaucucaucccuauugugguuuuuagggacacuuuucucuuucccagagaugagaggaccaauucaggacagaagagcccucgugaauaccaacgugcuagcucagguucccuucuuuccuccaucagagcuauugguaggguuuuaaggucgugugugcaucaugcuuccaaugucaagagauuuccucaaacagccuguuuacuagaugaauuuuccagcuggugaaauacaugagcuuuguuguuuuccuggucuuccaauagccugucauuauuguuagauauuauggcaccuguuguugaauguagguucccuuacagcccuggucuagaugauccuagauggggugagacauaugcaagccauugguaugugcauaagcaguugcaaugaaccuuaggcugacuugguaguaggcauuugucuuucuguucaugcauugaauaaacauuuuuaagaaccaucuaugugccaggcuuugugcuaggcacugacaguagagagaugaagacauaguccuugcacuuaaggaauucauacuccagaugucuggaguuaagaaauacauauuucagccaggcaugguggcucacaccuagaaucccagcacuuucagaagcugaggcagaauugcuugaggccaagaguuuaagacuagccuggucaacauagccagaccccaucucuauaaaaaaauguaaaaauuagucaagucuuguggcucgcacuuguagacacaauuacucaggaugcugaggcaagaggauuuugcuugggccuaggaguucaaggcuguagugagcuaugacuuugccacuguacucuagcccagguaacagggcaacauccccagcucagaaaaccaaaacuacacauuucauuauaauuguuuuuuuuuguaauuuuauguauuuuaugcauugaaaaacauuauuuaagaauugguucauagguuucagcagacugccaaaggcacaaacaagcagcucuccuuuacugagguacugaaacagauccuacugcguaagugcugugugugauagggcuauuggcuaggagcugagagaacaaagcaugaagugccuaacccagcuuagcgguguagagguggggucagcaaauaagggagaucuuccuggagaaggcauauaccuaagcugauuuaggagagaccacuuuuggcuagguuuauuguacuacuugauuuucaaguaauugggcuuauuuauucuagagaaaaagucuucagucucuugcuucugccugcaaagcaaggcagagucagcaacaugggcagucuccccacuggagaacgcugagucaugcaugggcuucuccaaguuuccaucagaugggauccaguguugaauccagugcaggacuggagucuagcuggcaaaggguaaaugcccccaaagccuuccugccauaugguuuccacgaaggccugagagucagcuguacaacugucuugucuuggccaugucccuguuuggucccugccuuguucucuucccuuucucaauuuccaagcuccacccacuccuaaaaacaccagucauucugaaguaaaaaauggacaauaaacaugaauauucaagauucaaa

SEQ ID NO: 11 - RNA, 7084 nt, Homo Sapiens
gacuggaagaaggaggcgggcggcccgggccucaggccccucccaggcucugagucucccggcugcaggcggauggauggggcuucuucaggcgguggcggcagcagcgaagguggcggcggcagcagcggcagcggcuaugguguggucgcucgauucucccagugccuggcugaguuucggacgugguuaagaaccaacugguugagguucaaugcagacaagacggaugugaugcuguagaaaaugugcaucagauguuuauguuuaauugguuuacagacugucuguggacucuuuuccugucaaauuaccaggcggcuccugcgcguucccgccgaggcaguggcggcgggagcggcagagacggcagcggccggagucccguugcugagucucacauccggguucuggccgugacccagcugcggccgccgcggagaugugacccggcaguacggcaaauauggcggagcagccaucuguugaaucuucaaguccaggagguucagcaacaucagaugaccaugaauuugauccaucagcugacaugcugguucaugauuuugaugaugaacgaacauuagaagaggaagaaaugauggaaggagaaacaaacuucagcucugaaauagaagaucuugcaaggguaaauaacauguagagcuaggguaugaauugguuaugacuuuuuuguggaaagggaagaucugaaauuuugauucucugauuaggagagaaauuguguuauauauuaaugacugaaaaauuuugugugaucauaggugggauauuuaaaguuugaaaugaaaggauuuaaaaacaauaacuuuauuaugugcaauaacagaauucacauaguuacuuugguaaaacauagacuguuaaaugauucugcuauaaaggucuggucaaaaauggacuauaaaaggauucuacacggccucauauauccuuuguccuuccccaguuaccauaucuuuuacuuauucuccuucagagccaaaaauucuugaaguaucauuuuccauucacuacauaaagugcucuagauuaucuccacuacauaaagugcucuagauuaucuccaccucuuccuaucaaggugaccagugaacuuuccuuguuacauccauuuuuauauucacuuuucucucacuaccuuacuuuuucucagcaguauucaauauaguuuaacauucccuucuuuuacuugaauucuggaguacaccacugucugguuuucuuuaucuuuuuguuucuauucaguaucuuuugcagacucuucuuccguuacucaagguuuacauguuggcaguuugugauucucaguuuggaccuucuuuuuuucucuccugucucugucuggaucagugcuccucaaaauguaguaugagggucaguugcaucagaaucaacccuguacuuauuuuaaaaagcagauuuuuuggaccucucccccggcauacugaaucagaaucucuggaggugguguucagauccacaucuucauuaaguaaguuggcauuauauguacaccaaauuugaaaaucacuaagcugugugauuuaauuuauucccuugguguguauauccuuaguauucuuuaguuuauauuucuagcauuaaccuauuuccugucuccaguuuuguuuguccaccuugacauuucugcuugcuuaacuaaauggacaucucuaaauuauaaauguccaaaacagaacuauugacuguuguuuuuuucucugcuuguucuuucccuguccuaucaguaaaaagugguacuacuauuuacccuguugccuaagucagaaaccagugagucauuuuccuucucuuucaauaucuuauuucuaaauaaaccuaucauuuguauccacaagaauaucccuuagccgacucuugauccauugcugccuagauuaccauucuuucuagccuaggcuauugcaguagcuuccugacugguuuccccauuuccucuuuuaccaucuuucuccugauacauuuccacccagcagcugugaucuucuuuucaaaauguaaaucaauuaauaucaaccucccagcuuccuguuauauccaaagaaaacccaaacuccucaaccaggccagcaaggccaccugcaugauaauggccucuuacccauguaucacacuaccucuguuauagccacacuagcugcuuuuguuguuaaauaggcuaguuucuucugcuucaaggguuuucagcucauucucacucucugguauaugcaucccaaggccggcuccuuauccucuggguucgguguugccuccucagaauagcagccuuuccuguccccuaauuagguuuuaauuaguuuuuuguuuuauuuuuauuuuuuuuuaaccacuguccccuauucaaugcuuucuuuaguguuaggacacaauuuguaauuguuuguuuaauuuauugucuguaccuccacugguuuugagaagaugaaauaaaaugacuguuauucaccaguguauuucaugguaccuugcaagagugcucacucaaaaguauuguaugaaugaauggauauaucagucugguauguucuaauaaaauauaucaugcagaaggcgacaugccaauucaugaacuucucagccuuuaugguuaugguaguacuguucgacuaccugaagaagaugaggaagaggaagaagaggaagaagaaggugaagaugaugaagaugcugauaaugaugacaacaguggcuguaguggggaaaauaaagaggagaauauaaaggauucaucaggucaggaggaugaaacucagucuuccaaugaugauccaucacaaucuguugcuucucaagaugcccaggaaauaauccgcccacgucgauguaaauauuuugauacaaauagugaaguagaagaagaaucugaagaagaugaagauuauauuccaucagaagacuggaaaaaggagauuauggugggcuccauguuucaagcagaaauuccaguuggcauuuguagauacaaagaaaaugaaaaaguauaugaaaaugaugaucagcuccugugggacccugaguacuuaccagaagauaaagugauuauauuucuuaaagaugcaucuagaagaacaggugaugagaaggguguagaagcaauuccugaaggaucucacauaaaagacaaugaacaggcuuuauaugaauugguuaaaugcaauuuugauacagaagaagcauugagaagauuaagauuuaauguaaaagcagcuagagaggaauuaucuguuuggacagaggaagaguguagaaauuuugaacaagggcugaaggccuauggaaaggauuuucauuugauucaggcuaauaaaguccgaacaaggucaguuggugaauguguagcauucuauuacauguggaaaaaaucugaacguuaugauuucuuugcucagcaaacacgauuuggaaagaagaaauauaaucuucauccugguguaacggauuacauggaucgucuucuagacgaaagugaaagugcugcaucuagucgagcaccauccccucccccaacugcaucaaacaguaguaacagccagucugagaaagaagauggcacuguaagcacugcuaaucaaaauggagugucaucuaauggaccaggugaaauauuaaacaaagaggaaguaaaaguugaaggguuacacauuaauggaccaacagguggaaauaagaaaccacuucaugcagauauggauacuaaugguuaugaaacagauaaccuuaccacugacccaaaacuugcccauaugacugcaagaaaugaaaaugauuuugaugaaaaaagugagagaccugccaaaaggcgaaggguaaacagcaauggaaaagaaaguccagguucuucugaauuuuuccaagaagcagucucacaugggaaauuugaagaacuugaaaacacagaugacuaaauuuuagaccuauuuuacuuucuuuggaguaaauucuggugugacuaaaauuuucaggguugauggguuaccuuaaaaaguugauuuccuugaagcaguuugaaaauuugaauugagucuuaacuuuaggaaaugagguuucauaauucugccuuuugcagauuuuuuuacuuuaaagcugucagacucuuuuaaggguauuuuaaaaauuaguaaauuugaaugaacuaaagauauaucucuaccuucucauuugaauaucuuuaguucauucagauuuacuaauuuugguaaaucugaaugaacuaaagauguaucuguaccuucucauuugauguauuaaucauaaaauuucacuacaagguaauuuuugcuuaguuugauggaugaaugggaaacucaaguccaaauuucugcuuaauaccaauuucucugaguuucuugaaaugucuuuaaaacagacauuuuucucaccaaacaguuugaguaucuuuauuaaggaaacccuuacgaauccugaaaauuaugcuagcaugauuuuuuuauauauagaaguuuaaaaauaaaccaggucagguuuguauauguaaaauuguugacaucaaugaugucuuuccauauucuuaucugggcuuaagaaauacauucuguauuuuuccagauucuuuguagccuuugaaagauuuuuacaguacauaugucuugacugagcuguccuuucuuaauacaaaagcguguauaauuuucuuaacuuguacaguugguaaacuuuuaugagaggaauuguuauucugagucugucagcuuucauuuuauuuugcuaagguuuuucuaaugaauuuuuaaguguuuguguaguaauuaagucauauuucuuauccaggugguuaaagcauucauaaaggauuauaaaauuuuuuuuuuuuuuuuuuuuuuuaaauuucuacuuaagggcaaguaauuugagaauucugaaauuaagcaugaugcuuagauugcaguuuguuuugcauuugcuauaauuuucaaaauuauuuuugaagcaagacaaaaguuuaaugucagcuuaagugcuuaaauauaucaugcugaccagaauccuguuauuuuuauaugcaucauaaaauuucccauuucugcauuaaauaaacagaggaggggggucaagugauacuuagauauuggcacacacaaggaacaacuguuggcaggcaguaucgauuuuaugaagagaaagugaaguuugaaaacuuuucaaacuuuucuaguuacaauccaauuuuucagauuugauaaugcuuuuccaaagugaaaauaagauacacaauaaucauugcucugugugauuacagauaggauuauccaucugcauagccuuguaaaagugccauuuuauuuuuagugcuaaauucuuguuaaauaauguaguuuuauauagcugauagaccaaccuauauccaaacuuuuauaaaauauuaauuauucuuguuuuucucacacaggcauacuccaaaugcuucuuccaguucauuuuucagccaucaguucaagagccaaugccuuuuuaaaauaaagcuucuguggucuuguuuuuaauggcucaacugucugauguaauugagugaagguuugcacugagaaauuagcauucaggccuuacccccaugaaguauuacuguuaacauauguucggacugcuucccuucaccaaugugaacaacuuuuuuucccaaacaguguuaaaagccacuuugcaacacuugacuucaucuuaauguacauucacuguuguuacauacauaucuaaguaaaucaaaguuuuggguggaaguguugagaaguaugaguuuuuuguuguuuuuguuuuacuuaaaacuuuuaauuuauccagaauggcaguagcuuuagcaagcagauggucacaaucuguuuucuaaaucauuuuuuauuaaaugaauccaaaguauccuagcucuuugucaaagauggucuguagaaauguuuuuaaagauuagggaugcuguacuuuuugaauuguugcaguguuggagaugccauuuucaccuuuuuaaaaagaugcauuuuauuugcagguuugugaaguucuugcaaacucuuacuacagaaauguuuuaaauacauucucaggcauguuugcaaaaauauggcacauguauacauuuuaggaaauguuacuuuuguuaaucuuuaaaaaauacaccuaaugaaagacauuccacuauuaugcguaaugcucagcuuuuuguaaagaaauauuuaauuguauuuuguguuuauacagguauuucacacaauaauuuguucuuaaugcagccacuauaacuugauaagucauugcacuauuuaaaaaguuuuaguaauaucaugaauuuaauuugcuuaagauuuaguacauuucagaacuuuugaacuuuugacaaauugcauuggaaaaagaagucuguuaauagugauuuagucuccccgccucauucccacccccaacaaagcacuaucauuuucauuuggaauggguauuuucuguuucaugauguauuuucaaauagaguucaggaucugcaauucaguucaacacaaguuuguugagcuuuaaaauguauuugaaguaauauuuaaauaggcauuuaaaauuucaaauuagauguuaaauuuaugcauaguaauuuugcacuguaaaauaauucccuucucccauuccuugucugccauucugaauaugcuuauuaaaauauuuuuuuaaacauauuugccuacauaauacugugugaauauuuucauuagauuaauucacuaagauuuuauuagagauuguuugaaugaugcauguuauugacaaggcaaauauauauauauacacagucuguuucuucuauuccuagacauauugcacuacuuuuucagugguucuugguccccuuuaccacaucuugggugauguauuuuugucuucuuccccuuugccacaagagauccuuucagucccuagaccuccauucacucuguuucucuucugcuggauuauauaauuuaaaaauaauguguucccguauuuuguaguggaguucauaucacauuauguuuugcaaaauaaaacuuguuuugucacaaua

SEQ ID NO: 12 - RNA, 4616 nt, Homo Sapiens
gccauucggcaccggagucgcuccgcgcucccagaaugcaccggcaguccgcgggaaaccaaaauggcgaggggcuguauugaagugggcuguguuugaggccgguguaagaacgcucauucuacccccaacccuugucuccaaggaccucgguuugugcgugcauaugugccggguacccgguggggcgggugcccaguaagugcucggacucgcaggggaagcgcccacggggacggauugguuguuuuuuccuguaugaagcgguuggcaccacugaagugaccgaaugagagagacucuacaggggcagguaauucacugguccacaagcggucuccuuuacgucgaaaccaaaagaccccaacauccuugaccaagcugucuuuacaggauggacauaaagccaaaaagccagcauguaaauuugaagagggucaggauguccuagcuagauggucagauggcuuguuuuaucuuggcacuaucaaaaagauaaacauauugaaacagagcugcuucaucauauuugaagacaguucuaaauccuggguucucuggaaggacauucaaacaggcaguggagccacuggaaguggggaaauggucuguacaauaugucaagaagaguauucagaagcucccaaugaaaugguuauaugugacaaguguggccaaggauaucaucaguugugucacacaccucauauugauugcagugugauugauucagaugaaaaauggcucugucggcaguguguuuuugcaacaacaacaaagagggguggugcacuuaagaaaggaccaaaugccaaagcauugcaagucaugaagcagacauuacccuauaguguggcagaccuugaaugggaugcaggucauaaaaccaauguccagcaguguuacugcuauuguggaggcccuggagacugguauuugaagaugcuacagugcugcaaauguaagcagugguuucaugaggcuugugugcaaugccuucaaaagccaaugcuauuuggagacagauuuuauacguuuauaugcucugucugcaguucuggaccagaauaccucaaacgucuaccauuacaguggguagauauagcacaccuaugccuuuacaaccuaaguguuauucauaagaagaaauacuuugauucugaacuugagcuuaugacauacauuaaugaaaacugggauagauugcacccuggagagcuggcagacacaccaaaaucugaaagauaugagcauguucuggaggcauuaaaugauuacaagaccauuacuccuuuuauuuucugggccucuaggauuuaucuccugcuuucuuuuucaaugcugucaccuauuauuucugacuaagguuuuucucuuuauaaauccacucugagauggaauucuuuuuucccuaaaucccuuuugaaauauuucuaacagaugacacuaaauaugggaaagcauauugggaccaaaaauauaccauucuuuguucuucuuucuuccuuuaaaaaguuaguugccauguuuaaaaagaaaaguggacaugugcucuucuccuuucugguccuaucccuuccuccccaucauauccuacuguagacuggcucuggggcagauaaaaaucaaggaaagcaaggggaagugaauuuuuguaguauugggugggcuuucaaguauaagggccuuauauaugaaaguuaaguuagggucuacuauguauauguguucaguuuuuaaaauuuuaguuaauuuuuuuaaaaauuuagguuuaugucugggaaagaaauaaagaagaagaagcauuuguuuggguugcgaauucguguuccuccugugccaccaaauguggcuuucaaagcagagaaagaaccugaaggaacaucucaugaauuuaaaauuaaaggcagaaaggcauccaaaccuauaucugauucaagggaaguaagcaauggcauagaaaaaaaaggaaagaaaaaaucuguaggucguccaccuggcccauauacaagaaaaaugauucaaaaaacugcugagccacuuuuggauaaggaaucaauuucagagaauccuacuuuggauuuaccuuguucuauagggagaacugagggaacugcacauucauccaauaccucagauguggauuucacgggugcuuccagugcaaaagaaacuaccucgucuagcauuuccaggcauuauggauuaucugacuccagaaaaagaacgcguacaggaagaucuuggccugcugcaauaccacauuugcggagaagaagaggucgucuuccaagaagagcacuccagacucagaacucagaaauuguaaaagaugaugaaggcaaagaagauuaucaguuugaugaacucaacacagagauucugaauaacuuagcagaucaggaguuacaacucaaucaucuaaagaacuccauuaccaguuauuuuggugcugcagguagaauagcauguggcgaaaaauaccgaguuuuggcacgucgggugacacuugauggaaaggugcaguaucuuguggaaugggaaggagcaacugcauccugacuguaggacugaacauuauguucacugcacucugauuuucuguagguacaguucaaagcccuaaaggagucuggcuuuuacuaucuuucuuaaaaaaaaaaaaaagucaaaaaaauucaaaaaaggggaugauacuagccuuaacauguaccugucaauguuauggauauugucauaaaaagguaucuuuuaaaaaucagaacagagacuuaauuuuuuaaaucuuaagauuuguagaauguuucuaggauaggauauuaaaaaugauugaaacccaugcaugguguuagacaauuuuucuaauuauuccauugagucaguuuuuugugauuagugauuaucagagcaaacaucauguagauagcacaaguauuuggagaaacguuguuuguuuuguuaccaaaauguuggaaaaauuuauuucaauaccuuuuagauuucauaaagugcaguguauauaaugccuacugaaagacuguaaaauauugaaauuuucuuucaagcaaaguguaaaaaaauauauugagccuguaaauugcucugugacuagacuucauugucgucuuaauauauucuugcaugugcauauauauacacacguguauauauaugugugugauuaugugaccuaugcaauacaaauuaugggaaugggcagcuuuggaguauauaucccauaauucuuuuuucaggaauaguugcaguauuuacacagcagcauuucuucucaggcuuuuauugggugcuguugcuugcuauguaugaagagaaaugugucagacaaguuuaguguguucugaagaagggugugaacaacaguguucaugggcuuuuagaaugcuuuucacuuuuaguccuuguaacucagcuguucaguaccuaaaacaaauucaaauaauaugaacauuaucuccuacuagaaguaacguuuucaaguuuucauggcacauuaugauuguaaaugucucucauuuuuaacaguaagucuauaggagucccgugaagauuccugaaaugucuguaguaacuguuagucauguuugaauaaguguaguaugaacaaaguauuuuauugcacaggguuaacaaacaguauguugccagcugaggcuacugcuguuuuauuacaacauuaccucuuguuuuuauaaaguguaccaagauuuaaauugauaacuuuauuuuacuuguaaaaaaaaaguuucuuuuaucaccaguguuacaguugucuucuguuucuuuuuguuuuguuuuauuuguuuuccuuuuuagccaaagagugaacagaagauuuucuuauuuugguggcuauucauuuuacuuuuaaaagugauugguggauuuuagacuaauuaugggggaauuugccaccaaaauaaaaaauauguaaaguguagugauuacagagugguuaaaauguggguuaguacuuauuuauuccauuaauugauuauuugacuguuuauaaagaaaguugcuuuauuucuuuaaacaucuucaaaagaugauccuuucuugucacauuauagccaaaagaagcagagaacuucauugucugcauuugguuccugguuggccagguauaaaugagcuuuacaaaagugcaaauuaaaaacuguuacuucuguuuaccuccaccaaaacuugauuuuccccuagcuauuaauuuaagguugccuuuccugcagcugcaauauuuugaauaacacacagaguuuguguugauuuuugaauguuuguuuauaucuagggguaaugaaaaauguaaaucccguguauccuuauucacuccaccuguaucauauuauuucauuuuccccaaaguccuuuaauucuaacugaacaccagcaguauuuuuagaaauuuuucuuuaacauacuuggaagaugauuuauccagcugaacugucuuuagacguaauuauugugaaugucuguuuuauuuucucauggugguucacauggcucugauguucaguuuguauuuuuggaauugcuuuacuuagaaauuaaaacagaccaacauuaaauguguguauuuuuuaaagagcuaa

SEQ ID NO: 13 - RNA, 2777 nt, Homo Sapiens
aggcaggccgggcccucaagauggcggcgggcgcccagagcggcucggcccggcaguaguggugggacggcacuagcugcuggggccugccgccccgggaguggcugcagcagcgccaggaaucgaggaugguaaaaugacccaggggaagaagaagaaacgggccgcgaaccgcaguaucaugcuggccaagaagaucaucauuaaggacggaggcacgccucaaggaauagguucuccuagugucuaucaugcaguuaucgucaucuuuuuggaguuuuuugcuuggggacuauugacagcacccaccuuggugguauuacaugaaaccuuuccuaaacauacauuucugaugaacggcuuaauucaaggaguaaaggguuuguugucauuccuuagugccccgcuuauuggugcucuuucugauguuuggggccgaaaauccuucuugcugcuaacgguguuuuucacaugugccccaauuccuuuaaugaagaucagcccauggugguacuuugcuguuaucucuguuucugggguuuuugcagugacuuuuucugugguauuugcauacguagcagauauaacccaagagcaugaaagaaguauggcuuauggacugguuucagcaacauuugcugcaaguuuagucaccaguccugcaauuggagcuuaucuuggacgaguauauggggacagcuuggugguggucuuagcuacagcaauagcuuugcuagauauuuguuuuauccuuguugcugugccagagucguugccugagaaaaugcggccagcauccuggggagcacccauuuccugggaacaagcugacccuuuugcguccuuaaaaaaagucggccaagauuccauagugcugcugaucugcauuacaguguuucucuccuaccuaccggaggcaggccaauauuccagcuuuuuuuuauaccucagacagauaaugaaauuuucaccagaaaguguugcagcguuuauagcaguccuuggcauucuuuccauuauugcacagaccauagucuugaguuuacuuaugaggucaauuggaaauaagaacaccauuuuacugggucuaggauuucaaauauuacaguuggcaugguauggcuuugguucagaaccuuggaugaugugggcugcuggggcaguagcagccaugucuagcaucaccuuuccugcugucagugcacuuguuucacgaacugcugaugcugaucaacagggugucguucaaggaaugauaacaggaauucgaggauuaugcaauggucugggaccggcccucuauggauucauuuucuacauauuccauguggaacuuaaagaacugccaauaacaggaacagacuugggaacaaacacaagcccucagcaccacuuugaacagaauuccaucaucccuggcccucccuuccuauuuggagccuguucaguacugcuggcucugcuuguugccuuguuuauuccggaacauaccaauuuaagcuuaagguccagcaguuggagaaagcacuguggcagucacagccauccucauaauacacaagcgccaggagaggccaaagaaccuuuacuccaggacacaaaugugugacgacugaaaucaggaagauuuuucuaucagcacccaggucuuaguuuucaccucuaguucuggauguacauuccauuuccauccacaguguacuuuaagauugucuuaagaaauguaucugcaugaacuccgugggaacuaaaggaagugggaacuuagaaccagacaguuuuccaaagauguuacaauuucuuuugaaaaaccuuuuguuuauuagcaccaauuucuugccacuaagcuauuuguuuuauuauacauccuuuaauuaaaaacuauauauguaacuucuuagauauuagcaaaugucucugcuaccauuuccuuaagguguugagcuuuaacucuaugcugacucagugagacacaguagguaguaugguuguggaccuauuuguuuuaacauuguaaaauuuugagucagauuuuaauauuguaaaaucuugggucaaauaauucaaagccuuaaugcagaugcacuaaaacaaagaaaugguaaaugaauuguuugcauuuaaaaaaaaaaacucuuaagaaaacuguacuaaaucugaaucauguuuugagcuuguuugcaguacuuuuaaacauuauucacuacuguuuuugaagugagaaaguaucagccauuuagcauuuaaguugggguauuuagagccuguaaucuaaaugcuggcucaaauuuauuccccagcuacuucuuauaccacuauucuuuuaauguuugcauaaucauaagcaccucaacacuugaauacauaaucuaaaaauuauauaguaaagcugguagccuugaaaaugucagugugauaucuauuauguagauaaauauauauaguggccuuucaggacugucacaguaacacuuuauuuacagagcuaauguuuguccuaaauuuucaggacccuagaggagagcuuuauacaauuaccgaugugaauuucucuaaaguguauauuuuuguguccaguuauauuauuuaaaaaaguguuacuuuguaaaaauuguauauaaagaacuguauaguuuacacuguuuucaucuugugugugguuauugcuuaaugcuuuuuaaacuuggaacacucacuaugguuaaauaaggucuuaaaagaaauguaaauauucuguuaauaaaguuaaauauuuuaaugauuuuuuuuuuaaaaaa

SEQ ID NO: 14 - RNA, 2480 nt, Homo Sapiens
aaaguagguugggaguggaaggugguggcugcugcuccgcagugucgggaagauggcgccgccgguggcagagagggggcuaaagagcgucguguggcagaagauaaaagcaacaguguuugaugacugcaagaaagaaggcgaauggaagauaaugcuuuuagaugaauuuaccacuaagcuuuuggcaucguguugcaaaaugacagaucuucuagaagaagguauuacuguuguagagaauauuuauaagaaccgugaaccugucagacaaaugaaagcucuuuauuucaucacuccgacaucaaagucuguagauuguuucuuacaugauuuugcaaguaaaucggagaacaaguauaaagcagcauauauuuacuucacugacuuuugcccugauaaucucuuuaacaaaauuaaggcuucuugcuccaagucaauaagaagauguaaagaaauaaauauuuccuucauuccacaugaaucucagguguauacucuugauguaccagaugcauucuauuacuguuauaguccagacccugguaaugcaaagggaaaagaugccauuauggaaacaauggcugaccagauaguuacagugugugccaccuuggaugaaaaucccggaguaagauauaaaaguaaaccucuagauaaugccaguaagcuugcacagcuuguugaaaaaaagcuugaagacuacuacaagauugaugaaaagagccuaauaaaggguaaaacucauucacagcucuuaauaauugaucguggcuuugauccuguguccacuguccugcaugaacugaccuuucaggcaauggcauaugaucuacuaccaauugagaaugauacauacaaauauaaaacagauggaaaagaaaaggaggccauccuugaagaagaagaugaccucuggguuagaauucgacaucgacauauugcgguuguguuagaggaaauucccaagcuuaugaaagaaauuucaucaacaaagaaagcaacagaaggaaagacaucacuuagugcucuuacccagcugaugaaaaagaugccccauuuccgaaaacagauuacuaagcaaguuguccaucuuaacuuagcagaagauugcaugaauaaguucaagcuuaauauagaaaagcucugcaaaacugaacaggaccuggcacuuggaacugaugcagaaggacagaaggugaaagauuccaugcgaguacuccuuccaguucuacucaacaaaaaucaugauaauugugauaaaauaagagcaauucuacuuuauaucuucaguauuaauggaacuacggaagaaaauuuggacagguugauccagaauguaaagauagaaaaugagagugacaugauucguaacuggaguuaccuugguguucccauuguuccccaaucucaacaaggcaaaccguuaagaaaggaucggucugcagaagaaacuuuucagcucucucgguggacaccuuuuaucaaagauauuauggaggaugcuauugauaauagauuagauucaaaagaauggccauauuguucccaguguccagcaguauggaaugguucaggagcuguaagugcucgccagaaacccagagcuaauuauuuagaagaccgaaaaaaugggucaaagcugauuguuuuuguaauuggagggaucacauacucugaagugcguugugcuuaugaaguuucucaggcacauaaauccugugaaguuauuauugguucuacacauguuuuaacacccaaaaagcuguuggaugauauaaagaugcugaauaaacccaaggauaaagucuccuuaauuaaagaugaauagcauuucuuuuuggaggguuuagagauucuuacuaauauguugaacuaaaauagaaagaaaauguugcugucauguaauuuaaacaauguaaauauuuuauggaauaauggcuuuucaaauacauuucuuaaggaacuguuuaugauuauuacuggauuugucauuuuugauaauuuaaauauugcugcugcuuuguagaugaugagaagaaauguuaaagugcuuucuaaaaggaaauuuuuucaccuuuggaggagaauauauuagaguuguggguaauuuuucacagccaccuauguacauacuaauuacccauuggauacuuauaucuaaaagucucaugcugaaguauaguuuuugggaaagaaugauuuuaaauaaagagauuguaaaaguaaaaaacuguaaauguauauguaugauagaauuguuuccucuaaguguaguuuuucuuucaacuaaaauucaguuuauguguaaaauaauucagucauuaauagaaauggagugauuucacaguguguacuguuuugccacauacuucuaaagaacacaauuuuauauaauuuugaaaucauguauguuuaaauuagaaaaccaaaaaucaugaacauucuaagagaaaauaaauauagaauuuaaaaaauua

SEQ ID NO: 15 - RNA, 4019 nt, Homo Sapiens
ggacccggaaggggcaggucuugugggcggguccaaucggcugggagccucguggaggcugagagauugcuucaccugugguaucagacaucacaacauggggcucaccaagcaguaccuacgcuauguugcuagugcggucuuuggcguuaucggcagccaaaaagguaauauugucuuugugacacuucguggugagaaaggacguuauguggcaguaccagcuugugaacacguuuucaucugggacuuaaggaaaggagagaaggucuagcuagccaagcaucaaguuccuuuguguucuucgccacugaauucugaaaaccacaaugaaauaggagcuuauuucuuagaugucuauuuguuggaauauuuacagauucuuauccuucaggggcuuaaacaagaaguuacuugcuuaugccccuccccagaugggcuacacuuagcuguuggguaugaggaugggucgauccgaaucuucagucuccugaguggggaaggaaaugugaccuucaauggucacaaagcagcuaucacuaccuugaaguaugaucagcuaggaggcagacuggcaucuggguccaaggacacagauauuauuguaugggaugugaucaaugaaaguggucuguaccgucuaaaggggcacaaggaugccaucacacaagcauuguuucuacgagaaaagaaccugcuaguuacuagugggaaagauaccauggugaaauggugggaccuugauacucagcacugcuuuaaaacaaugguuggccaccggacugagguauggggguugguucuguugucagaagaaaagcgacucaucacuggggccucagacagugaacugaggguaugggacauagcuuaucugcaagagauugaagacccggaagaaccagaccccaagaaaaucaaaggaucuucuccuggaauacaagauacucuugaggcagaggauggugccuuugagacggaugaagccccugaggaucgaauccuuucaugcagaaaagcugguuccauaaugcgggaaggaagagacagaguuguaaaccuugcagucgacaagacaggcaggauucuugcuugccauggaacugacucugugcuagaauuguuuuguauccuuuccaaaaaggaaauucagaagaaaauggauaagaagaugaagaaagcuagaaagaaagcaaaauuacauucuagcaaaggagaggaggaagauccugagguuaauguugaaaugagucugcaagaugaaauccagcgggugacuaauauaaaaacuucugccaaaaucaaguccuuugacuugauucauucaccucacggagaguuaaaggcugucuuccugcugcagaacaaccugguggaauuguauucacugaauccauccuugccuacuccucagccugucaggacaagcagaaucacuauugggggucaucgcagugaugugcggacuuugucauucagcucagacaauauugcuguucuuucagcugcagcugauuccauuaaaauauggaacaggucuacacugcaguguauucgcacaaugaccugugaauaugcacuuugcucauucuuuguaccuggugauagacagguagucauaggaacaaagacagggaagcugcagcuuuaugacuuggcuucagggaaucugcuggagacaauagaugcacaugauggagcuuugugguccaugucccucucuccagaucagcguggcuuugugacagguggugcagauaaaucugucaaauucugggauuuugaguuagugaaagaugaaaauaguacccaaaagagacuuucugugaagcaaacccgaacuuugcaacuagaugaagauguucugugugucaguuacucucccaaucaaaagcuauuggcugugucuuugcuggacuguacugugaaaauuuucuacguugauacuuuaaaguuuuuucugucacuguauggacacaaacugccuguuauaugcauggacaucucucaugauggagcacucauagcaacuggcuccgcugauaggaaugugaaaaucugggguuuggacuuuggggacugccacaagucucucuuugcacaugaugacagugugauguaccuacaguuuguacccaagucucaccucuucuucacugccggaaaagaucauaagauuaaacagugggaugcagacaaauuugaacacauacagacucuggagggucaucaccaggaaauaugguguuuggcuguaagccccaguggagacuauguuguaucaucgucccaugacaaaucucugagacuuugggagagaacaagggagccucuuauucuugaggaagaaagggagauggaaagagaagcagaauaugaggagaguguggccaaagaagaccaaccagcaguuccaggagagacucaaggugacaguuacuuuacuggaaagaaaacuauugaaacagugaaagcagcugagaggauuauggaggcuauugaguuguaccgagaagaaacugcaaaaaugaaggaacacaaagccauuuguaaagcugcagggaaagagguuccacuucccagcaaccccauccuaauggcuuauggcaguaucucaccuucagcuuauguauuagagauuuuuaaagggaucaagucgagugagcuggaagaaucucuacuugugcugccuuucucuuaugucccagacauucuuaaacucuuuaacgaauucauucagcugggcucugauguugaacuuauaugccggugccucuucuuccuccuuaggauucacuuuggacagaucacuagcaaucaaaugcuugugccagugauagaaaaauuaagggaaacaacuauuucaaaagucagccaaguccgggauguuaucggcuucaauauggcuggucuugauuaucucaagagggaaugcgaggcaaaaagugaaguuauguuuuuugcugaugcuacuagccacuuggaagagaagaagaggaagaggaaaaagagggagaaguugauucuaacguugacuuagaacugaaaugugguaucuuuuuuuuuuucaacuuuuuccuuuaaaggacuccuaaacuaagcacagaagaguuggcgucaucuuaaaaauaccaaauaacagaagaucgcauugcagaugauaucaggaugugguuuccagcuuugccugagggaauuccaacaugagauuaugggcuggcuccauuucuuggacuuaaaaugcauuauuaguuuaaaaaucuuucugugcucucaaagcuugagccuugcagcucaagcuuguuguucccuuuauauucuagcagggaauaaauaauuguuuuaauuagguauuuguuucauuggaguugaaauuaacauuucaaaaguuuuucguauuuuuuuauggcagaugauuugucauuuauuuauauuagguuuuacugccuauugagacaaccaggugcauaauugauugcccuuuggccauaaaaaugcagugucauggaucuuagagcuaaaaaggacuguaaaaauuacccagaacagcguccucagacuuaaccuucugcaaguuaugucuguauauaagaagauucuaauugcuaacuguuuauacuuuucugaauaaaauaguuguuucuaauuaaaaaguagccaagcuaagaugccuggcugggcuucugaggaauuaauacacucguguguguguguguguguguguguguguguguguguguauguguauguguauguacacauacauauauauaguugacacuugaaaaaugcaggugguaggggcacugacccaccccuacgccccgcacagucaaaaaucugcauauaacuuuugauuccccaaagucuuaaguacuaguagccuguuauugacugggagccugacugauguauuauauauauuguauacuguauucuuaaaguaagcuagagaaaagaaaauguuacuuagaaaaucauaaggaagagaaaauauauuuacuguguuuaucaauacu

SEQ ID NO: 16 - RNA, 1374 nt, Homo Sapiens
gggaucuuauccauagaacagcucaucagccggguuggugugauuggagugacucucauggcucuucuuucuggauuuggugcugucaacugcccauacacuuacaugucuuacuuccucaggaaugugacugacacggauauucuagcccuggaacggcgacugcugcaaaccauggauaugaucauaagcaaaaagaaaaggauggcaauggcacggagaacaauguuccagaagggggaagugcauaacaaaccaucagguuucuggggaaugauaaaaaguguuaccacuucagcaucaggaagugaaaaucuuacucuuauucaacaggaaguggaugcuuuggaagaauuaagcaggcagcuuuuucuggaaacagcugaucuauaugcuaccaaggagagaauagaauacuccaaaaccuucaaggggaaauauuuuaauuuucuugguuacuuuuucucuauuuacuguguuuggaaaauuuucauggcuaccaucaauauuguuuuugaucgaguugggaaaacggauccugucacaagaggcauugagaucacugugaauuaucugggaauccaauuugaugugaaguuuuggucccaacacauuuccuucauucuuguuggaauaaucaucgucacauccaucagaggauugcugaucacucuuaccaaguucuuuuaugccaucucuagcaguaaguccuccaaugucauuguccugcuauuagcacagauaaugggcauguacuuugucuccucugugcugcugauccgaaugaguaugccuuuagaauaccgcaccauaaucacugaaguccuuggagaacugcaguucaacuucuaucaccguugguuugaugugaucuuccuggucagcgcucucucuagcauacucuuccucuauuuggcucacaaacaggcaccagagaagcaaauggcaccuugaacuuaagccuacuacagacuguuagaggccagugguuucaaaauuuagauauaagaggggggaaaaauggaaccagggccugacauuuuauaaacaaacaaaaugcuaugguagcauuuuucaccuucauagcauacuccuucccccucaggugauacuaugaccaugaguagcaucagccagaacaugagagggagaacuaacucaagacaauacucagcagagagcaucccguguggauaugaggcugguguagaggcggagaggagccaagaaacuaaaggugaaaaauacacuggaacucuggggcaagagaugucuaugguagcugagccaaacacguaggauuuccguuuuaagguucacauggaaaagguuauagcuuugccuugagauugacucauuaaaaucagagacugu

SEQ ID NO: 17 - RNA, 1713 nt, Homo Sapiens
cgccuugacagaagcugucuaucgggcuccagcggucauguccggcagaggaaagggcggaaaaggcuuaggcaaagggggcgcuaagcgccaccgcaaggucuugagagacaacauucagggcaucaccaagccugccauucggcgucuagcucggcguggcggcguuaagcggaucucuggccucauuuacgaggagacccgcggugugcugaagguguuccuggagaaugugauucgggacgcagucaccuacaccgagcacgccaagcgcaagaccgucacagccauggaugugguguacgcgcucaagcgccaggggcgcacccuguacggcuucggaggcuaggccgccgcuccagcuuugcacguuucgaucccaaaggcccuuuuuagggccgaccacuugcucaucugaggaguuggacacuugacugcguaaagugcaacaguaacgauguuggaagguaacuuuggcaguggggcgacaaucggaucugaaguuaacggaaagcuaccgcggcccauagcgcucacagccguaaagacuuaagucguugaccgaaagcggcuuuuucacuuaccugggcuuuuuuuuuuuuuuuuuuuuuuuuuuuaaagccuuuaucgguaugaaagguugaaugcucuagguuugagcacugcuuucucggcuugcucuucuggugcaguauaggcacaccuagagggccacgucagucuuugcgaucaccaaaucugguucugagaaauaggcacuggcaauuuacacaugccuugcuguguaaucucacuauauuugcucaggcaaagugggagaagcagccuuagguuuucauucuagagaugccggcuuucccaccugaucggcuuagaguucacgauugacuguuuugggcuucauuucacccucuacauaacaagcggguggacuagaugccuuagcaaggguccguguuguguggugucuccagccacgcacucagcucaaucuuagcacaguuaaaaaaugccuuucuagcaaguuaucugcccagugccugaaaaguaucauuucuuguguucaauaaaaagccuccuaauuuaaucaaggaccuaugagauaacugucuuuuaguuguggcauugcaaggauacaaaugcagagauauuuuaaagugauccuucuguaagagugaaccaacgauaugaucugaaagcaacuucacagguaauucaggcuuaugauuuuacuguguauguauuugggagaagaaauucugucagcucccaaaggauaaaccagcaguugcuuuauuggucuucagauguggcugcaaacacuugagacugaacuaagcuuaaaacacgguacuuagcaaucggguugccagcaaagcacuggaugcaagccuugccuuccagaagcuuaccagucggguugccagcaaagcaguggaugcaagacuugcccuccaggagcuuaccaucacaacgaagaagacaaauaaaugcauaauauauagacgacauaaauccauacuguacacauuuaagaauaaacaguccaguaguaagaggcaguacauauucaaucugcugagaaauguagacaauaacuacuauaagaauccuaaugcuacagaagucacuggcugcugggaaaccggggaaaacuuggcuauggacgugggggcuugugucggacucugaauaaagagcagaaugauuggc

SEQ ID NO: 18 - RNA, 925 nt, Homo Sapiens
agcacagcugcacagugcugucagaacggccgaucuccagcccaagaugauuccagcaguggucuugcucuuacuccuuuugguugaacaagcagcggcccugggagagccucagcucugcuauauccuggaugccauccuguuucuguauggaauuguccucacccuccucuacugucgacugaagguaauccaagugcgaaaggcagcuauaaccagcuaugagaaaucagaugguguuuacacgggccugagcaccaggaaccaggagacuuacgagacucugaagcaugagaaaccaccacaguagcuuuagaauagaugcggucauauucuucuuuggcuucugguucuuccagcccucaugguuggcaucacauaugccugcaugccauuaacaccagcuggcccuaccccuauaaugauccuguguccuaaauuaauauacaccagugguuccuccucccuguuaaagacuaaugcucagaugcuguuuacggauauuuauauucuagucucacucucuugucccacccuucuucucuuccccauucccaacuccagcuaaaauaugggaagggagaacccccaauaaaacugccauggacuggacucauggagucucccucuaucaccaggcuggagugcaguggcaugaucugggcucacugcaaccucugccuccuggguucaagagauucucgugcuucacccucccgaguagcuaagacuacaggcaccaccaugcccagcuaauuuuuuuuguauuuuuaguagagacaggguuucacuauguuggucuugaucucuugaccucgugaucugcucgccucagccuccuaaagugcugggauuacaggugugagccaccgagccugaccuggaaguaacucuuuuaaagauaaagugggaauaaacuuuuauu

SEQ ID NO: 19 - RNA, 1215 nt, Homo Sapiens
gccugggcggggcgcgccgcgguuggcgccugggcggcugggcggcugccuagcacccggaagagccgucaacuuagcgagcgcaacaggcugccgcugaggagcuggagcugguggggacugggccgcaauggacaagcugaagaaggugcugagcgggcaggacacggaggaccggagcggccuguccgagguuguugaggcaucuucauuaagcuggaguaccaggauaaaaggcuucauugcguguuuugcuauaggaauucucugcucacugcuggguacuguucugcugugggugcccaggaagggacuacaccucuucgcaguguuuuauaccuuugguaauaucgcaucaauugggagaguaccaucuuccucaugggaccagugaaacagcugaagcgaauguuugagccuacucguuugauugcaacuaucauggugcuguuguguuuugcacuuacccuguguucugccuuuugguggcauaacaagggacuugcacuuaucuucugcauuuugcagucuuuggcauugacgugguacagccuuuccuucauaccauuugcaagggaugcugugaagaaguguuuugccgugugucuugcauaauucauggccaguuuuaugaagcuuuggaaggcacuauggacagaagcugguggacaguuuuguaacuaucuucgaaaccucugucuuacagacaugugccuuuuaucuugcagcaauguguugcuugugauucgaacauuugaggguuacuuuuggaagcaacaauacauucucgaaccugaaugucaguagcacaggaugagaaguggguucuguaucuuguggaguggaaucuuccucauguaccuguuuccucucuggauguugucccacugaauucccaugaauacaaaccuauucagcaacagcacauaagccuugggugcaagugauucccagguggcaaaaggcagccccaucagagaucacgggagcaacaguaagggacagaguuuugggguccacuugucccucagcauggaagccaucaccgugguccugcauagagugagucugcuucuacucuggcaucugagaacaagugacucugcuuuagacaagccccuggagagccuggccauggagugagguagaaaagaagcacuuuuuggugguauaugcuguuucugaauuugaaucuaagcauucuugguguucuga

SEQ ID NO: 20 - RNA, 6841 nt, Homo Sapiens
agcuuagcaggcgacguugcgggcccugggcgccaggagagcuucccggagucgaccuuccugcuggcugcucugugaccgcuucccggcucugcccucuuggccgaagugcccgcugccgggcgcgggccucagacaauacaauggugggugaagagaagaugucucuaagaaaccggcugucaaaguccagggaaaauccugaggaagaugaagaccagagaaacccugcaaaggagucccuagagacaccuaguaauggucgaauugacauaaaacaguugauagcaaagaagauaaaguugacagcagaggcagaggcaacugaauugaagccauuuuuuaugaaggaaguuggcagucacuuugaugauuuugugaccaaucucauugaaaagucagcaucauuagauaauggugggugcgcucucacaaccuuuucuguucuugaaggagagaaaaacaaccauagagcgaaggauuugagagcaccuccagaacaaggaaagauuuuuauugcaaggcgcucucucuuagaugaacugcuugaaguggaccacaucagaacaauauaucacauguuuauugcccuccucauucucuuuauccucagcacacuuguaguagauuacauugaugaaggaaggcuggugcuugaguucagccuccugucuuaugcuuuuggcaaauuuccuaccguuguuuggaccugguggaucauguuccugucuacauuuucaguucccuauuuucuguuucaacauugggccacuggcuauagcaagaguucucauccgcugauccguucucucuuccauggcuuucuuuucaugaucuuccagauuggaguucuagguuuuggaccaacauauguuguguuagcauauacacugccaccagcuucccgguucaucauuauauucgagcagauucguuuuguaaugaaggcccacucauuugucagagagaacgugccucggguacuaaauucagcuaaggagaaaucaagcacuguuccaauaccuacagucaaccaguauuuguacuucuuauuugcuccuacccuuaucuaccgugacagcuaucccaggaaucccacuguaagaugggguuaugucgcuaugaaguuugcacaggucuuugguugcuuuuucuauguguacuacaucuuugaaaggcuuugugcccccuuguuucggaauaucaaacaggagcccuucagcgcucguguucugguccuauguguauuuaacuccaucuugccaggugugcugauucucuuccuuacuuuuuuugccuuuuugcacugcuggcucaaugccuuugcugagauguuacgcuuuggugacaggauguucuauaaggauugguggaacuccacgucauacuccaacuauuauagaaccuggaauguggugguccaugacuggcuauauuacuaugcuuacaaggacuuucucugguuuuucuccaagagauucaaaucugcugccauguuagcugucuuugcuguaucugcuguaguacacgaauaugccuuggcuguuugcuugagcuuuuucuaucccgugcucuucgugcucuucauguucuuuggaauggcuuucaacuucauugucaaugauagucggaaaaagccgauuuggaauguucugauguggacuucucuuuucuugggcaauggagucuuacucugcuuuuauucucaagaaugguaugcacgucagcacuguccucugaaaaaucccacauuuuuggauuauguccggccacguuccuggacuugucguuacguguuuuagaagcuuggacuuuguuuccuccuugucacugaagauuggguagcucccugauuuggagccagcuguuuccaguuguuacugaaguuaucuguguuauuuggaccacuccaggcuuuacagaugacucacuccauuccuaggucacuugaagccaaacuguuggaaguucacuggagucuuguacacuuaagcagagcagaacuuuuuuuguggggcuggguggggggagaagaccgacuaacagcugaaguaaugacagauuguugcugggucauaucagcuuuaucccuugguaauuauaucuguuuuguuucuugacucuguccaaucagagaauaaacaucauaguuucuuggccacugaauuagccaaaacacuuaggaagaaaucacuuaaauaccucuggcuuagaaauuuuuucaugcacacuguuggaauguaugcuaauugaacaugcaauuggggaagaaaaaauguagaaugauuuuugcuauuucuaguagaaagaaaaugucuguuuuccaaagauaauguuauacauccuauuuuguaauuuuuuugaaaaaaguucaauguucaguuuuccuuaguuuuuaccuuguuuucucuauaggucaugauuucugugaagcaaaaagaugccuuuuaccaugaauucuugaguuuacaucaauaauauuguauauuaaggggaucagaaguaggaaggaaaaaauaagagauagcagaggaaaaagaaaaacauuuccucuuauaacuucugaaguaauuuguaaaaaagauuuguagagucaaucauguguuuaaauuauuuuaucacaaacuuaacauggaagauauuccuuuuuaacuuugugguaacuucuuugaaguuauuuagaaauauccuuuggaacaauuauuuuauugucuaauaaauauugacuucucuugaauuauuuugcagacuagugagucuguaccauaaguauuaaucaccuccacucauauuaaagugaucauuaagaauccagaagcuggcuucugcauuugcucaguuauacuuuuaaugguaguauguuuuuagguggaauaaauuaauaugugauugguuucaaggaaauguacucuauuauguaauacuuccauuuuauaagaugcccauuucuaauacaauguguguaggaauuauuuguauguaugagguaugauuguaaagauugagcauuggaagggguaucagagaccauguaguucaacuuuccacucaaaguaagauuuaugaauuauuuaaaugauaguuguuacuuggaacagccacuugagaggcucucuugguauuguuuggaauuguuuuaaagucaguuugagucucacaagaagguaaguagaguuucuuaauagucacaacuuaauuugaaccacaaguauccagcuuaaucacguaucuuacucacgauaccacugguccagaugaguuuagguaauuuucaaacauuaaauccaacuucaacggaaacaaauacacucaagggaaguuauuuuuaaaaagguacucugcauguucccgcaguaauguucugcacaacaguauuguaauuguaauggaaucauaaccugcuaacuaguuugcuuuaauauggcuuguaauucuugacauuuuucuuaaaauuaaaacgaauuuuuauuuugaauuuauaacugcauuuuaaauauauuggggacagauugcgcugagaccugguuaugagcaagccaaucuuuugaaucuagagaauggaauucuuagguuuauauuucuguuaagaaauacuauaaauaugacucuuaugagaagacuuuguugcucuguaguguuucugaauacuguauuuguuggauugaucaaggcuauuuuucaaaaagcucucugcuuccuguuuguuuguuuguuuguuuuugagacagagucuugcucugucgccggggcuggagugcaauggcgugaacucagcucacugcaaccucugccucccugguucaagcuauucuccugccucagccuccugaguagcugggauuacagggccacgccuggcuaauuuuuguauuuuuaguagagaugggguuucacccuguuggucaggcuggucucaaacuccugaccuugugaucugcccaccucagccucccaaagugcugggaagacaggcguuagccaccgugcccggccucuguuuccuguuauuagugauuuuccugcccaagauugcaacaacaaauauguagaacuacagacuguuuagaaugcugagacuguucuaagaaacuuucaaaaacaguagcacuucaaggaauggucacuuucuaugaaagaaacugguuugauagccauaaucuuauugcuagcugcuuuuagcaaaagucuuuucuugaaaccaccaccuauacucuuuaaacaaauaaaaacuaaaaucucuugcuaauguuucaggaagauuuauuuuuucuauuuugcuauuguggcgaaaauuauuuucaguuauaggauacuuuuuuccuucugaaaaguaauaagcuuaaaguuuuuguuucuguaagauguaaugauaguaacuauuauuuugggcauauuaaccaacagaacaauuauguaguauguauaucacuuucucauuagaucucuaacuugaccuucuaguaccuuuaugugugaggauaaauuuguuagauccuuuuauucucaaucuuggauaaugaugcaaaauggaauuuuguuuuguuuguugguagauucacauacuaaaacuuugcagguaaaguugcuugccucauguuagaauuuaauuagaaaacugaggcugccuuuuuuuuuuuuuuuuuuuuuuuuuaagacagagucuuguucugucgcccaggccaguuuuuuuuuucuuguacagaugggguuuuaccauguugcucaggcuggucucaaacuccuggagucaagggaucuauuugccucagccucucaaagugcugggauuacaggugugagccacggcuccuggcuccuugcuccagaaucaguuuuuuaauggaagauagcucauacuuuguuuuuguuuuuaaagagacagggucucacucuguugcccaggcugguaguagcgugaucauagcucacugcagucucaaacuccuggacucaaauagugcucuggaguaccuagaacuacaagugccuaccaccacacccagcuaauuuauuuguuuuuuuuuuuuuagagauggggggggucucccuauguugcccaggcuggucucaaacucuucaccucaagcaaaacucccacugcagaaagcuuugggauuacaggcaugagccaccaugccaagcccauacuuauuguuaauaaaguuucagugacuugcuuacuaaucuuaugcaaaauuucauguaauuuauguaauacuacauaacaaugcuacauaugguauguauacauacacuguauacacacaaaggucuguucuggguauuuuauguaucuuaucucuaggcuuuauggcucugaaauggagggaacuggacauaaauguuucaaggaauaaagugaauguuuuguuuguuuguuuguuuugagacggagucucagucaccaggcuggagugcagugcugugaucucagcucacugcaaccucugccuccuggguucaagcgauucuccugccucagccucccgaguagcuggcauuacaggugccugccaccauguccagcuaauuuuuguguuuuuaguagagaugggguuucaccaugauggucaggcuggucucgaacuccugaccucaugauccgccagccucagccucccauagugcugggauuauaggcaugagccaugcucccggccaaagugaauguuuugggugaaguuuauauaaggauuugacuuuuguaucauuauuaaaguuucugucagguaauacaguguuggcccucuguugaaauaaaauguuacauaucgcuggguguaguggcucaugccuuuaaucccaguacuuugggaggccaaggcaggaggauugcuugagcucagaaguuugagaccagccugggcaacauagcaaaaccuugucacuauaaaaaauacaaaaauuagccaggcgugguggugcacgccuguagucucagcuacucagucggcugaggugggaagauggcuucaagccgggagauggaggcuucagugaccugugaccugugaucacaccacuuaauuccucaaaacauuuaugucccaguucccuccauuucagagccaugggcaacagagcgagacccugucucaaaaaaaaaauuacauauaagcccgguuuaaagagaggauaauaugcaaccacccuaguugaaacagaguguaucacuucuuucucacccuaaauuuaaugccuaguuugaaaaucaguagacaauaauaaaguugauaagcuuuagguugguaggaaagcuauguaaucuauauaguguacuaaauccuuauauguuuuugguaaaaaaagacuuuaauagcuaauuuggacuucagaaaauggguuaauuucacgagugcauaucacuuuugacuauauuagucaagcauauuauuaaaguuuaaaaaacucuaaaacuucuguacuguuuuuuucuuaagugcucucuuccuuauuucuacauuacuacauucacauuucugcugucaauaagcccuaauggagugauaaacuuuaagcuaguagauacugcaccaugucuuguggugguguuuucuuaaugaaauggaagcuguacuuccuguuuguuuuuaaauacuuuugaaacagacaguucauguaccccaucauuuagagaugcaguuugaauuuccauggaaaaaggugccaauuuuggauugggaaaggagcugaagccccagucaagacuuugccauuugggguaaugcagcagauuccugugucuguaucuuuccaguguguguguuaauccauaguguucugagcaccagaagggucauguaaaucugaaguuguuauuaaagguuuuucuauagugaaa

SEQ ID NO: 21 - RNA, 339 nt, Homo Sapiens
aaguucgcuauccagaaccuccacucuuucgaccccuuugcugaugcaaguaagggugaugaccugcuuccugcuggcacugaggauuauauccauauaagaauucaacagagaaauggcaggaagacccuuacuacuguccaagggauugcugaugauuaugauaaaaagaaacuagugaaggcauuuaagaauuuugccugcaaugguacuguaauugagcauccagaguauggagaaguaauucagccucagggugaccaaugcaauaacauaugccaguuccucguagagcuuggacuggcuaaggacgaucagcugaagguucauguguuuuaa

SEQ ID NO: 22 - RNA, 4299 nt, Homo Sapiens
gcuggccccgcccccuagcgccgcggucggagccauuucgccgauuccuccaugcgaguugcugugcguuucucuguugucucgguagaaggccagagucacacacgguccuaagagcugggcaccaggaagcgaaggcugaucugaagaagacacuugaaucaugggugacguuaaaaauuuucuguaugccugguguggcaaaaggaagaugaccccauccuaugaaauuagagcaguggggaacaaaaacaggcagaaauucaugugugagguucagguggaagguuauaauuacacuggcaugggaaauuccaccaauaaaaaagaugcacaaagcaaugcugccagagacuuuguuaacuauuugguucgaauaaaugaaauaaagagugaagaaguuccagcuuuugggguagcaucuccgcccccacuuacugauacuccugacacuacagcaaaugcugaaggagauuuaccaacaaccaugggaggaccucuuccuccacaucuggcucucaaagcagaaaauaauucugagguaggggccucuggcuaugguguuccugggcccaccugggaccgaggagccaacuugaaggauuacuacucaagaaaggaagaacaagaagugcaagcgacucuagaaucagaagaaguggauuuaaaugcugggcuucauggaaacuggaccuuggaaaaugcuaaagcucgucuaaaccaauauuuucagaaagaaaagauccaaggagaauauaaguacacccaaguggguccugaucacaacaggagcuuuauugcagaaaugaccauuuauaucaagcagcugggcagaaggauuuuugcacgagaacauggaucaaauaagaaauuggcagcacaguccugugcccugucacuugucagacaacuguaccaucuuggagugguugaagcuuacuccggacuuacaaagaagaaggaaggagagacaguggagccuuacaaaguaaaccucucucaagauuuagagcaucagcugcaaaacaucauucaagagcuaaaucuugagauuuugcccccgccugaagauccuucugugccaguugcacucaacauuggcaaauuggcucaguucgaaccaucucagcgacaaaaccaagugggugugguuccuuggucaccuccacaauccaacuggaauccuuggacuaguagcaacauugaugaggggccucuggcuuuugcuacuccagagcaaauaagcauggaccucaagaaugaauugauguaccaguuggaacaggaucaugauuugcaagcaaucuugcaggagagagaguuacugccugugaagaaauuugaaagugagauucuggaagcaaucagccaaaauucaguugucauuauuagaggggcuacuggaugugggaaaaccacacagguuccccaguucauucuagaugacuuuauccagaaugaccgagcagcagaguguaacaucguaguaacucagcccagaagaaucagugcgguuucuguggcagagcgaguugcauuugaaagaggagaagagccuggaaaaagcuguggcuacagcguucgauuugagucuauacuuccucguccucaugccaguauaauguuuuguacuguaggugugcuccugagaaaauuagaagcaggcauucgaggaaucagucauguaauuguagaugaaauacaugaaagagauauuaauacuagacugacuuccuuuugguaguacugcgugauguuguucaggcuuauccugaaguucgcauuguucuuaugucugcuacuauugauaccagcauguuuugugaauauuucuucaauugccccaucauugaaguuuaugggaggacuuacccaguucaagaauauuuucuggaagacugcauucagaugacccacuuuguuccuccaccaaaagacaaaaagaagaaggauaaggaugaugaugguggugaggaugaugaugcaaauugcaacuugaucuguggugaugaauaugguccagaaacaagguugagcaugucucaauugaacgaaaaggaaacuccuuuugaacucaucgaggcucuacuuaaguacauugaaacccuuaauguuccuggagcuguguugguuuuuuugccuggcuggaaucugauuuauacuaugcagaagcauuuggaaaugaauccacauuuuggaagccaucgguaucagauucuaccccugcauucucagauuccucgagaggaacagcgcaaaguguuugauccaguaccaguuggaguaaccaagguuauuuuguccacaaauauugcugaaacaagcauuaccauaaacgauguuguuuaugucauugacuccugcaagcagaaagugaaacucuucacugcucacaacaauaugaccaacuaugcuaccguaugggcaucaaaaacaaaccuugagcaacggaaagggcgagcuggccgaguacggccuggauucugcuuucaccugugcagccgagcucguuuugagagacuugaaacccacaugacaccagagauguuccgaacaccauugcaugaaauugcucuuagcauaaaacuucugcgucuaggaggaauuggccaauuucuggccaaagcaauugaaccucccccuuuggaugcugugauugaagcagaacacacucuuagagagcuugaugcauuagaugccaaugaugaguugacuccuuugggacgaauccuggcuaaacuccccauugagccucguuuuggcaaaaugaugauaaugggguguauuuucuacgugggagaugcuaucuguaccauugcugcugcuaccugcuuuccagagccuuucaucaaugaaggaaagcggcugggcuauauccaucgaaauuuugcuggaaacagauuuucugaucacguagcccuuuuaucaguauuccaagccugggaugaugcuagaauggguggagaagaagcagagauacguuuuugugagcacaaaagacuuaauauggcuacacuaagaaugacuugggaagccaaaguucagcucaaagagauuuugauuaauucuggguuuccagaagauuguuuguugacacaaguguuuacuaacacuggaccagauaauaauuuggauguuguuaucucccuccuggccuuugguguguaccccaauguaugcuaucauaaggaaaagaggaagauucucaccacugaagggcguaaugcacuuauccacaaaucaucuguuaauuguccuuuuaguagccaagacaugaaguacccaucucccuucuuuguauuuggugaaaagauucgaacucgagccaucucugcuaaaggcaugacuuuagucaccccccugcaguugcuucucuuugccuccaagaaaguccaaucugaugggcagauugugcuuguagaugacuggauuaaacugcaaauaucucaugaagcugcugccuguaucacuggucuccgggcagccauggaggcuuugguuguugaaguaaccaaacaaccugcuaucaucagccaguuggaccccguaaaugaacguaugcugaacaugauccgucagaucucuagacccucagcugcugguaucaaccuuaugauuggcaguacacgguauggagaugguccacguccucccaagauggcccgauacgacaauggaagcggauauagaaggggagguucuaguuacagugguggaggcuauggcgguggcuauagcaguggaggcuaugguagcggaggcuaugguggcagcgccaacuccuuucgggcaggauauggugcagguguugguggaggcuauagaggaguuucccgagguggcuuuagaggcaacucuggaggagacuacagagggccuaguggaggcuacagaggaucugggggauuccagcgaggaggugguaggggggccuauggaacuggcuacuuuggacagggaagaggagguggcggcuauuaaaacuugguuaugucaguuccuguguguagacaguaaggaaaaaaaggcaugcuauguguuacguguuuuuuccaguauguuuauuugccaccaaaaaguaaaugcauuuucacccauucugugguucauuguaguuuaaggaaaccaagcauauagaugcauuagugauuuuguuuauauuauguaaaauauaacgaucucuuaaaaauaccacaguuuguauuuuuucuuuaaggaguaaagauuugccuuuaaauaacuugguauuuuccuggcuuucguuuaauacaauagaaaauaaaguauuacaccgaauac

SEQ ID NO: 23 - RNA, 207 nt, Homo Sapiens
cuccaaacuggcaugcgaggugccuuuggaaagccccagggcacuguggccaggguucacauuggccaaguuauguccauccacaccaagcugcagaacaaggagcaugugauugaggcccugcgcagggccaaguucaaguuuucuggccgccagaagauccacaucucaaagaaauggggcuucaccaaguucaaugccaauuaa

SEQ ID NO: 24 - RNA, 9967 nt, Homo Sapiens
uuuugucccggaaccccgcagcccuccccacacucugggcgcggagcacaaugauuggucacuccuauuuucgcugagcuuuuccucuuauuucaguuuucuucgagaucaaaucugguuuguagaugugcuuggggagaaugggggccucuucuccaagaagcccggagccugucgggccgccggcgcccggucuccccuucugcugcggaggaucccugcuggcgguuguggugcugcuugcgcugccgguggccuggggucaaugcaaugccccagaauggcuuccauuugccaggccuaccaaccuaacugaugaauuugaguuucccauugggacauaucugaacuaugaaugccgcccugguuauuccggaagaccguuuucuaucaucugccuaaaaaacucagucuggacuggugcuaaggacaggugcagacguaaaucaugucguaauccuccagauccugugaauggcauggugcaugugaucaaaggcauccaguucggaucccaaauuaaauauucuuguacuaaaggauaccgacucauugguuccucgucugccacaugcaucaucucaggugauacugucauuugggauaaugaaacaccuauuugugacagaauuccuugugggcuaccccccaccaucaccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggccccgccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucaccugggcaggaaguguucuacagcugugagcccggcuacgaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuacugugucuuggcuggaauggaaagccuuuggaauagcaguguuccagugugugaacaaaucuuuuguccaaguccuccaguuauuccuaaugggagacacacaggaaaaccucuggaagucuuucccuuugggaaaacaguaaauuacacaugcgacccccacccagacagagggacgagcuucgaccucauuggagagagcaccauccgcugcacaagugacccucaagggaaugggguuuggagcagcccugccccucgcuguggaauucugggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggcaccgacucauuggucacucaucugcugaauguauccucucgggcaaugcugcccauuggagcacgaagccgccaauuugucaacgaauuccuugugggcuaccccccaccaucgccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggcccggccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucacccgggcaggaaguguucuacagcugugagcccggcuacgaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuacugugucuuggcuggaauggaaagccuuuggaauagcaguguuccagugugugaacaaaucuuuuguccaaguccuccaguuauuccuaaugggagacacacaggaaaaccucuggaagucuuucccuuugggaaaacaguaaauuacacaugcgacccccacccagacagagggacgagcuucgaccucauuggagagagcaccauccgcugcacaagugacccucaagggaaugggguuuggagcagcccugccccucgcuguggaauucugggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggcaccgacucauuggucacucaucugcugaauguauccucucgggcaaugcugcccauuggagcacgaagccgccaauuugucaacgaauuccuugugggcuaccccccaccaucgccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggcccggccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucacccgggcaggaaguguucuacagcugugagcccggcuaugaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuauugugucuuggcuggaauggaaagccuuuggaauagcaguguuccagugugugaacaaaucuuuuguccaaguccuccaguuauuccuaaugggagacacacaggaaaaccucuggaagucuuucccuuuggaaaagcaguaaauuacacaugcgacccccacccagacagagggacgagcuucgaccucauuggagagagcaccauccgcugcacaagugacccucaagggaaugggguuuggagcagcccugccccucgcuguggaauucugggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggcaccgacucauuggucacucaucugcugaauguauccucucaggcaauacugcccauuggagcacgaagccgccaauuugucaacgaauuccuugugggcuacccccaaccaucgccaauggagauuucauuagcaccaacagagagaauuuucacuauggaucaguggugaccuaccgcugcaaucuuggaagcagagggagaaagguguuugagcuugugggugagcccuccauauacugcaccagcaaugacgaucaagugggcaucuggagcggccccgccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccagaguuaccaagcugcuccagggugugucagccgccuccagaaauccugcauggugagcauaccccaagccaucaggacaacuuuucaccugggcaggaaguguucuacagcugugagccuggcuaugaccucagaggggcugcgucucugcacugcacaccccagggagacuggagcccugaagccccgagaugugcagugaaauccugugaugacuucuugggucaacucccucauggccgugugcuauuuccacuuaaucuccagcuuggggcaaagguguccuuugucugugaugaaggguuucgcuuaaagggcaguuccguuagucauugugucuugguuggaaugagaagccuuuggaauaacaguguuccugugugugaacauaucuuuuguccaaauccuccagcuauccuuaaugggagacacacaggaacucccucuggagauauucccuauggaaaagaaauaucuuacacaugugacccccacccagacagagggaugaccuucaaccucauuggggagagcaccauccgcugcacaagugacccucaugggaaugggguuuggagcagcccugccccucgcugugaacuuucuguucgugcuggucacuguaaaaccccagagcaguuuccauuugccaguccuacgaucccaauuaaugacuuugaguuuccagucgggacaucuuugaauuaugaaugccguccuggguauuuugggaaaauguucucuaucuccugccuagaaaacuuggucuggucaaguguugaagacaacuguagacgaaaaucauguggaccuccaccagaacccuucaauggaauggugcauauaaacacagauacacaguuuggaucaacaguuaauuauucuuguaaugaaggguuucgacucauugguuccccaucuacuacuugucucgucucaggcaauaaugucacaugggauaagaaggcaccuauuugugagaucauaucuugugagccaccuccaaccauauccaauggagacuucuacagcaacaauagaacaucuuuucacaauggaacggugguaacuuaccagugccacacuggaccagauggagaacagcuguuugagcuugugggagaacggucaauauauugcaccagcaaagaugaucaaguugguguuuggagcagcccucccccucgguguauuucuacuaauaaaugcacagcuccagaaguugaaaaugcaauuagaguaccaggaaacaggaguuucuuuacccucacugagaucaucagauuuagaugucagcccggguuugucaugguagggucccacacugugcagugccagaccaauggcagaugggggcccaagcugccacacugcuccagggugugucagccgccuccagaaauccugcauggugagcauacccuaagccaucaggacaacuuuucaccugggcaggaaguguucuacagcugugagcccagcuaugaccucagaggggcugcgucucugcacugcacgccccagggagacuggagcccugaagccccuagauguacagugaaauccugugaugacuuccugggccaacucccucauggccgugugcuacuuccacuuaaucuccagcuuggggcaaagguguccuuuguuugcgaugaaggguuccgauuaaaaggcaggucugcuagucauugugucuuggcuggaaugaaagcccuuuggaauagcaguguuccagugugugaacaaaucuuuuguccaaauccuccagcuauccuuaaugggagacacacaggaacucccuuuggagauauucccuauggaaaagaaauaucuuacgcaugcgacacccacccagacagagggaugaccuucaaccucauuggggagagcuccauccgcugcacaagugacccucaagggaaugggguuuggagcagcccugccccucgcugugaacuuucuguuccugcugccugcccacauccacccaagauccaaaacgggcauuacauuggaggacacguaucucuauaucuuccugggaugacaaucagcuacauuugugaccccggcuaccuguuagugggaaagggcuucauuuucuguacagaccagggaaucuggagccaauuggaucauuauugcaaagaaguaaauuguagcuucccacuguuuaugaauggaaucucgaaggaguuagaaaugaaaaaaguauaucacuauggagauuaugugacuuugaagugugaagauggguauacucuggaaggcagucccuggagccagugccaggcggaugacagaugggacccuccucuggccaaauguaccucucguacacaugaugcucucauaguugggcacuuuaucugguacgaucuucuuuauuuuacucaucauuuuccucucuuggauaauucuaaagcacagaaaaggcaauaaugcacaugaaaacccuaaagaaguggcuauccauuuacauucucaaggaggcagcagcguucauccccgaacucugcaaacaaaugaagaaaauagcaggguccuuccuugacaaaguacuauacagcugaagaacaucucgaauacaauuuuggugggaaaggagccaauugauuucaacagaaucagaucugagcuucauaaagucuuugaagugacuucacagagacgcagacaugugcacuugaagaugcugccccuucccugguaccuagcaaagcuccugccucuuugugugcgucacugugaaacccccacccuucugccucgugcuaaacgcacacaguaucuagucaggggaaaagacugcauuuaggagauagaaaauaguuuggauuacuuaaaggaauaagguguugccuggaauuucugguuuguaagguggucacuguucuuuuuuaaaauauuuguaauauggaaugggcucaguaagaagagcuuggaaaaugcagaaaguuaugaaaaauaagucacuuauaauuaugcuaccuacugauaaccacuccuaauauuuugauucauuuucugccuaucuucuuucacauauguguuuuuuuacauacguacuuuucccccuuaguuuguuuccuuuuauuuuauagagcagaacccuagucuuuuaaacaguuuagagugaaauauaugcuauaucaguuuuuacuuucucuagggagaaaaauuaauuuacuagaaaggcaugaaaugaucaugggaagagugguuaagacuacugaagagaaauauuuggaaaauaagauuucgauaucuucuuuuuuuuugagauggagucuggcucugucucccaggcuggagugcaguggcguaaucucggcucacugcaagcuccgccucccggguugacaccauuuuccugccucagccuccugaguaguugggauuaccaguagaugggacuacaggcaccugccaacacgcccggcuaauuuuuuuguauuuuuaguagagacgggguuucaccauguuagccaggauggucuggaucuccugaccucgugauccaccugccucggccucccaaagugcugcgauuacaggcaugagccaccgcgccuggccgcuuucgauauuuucuaaacuuuaauucaaaagcacuuugugcuguguucuauauaaaaaacauaauaaaaauugaaaugaaagaauaauuguuauuauaaaaguacuagcuuacuuuuguauggauucagaauauacuaaauuaacuuuuuaaaacacaacuuuuaaaaaauguaucaaaauaauaaacguguucugauauuuuuaaaauaagugaccuuguguucuuuaaccaguccacaucuuuagagaacaaaaauguguuaugauauuaugggccaugcuaaugaccucuagaaaacaucagaauauuucuggauauuuaauaauagcuuuauauaugacuaaugcucauuucuauguaauucuguuuaauaguugcuuuaaaggugaauuuugccacauuuacuuugacagcaguauaaggagugagauagacaugaaccugaauuucaauuuaaaaucauggaagagagggaaaaaaaaccagcuuaagaaaaaucaacugauaaacugcaagaaaaaaaugcaacuuacaucacaaaagcuaauugcuuuauuauuuagagaguacuuaaaaauuaaagaccaaacuucucuccacccaacaaaaaugggcaaaggacauacagcuaggucaccaagaaagaagggcaaauagguggugaguauauguaaagauacuugauaggacuuuugcuuaguugaaucuuuagcaaaucucuuuuauuucuugggauuuugaagaaguaauuuuuaaaggaggacuagaaacuaagugauugggaauuggccuuuuuagaauuaaaauuucccauuacaagaaaaaaaaauccuguguucuuuuuuuuuuccagaauggaguaggucagugagcaaugugauuaauaaauauuucaaugucugugacuuuugauuuauuuuggagacagggucuugcucuguuacccaggcuggagugcaguggugcuaucuaggcuuacugcaaccucaccugucacuuuuuaauugcaagaaagcugaaagguuuuuuucuauuauaucaguuauaaugauaaauacuguauauacuaacuaugaguaaaauacuauauugccuaacuuguauuauuaagcaauucugcuaaccugugaccuuacauuuucaucugaaaagcaggggcuggacaccaauugcccuaugaagcuauugcuaguccuaacauucuuuguuuuguuugcuuuuuuggcacacuuaaguguguacuaugaaguuuaugaugcuuuaaugaaauuuucugucucuaccauuguaaugagaaaggaauaaaauacuuuauuuugcaaaucua

SEQ ID NO: 25 - RNA, 2216 nt, Homo Sapiens
ggcuggcuuucgguuucucugcucaccuccggauaaaucacggggucucccgcgccgcucauggcgccucccguccgucucgagcgucccuuuccuucccggcgcuuuccuggguugcuucuggcggcccugguguugcugcuguccuccuucuccgaugggggucucuucuccgagaagccgggagccuguugggcagccggcgcccggucuccccuucugcugcggaggaucccugcuggcggucguggugcugcucgcgcugccgguggccugggaucaaugcaaugucccggaauggcuuccauuugccaggccuaccaaccuaacugaugacuuugaguuucccauugggacauaucugaacuaugaaugccgcccugguuauuccggaagaccguuuucuaucaucugccuaaaaaacucagucuggacaagugcuaaggacaagugcaaacguaaaucaugucguaauccuccagauccugugaauggcauggcacaugugaucaaagacauccaguucagaucccaaauuaaauauucuuguccuaaaggauaccgacucauugguuccucgucugccacaugcaucaucucaggcaacacugucauuugggauaauaaaacaccuguuugugacagugaugacauuagggagugaggccuuuggaaggugaugagaucaugagagcagagcugucacgaaugggauuagcguccuaauaaaagaggcccagaagagcuccuuugccccuccugccaugggaagaaaugcugaaucugccagagaggaauuauuugugggcuaccccccaccaucgccaauggagauuucacuagcaucagcagagaguauuuucacuauggaucaguggugaccuaccacugcaaucuuggaagcagagggaaaaagguguuugagcuugugggugagcccuccauauacugcaccagcaaagaugaucaagugggcaucuggaguggcccagccccucagugcauuauaccuaacaaaugcacgccuccaaauguggaaaauggaauauugguaucugacaacagaagcuuauuuuccuuaaaugaaguuguggaguuuaggugucagccuggcuuuggcaugaaagggcccucccaugugaagugccaggcccugaacaaaugggagccagaguuaccaagcugcuccaggguaugucagccaccuccagauguccugcaugcugagcguacccaaagggacaaggacaacuuuucacccgggcaggaaguguucuacagcugugagcccggcuacgaccucagaggaucuacguauuugcacugcacaccccagggagacuggagcccugcagcccccagaugugaagugaaauccugugaugacuuccugggccaacuuccuaauggccaugugcuauuuccacuuaaucuccagcuuggagcaaaaguggauuuuguuugugaugaaggauuucaauuaaaaggcagcucugcuaguuacuguguuuuggcuggaauggaaagccuuuggaauagcaguguuccagugugugaacguaaaucaugugaaacuccuccaguuccagugaauggcauggugcaugugaucacagacauccauguuggauccagaaucaacuauucuuguacuacaggguucugauuaaaaggcaggucugcuagucauugugucuuggcuggaaugaaagcccuuuggaauagcaguguuccagugugugaacuuaacaaaucuuuuguccaaauccuccagcuauccuuaaugggagacacacaggaacuccccuuggagauauucccuauggaaaagaaguaucuuacacaugugacccccacccagacagagggaugaccuucaaccucauuggggagagcaccauccgccgcacaagugaaccucaugggaaugggguuuggagcagcccugccccucgcugugaacuuccuguuggugcugguucacaugaugcucuuauaguuggcacuuuacuugguacgaucaucuuuauuuuaaucaucauuuuccucuauuggauaauuuucaagcacagaaaaaggggaccuuccuugacaaaguacuauacagcugaagaacaucucgaauacaauuuugguuggaaaggagccaauugauuucaacagaaucagaucugagcuucauaaagucuuugaagugacuucacagagacgcagac

SEQ ID NO: 26 - RNA, 135 nt, Homo Sapiens
uauggccuuuaucaaagcugcagcugcuuccauguagcugcuguggucaaaaagaagccaagagugacaguuuuccuugauggucauaguucuguuugcuguaacugaucugcaagauuuugggaaaauaccauu

SEQ ID NO: 27 - RNA, 1898 nt, Homo Sapiens
cgcggcaacgcaggggcggaaccgcaugacuggcaguggcaucagcgauggcggcugcgucggggucgguucugcagcgcuguaucgugucgccggcagggaggcauagcgccucucugaucuuccugcauggcucaggugauucuggacaaggauuaagaauguggaucaagcagguuuuaaaucaagauuuaacauuccaacacauaaaaauuauuuauccaacagcuccucccagaucauauacuccuaugaaaggaggaaucuccaauguaugguuugacagauuuaaaauaaccaaugacugcccagaacaccuugaaucaauugaugucaugugucaagugcuuacugauuugauugaugaagaaguaaaaaguggcaucaagaagaacaggauauuaauaggaggauucucuaugggaggaugcauggcaauacauuuagcauauagaaaucaucaagauguggcaggaguauuugcucuuucuaguuuucugaauaaagcaucugcuguuuaccaggcucuucagaagaguaaugguguacuuccugaauuauuucagugucaugguacugcagaugaguuaguucuucauucuugggcagaagagacaaacucaauguuaaaaucucuaggagugaccacgaaguuucauaguuuuccaaauguuuaccaugagcuaagcaaaacugaguuagacauauugaaguuauggauucuuacaaagcugccaggagaaauggaaaaacaaaaaugaaugaaucaagagugauuuguuaauguaaguguaaugucuuugugaaaagugauuuuuacugccaaauuauaaugauaauuaaaauauuaagaaauaacacuuuccugacuuuuuuauuauuaaaaugcuuaucacuguagacaguagcuaaucuuauuaaugaaaaacaauagacaaacaucugugcauaauuuuucagacacaauucuguaaauauuuggaaaccuuuuaaguauuuaaacuuuuaaauuuuugaaauaaaguauucuaaacuaauauaaauaaggacaaugaaaaaacaugaaaggacuuagcauaauguuauuuuaucuuuucuacaacuuuguuuaaauuaccuuuccaaagauauuuguguuuauguaauuuuccacggaauaacauuaauacucuagguuuauaaaccgguuucacauuauuucauuugaucaucacaagagcuuugugaaguaagccgagaaguuguuacugguauuuaauaauagcaauagaggaguuaaagacuuucccacagcuugcaggucaagacaagaaauucaggucuccuaauucucaguggagcucuauuucuguuaacccaaauugcugcucuguuuuaggucucaauuucaucuguaaaaugauacuaauaguacuuaucccauuggauuuuuguugagauuuaaauaaauagccaaaagccaauacauaauaaacacucaauaaagauuaaccauaaggagagucaugaucugguuccaggaauacauuguuagaugacugaaaaauuguauuacuucaaugaaaauacuauaaauaauaacauuuucauauauuaguugguucucaugcauacauaaucuaauuuuauuugauccucacaacuguuuaaguuuuauuaaauauacauuaucccuauuuguauaaauagaaucauacaauaccugccugcuuucauucaacaaaauuaucaugagauuuuuccauguuguguacaucaauaguucaucuauuuuauugcucaguaauauuccauuguguggauguaucacuauuuguuuacacauucaccacugauauauaaguugcuuccagugugaggcuguuuuaaauaaagcugcuaugaauauucauguaaga

SEQ ID NO: 28 - RNA, 4129 nt, Homo Sapiens
cccggcaagggccuaucaggggugggucggggcauccgagcggguuugacggaaggagcggcggcgacggaggaggaggauggaggcggugguguucgucuucucucuccucgauuguugcgcgcucaucuuccucucggucuacuucauaauuacauugucugauuuagaaugugauuacauuaaugcuagaucauguugcucaaaauuaaacaaguggguaauuccagaauugauuggccauaccauugucacuguauuacugcucaugucauugcacugguucaucuuccuucucaacuuaccuguugccacuuggaauauauaucgauacauuauggugccgagugguaacaugggaguguuugauccaacagaaauacacaaucgagggcagcugaagucacacaugaaagaagccaugaucaagcuugguuuccacuugcucugcuucuucauguaucuuuauaguaugaucuuagcuuugauaaaugacugaagcuggagaagccgugguugaagucagccuacacuacagugcacaguugaggagccagagacuucuuaaaucauccuuagaaccgugaccauagcaguauauauuuuccucuuggaacaaaaaacuauuuuugcuguauuuuuaccauauaaaguauuuaaaaaacaugaauugaguuucuguagauuucuaguucucaacuuuagccugaacgccaacacuugaagguguuuuucauccucuguauguugaaggugguuauuuguauguaggaacaggacugccaucccagcuuugcaugccaaagaaauaaagaacacacuuuaaagggcaaacugaagagaugagcgagcaaaggugcccuucaggucuacugaaaaguuagaguacaaaacaacacuguugaucuggacaaaagaagaaaaauuacccuuuuugcuuguguugugacaacuucauuuaauaugguuuaaagauuuaugagacugucagcuaaaagucuuuucacaagaaugucaacagagaauggcaucucaaaauauauauauuucuuugcacaauuugugaaaccuuauaagccauuuuccccagguacaauguaguuccugcugauagaaaggaaauauuuugucaagagcuuucauuuaaaagcuacuaccuccacaaucacccccaaacccagaaaauccccacuggcucuugccagucugguuuucguauugcaguuauuccaauuguauuugaucucccugauaacguauuuucauggguuuggguagaagaugcuaaucagauuagaagcaggaauaguuauuugcugucugugaaauugagccuuuuggugcgccacguggugccagaucaacacuucuaucccucugcacugaccacguugugaacugggagaccaaaugcaagccauuucauggacauagcaauauacaaccaaacucuguuccuuggaguuauauuguaaacucuugcaggugggagagcaguucaccuccuuagcucuguuugccagcucuuacaggguaaaauaaaccuggcaauuuauccucaguccuaguuugugguuuaauguugcuaucuuaagcacuggcauuugggcaaaacaugacuguguucugugggagaauccaaaggcauuauucacucuaguugagauagaauuggguggcuaaacagggugugugguacccaaaagauuaaauguuacauguccuuuuaguccuugaccaggucuagccuuggcagaagcaagggagccacuaagccaaacucccugugcagacagaccauguuucaaggcuggaaguagugcccuggcaacacacaaaaggaacggugaaaugguaggcaaagugaacuuggcucugcuggccucuuuggggucacagaaauugcuccuugugguaaucuuauauuucugucaggcacagggccaagaagcuguguaacagacauuacuuugcuugcaucucuuuuucauaccuuuucccucugaggcagcuuuugcuuagaaaacagucccuucacucugccuuuccuccuaacuuccugugccucuucauguucugcucaagcuuuuuaaagcaacgaagcuguuggagaacuuaaauccuugcaacugagagauaagcuacuuaaaggcgguagagaucuuuuuuuuuuuuuuuuugagauggggucuugcuguguugcccaggcuggagugcaguggugugaucucagcucacugcaaccucugcuuucuggguucaagcgauucuccugccucagccucccaaguagcugggauuacggcuagcuacuccuggcuaauuuuuguauuuuuaguagagaugggguuucaccauguuggccaggcuggucucaaacuccugaccucaaacgaucugccugccuuggucucccaaagugcugggauuauaggugugagccacugcgccuggccauguagaugacuuuugaccaaaauguuucaccuucucauucagauauucuuaguaaccaaaacagugacucaugcaguugagagagccuuugggcugucaguuuacaguacaucaggcuugcugaggcuaagcaaaucagaaaggugccauguuuauaacagaggucaaagcuccuuacuucugaaacauuagcugugguuaaaaacaaaaacucuuccuucuuguauugcuugucuaucaaagccaggaaagugggggaucacuguaguuaaauuuuuuuuuuuuuuaauuagagacagagucuugcccugucgcccaagcuggagugcacuggcgcaaucgugguacacugcagccuugaacuccuggacucaagcaguccuccugccucagcuucccaaguaguugggaguaggugcacaccaccaugcccagcgaauuuuuuguagagacagaggucuugcuauguugccuaggcugguaucaaaauuacuggccucaagcgauucuccugccucggccucccagauguugggauuacuggugugagccaccacgcccagcucaaaaacaauuuuuuuaggggcacuucuacaaaucaugaaagggggauaaaagcacugacuuuaaaaagccauguuuaagaugcuauaaauguucuccccuuuucauugauuggagaguuguagaggaccuuagagaucauuuugucuaacucccucaucccaaagauaaacugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggccuagagaucguucaggguguuguaacugggaacaucugaaugcugaggcuuaguccaguguucucucucccuuaccacuccucuuccccuucccucuauaauggcaguacccagggcccgguccauagacuacuaucgagugcuccuaugugcaucuuaguacguaucauuuucccuugccuuuuuccuucuauccuuucagugguagcaacugcccuugcuaaucaccguaaccucggcugagaaagaagaggaagcgaaauccaagaugcagcucaguucaucaaagccuagcagguccccucagcugccuuuucaugccugccacagacuacaguaggacaaaaccugaccuggucuuugaaguuaagagcuaagaaagcuuccuauaguaguaucucccauggcacuuaccacauucuaucugguauuacaguuauuuguaugcaauuaaucacucuuagauuguauguuccuggagggcagaauaugcccauucauauuuguaucuucuuccuucugcucuuggcaccuaacacagugccuugcacacaaacaauaaaugauuguugagugaauaaguaaa

SEQ ID NO: 29 - RNA, 2718 nt, Homo Sapiens
gugcgcguccccggcguuggcgucuucguccuguugcuggucuccguccggucgccggccgucuaggucuccggcccuccccagccgcuccugcgcccuugccggccccgccgcccgcagcccuggcgcucccugcgggccccgccgaggccgccugcgcccugugccagcgcgcgccccgggaaccggugcgcgccgacugcggccaccgcuucugucgggcgugcguggugcgcuucugggccgaggaggacgggcccuucccgugccccgagugcgccgacgacugcuggcagcgcgccguggagcccggcaggcccccgcucagccgccgccuucuggcgcucgaggaggcggccgcggcgcccgcgcgcgacggcccggccagcgaggccgcgcugcagcugcugugccgcgccgacgccggcccgcucugcgccgccugccguauggcugcgggccccgagccgcccgagugggaaccgcgcuggaggaaggcgcugcgcggcaaggagaacaaggggucuguggaaaucaugagaaaggacuugaaugacgcccgggaccugcauggccaggcagagucagcagcugcaguguggaagcugguugggacacgugauggaccguaggaagaaggcacugaccgacuacaagaagcugcgggccuucuuuguggaggaggaggagcauuuccugcaggaggcugagaaggaggaggggcucccugaggacgagcuggcugaccccacugagcgguucaggucacugcugcaggcggucucggagcuggagaagaagcaucgcaaccugggccucagcaugcugcugcagugauggcgccaacccguggcagucccagagcuggaggcaggaggauggauccucaucuccaugggaagugucagcguguggcugccagggaagcguggcaggcgccuggccuuggguccaucuacauaguugcguguuucaacaauguccauuuauccuucaccccgaggcguguuuugggggcugcaaacaccucccgguagaggcuggaccugaggacccuucccaccugugcccgucccuuccugaaguccuagccacagcccauccuccaugagucccggcagcucugggucaugcccuucccuggucacccaucugccccucaccucgucauccagggacccagacccugcaccuuccaugugggcccacagauccuuggcagguaccugaggugcaccauugagugucggauuugggguuagcauccagaaagaagaaugcgcaugacgcucugugaaggcuggaacucaggucuucagggagagaaaggaagacuggauugcaccuugaugccuccugaggaggcggccccccucuugaggugggcgugggcccggcccagccuuauccaagucgcucuguccaccucccccuuccuggcccccaccccacuccugugccucccaggagcccucccugugcuccaccugccuccgcagaaggaagccucuuucucuguuucccugggugagggggcuggcagguggcuaaccccauuuagcaucuccaggcccugccaucgugucucaucuugcuguuaucucuagcucuuucccuccucccauuuccuuuaguaguugaauuuugcaaagcuuguagcaguagcucaguugccugcagcauccuuguguguagauaaauuagucgacagaaacucagcacuggggacaggauugcaaagucggggacauagaugcagacaguuguugagauuuggggauagccgggcuugugagcggugcccauuuccagaugaagccuuucagcccuucugaguccccggcccuuggugcgaugucugugaguuugaccugcccagcgugugggcuggcucaaugcugaauaaaguggguuugugucagcucguuugcuucgucuccguguguccaccuggccucuucccccugcccuggccacccuccagugucaaaggaaacuuccucgugacacgugcuaaagcauggugaggaggacuuugauugggaccauugagaugggugugggacccuuuccuuggggccuggggggagauggggcuccaccccgacguagcagggcagggguuggaggagcgaggagcaguauaggguccaugggugggaaugacugugaggagacaucagggcugagggggcucuggcuaaacccaccucacagaguccuugcugcaggcaggcagggcgaucagacauuggcugcaaacggucagagaggaacccagucagguaccauugaggguggucagauauuaugguuaaccaaauuaggguucuugcuaaaacuggauuucauaagaaagggcaaagagggcccuaggagaagauuccagagccuggccagaguuuggccaaguagagaaucuuugucagcacgccaacaacaucccgacccugagaccuccaguuugucuuucucacugucuccgccugcugcagucugcugucaucccugagcaucccugccccugcccugcacaccugugaugcuugcccggacagguccugauggcagagucucccacaacaucagugucuccacaucaccagguccgacaguggcuucaccauccucaccuaaccuagcugaccagcaacaucccacccugucaaucacaaccucuuucuauuuaagaaaauuauauauuuauggggcacagug

SEQ ID NO: 30 - RNA, 74 nt, Homo Sapiens
guagauugaagccaguugauuagggugcuuagcuguuaacuaaguguuuguggguuuaagucccauuggucuag

SEQ ID NO: 31 - RNA, 103 nt, Homo Sapiens
ugcuugccucaguagcacacauacuuuaguuggaacaauagagagauuggcacggccucugugaaagaaugacaugcaaauuugugaagcauuccauauuuuu

SEQ ID NO: 32 - RNA, 2808 nt, Homo Sapiens
gucucaguccaucaggggggggaggggguggcgcgcgcgccauuucuagucguuuucaaagcgccucgcgcugauucucacgggcccggcugccggcccccgcucugcccugcagcauaauaaaauggcuaaucaggugaaugguaaugcgguacaguuaaaagaagaggaagaaccaauggauacuuccaguguaacucacacagaacacuacaagacacugauagaggcaggccucccacagaagguggcagaaagacuugaugaaauauuucagacaggauugguagcuuaugucgaucuugaugaaagagcaauugaugcucucagggaauuuaaugaagaaggagcucugucuguacuacagcaguucaaggaaagugacuuaucacauguucagaacaaaagugcauuuuuauguggaguuaugaagaccuacaggcagagagagaaacaggggagcaaggugcaagaguccacaaagggaccugaugaagcgaagaucaaggccuugcuugagagaacugguuauacucuggauguaaccacaggacagaggaaguauggugguccuccaccagacaguguguacucuggcgugcaaccuggaauuggaacggagguauuuguaggcaaaauaccaagggauuuauaugaggaugaguuggugccccuuuuugagaaggccggacccauuugggaucuacgucuuaugauggauccacuguccggucagaauagaggguaugcauuuaucaccuucuguggaaaggaagcugcacaggaagccgugaaacugugugacagcuaugaaauucgcccugguaaacaccuuggagugugcauuucuguggcaaacaacagacuuuuuguuggauccauuccgaagaauaagacuaaagaaaacauuuuggaagaauucaguaaagucacagagcuuagagaaguuuaacagaggguuugguggacguuauucucuaucaucaacccgaugacaaaaagaagaaucggggguucugcuuccuugaauaugaggaucacaagucagcagcacaagccagacgccggcugaugaguggaaaaguaaaaguguggggaaauguaguuacaguugaaugggcugacccuguggaagaaccagauccagaagucauggcuaagguaaaaguuuuguuugugagaaacuuggcuacuacggugacagaagaaauauuggaaaagucauuuucugaauuuggaaaacucgaaagaguaaagaaguugaaagauuaugcauuuguucauuuugaagacagaggagcagcuguuaagaugcuacauguuuauuuuaaaauucuaauccugagaaguuaaucuuugucuggcucguauuaauacuggcauuuuuccccggcuauggaugaaaugaauggcaaagaaauagaaggggaagaaauugaaauagucuuagccaagccaccagacaagaaaaggaaagagcgccaagcugcuagacaggccuccagaagcacugcguaugaagauuauuacuaccacccuccuccucgcaugccaccuccaauuagaggucggggucgugguggggggagagguggauauggcuacccuccagauuacuacggcuaugaagauuacuaugaugauuacuaugguuaugauuaucacgacuaucguggaggcuaugaagaucccuacuacggcuaugaugauggcuaugcaguaagaggaagaggaggaggaaggggagggcgaggugcuccaccaccaccaagggggaggggagcaccaccuccaagagguagagcuggcuauucacagaggggggcaccuuugggaccaccaagaggcucuagggguggcagaggggguccugcucaacagcagagaggccgugguucccguggaucucggggcaaucgugggggcaauguaggaggcaagagaaaggcagauggguacaaccagccugauuccaagcgucgucagaccaacaaccaacagaacugggguucccaacccaucgcucagcagccgcuucagcaagguggugacuauucugguaacuaugguuacaauaaugacaaccaggaauuuuaucaggauacuuaugggcaacaguggaaguagacaaguaagggcuugaaaaugauacuggcaagauacgauuggcucuagaucuacauucuucaaaaaaaaaaauuggcuuaacuguuucaucuuuaaguagcauuuugcugccauuuguauugggcugaagaaaucacuauuguguauauacucaagucuuuuuauuuuuccucuuuucauaaaugcucuuggacauuauugggcuugcagaguucccuuauucuggggauuacaaugcuuuuaucguuucaggcuucauuuuagcuucaaaacaagcugggcacacuguuaaaucaugauuuugcagaaccuuugguuuuggacaguuucauuuuuuuggauuugggauagauuacauaggaguauggaguaugcuguaaauaaaaauacaagcuagugcuuugucuuaguaguuuuaagaaauuaaagcaaacaaauuuaaguuuucuuguauugaaaauaaccuaugauuguauguuuugcauuccuagaaguagguuaacuguguuuuuaaauuguuauaacuucacaccuuuuugaaaucugcccuacaaaauuuguuuggcuuaaacgucaaaagccgugacaauuuguucuuugaugugauuguauuuccaauuucuuguucauguaagauuucaauaaaacuaaaaaaucuauucaaaacauuaaaaaaaaaaa

SEQ ID NO: 33 - RNA, 2109 nt, Homo Sapiens
augcccggggcgugugcggcggugcggcccgggcuccacguccacaggcugggcagcgcugugggccccgcgggcgccgaguccgcaggacccgcgagggcacuaccgcgaagcaucggccuccgggccgggccgggccggaccgggagccugcucggcggguccgggcuccugcaaggcggggacgcggggccggcgacccuucacgcuucguacucauugagcgccgauuuuaugccaggcaccgugcuggaucucccagugccuggaagagaaaacccauucuguuucgaagggcauccagagcuggucacaguggggacccacccuccuuuuccaggcuacgccagaucgcucccucaagcccucaaguagguguuggagagaggggugaugccuggugcugguggaaccccugcacagagacggacacaggaugagcucuaaguacccgcggucuguccggcgcugccugccccucugcgcccuaacacuggaagcagcucucauucuccucuucuauuuuuuuacccacuaugacgcuuccuuagaggaucaaaaggggcucguggcauccuaucaagacccuggguguguguacguuucaauggaagugaauuuaaauguacuuuauaaaucaaagacuuuuucugagacuuuggagaguuccaguaaugagagcuucucauuguuaucaaagccagggcuggagaccaguggcagucggccaagaucugaccgugauggcggcccuuggcuugggcuuccucaccucaaauuuccggagacacagcuggagcaguguggccuucaaccucuucaugcuggcgcuuggugugcagugggcaauccugcuggacggcuuccugagccaguucccuccugggaagguggucaucacacuguucaguauucggcuggccaccaugagugcuaugucggugcugaucucagcgggugcugucuuggggaaggucaacuuggcgcaguugguggugauggugcugguggaggugacagcuuuaggcacccugaggauggucaucaguaauaucuucaacacagacuaccacaugaaccugaggcacuucuacguguucgcagccuauuuugggcugacuguggccuggugccugccaaagccucuacccaagggaacggaggauaaugaucagagagcaacgauacccaguuugucugccaugcugggcgcccucuucuuguggauguucuggccaagugucaacucugcucugcugagaaguccaauccaaaggaagaaugccauguucaacaccuacuaugcucuagcagucaguguggugacagccaucucagggucauccuuggcucacccccaaaggaagaucagcaugagacuuaugugcacagugcgguguuggcaggaggcguggcuguggguaccucgugucaccugaucccuucuccguggcuugccauggugcugggucuuguggcugggcugaucuccaucgggggagccaagugccugccgguguguuguaaccgagugcuggggauucaccacaucuccgucaugcacuccaucuucagcuugcugggucugcuuggagagaucaccuacauugugcugcuggugcuucauacugucuggaacggcaauggcaugauuggcuuccagguccuccucagcauuggggaacucagcuuggccaucgugauagcucucacgucuggucuccugacagguuugcuccuaaaucucaaaauauggaaagcaccucauguggcuaaauauuuugaugaccaaguuuucuggaaguuuccucauuuggcuguuggauuuuaagcaaaagcauccaagaaaaacaaggccuguucaaaaacaagacaacuuccucucacuguugccugcauuuguacgugagaaacgcucaugacagcaaagucuccuuauguauaaugaaacaaggucagagacagauuugauauuaaaaaauuaaagacuaaaaacuuaguuuaagagucaauuuaauaaguuuaaaauaaauguuuaguuucauuaggaugaugcuaucaauauuuucuugguuacagacacauuauuaaaguuuuggguuaauuuua

SEQ ID NO: 34 - RNA, 320 nt, Homo Sapiens
ggaugugagggccaucuggcugcaacaccugucaccccauugaucggcagaguugauuccgcugaucuggcuggcuacgcagguguccccuuccuccuucacugcuccaugugcgucccuccugaaccagcagcugggucaaagaggacgaccaucccguagaggagggccgucccucagucaagggcauacgaguagcugcccuccccugcuagaaccuccagacaagcucucaaguucucagacaccuuugcaauuggaaagacuaauucuaaaagaaaggaaauguuuccaucucuacagaaaagccaaagcuguuu

SEQ ID NO: 35 - RNA, 1357 nt, Homo Sapiens
augcugucccggucccacugugucccgggcguucagccacucgcucucugccuuccagaaggggaacugcccucuagggagacauucccugccuggggucuccuuaugccagggaccagguuacccuaacagcaggaagguugucauuaacaacagugucuucaguguucgcuucuucagaacuacaacuguaugcaaguaugacuugguuacagucaaaaccccagcguuugcagaaccugucacagagggagaugucaggugggagaaagcuguuggagacacaguugcagaagaugaagugguuugugagauugaaacugacaagacauuggugcagguuccaucaccagcaaauggcaugauugaagcucuuuucguaccugaugggggaaaagucgaaggaggcacuccgcuuuucacacucaggaaaacuggugcugcuccugcuaaggccaagccggcugaagcuccugcugcugcagccccaaaagcagaaccuauagcagcggcaguuccuccccaugcagcacccauacccacucgaugccaccagugcccucgcccucacaaccuccuucuagcaaaccugugucugcaguaaaacccacugcugucccaccacuagcugagccaggagcuggcaaaggucugcauucagaacaucaggagaaaaugaacaggaugcggcagugcauugcucagcgucugaaggaggcccagaauacaugugccaaugcugacaauuuuuaaugagauugaugugaguaacauccagaagaugagggcucggcacaaagaggcuuuuuugaagaaacauaaccucaaacuaggcuucaugucggcaucugugaaggccucagccuuugccuugcaggaacagccuguuguaaacgcagugauugaugauauaaccaaagaggugguauauagggauuauauugacaucaguguugcaguggccaccccacagggucuggugguuccagucaucaggaauguggaagcuaugaauuaugcagauauugaacagaccaucacugaacugggagagaaggcccgaaagaaugaauuugccauugaagauauggauggugguaccuucaccauuagcaauggagguguuuuuggcucacucuuugaacacccauuaucaaccccccugucugccauccuggggaugcauggcaucuuugacaagccaguggcuauaggaggcaagguagaggugcagcccaugauguacguggcacugaccuaugaucaccggcugauugauggcagagaggcugugacuuuccuccgcaaaaucaaggcagcgguagaggaucccagaguccuccucuuugaucuuuag

SEQ ID NO: 36 - RNA, 924 nt, Homo Sapiens
cuucccacaaacugggaggaaaacugagaccuccuggucacccgccgccgggccuuuuagaaacucccacaagcucugccuucccucccugguccucuucagacccccucuuaguucuucgcggcuaacgguaagcucucuccuuaccucucccuaaucggccccucuggagaggaaaagaaaacuuaagagucgggucgcgcuagccuccagcagccgccgcgcccaccgacugcuccgccccuucuccucccccuccuccaggcucgcgcucggggccggguguggagcuggaacagagggcuggcaaggcgcgcaugcgcaccgaggguggagccgcugagcacagaaccggaaacuuagagacaaaguucggagccccgcccccgccgcgcgccgcugaguugucuggccccgccgacccacggcccacgacccaccgacccacgaaucggcccggccgucgcgugcaccaugucuggcuccuccagcgucgccgcuaugaagaaagugguucaacagcuccggcuggaggccggacucaaccgcguaaaaguuucccaggcagcugcagacuugaaacaguucugucugcagaaugcucaacaugacccucugcugacuggaguaucuucaaguacaaaucccuucagaccccagaaagucuguuccuuuuuguaguaaaaugaaucuuucaaagguuucccaaaccacuccuuaugauccagugaauauucaagagagcuacauuugaagccuguacaaaagcuuaucccuguaacacaugugccauaauauacaaacuucuacuuucgucaguccuuaacaucuaccucucugaauuuucaugaauuucuauuucacaaggguaauuguuuuauauacacuggcagcagcauacaauaaaacuuaguaugaaacuuu

SEQ ID NO: 37 - RNA, 118 nt, Homo Sapiens
agcuguucugaggguagugaguuaucucaauugacuguucaccaugaguuacaguugaacuccuuguucuacucuuucuccucacccuucucacuacugacugcacuugacuagucuu

SEQ ID NO: 38 - RNA, 1132 nt, Homo Sapiens
aaaacauucagauggcagauaacaguuuuucagaugggguuccuucagauuucguggaagcugcuaaaaaugcaaguaagacggaaaagcucacggaucaggugaugcagaauccuggaguuuuggcagcuuuacaggagcgacuugacaaugccccucacaccccuuccagcuacaucgaaacuuuaccuaaagcaguaaaaagaagaauuaaugcauugaaacaaauucaggugagaugcgcucauauagaagccaaguucuaugaagaaguucaugacuuggaaagaaaauaugcagcauuauaccagccucucuuugacgagagaagagaauuuaucaccggugauguugaaccaacaucugauauggaaucagaauggcaccgugaaaaugaagaggaggagaaauuggcuggagacaggaaaaauaaaguagucauaacagaaaaagcagcagcaacagcugaagagccaaaucccaaaggaauuccagaguucugguuuaccaucuuuagaaauguagauaugcuaagugaauuaguccaggaauaugaugaaccaaucuugaaauaccugcaggauauuaaagugaaguuuucugacccuggacagccuaugucuuucauauuaagaguuccacuuucaacccaaugacugcuuugccaacucaguccugacaaaaaccugcaagaugaaaucagaaccagauaaggcugaucccuuuucauuugcagguccugagaucauggacugcgauggguguacuauugacuggaagaaaggaaagaauguuacugucaaaaccaucaagaaaaagcagaagcguaaggguccaggcacuguuagaacaauuaccaaacaaguauccaaugagucauuuuucaacuucuucaauccacugaaagcaucuggggacggagaaucacuggauaaagauucugaauucguauuagccucugauuuugaaauuggacacuuuuuccgugagcggaccacaggcugugcuguacuucgcuggggaggccuuaaaggaugaugacaauuuugacgaaggugaagaagaagaggacgaauuagaaggugaugaggagggagaagaugaggaugagguggaaauuaaucccaacaag

SEQ ID NO: 39 - RNA, 1713 nt, Homo Sapiens; identical to SEQ ID NO: 17

SEQ ID NO: 40 - RNA, 2224 nt, Homo Sapiens
acuucuuuucuuggcuaagccgcguuuguacugugucuuaccaugccugaaccggcaaaauccgcuccggccccuaaaaagggcuccaagaaagccgucaccaaagcccagaagaaagacggcaagaagcgcaagcgcagccgcaaagagagcuacuccaucuacguguacaaggugcugaagcagguccaccccgacaccggcaucucguccaaggccaugggcaucaugaacuccuucgucaacgacaucuucgagcgcaucgcgggagaggcuucccgccuggcgcacuacaacaagcgcuccaccaucacaucccgcgagauccagacggccgugcgccugcugcugcccggcgagcuggccaagcacgccguguccgagggcaccaaggcggucaccaaguacaccagcuccaagugagucccugccgggaccuggcgcucgcucgcucgagucgccggcugcuugacuccaaaggcucuuuucagagccacccaccuaaucacuagaaaagagcuuguucacuuauucccuuaguuucuuuucauaaaguaaguuauuuuagugugaaggucaugggaaauggcauacguagcuuuuuaacuauuuggaacucgagguccccagugcgucauuggauuugcuuuugaaucuagagcgugucuuuacucauugugcugcuuagccuucccaggagucgguucucaauuaggcuguugggaauccgccucuuuacccgcccccacucccgccccacacgcgcccugguggcuccuugggucuguuucauucuaaaacgaaguggcugaguucggcugucauuuaagagaacuccaggacacaauucagcccggguuccgcaaacacugcgugacagcucuguaugacugacgcuuggcagcagcuuuuguguccggucaccaguucugccgugcgauggggccuccuguggauaccagccguucuguguauuuuggacgaaggccgcgcagccgggucccagccuuguccugauugggcgacaagaauauucaaaauucugcgccuuuuucuaauuuguagauuucaguuuccgucguucacuuugagacuuugaaauuccuauuucucauuuuguugauaauuucugcauuuaauggucugugcuuuaaaugguaacgcuacggccccaggucacugcgaggcacuuaccauguagauacgggcucaaaagucaccucucagagaccuacgucauccacucaggaauucgcgccucucauacuugccugucucauuuuaucuuccuucuagcagcugucugaaauugguucgucuguuuucuuguuuaugguauucucaagcccuugacagaccggcuagugugguuuucccgugcaucuucagccuggcacauuauggacacuuaaauacuacguauugaucuaauauuguuggguuaauuuuuccaucccacccuuuucuuaaucgcuuccguggauggaugaagggugcuguucauuuccauuagauguaugugaaggcacagugaaaauggaaauguucuuggagcuacuuccucaaaauguauccuuagucaccucagugcaacagcugggagggggccguguuaagauuuuuuuugcuacaaagaggagguggcaaugguagauccacccuuaugcuucucaguuuagcauaaccucuuauggauuuucaucaaauucagcguguuggucacuggaaagagccuuuuccuucuccuuuucuuacucuccccucaugguguuccccucuuaaaggagaggagcuuuuaauuuacacuuaccaccucauuugcuuuucuggaggccaugcaauauaggcgggacuacagaguuaaucuccuuuuuacaaaugaggccaagagaagccucauugguucacagucaugcagcucauacuguccacccuuguauucucagaugcaggacaauugcauuuuaguuuuauuuuguggaggugcagaauauuuacucuuucuguccaacccuugauucugccgaggaagacacugaugguuugaugagugauucagcuguuuuuggcuaagggcuuuuggagcugauggcagggguuugaugaauccaaaugagcucuagacauuaucacagacugaauagaucuuaacugucuccuacauguguguuuucaaauguguauagaugcuauuguuauuaauaaaguuaccaauuaauuuaaa

SEQ ID NO: 41 - RNA, 302 nt, Homo Sapiens
gcugggugugcuggugcgugccuauaguuccagcuacucaggaggcugaagcgggaggaucucuugggccuaugaguccugggcugcagugcacuaugccaauuaauuggguguccacgcuaaguuugacaucaauauggugaccuccugggagcaggggacaaccagguugccuaaggagggugaacuggcccaggucagaaaugcagcaggucaaaacuccugugcugaucaguauugggaucacuccugugaauagcuacugcacucuagccugggcaauagagcaagaccuggucucu

SEQ ID NO: 42 - RNA, 3483 nt, Homo Sapiens
gcgacucgggcgccgguggcgccaucuuacucgguugcgggaggggucacaggucagugccggagccuccgcgagugaaggaagacgaagugcgugacccgaccggcugugguguuccaguccccacugaccaguaggagcagcagggcgucggcuugugagccagaguaagagggacaggccagaauauguauggaaagguggcuuuuccucggggcaaccgaggaaggccccaagaggacaauggauucuggaacucgcccaguugguagcugcuguagcagccccgcugggcucucacgggaguacaaacuagugaugcugggugcuggugguguagggaagagugccaugaccaugcaguucaucagccaccgauucccagaagaucaugaucccaccauugaagaugcuuauaagaucaggauccguauugaugaugagccugccaaucuggacauuuuggauacagcuggacaggcagaguuuacagccaugcgggaccaguauaugagggcaggagaaggguuuaucaucuguuacucuaucacggaucgucgaaguuuccaugaaguucgugaguuuaaacagcuuauuuaucgaguccgacguacugacgauacaccugugguucuugugggaaacaagucagaccucaaacagcuaagacaggucaccaaggaagaaggauuggccuuggcccgagaauucagcugucccuuuuuugagacaucugcugcauaccgcuacuauauugaugauguuuuccaugcccuuguacgggagauacguaggaaagaaaaggaggcaguacuggccauggagaaaaaaucuaagcccaaaaacaguguauggaagaggcuaaaaucaccauuccggaagaagaaagauucaguaacuugaagagaagaugugaaguguuuaucugugaacugcagugcuguaucaaagcaguccaguaaccugcaguacugaguauggugcuugcucuuucacuuaacugauaagagggacaugccuacuaggaguuuuuaaugaugugguauuuaaaguauugucucuuaguuaaguaugauuuauuaacccaguggagcacugucugcuuuuaaauugucacauuagaauuuguucuaccaauguuuuggguucuguugcgcuauuaauuaauguaaauuuguuuauacccaggagaauauguauaccauguguguuugacuaaguucacaagggaaguuuuuggcucugcacuccacauuauccuuuaauuucaauuuccugggacuaucccagagaaagaccucagucucuucuauucacacuaugcuuccuagagacagaacaaaaaucauguagggaaauuggggcuaaugagaucagugccaaauuucagcagauaccugugaggcugacaccuguugcagacuauggaguggugagauuugggaaaguugggcuauauguuugcagggacuuaaaaagguagguucagaacaguauucucaguacaagcuucgcuuuucuaagaaguacacauuuggcccaaauucaccgggauaagugagaacagccagaagcauaaaaugugaugaagguuucuccugggaaccuuauuuuacucuucauuucaggguuuucuuuuuuuuuuuaccuucaaagguagacauuuugggaaucauaacuguauuacuaaacguguuuaaucaaaauucauaguuggaucagccauugccuuguacagguuuauuuuuuccccacagacgcacacaccaacacauuuauauucauugcuuccucccacuuugugcucuguaaaagagcuacagcuggcaagauguuuuuucggcccuucaucacugauugcauuuuccauacagaagagacaucagggguguggguaaaauugugugugugccuccuugacguggacaaucacuagacucagugcucugagaaaaucugcuauuucuguugaaugggucagucuuaaagcuuuaaaauucacauagguggaguuucccaucugaagauuucuuuacaaggacuuugcuaaguucaucucaggguuaucugagccuugaccaaguuuauccuaagggaauaccacuuugcucccugugcauaguuuaggaacuguaguccuaggaggaaacagcuuuaaauauugguagugaguugucuaagaucaggacuguuuugauaucugaccuuguuauaugcggagaguaaaugcaaaaaugcuaagaguaaugcaucauguauugaauauuaagugucacugaagcaauguuuguguugacuagaaacguaagaugacuuguguagcaccucuuuauaagcacacagcucaucuuaauauuuuccauuuuuauuagaggaaguaggacagaguuguguuuuucuuuauaaacaaaugauaaacuagcuuuuuuaaaaagugacuguuagaacuuuuuuagcucugaguaguggucccuuuuuaaacuccuggaaacauuuuuguuaccaaauaaaucauguuuuaugguacucagccauccaaaagugaaagaccuagcauuugauucugugcaggacacaaaucucacaggaacuauagcacuuuggaaaagcaucaaaguagaaaagaaauacagugcaauucuauuaugagaauguuuuacauuuaaacugguuuagcaccuuuuaaguuuaaagcccauagcuucuuauuacuagugaccuagggaauuguuauuaacauuaagagauauauauauauauauauauauauauuuuuuuuuuuuuuuuuuuuuuuuuuuaaauagagaugagguuucacuauguugcccaggcugaucucgaacuccuaggcucaagcaauccucccaauaugcugggauuacaggcaugagccaccaccuggcccaagcaagaaauugacacuauauaguuauuuaagguagucaggcaguagaaacauugccagaaggauagaaaggaauuuggauuauauauaaggaaaauaacaaaucgguguuuuuaagacuaucacugucauauauuagauccuuguauuaguccauccauuaauauuaguucuauucguggugcuagguagcuugacagguaugauaugcauaagucauagcucuauucuuagugucauaaaguguagcuaauuuauaagcucuaaguaaucagcuuuaucuaauuugagggcauuaaaauuacugccuagaacuuugagaagagaaaaauucagggauaaguugaaaggcacuggaacuguucauguccauaccagaccgguaaauuauaagauccagauguuagugucuagaauuagcuguuuagaauucagaggggacauauguuuuaacuuugucauauauuagcaagaauuggucuacugugauguuuggggaggaggagggggggauaauuuuuuuaaugcacuuguaugugaagacaguuuguaugacauaauacaaaacuuuuaaacaa

SEQ ID NO: 43 - RNA, 111 nt, Homo Sapiens
ggcauguccaaagguagugaguuagcucaauugauuguucacagucaguuacagaucgaacuccuuguucuacucuuucuucucuucucacuacugcacuugacuaggcuu

SEQ ID NO: 44 - RNA, 1183 nt, Homo Sapiens
aggagcguuuuuggagaaagcugcacucuguugagcuccagggcgcaguggagggagggagugaaggagcucucuguacccaaggaaagugcagcugagacucagacaagauuacaaugaaccaacucagcuuccugcuguuucucauagcgaccaccagaggauggaguacagaugaggcuaauacuuacuucaaggaauggaccuguucuucgucuccaucucugcccagaagcugcaaggaaaucaaagacgaauguccuagugcauuugauggccuguauuuucuccgcacugagaaugguguuaucuaccagaccuucugugacaugaccucuggggguggcggcuggacccugguggccagcgugcacgagaaugacaugcgugggaagugcacggugggcgaucgcugguccagucagcagggcagcaaagcagucuacccagagggggacggcaacugggccaacuacaacaccuuuggaucugcagaggcggccacgagcgaugacuacaagaacccuggcuacuacgacauccaggccaaggaccugggcaucuggcacgugcccaauaagucccccaugcagcacuggagaaacagcucccugcugagguaccgcacggacacuggcuuccuccagacacugggacauaaucuguuuggcaucuaccagaaauauccagugaaauauggagaaggaaaguguuggacugacaacggcccggugaucccuguggucuaugauuuuggcgacgcccagaaaacagcaucuuauuacucacccuauggccagcgggaauucacugcgggauuuguucaguucaggguauuuaauaacgagagagcagccaacgccuugugugcuggaaugagggucaccggauguaacacugagcaccacugcauugguggaggaggauacuuuccagaggccaguccccagcaguguggagauuuuucugguuuugauuggaguggauauggaacucauguugguuacagcagcagccgugagauaacugaggcagcugugcuucuauucuaucguugagaguuuugugggagggaacccagaccucuccucccaaccaugagaucccaaggauggagaacaacuuacccaguagcuagaauguuaauggcagaagagaaaacaauaaaucauauugacucaag

SEQ ID NO: 45 - RNA, 7058 nt, Homo Sapiens
aggaaaagccccagaaaaagcggagggagugagagccagaggcugcugcugccguuugcaagaacugcaggggaggaggacgcugccacccacagccucuagagcucauugcagcugggacagcccggagugugguuagcagcucggcaagcgcugcccagguccuggggugguggcagccagcgggagcaggaaaggaagcauguucccaggcugcccacgccucuggguccugguggucuugggcaccagcuggguaggcugggggagccaagggacagaagcggcacagcuaaggcaguucuacguggcugcucagggcaucaguuggagcuaccgaccugagcccacaaacucaaguuugaaucuuucuguaacuuccuuuaagaaaauugucuacagagaguaugaaccauauuuuaagaaagaaaaaccacaaucuaccauuucaggacuucuugggccuacuuuauaugcugaagucggagacaucauaaaaguucacuuuaaaaauaaggcagauaagcccuugagcauccauccucaaggaauuagguacaguaaauuaucagaaggugcuucuuaccuugaccacacauucccugcggagaagauggacgacgcuguggcuccaggccgagaauacaccuaugaauggaguaucagugaggacaguggacccacccaugaugacccuccaugccucacacacaucuauuacucccaugaaaaucugaucgaggauuucaacucggggcugauugggccccugcuuaucuguaaaaaagggacccuaacugagggugggacacagaagacguuugacaagcaaaucgugcuacuauuugcuguguuugaugaaagcaagagcuggagccagucaucaucccuaauguacacagucaauggauaugugaaugggacaaugccagauauaacaguuugugcccaugaccacaucagcuggcaucugcugggaaugagcucggggccagaauuauucuccauucauuucaacggccagguccuggagcagaaccaucauaaggucucagccaucacccuugucagugcuacauccacuaccgcaaauaugacugugggcccagagggaaaguggaucauaucuucucucaccccaaaacauuugcaaggcaagaaacucuccugacacugggaugcaggcuuacauugacauuaaaaacugcccaaagaaaaccaggaaucuuaagaaaauaacucgugagcagaggcggcacaugaagaggugggaauacuucauugcugcagaggaagucauuugggacuaugcaccuguaauaccagcgaauauggacaaaaaauacaggucucagcauuuggauaauuucucaaaccaaauuggaaaacauuauaagaaaguuauguacacacaguacgaagaugaguccuucaccaaacauacagugaaucccaauaugaaagaagaugggauuuuggguccuauuaucagagcccaggucagagacacacucaaaaucguguucaaaaauauggccagccgccccuauagcauuuacccucauggagugaccuucucgccuuaugaagaugaagucaacucuucuuucaccucaggcaggaacaacaccaugaucagagcaguucaaccaggggaaaccuauacuuauaaguggaacaucuuagaguuugaugaacccacagaaaaugaugcccagugcuuaacaagaccauacuacagugacguggacaucaugagagacaucgccucugggcuaauaggacuacuucuaaucuguaagagcagaucccuggacaggcaaggaauacagagggcagcagacaucgaacagcaggcuguguuugcuguguuugaugagaacaaaagcugguaccuugaggacaacaucaacaaguuuugugaaaauccugaugaggugaaacgugaugaccccaaguuuuaugaaucaaacaucaugagcaauuuuacacuuucagcuaucaauggcuaugugccugagagcauaacuacucuuggauucugcuuugaugacacuguccaguggcacuucuguaguguggggacccagaaugaaauuuugaccauccacuucacugggcacucauucaucuauggaaagaggcaugaggacaccuugacccucuuccccaugcguggagaaucugugacggucacaauggauaauguuggaacuuggauguuaacuuccaugaauucuaguccaagaagcaaaaagcugaggcugaaauucagggauguuaaauguaucccagaugaugaugaagacucauaugagauuuuugaaccuccagaaucuacagucauggcuacacggaaaaugcaugaucguuuagaaccugaagaugaagagagugaugcugacuaugauuaccagaacagacuggcugcagcauuaggaaucaggucauuccgaaacucaucauugaaucaggaagaagaagaguucaaucuuacugcccuagcucuggagaauggcacugaauucguuucuucaaacacagauauaauuguugguucaaauuauucuuccccaaguaauauuaguaaguucacugucaauaaccuugcagaaccucagaaagccccuucucaccaacaagccaccacagcugguuccccacugagacaccucauuggcaagaacucaguucucaauucuuccacagcagagcauuccagcccauauucugaagacccuauagaggauccucuacagccagaugucacagggauacgucuacuuucacuuggugcuggagaauucaaaagucaagaacaugcuaagcauaagggacccaagguagaaagagaucaagcagcaaagcacagguucuccuggaugaaauuacuagcacauaaaguugggagacaccuaagccaagacacugguucuccuuccggaaugaggcccugggaggaccuuccuagccaagacacugguucuccuuccagaaugaggcccuggaaggacccuccuagugaucuguuacucuuaaaacaaaguaacucaucuaagauuuugguugggagauggcauuuggcuucugagaaagguagcuaugaaauaauccaagauacugaugaagacacagcuguuaacaauuggcugaucagcccccagaaugccucacgugcuuggggagaaagcaccccucuugccaacaagccuggaaagcagaguggccacccaaaguuuccuagaguuagacauaaaucucuacaaguaagacaggauggaggaaagaguagacugaagaaaagccaguuucucauuaagacacgaaaaaagaaaaaagagaagcacacacaccaugcuccuuuaucuccgaggaccuuucacccucuaagaagugaagccuacaacacauuuucagaaagaagacuuaagcauucguuggugcuucauaaauccaaugaaacaucucuucccacagaccucaaucagacauugcccucuauggauuuuggcuggauagccucacuuccugaccauaaucagaauuccucaaaugacacuggucaggcaagcuguccuccaggucuuuaucagacagugcccccagaggaacacuaucaaacauuccccauucaagacccugaucaaaugcacucuacuucagaccccagucacagauccucuucuccagagcucagugaaaugcuugaguaugaccgaagucacaaguccuuccccacagauauaagucaaauguccccuuccucagaacaugaagucuggcagacagucaucucuccagaccucagccaggugacccucucuccagaacucagccagacaaaccucucuccagaccucagccacacgacucucucuccagaacucauucagagaaaccuuuccccagcccucggucagaugcccauuucuccagaccucagccauacaacccuuucuccagaccucagccauacaacccuuucuuuagaccucagccagacaaaccucucuccagaacucagucagacaaaccuuucuccagcccucggucagaugccccuuucuccagaccucagccauacaacccuuucucuagacuucagccagacaaaccucucuccagaacucagccauaugacucucucuccagaacucagucagacaaaccuuuccccagcccucggucagaugcccauuucuccagaccucagccauacaacccuuucucuagacuucagccagacaaaccucucuccagaacucagucaaacaaaccuuuccccagcccucggucagaugccccuuucuccagaccccagccauacaacccuuucucuagaccucagccagacaaaccucucuccagaacucagucagacaaaccuuuccccagaccucagugagaugccccucuuugcagaucucagucaaauuccccuuaccccagaccucgaccagaugacacuuucuccagaccuuggugagacagaucuuuccccaaacuuuggucagaugucccuuuccccagaccucagccaggugacucucucuccagacaucagugacaccacccuucucccggaucucagccagauaucaccuccuccagaccuugaucagauauucuacccuucugaaucuagucagucauugcuucuucaagaauuuaaugagucuuuuccuuauccagaccuuggucagaugccaucuccuucaucuccuacucucaaugauacuuuucuaucaaaggaauuuaauccacugguuauagugggccucaguaaagaugguacagauuacauugagaucauuccaaaggaagagguccagagcagugaagaugacuaugcugaaauugauuaugugcccuaugaugaccccuacaaaacugauguuaggacaaacaucaacuccuccagagauccugacaacauugcagcaugguaccuccgcagcaacaauggaaacagaagaaauuauuacauugcugcugaagaaauauccugggauuauucagaauuuguacaaagggaaacagauauugaagacucugaugauauuccagaagauaccacauauaagaaaguaguuuuucgaaaguaccucgacagcacuuuuaccaaacgugauccucgaggggaguaugaagagcaucucggaauucuugguccuauuaucagagcugaaguggaugauguuauccaaguucguuuuaaaaauuuagcauccagaccguauucucuacaugcccauggacuuuccuaugaaaaaucaucagagggaaagacuuaugaagaugacucuccugaaugguuuaaggaagauaaugcuguucagccaaauagcaguuauaccuacguauggcaugccacugagcgaucagggccagaaaguccuggcucugccugucgggcuugggccuacuacucagcugugaacccagaaaaagauauucacucaggcuugauagguccccuccuaaucugccaaaaaggaauacuacauaaggacagcaacaugccuauggacaugagagaauuugucuuacuauuuaugaccuuugaugaaaagaagagcugguacuaugaaaagaagucccgaaguucuuggagacucacauccucagaaaugaaaaaaucccaugaguuucacgccauuaaugggaugaucuacagcuugccuggccugaaaauguaugagcaagagugggugagguuacaccugcugaacauaggcggcucccaagacauucacgugguucacuuucacggccagaccuugcuggaaaauggcaauaaacagcaccaguuaggggucuggccccuucugccugguucauuuaaaacucuugaaaugaaggcaucaaaaccuggcugguggcuccuaaacacagagguuggagaaaaccagagagcagggaugcaaacgccauuucuuaucauggacagagacuguaggaugccaaugggacuaagcacugguaucauaucugauucacagaucaaggcuucagaguuucuggguuacugggagcccagauuagcaagauuaaacaaugguggaucuuauaaugcuuggaguguagaaaaacuugcagcagaauuugccucuaaaccuuggauccagguggacaugcaaaaggaagucauaaucacagggauccagacccaaggugccaaacacuaccugaaguccugcuauaccacagaguucuauguagcuuacaguuccaaccagaucaacuggcagaucuucaaagggaacagcacaaggaaugugauguauuuuaauggcaauucagaugccucuacaauaaaagagaaucaguuugacccaccuauuguggcuagauauauuaggaucucuccaacucgagccuauaacagaccuacccuucgauuggaacugcaagguugugagguaaauggauguuccacaccccuggguauggaaaauggaaagauagaaaacaagcaaaucacagcuucuucguuuaagaaaucuugguggggagauuacugggaacccuuccgugcccgucugaaugcccagggacgugugaaugccuggcaagccaaggcaaacaacaauaagcaguggcuagaaauugaucuacucaagaucaagaagauaacggcaauuauaacacagggcugcaagucucuguccucugaaauguauguaaagagcuauaccauccacuacagugagcagggaguggaauggaaaccauacaggcugaaauccuccaugguggacaagauuuuugaaggaaauacuaauaccaaaggacaugugaagaacuuuuucaaccccccaaucauuuccagguuuauccgugucauuccuaaaacauggaaucaaaguauugcacuucgccuggaacucuuuggcugugauauuuacuagaauugaacauucaaaaaccccuggaagagacucuuuaagaccucaaaccauuuagaaugggcaauguauuuuacgcuguguuaaauguuaacaguuuuccacuauuucucuuucuuuucuauuagugaauaaaauuuuauacaagaa

SEQ ID NO: 46 - RNA, 330 nt, Homo Sapiens
auggugcuugcaaagaagauuaaaaagucaguggaauggaucaacucuaggcuucuacuuguuauaaaaaguggaaaguacauacuggcguacaagcagacuccaaagaugaucaggcaaggcaaagcaaaauuggcuauccacacugaaaacuguccagcuuugaggaaauccaaaauagaguacuauaccauguugaccaaaacugguguccaucacuacagugacaauaauuuugaauugggcauagcaugugguaaauacugcagaguaugcauguugucuaucauugauccagacgauucugauaucguuagaagcgugccagaa

SEQ ID NO: 47 - RNA, 3189 nt, Homo Sapiens
caccuauaccauucauuccagucuccucaauucuuucacuguauuaagacggccugcccucuggcacguuuucuggaacgaaagcggcuugggacagacagacucccuucgccagggagccccgaccccgagggcgcgcccugagcgucugagcgcagccccgcugcguccccaguuguaucccccgccacgcccgccucuuccgccgcucgcgcgcgcgcgcacggccggccacggcgcgccgggguuggcugcuacagggaccgcgguggcggcggcggccucgacagcgguagugccuucuacuccgcuuuuuuaguuuccuccgcccccucccgugggacgcuguuguguggcugccuuaaaaaaaaacgcaacuuuauuguuccucagccccaccuccggcucggcgggcguccucaggaugcacugaggcugaggggaggggaggcggcggagggucgaggucgcggucccucuccuccgagcgcccggcuggaggggagggagucacgaugucugguagccgccaggccgggucgggcuccgcugggacaagccccggguccucggcggccuccucggugacuuccgccuccucgucuuuauccucuuccccgucgccgccuuccguggcgguuucggcggcagcgcugguguccggcgggguggcccaggccgccggcucgggcggccucgggggcccggugcggccuguguugguggcgcccgccguaucggguagcggcggcggggcgguguccacgggccugucccggcacagcugcgcggccaggcccagcgccggcguaggaggcagcagcuccagccuaggcagcggcagcaggaagcgaccucuccucgccccccucugcaacgggcucaucaacuccuacgaggacaaaagcaacgacuucguaugccccaucugcuuugauaugauugaagaagcauacaugacaaaauguggccacagcuuuugcuacaaguguauucaucagaguuuggaggacaauaauagaugucccaaguguaacuauguuguggacaauauugaccaucuguauccuaauuucuuggugaaugaacucauucuuaaacagaagcaaagauuugaggaaaagagguucaaauuggaccacucagugaguagcaccaauggccacagguggcagauauuucaagauugguugggaacugaccaagauaaccuugauuuggccaaugucaaucuuauguuggaguuacuagugcagaagaagaaacaacuggaagcagaaucacaugcagcccaacuacagauucuuauggaauuccucaagguugcaagaagaaauaagagagagcaacuggaacagauccagaaggagcuaaguguuuuggaagaggauauuaagagaguggaagaaaugaguggcuuauacucuccugucagugaggauagcacagugccucaauuugaagcuccuucuccaucacacaguaguauuauugauuccacagaauacagccaaccuccagguuucaguggcaguucucaggcuggagugcaauggcgcuaucuuggcucacugcaaccuccaccucccagguacaagcgauucuccugccucacccucccaaguagcugggauuaccggcgccugccuccacaccugacaaagaaacagccuugguauaauagcacguuagcaucaagacgaaaacgacuuacugcucauuuugaagacuuggagcaguguuacuuuucuacaaggaugucucguaucucagaugacagucgaacugcaagccaguuggaugaauuucaggaaugcuuguccaaguuuacucgauauaauucaguacgaccuuuagccacauugucauaugcuagugaucucuauaaugguuccaguauagucucuaguauugaauuugaccgggauugugacuauuuugcgauugcuggaguuacaaagaagauuaaagucuaugaauaugacacugucauccaggaugcaguggauauucauuacccugagaaugaaaugaccugcaauucgaaaaucagcuguaucaguuggaguaguuaccauaagaaccuguuagcuagcagugauuaugaaggcacuguuauuuuaugggauggauucacaggacagaggucaaaggucuaucaggagcaugagaagagguguuggaguguugacuuuaauuugauggauccuaaacucuuggcuucagguucugaugaugcaaaagugaagcuguggucuaccaaucuagacaacucaguggcaagcauugaggcaaaggcuaaugugugcuguguuaaauucagccccucuuccagauaccauuuggcuuucggcugugcagaucacuguguccacuacuaugaucuucguaacacuaaacagccaaucaugguauucaaaggacaccguaaagcagucucuuaugcaaaguuugugaguggugaggaaauugucucugccucaacagacagucagcuaaaacuguggaauguagggaaaccauacugccuacguuccuucaagggucauaucaaugaaaaaaacuuuguaggccuggcuuccaauggagauuauauagcuugugguaagaagugaaaauaacucucucuaccuguacuauaaaggacuuucuaagacuuugcuaacuuuuaaguuugauacagucaaaaguguucucgacaaagaccgaaaagaagaugauacaaaugaauuuguuagugcugugugcuggagggcacuaccagauggggaagaaaauuugcauauaagugguuccucacaggaguccaaugugcugauugcugcuaacagucaggguacaauuaaggugugcuagaauugguaugaaggguuaacucaagucaaauuguacuugauccugcugaaauacaucugcagcugacaaugagagaagaaacagaaaaugucaugugaugucucuccccaaagucaucauggguuuuggauuuguuuugaauauuuuuuucuuuuuuucuuuucccuccuuuaugaccuuugggacauugggaauacccagccaacucuccaccaucaauguaacuccauggacauugcugcucuuggugguguuaucuaauuuuugugauagggaaacaaauucuuuugaauaaaaauaaauaacaaaacaauaaaaguuuauugagccaca

SEQ ID NO: 48 - RNA, 4482 nt, Homo Sapiens
gacgcagcaggaggaaacugcucgggcugcaagcagucuuccaggcuuugcggcugccaaaggaauaauugagacgucugaguugagcagcagguggaaugucagaagacugagaacauuguuccuucuucauacugcugcucuguugccagagaaucccaauuuacacucaaagcuucuuugauuaagugcuaggagauaaauuugcauuuucucaaggaaaaggcuaaaagugguagcagguggcauuuaccgucauggagagcagggaucauaacaacccccaggagggacccacguccuccagcgguagaagggcugcaguggaagacaaucacuugcugauuaaagcuguucaaaacgaagauguugaccugguccagcaauugcuggaagguggagccaauguuaauuuccaggaagaggaagggggcuggacaccucugcauaacgcaguacaaaugagcagggaggacauuguggaacuucugcuucgucauggugcugacccuguucugaggaagaagaauggggccacgccuuuuauccucgcagcgauugcggggagcgugaagcugcugaaacuuuuccuuucuaaaggagcagaugucaaugagugugauuuuuauggcuucacagccuucauggaagccgcuguguaugguaaggucaaagcccuaaaauuccuuuauaagagaggagcaaaugugaauuugaggcgaaagacaaaggaggaucaagagcggcugaggaaaggaggggccacagcucucauggacgcugcugaaaaaggacacguagaggucuugaagauucuccuugaugagaugggggcagauguaaacgccugugacaauaugggcagaaaugccuugauccaugcucuccugagcucugacgauagugauguggaggcuauuacgcaucugcugcuggaccauggggcugaugucaaugugaggggagaaagagggaagacuccccugauccuggcaguggagaagaagcacuuggguuuggugcagaggcuucuggagcaagagcacauagagauuaaugacacagacagugauggcaaaacagcacugcugcuugcuguugaacucaaacugaagaaaaucgccgaguugcugugcaaacguggagccaguacagauuguggggaucuuguuaugacagcgaggcggaauuaugaccauucccuugugaagguucuucucucucauggagccaaagaagauuuucacccuccugcugaagacuggaagccucagagcucacacuggggggcagcccugaaggaucuccacagaauauaccgcccuaugauuggcaaacucaaguucuuuauugaugaaaaauacaaaauugcugauacuucagaaggaggcaucuaccugggguucuaugagaagcaagaaguagcugugaagacguucugugagggcagcccacgugcacagcgggaagucucuugucugcaaagcagccgagagaacagucacuuggugacauucuaugggagugagagccacaggggccacuuguuugugugugucacccucugugagcagacucuggaagcguguuuggaugugcacagaggggaagauguggaaaaugaggaagaugaauuugcccgaaauguccugucaucuauauuuaaggcuguucaagaacuacacuuguccuguggauacacccaccaggaucugcaaccacaaaacaucuuaauagauucuaagaaagcugcucaccuggcagauuuugauaagagcaucaagugggcuggagauccacaggaagucaagagagaucuagaggaccuuggacggcugguccucuaugugguaaagaagggaagcaucucauuugaggaucugaaagcucaaaguaaugaagaggugguucaacuuucuccagaugaggaaacuaaggaccucauucaucgucucuuccauccuggggaacaugugagggacugucugagugaccugcugggucaucccuucuuuuggacuugggagagccgcuauaggacgcuucggaaugugggaaaugaauccgacaucaaaacacgaaaaucugaaagugagauccucagacuacugcaaccugggccuucugaacauuccaaaaguuuugacaaguggacgacuaagaugagcaagcugaggcacagacaaauaauuuuuccaacuacacagaaccaguaaggggugcaccaggauuugaagcugggaaggauggcugcagaggccaugugcuuaagccacaccacuacaugaagcugugauggcaucaagucuaccaacucauuuacucacugaggaaauugaggcucagagaccacacucaaauuacucaugcuggacagucagagauuggcagaccuggaaagagauuaaugaauguguuaugaaaaaaaugaauaaguuuuaugaaaaaagaggcaauuucuaccagaacacugugggugaucugcuaaaguucauccggaauuugggagaacacauugaugaagaaaagcauaaaaagaugaaauuaaaaauuggagacccuucccuguauuuucagaagacauuuccagaucuggugaucuaugucuacacaaaacuacagaacacagaauauagaaagcauuucccccaaacccacaguccaaacaagccucagugugauggagcugguggggccaguggguuggccagcccugggugcugauggacugauuugcuggaguucagggaacuacuuauuagcuguagaguccuuggcaaaucacaacauucugggccuuuuaacucaccagguugcuugugagggaugaguugcauagcugauaugucagucccuggcaucguguauuccauaugucuauaacaaaagcaauauauacccagacuacacuaguccauaagcuuuacccacuaacugggaggacauucugcuaagauuccuuuugucaauugcaccaaaagaaugagugccuugaccccuaaugcugcauauguuacaauucucucacuuaauuuucccaaugaucuugcaaaacagggauuaucauccccauuuaagaacugaggaaccugagacucagagagugugagcuacuggcccaagauuauucaauuuauaccuagcacuuuauaaauuuaugugguguuauugguaccucucauuugggcaccuuaaaacuuaacuauccuuccagggcucuuccagaugaggcccaaaacauauauagggguuccaggaaucucauucauucauucaguauuuauugagcaucuaguauaagucugggcacuggaugcaugaauuccacuccuuccagaaccaacugcauugguuuuccaugaccuuaaggcaguaguucucaacuggggggcaauuuugcacugaagagagcauuuggcagagucugaagaaguuuuuggugucacagcuuuguggggagcaugcuauggcauuuaguggguaaagaccagggaugcugccaaaccugccuugcacaggacagccccugcaacaaagaauuauccagacaaaaauaucaauggugcugagguugagaaaaccugacuuaaggggcugggaugcuuuugaacuagcuuaaggcccaggacuguggaguguguggaccaccccacagaggagggacucagauuuauuuacucuugcuggaucuguagugauggaguuccuucuggugucagccccacaggaggcucccaggccucccucacuucccauacccagucuaggagcuccuucuggcucccaagcacccagagcuuuccuccgccuuuuaguuuugguuccuccacuggaauguaggcuccucacgggcgauggcugucuuuucuugacuuuguaucuucacugccaagcaaaaagucugccaagugggaauguuuaauaaauauucauugaauaaugaaugaaccaucuucguacaugaauaauaauacugucuuacguuuuucuggugcuuuauaauguauacauuacaucugaguauuuuauuuuauuuaauuuucaaaacaauccuuuaaggucaacauuguuaucccuauuuugcugaugaggaaacuaagguuagaaacauuuugauuuccucuaggacguauagcuaggaaguguuacuaucuugauuugaacaaauuuucuggugcuaagucugauguucuuuccaugaaucauuguggugguugagauggagcuuuguaaugggaauaaaacaguaccuuagguucuuucugaaaaggagguaucuagcaauggauaaauagauaccacugaaugaaauuaaauguugauuaggaacaaauuuaaggcuuaaaaaauacuuuaugagcagcaagauugcuuuaacuuuuaaaaugaagcuuugguucucugauuuguaaugagcaccuggacaugucaauuaaaaugcccauuugugaagcuuacucaauaaaacuuuaaauugucuua

SEQ ID NO: 49 - RNA, 7546 nt, Homo Sapiens
uucagucuguugaaggauaccccguuguguauuucuaccuguauguaccagagacaccucaaauucaaaauguccagaaaugaacacaguaucuucuucccuugaguaacucgccuucuguauauaauuggggugaauguuccagcaaugccaacgggcuagcaucuacucaggcagguacgccagacaucugaaucuuaauaccucgucguccccccucaaucugucacuauguccuaauuuuauuuccuaccuuugcaucccuuccucauaauuaucagcaccacugccuuaauuuagauccuaucauuccuugucuggauuauuucaagucuuucgccccucucaagucugaccucgucauagacuguuuguggaugauuauuuucccugcaacaucuccaccucccaauagucuccaucacuuauuagccaugugaauuauggcaaauugcuuaaccuaccuaugccucacuuuccuuauuguaaaguggaaauaagaguaccuaucucauaggguugugugauuaaucaugcgaugcaauuagaacagugccuaggauaugaaagugccccaaaauguuacguuauuauuauuauuacuacuauugccuucucaugaacaugcuauguguauguucaagcuguuaucucuacuggaaaauccuucuccguuuccaauacucuuuccaaaacccccuccuggguuuuacugcaccuaccauuguguacugacgugauugaaugauuggcuuaugggacugauccuuucuaccagacuuaacuucuucagggcaggaacucugauacauaguaaauggucaauaaaaguuggcucaacugaaacccuaaggauaaacuccauccacagcggaaggcgcggccccgcccgauucgggggcggggcggggagccgcgcgcggagggugggucgauggggguggggugggacucuuuuuccucgccguggcggcggaggcgcacggcgugggcuugcggcgagacgucgucgucggaggcugaaaaagcccaaggugcugccguugcccguacaacucggacuugcuguugcucgagccgcgucugcacgggucucggaccgagcggagcucgcagccucggucccggagcccaccuucgccucgcccuugcccagccugcggugauggaggcggccaccacacugcacccaggcccgcgcccggcgcugccccucgggggcccgggcccgcugggcgaguuccugccuccacccgagugcccggucuucgaacccagcugggaagaguucgcggaccccuucgcuuucauccacaagauccggcccauagccgagcagacuggcaucuguaaggugcggccgccgccggauuggcagccaccauuugcaugugauguugauaaacuucauuuuacgccacguauccagagacugaaugaauuggaggcccaaacucguguaaaauugaauuucuuggaccagauugcaaaguacugggaguuacagggaaguacucugaaaauuccacauguggagaggaagaucuuggacuuauuucagcuuaauaaguuaguugcagaagaagguggauuugcaguuguuugcaaggauagaaaauggaccaaaauugcuaccaagaugggguuugcuccuggcaaagcagugggcucacauaucagagggcauuaugaacgaauucucaaccccuacaacuuauuccuguccggagacagccuaagguguuugcagaagccaaaccugaccacagacacuaaggacaaggaguacaaaccccaugauauuccccagaggcagucugugcagccuucggaaacgugccccccagcccgacgagcaaaacgcaugagagcagagagacagagucucgcuguguugcccaggcuggagugcaguggcgcgaucuuggcucacugcaaccuccgccuccuagauuccagcaauucuucugccucagccucccaagccaugaauauuaaaauagaacccgaggagacaacggaagccagaacucauaaucugagacgucgaauggguuguccaacuccaaaaugugaaaaugagaaagaaaugaagaguagcaucaagcaagaaccuauugagaggaaagauuauauuguagaaaaugagaaggaaaagcccaagagucgaucuaaaaaagccaccaaugcuguggaccuguaugucugucuuuuauguggcaguggcaaugaugaagaccggcuacuguugugugauggcugugaugacaguuaccauaccuuuugcuugaucccaccucuccaugauguucccaagggagacuggagguguccuaaguguuuggcucaggaauguaguaagccacaagaagcauuuggcuuugaacaagcagccagggacuauacccuccguacuuuuggggaaauggcagaugcguucaaaucugauuacuucaacaugccaguccauaugguccccacagagcuuguugagaaagaauuuuggagacuaguaagcacuauugaggaggaugucacaguggaauauggagcugacauugccucaaaggaauuuggcaguggcuuuccuguccgagaugggaaaaucaaacucucaccugaggaagaggaguaucuugauaguggcuggaauuugaacaacaugccagugauggagcagucuguccuugcacauauuacugcugauauauguggcaugaaacuuccuugguuguaugugggaaugugcuuuucuucauucuguuggcacauugaagaccacuggagcuauucaauuaacuacuugcacuggggugagccaaaaaccugguauggagucccaggguaugcugcugagcagcuagaaaauguaaugaagaaacuagcuccagaacucuuugugucccagccggaucuccuccaucagcuugugaccaucaugaaccccaauacccugaugacucaugaagugccuguuuaccgaacuaaucagugugcuggggaguuugugauuacauuuccaagagccuaccacagugguuuuaaccaggguuuuaauuuugcugaggcuguuaacuucugcacuguugauuggcugccauuaggccgacaguguguggagcauuaucgcuugcuucaucgauauuguguguuuucccacgaugagaugaucugcaagauggcuuccaaggcugauguauuagauguuguaguggcuucaacuguucagaaagacauggccauuaugauugaggaugagaaagcuuuaagagaaacuguccguaaauugggagugauugauucggaaagaauggauuuugagcuguugccagaugaugaacgucaguguguaaaaugcaaaacuacaugcuucaugucugccaucuccuguucuuguaaaccuggccuucuuguuugccugcaucauguaaaagaauuguguuccuguccuccuuacaaauauaaauugcgguauagguacacgcuggaugaucucuacccuaugaugaaugcauugaagcuucgagcagaaucuuacaacgaaugggccuugaaugugaaugaagcuuuggaggcaaagaucaacaagaagaaaagccuugucagcuucaaggcuuuaauugaagaaucugaaaugaagaaauucccagacaaugaucuuuugcgacaccuucgccuagucacacaggaugcagagaagugugccucuguugcgcagcaguugcuuaauggcaaaaggcaaacuagauaucgaucugguggagggaaaucccaaaaucaguugacagugaaugagcuccggcaguuuguaacacagcuguaugcucuuccauguguccucagucagacaccauuacuaaaggaucucuugaaucguguagaagauuuucaacagcauagucagaaacuacucucugaggaaacgccuagugcugcggagcugcaggacuugcuagaugucagcuuugaauuugauguugaacuuccacagcuugcugagaugcguauccguuuggaacaagcccguuggcuagaagaggugcagcaagcuugccuagaccccagcucccuuacuuuagaugauaugagacgucucauagaccuagggguagggcuggccccguauucagcaguggagaaagcuauggcccggcugcaggaacugcucacagugucagagcacugggacgacaaagccaagagucuccucaaggccaggccacgacauucauugaauagccuugcuacggcaguaaaggaaaucgaagagaucccugcauaucugcccaauggugcggcucugaaagacucagugcagagagccagagacuggcuucaggauguagagggccugcaggcuggaggacgugugccaguguuagacacacucauagaacuuguuacacgaggccgaucuauccccguacaucugaauucuuugccaagacuggaaacccuaguagcugagguucaggcuuggaaagaaugugcuguuaauacauucuugacugagaauucuccauauucucucuuagaggugcuguguccucgaugugauauuggccuuuugggauugaaaaggaagcagagaaaguuaaaggagcccuugccaaauggaaagaaaaaaagcaccaaauuagagagucugagugaccuggagagagcuuuaacugaaagcaaggagacugcuucagcuauggcaacucuuggggaagcucgccuaagggaaauggaagccuugcagucucucagacucgccaaugaagggaaauugcugucgccucuccaagauguggauauaaaaaucugccuaugucagaaggccccagcugccccuaugauucaaugugaacucugcagggaugcuuuccacaccaguuguguggcgguacccaguauuucacagggccugcgaaucuggcuuuguccccauugucggaggucagagaaaccuccauuagagaaaauucugccccugcucgccucccuucagcguauccgaguucgccuuccugagggagaugcacuucgauauaugauugaaagaaccgugaacuggcagcacagagcccagcaacugcuuucgucagggaaucuuaaauuugugcaagaucgagugggcucaggacuguuauauagcagauggcaagccucagcaggacaggugucagacacaaacaagguaucucaaccuccuggcacaacaucauuuucuuugccugaugacugggacaacagaaccucauauuugcacucccccuucucaacuggacgaaguuguaucccccuccaugguguuaguccagaagugaaugaacuauugauggaagcccagcugcuccagguaucccuuccugaaauucaggaacuuuaccagacuuuacuugcaaagccaagcccugcucagcagacugaccgaagcucaccagugagacccagcagugagaagaaugacuguugccgagggaagcgagauggaauuaacagucuugagagaaaacugaagagacgccuggaaagagagggccucuccagugagcggugggaacgaguuaagaaaaugcggacccccaaaaagaagaaaaucaaacugagccaccccaaggacaugaacaauuucaaguuagagagagagcguagcuaugaauuaguucguucugcugaaacucauucccugcccucagacacauccuauuccgaacaggaagacucugaggaugaagaugccaucugcccagcugugagcugccugcagccagaaggagaugagguggacuggguccagugugauggcagcugcaaucagugguuucaucaggucuguguuggugucuccccagagauggcagagaaagaagacuacaucugugugcgcuguacugugaaggacgcaccaagccgaaaguaaaaacacaaaaacagauaccccccuacuuaauguaauucaggacuccaaccaagaggauuucuucaaaucucagcaaagcuacaggacugguacucaagccagccuguaaacggugcuauuucuauuccuuaugggaucauuuuuccaggacucuuugaagaaaagaaaaaacaacuaaaaaaauuuuugacacuuuuuguauuuuuuccuuaagagcuauuugugguuguugagguuugaaaagcugacuguuuuuuuugcagggguucccaccaauuuggaaggcauugaagcuugcaccuuuucauguacagcauuaaaauuuuaccucucucugggauuuaccagcuuaagaguccaacucacuuccagugcccaaaagggcacccaccagaaauuccaguaaauccucauuugaggaagcucucccuuguuuacucuguuaccacauuggggaaauuuuuaaguuuuucacuuugggaguuuuuguuuguuucuucuuuuccuuuauccacuuuucuucuuccugguagacuagguuuauuuaucugagcaauaacuucuauguugguuucaguggcuggaauuaaaacaaaacaaaacaaacuuccaaacaguguguuggugcuuuagcgauugauugauguacagaacacaaaugucuaguuucuagugucacugaugaacuagugauguagaaaagagacuucucuguaaguaauugccacagcuguauuuuggcuuucucccugucccuuccuuucuccccuauuuuuugguagcuuguaucaaauguuacaguuuauauuguggaauaaauccuucguccuaacauaacacuaaaugcugauuauuuagagccauuagagcacagcuucuucugccccucuacuguugcacagccagaaggggcugcuugcuuuugccucugcccaaccagguugcaguagcaguggauguuagccugcaaacaacauuaggggauucuucuuuuguguccugcucuguuuggugggccauaugccuacagcccucacuaacaaagaaccccucugucuucaaggacuagaaccuaucuuuaaagccgugcucuuuuaaaauaagcuuucucagaauguuggcaaaucacuucaauccucaaaucagucuuccuuguggaaugcugccuuuauuauauuugaauugacaggggaacuugguuuaggguuaagacguuggaaggaaaucuaaggaaaauuaauccucacagagguccggguuuaguauaugucuugagaggagacuugugaauucccagacucugccuccugguuuccuuucucauuucuuucuaacuguagcuaucauuacuggcuguggauagcccauagcuauuuuccuugcuuuucuuuuuuaaaggggucuguucugcaguggagaagacauucuggugaccagacuuuugcuuaccuuuuccuauucuguugccaauuuuuguuuuccccacauucuauagccauaaaccugaagaugaguaaaacuggugggucuuuaauaaaacaacaacaaaaacagcaguuugugauauagcagagguuuaaauguacccuccccuuuuaugcacuucaaauaauuaaaucucuuuaagaaugacuucua

SEQ ID NO: 50 - RNA, 132 nt, Homo Sapiens
cugcagauauucucacuguuuugauuuuguaauagucaggacaggcuaaccauucacuuuauuaagaccaugcauauauccccagaacuaguucuuuccugaggucuaguuuuauaaauguugcugauaaac

SEQ ID NO: 51 - RNA, 81 nt, Homo Sapiens
cuucuggaagcugguuucacaugguggcuuagauuuuuccaucuuuguaucuagcaccauuugaaaucaguguuuuaggag

SEQ ID NO: 52 - RNA, 5021 nt, Homo Sapiens
agcacgaaaggccacgcaggccguucuaacccuggcggccaagaggagggguagcaggcucuggaaccugcgggcggggacgaagacggcgcgcgacgaugucgcaccgcggcgugcgcggugucggcaguagcugcggcgcaggggcggagcgaaggcugcggcggcgucggguacgcgcacacguugcaucuucuuccuuucgcgggguccuccguaguucuggcacgagccaggcguacugacagguggaccagcggacugguggagauggcgacgcucucucugaccgugaauucaggagacccuccgcuaggagcuuugcuggcaguagaacacgugaaagacgaugucagcauuuccguugaagaagggaaagagaauauucuucauguuucugaaaaugugauauucacagaugugaauucuauacuucgcuacuuggcuagaguugcaacuacagcuggguuauauggcucuaaucugauggaacauacugagauugaucacugguuggaguucagugcuacaaaauuaucuucaugugauuccuuuacuucuacaauuaaugaacucaaucauugccugucucugagaacauacuuaguuggaaacuccuugaguuuagcagauuuauguguuugggccacccuaaaaggaaaugcugccuggcaagaacaguugaaacagaagaaagcuccaguucauguaaaacguugguuuggcuuucuugaagcccagcaggccuuccagucaguagguaccaagugggauguuucaacaaccaaagcucgaguggcaccugagaaaaagcaagauguugggaaauuuguugagcuuccaggugcggagaugggaaagguuaccgucagauuuccuccagaggccagugguuacuuacacauugggcaugcaaaagcugcucuucugaaccagcacuaccagguuaacuuuaaagggaaacugaucaugagauuugaugacacaaauccugaaaaagaaaaggaagauuuugagaagguuaucuuggaagauguugcaauguugcauaucaaaccagaucaauuuacuuauacuucggaucauuuugaaacuauaaugaaguaugcagagaagcuaauucaagaagggaaggcuuauguggaugauacuccugcugaacagaugaaagcagaacgugagcagaggauagacucuaaacauagaaaaaacccuauugagaagaaucuacaaaugugggaagaaaugaaaaaagggagccaguuuggucaguccuguuguuugcgagcaaaaauugacaugaguaguaacaauggaugcaugagagauccaacccuuuaucgcugcaaaauucaaccacauccaagaacuggaaauaaauacaauguuuauccaacauaugauuuugccugccccauaguugacagcaucgaagguguuacacaugcccugagaacaacagaauaccaugacagagaugagcaguuuuacuggauuauugaagcuuuaggcauaagaaaaccauauauuugggaauauagucggcuaaaucucaacaacacagugcuauccaaaagaaaacucacaugguuugucaaugaaggacuaguagauggaugggaugacccaagauuuccuacgguucgugguguacugagaagagggaugacaguugaaggacugaaacaguuuauugcugcucagggcuccucacguucagucgugaacauggagugggacaaaaucugggcguuuaacaaaaagguuauugacccaguggcuccacgauauguugcauuacugaagaaagaagugaucccagugaauguaccugaagcucaggaggagaugaaagaaguagccaaacacccaaagaauccugagguuggcuugaagccugugugguauagucccaaaguuuucauugaaggugcugaugcagagacuuuuucggagggugagaugguuacauuuauaaauuggggcaaccucaacauuacaaaaauacacaaaaaugcagauggaaaaaucauaucucuugaugcaaaguugaauuuggaaaacaaagacuacaagaaaaccacuaaggucacuuggcuugcagagacuacacaugcucuuccuauuccaguaaucugugucacuuaugagcacuugaucacaaagccagugcuaggaaaagacgaggacuuuaagcaguaugucaacaagaacaguaagcaugaagagcuaaugcuaggggaucccugccuuaaggauuugaaaaaaggagauauuauacaacuccagagaagaggauucuucauaugugaucaaccuuaugaaccuguuagcccauauaguugcaaggaagccccguguguuuugauauacauuccugaugggcacacaaaggaaaugccaacaucagggucaaaggaaaagaccaaaguagaagccacaaaaaaugagaccucugcuccuuuuaaggaaagaccaacaccuucucugaauaauaauuguacuacaucugaggauuccuugguccuuuacaauagaguggcuguucaaggagaugugguucgugaauuaaaagccaagaaagcaccaaaggaagauguagaugcagcuguaaaacagcuuuugucuuugaaagcugaauauaaggagaaaacuggccaggaauauaaaccuggaaacccuccugcugaaauaggacagaauauuucuucuaauuccucagcaaguauucuggaaaguaaaucucuguaugaugaaguugcugcacaaggggaggugguucguaagcuaaaagcugaaaaauccccuaaggcuaaaauaaaugaagcuguagaaugcuuacugucccugaaggcucaguauaaagaaaaaacugggaaggaguacauaccuggucagcccccauuaucucaaaguucggauucaagcccaaccagaaauucugaaccugcugguuuagaaacaccagaagcgaaaguacuuuuugacaaaguagcuucucaaggggaaguaguucggaaacuuaaaacugaaaaagccccuaaggaucaaguagauauagcuguucaagaacuccuucagcuaaaggcacaguacaagucuuugauaggaguagaguauaagccugugucggccacuggagcugaggacaaagauaagaagaagaaagaaaaagaaaauaaaucugaaaagcagaauaagccucagaaacaaaaugauggccaaaggaaagacccuucuaaaaaccaaggaggugggcucucaucaaguggagcaggagaagggcaggggccuaagaaacagaccagguugggucuugaggcaaaaaaagaagaaaaucuugcugauugguauucucaggucaucacaaagucagaaaugauugaauaccaugacauaaguggcuguuauauucuucgucccugggccuaugccauuugggaagccaucaaggacuuuuuugaugcugagaucaagaaacuugguguugaaaacugcuacuuccccauguuugugucucaaagugcauuagagaaagagaagacucauguugcugacuuugccccagagguugcuuggguuacaagaucuggcaaaaccgagcuggcagaaccaauugccauucguccuacuagugaaacaguaauguauccugcauaugcaaaauggguacagucacacagagaccugcccaucaagcucaaucaguggugcaauguggugcguugggaauucaagcauccucagccuuuccuacguacucgugaauuucuuuggcaggaagggcacagugcuuuugcuaccauggaagaggcagcggaagaggucuugcagauacuugacuuauaugcucagguauaugaagaacuccuggcaauuccuguuguuaaaggaagaaagacggaaaaggaaaaauuugcaggaggagacuauacaacuacaauagaagcauuuauaucugcuaguggaagagcuauccagggaggaacaucacaucauuuagggcagaauuuuuccaaaauguuugaaaucguuuuugaagauccaaagauaccaggagagaagcaauuugccuaucaaaacuccuggggccugacaacucgaacuauugguguuaugaccaugguucauggggacaacauggguuuaguauuaccaccccguguagcauguguucagguggugauuauuccuuguggcauuaccaaugcacuuucugaagaagacaaagaagcgcugauugcaaaaugcaaugauuaucgaaggcgauuacucaguguuaacauccgcguuagagcugauuuacgagauaauuauucuccagguuggaaauucaaucacugggagcucaagggaguucccauuagacuugaaguugggccacgugauaugaagagcugucaguuuguagccgucagacgagauacuggagaaaagcugacaguugcugaaaaugaggcagagacuaaacuucaagcuauuuuggaagacauccaggucacccuuuucacaagggcuucugaagaccuuaagacucauaugguuguggcuaauacaauggaagacuuucagaagauacuagauucuggaaagauuguucagauuccauucuguggggaaauugacugugaggacuggaucaaaaagaccacugccagggaucaagaucuugaaccuggugcuccauccaugggagcuaaaagccuuugcauccccuucaaaccacucugugaacugcagccuggagccaaaugugucuguggcaagaacccugccaaguacuacaccuuauuuggucgcagcuacugagggaugaacgaaagcccccucuucaacuccucucacuuuuuaaagcauugauauuaguaucuucucagauacagaccguuuuaugauuuuuuaaaaaguaaaaguucuaaaaugaagucacacaggacaauuauucuuaugccuaaguuaacaguggauaaaagacuuuucuguaaacaacuccaguaauaaauaucaugaacuaaaaaaaa

SEQ ID NO: 53 - RNA, 3473 nt, Homo Sapiens
gguuuucaggagcccgagcgagggcgccgcuuuugcguccgggaggagccaaccguggcgcaggcggcgcggggaggcgucccagagucucacucugccgcccaggcuggacugcagugacacaaucucggcugacugcaaccacugccuccaggguucaagcgauucucuugccucagccucccaaguagcugggauuacagauagauugauguucauguuccugacacuacuacaagauucauacuccugaugcuacugacaacguggcuucuccacagucaccaaaccagggaugcuauacuggacuucccuacucucaucugcuccagcccccugaccuuauaguugcccagcuuuccuggcaauugacuuugcccaucaauacacaggauuuagcauccagggaagaugucggagccucagauguuaauuuucuaauugagaauguuggcgcuguccgaaccuggagacagaguaucagcgccuuugcuugcugcuguuuuugcuguuuuuugaugcugggaaccaccaccuaaagauaguaaagaaaacacaggaagcuuuccggaaaacaaaaaguccuuucuccugauucaccaaaaaauaaaauacugacuaccaucacugugaugagauuccuauagucucaggaacugaagucuuuaaacaaccagggacccucugccccuagaauaagaacauacuagaagucccuucugcuaggacaacgaggaucaugggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucauuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggauuuccaggauguuggcugguuucuucauaaacucucucaacagauacuaaagaaagaaaaagaaaagaagaaagacaauaacauuccguugcaaacuguagcaaccaucuccuaaucaaaggagcaauuuccaacuuaucucaagccacaaauaacucuucacuuuguauuugcaccaaguuaucauuuugggguccucucuggagguuuuuuuuuucuuuuugcuacuaugaaaacaacauaaaucucucaauuuucguaucaacaccaug

SEQ ID NO: 54 - RNA, 68 nt, Homo Sapiens
guagcuacaguuuaaccaaaacauuagauugcagaucuaaucauagaagccugcaacuucuuaccuac

SEQ ID NO: 55 - RNA, 2780 nt, Homo Sapiens
acgggaguggcgcgccaggccgcggaaggggcguggccucgguccgggguggcggccguugccgccaccagggccucuuccugcgggcggugcugccgaggccggccugcgcggggcagucaugguacccccuugagcgggcuguggcggagagcggggcggggacuggcuggaggguggcggcccggcggggcgggggcggggccggccucuggcuccuucuuccucugcauguggcuggcggccgcagagcaguucaguucgcucacuccucgccggccgccucuccuucgggcucuccucgcgucacuggagccauggcguucgccgagaccuacccggcggcauccucccugcccaacggcgauugcggccgccccagggcgcggcccggaggaaaccgggugacgguggugcucggugcgcaguggggcgacgaaggcaaagggaaggugguggaccugcuggcgcaggacgccgacaucgugugccgcugccagggaggaaauaaugcuggccauacaguuguuguggauucuguggaauaugauuuucaucucuuacccaguggaauaauuaauccaaaugucacugcauucauuggaaauggugugguaauucaucuaccuggauuguuugaagaagcagagaaaaauguucaaaaaggaaaaggacuagaaggcugggaaaaaaggcuuauuauaucugacagagcucauauuguauuugauuuucaucaagcagcugaugguauccaggaacaacagagacaagaacaagcaggaaaaaauuuggguacaacaaaaaagggcauuggcccaguuuauucguccaaagcugcucggaguggacucaggaugugcgaccuuguuucugacuuugauggcuucucugagagguuuaaaguucuagcuaaccaauacaaaucuauauaccccacuuuggaaauagacauugaaggugaauuacaaaaacucaaggguuauauggaaaagauuaaaccaauggugagagauggaguuuauuuucuauaugaggcccuacauggaccaccaaagaaaaucuugguagaaggugcaaaugcagcacuauuagauauugauuuugggacuuacccuuuuguaaccucuucaaauuguacuguuggagguguuuguacugguuuggguaugccaccucaaaauguuggagaaguguauggaguugugaaagcuuauacaacuagaguugguauuggugccuuuccuacagagcaagacaaugaaauuggagaauuauuacaaacaagggguagagaguuugguguaacuacuggaaggaaaagaagauguggcugguuggaccucguuuugcucaaauaugcucauaugaucaauggauuuacugcguuggcacuuaccaaguuggauauuuuggacauguuuacggaaaucaaaguuggaguugcuuacaaguuagauggugaaaucauaccucauaucccagcaaaccaagaagucuuaaauaaaguugaaguucaauauaagacucucccaggauggaacacagacauaucaaaugcaagggcguuuaaagaacuaccuguuaaugcacaaaacuauguucgauuuauugaagaugagcuucaaauuccaguuaaguggauugguguugguaaauccagagaaucuaugauucaacucuuuuaaugauugccaguaaugcaagaaacacuccuugagagggaggggaaaagacuuucuuaaauauuucauuuaugaccugcaaauucaagaauaaagacacugaaguaaguuugaagcccuacaguuguuuccagucuuuucagauggaugccuacuguggagauuaacuuuggcauauuccagugucagcuuucuuuagcuggaauugccaaaucauuuguugcuccugcugcucucauggugccacguuuuuuuuuucaauguuuaguaauaguauaauccauguuguuugauaucaaaaguagaauuacuuuuaauguaguuuuucuucauuauugucauugcguguucuuaaguuuuaccccuauuagaugguaagaacaauuaaugcaguuuugcacaaauauuuuuacauucugaucauucaguucugucauuguaaucuuuguuguuagaaacaaaugaugaaaacauagggguucuguaaacuuuuguaaugcuaugaauucuguuuaaauuuugggcugucuauuuucugcugaaaccaugcaaaauugagcuuugguggggcugggaggggguuauguauucaugggaccuuuaauuuguacagaacacagaacuuauuucugucaguuauuuaauacauugaaaauuuagugaaauguucaaagagaauagauguuucccaaaacaacaaucuuuauguuaaaaauagucauuaaaagaucuguuguaauauaugguggauauuuuucuuuaauuucaaacauuaccucugaaauguguaucuuuucuuuuuuaucuuaccauuaauuuuaaaucuaguggauugguuuucaacaucgugccugccgauaugccuacagaaucaucuguaagugucaaaaugaacccacguuguuagccauaauuuugauuaugccuuuauuucuccuuucuugaaaaaaaaaagguguuauuuugacaauuaggcauaacauuguuuuguagauuaucuuuuaaugaacuauuuuaaauguuaaauuaggugccacuuaaauuuauuuuauuacaccaugaauagcugauuaaaagaaccaaauauuucuagua

SEQ ID NO: 56 - RNA, 7502 nt, Homo Sapiens
aggacguugcgugcucgcucgcgccaggcgagucuccgcgucucccucgcgaacucggugaaaggaauuggcgccguucgacaccaggcggauccgcucugcagcacgaacccaucuccagccgcagccgcagccgccgcccgggccgaggagcagccgcagcagccgccaccaguggccgagugagcggagccgaguuugaggcagcgccuagcggugaaucggggcccucaccaugaguuccucgccuguuaauguaaaaaagcugaaggugucggagcugaaagaggagcucaagaagcgacgccuuucugacaagggucucaaggccgagcucauggagcgacuccaggcugcgcuggacgacgaggaggccgggggccgccccgccauggagcccgggaacggcagccuagaccugggcggggauuccgcugggcgcucgggagcaggccucgagcaggaggccgcggccggcggcgaugaagaggaggaggaagaggaagaggaggaggaaggaaucuccgcucuggacggcgaccagauggagcuaggagaggagaacggggccgcgggggcggccgacucgggcccgauggaggaggaggaggccgccucggaagacgagaacggcgacgaucaggguuuccaggaaggggaagaugagcucggggacgaagaggaaggcgcgggcgacgagaacgggcacggggagcagcagccucaaccgccggcgacgcagcagcaacagccccaacagcagcgcggggccgccaaggaggccgcggggaagagcagcggccccaccucgcuguucgcggugacgguggcgccgcccggggcgaggcagggccagcagcaggcgggagguaagaagaaggcggaaggcggcggaggcggcggucgccccggggcuccggcggcggauggggcucguguguguuuuaggggacggcaaaacagaacagaaaggcggagauaaaaagagggguguuaaaagaccacgagaagaucauggccguggauauuuugaguacauugaagagaacaaguauagcagagccaaaucuccucagccaccuguugaagaagaagaugaacacuucgaugacacagugguuugucuugauacuuauccgggaagcaauuaaucccuaauuguugaacaggcaguccuggguaaagaggaccuaaaaugcugcacuauuaacagcauuagacggccagguuuguacuucauaguuuuaggcugucuucuucacaaguuuuagaaaaagaauuuaggagcuagagcccuggugcaggaucaacagcagcucauacuccuauuuuaaaauaauuuggucguggccucccuucaguuuuaauguggcacugguaaaucuaccugguucuggcaugcuucacuuugauuuccugcuauccucuacugcuugccucuaaaucaagguaaagagcagagcagguauguauuaaugucacauugucuugauuauuuuaaauacuuaaaauauacauguuaaaccuugguauuaguuucacaggcaguuuacuuuucaguacauaauuuaacaggagugacuuggugggaguggggcuuuaaacugaaaauuggaacaacagcaugauguggagaaaaguugugcagcauuaagaaguacaugcaaaaauuaaguaaccaaguuuugucuacauagcagauauguuuacauuggaugucaaaaguaacacaguauuugauauaauuacagauaauugugaucuacauuuuaaaauaucaagagaucgucucagugcuucuucccuuacaauggagaguuuugcuuuucuuugggcuggaggaagagcauccuauggugugucaaaaggcaaaguguguuuugagaugaagguuacagagaagaucccaguaaggcauuuauauacaaaagauauugacauacaugaaguucguauuggcuggucacuaacuacaaguggaauguuacuuggugaagaagaauuuucuuauggguauucucuaaaaggaauaaaaacaugcaacugugagacugaagauuauggagaaaaguuugaugaaaaugaugugauuacauguuuugcuaacuuugaaagugaugaaguagaacucucguaugcuaagaauggacaagaucuuggcguugccuucaaaaucaguaaggaaguucuugcuggacggccacuguucccgcauguucucugccacaacugugcaguugaauuuaauuuuggucagaaggaaaagccauauuuuccaauaccugaagaguauacuuucauccagaacguccccuuagaggaucgaguuagaggaccaaaggggccugaagagaagaaagauugugaaguugugaugaugauuggcuugccaggagcuggaaaaacuaccuggguuacuaaacaugcagcagaaaauccagggaaauauaacauucuuggcacaaauacuauuauggauaagaugaugguggcagguuuuaagaagcaaauggcagauacuggaaaacugaacacacuguugcagagagccccccagugucuugggaaauuuauugagauugcugcccgaaagaagcgaaauuuuauucuggaucagacaaaugugucugcugcugcccagaggagaaaaaugugccuguuugcaggcuuccagcgaaaagcuguuguaguuugcccaaaagaugaagacuauaagcaaagaacacagaagaaagcagaaguagaggggaaagaccuaccagaacaugcgguccucaaaaugaaaggaaacuuuacccucccagagguagcugagugcuuugaugaaauaaccuauguugaacuucagaaggaagaagcccaaaaacucuuggagcaauauaaggaagaaagcaaaaaggcucuuccaccagaaaagaaacagaacacuggcucaaagaaaagcaauaaaaauaagaguggcaagaaccaguuuaacagaggugguggccauagaggacguggaggauucaauaugcgugguggaaauuucagaggaggagccccugggaaucguggcggauauaauaggaggggcaacaugccacagagaggugguggcgguggaggaagugguggaaucggcuauccauacccucgugccccuguuuuuccuggccgugguaguuacucaaacagagggaacuacaacagagguggaaugcccaacagagggaacuacaaccagaacuucagaggacgaggaaacaaucguggcuacaaaaaucaaucucagggcuacaaccaguggcagcagggucaauucuggggucagaagccauggagucagcauuaucaccaaggauauuauugaauacccaaauaaaacgaacugauacauauuucuccaaaaccuucacaagaagucgacuguuuucuuuaguaggcuaacuuuuuaaacauuccacaagaggaagugccugcggguuccuuuuuuagaagcuuuguggguugauuuuuuuucuuuucuuuuuuguacauuuuuaauugcaguuuaaaagugaaucguaagagaaccucagcauugugcacgauaagagaaugugucaguauuucaggguucuacauuuuaucuguaaaaugugacuuuuuuuuuuuuuuaucacaacagaaguaaaauguugcuuuguaccuggugucuuuuauuaagaauuuacuccccccauuucucacagagaauaacagucgggagucauugucacaauauaauagaaauguuagcaaccagauucauguaaggacuaagugguccucaugaauugcauuaagacucuguacugcucauauuacacuccauccucucuguaguuugcuggguaguggaggggguaagcuaaaucauaguuucugacaauaacugggaagguuuuuucuuaaaauaacaauggaauugguauaauugggauugaaaacuaaaacuuggaacuaagauagagaagauggaguguauguagaagggcuguuaaaaauguaaaacuugguugcauuauuuguggaggcucaaacuugugaagguuaauaccauaauuuuuccauuuguucugcauuuugauucugaaaagaaagcuggcuuugcccauuucuuauuaaaaaaacuuguuguaaauccaguugucuaaugggaucuauaugaaguuagccaugucuguaugcccuucucccacaaaauacuguauaacuagugugcuuguaguaguuaacuccaccaucuuuguaagcuaaugaaauugugagucacccauuuauaucuuaauuuuuaaucaugucaguucuugaauggguaucuccuuagccugcugauuucuuuuucuuucuaaagaaaguggguggagaaauuaauuuagacguuuguuugcaauaaaaagaauucauuuuacucuuguuuugggauucucgccaucaagguucaaaaucccuuuauauaacucccaagaggagaaauuuauuaagugugugcuuucuggacagcuuauucuuuacucugcauagaacauuuagguuuuaaaaacuuaaauguauacugacaauugauacauaauuaugaaguaaaguugaauucuucccuuccccucccccccagacaacuuuuaacauauuuaaugaggggaaaagguacuggcugggagaaguuaacacugaguuuaucaucuuuacagaaugcuaaugcuguccucaacugauuauuuuauauacauauauaugauacaugaaacucugggaucagaugcuuuuagaagccaucaugcaagccagucauugaugucacugcuacacaacacugcuaacuugacuguagcuauguaauaacauuagauccccuaauuguaauuauauuggguuugcacagaacacuuuaaucuuccccucaccaaugugaagugaggaaucaggagucaaacuguagaacuaaaauuugacuucagucuagcguuuccuugguguuuuuagguugcuuugguaaguuuagguuugcuauauuucugauugcuuagaauuuuguuuuagcccuuuaaaaucagaucauaaauaugaauucauacuucuaaggaauuuucuugcuauaagcuggaguuuaggugauguauagguucaguugagacauuuuuggaacaggcaaauccuuaguuaacauaagauauuuaacaguugaagauagugucauggauuuuuaucuuuuuuagcaaguaaugcuaagaaccacuggccugagcuacuacucuucaguauacauuauuaggauugcauagacuuacuagaggaacaguuucagguuuugaugcuaaucaguguuguguccuaaaguuguccuuugugccuuuaaaaaguuuuggauauaucuucuaguuuaaaauugcuuauuaaggaauucauuuuauaauugcagugggaaaguaauggucaaguaacacuagguagacuaucaugccuguuuagcccagagaauuuggggggagagagaauagauaaaaauggcacccagaaaaauguuaaaaucuuuagucaagacuagaauuaauacaauugucuacacuuguauggcagaaauaaccuuauaaaguguuuaaggaauucagagaagggaauguaccaaauaagcaacagggagaaaauuagguaagaaguaagauacgaacgagaaaccugauuuauugcucauccuucccuugccucccuaauggcaagcaaaacucugaacaucugaaaaggauguaguucuggacaaauccugacuacccagaggaaacucacugugagauugcuguugauuugaagggugcuuucacuaagguuauauuuuaaaguagaauaacacaugcugaguguaaacuggcuuuggauuggucagcugcaguaguacaaaaacagcauagaauuugagaaaacuaaaacugcuaugagauagcuaugagaaaacuaaaacugcuaugagauagaaaugauguaaaauuauguggaaaguuuucccucauauacucacauacagccuuugaagggcucuggcucugaccgguugauggccuugagcgagaugaaaucaugaaauugagucaaaucaauuugacauugaaaugacaagaggaaacucuuaaauacauaaaaacaagcucucauuugccuaggauagauacugucuuaaaaauaaagacugaaccuagauguucugagcacuagcaacaagguauuuuaacaaguuuaaaggaauucucugaaaaaguuauaaaauuauucuaggaaacauaaccauaauaguguuuuaagggacuuucaccuggggauuuuauauucaugaacagaguguauucuguauuuaaaaugucucauuugugggaauuggaugacauguuuuuugauaaauuuauucacaauauaaauugacuuuuuauucuaggaccaugugaauaauggguuccauugcacaaauacaaauauuuuaauagcuucuuaggcagugguguagacaucuuggauauaaauaauuguagaucuuguauauuugauuuuuaaaaaacuagaauaaacagagaggcauaaacauaucuuagaguccaagugguaguguuuagcauuggauauaauaaauggauguuuuacaaaguguuuccauaauucucuuccuauacauaaaugucuuguuuucaaaaguggauggaacuuggcugggugugguggcucacgccuguaauccuagcacuuugggaggccaaggcgggaggaucacuugagcucaggaguuugagaccauccugggcaacauagugagaccuggucucuugaaaaaaaaaaaguggauggaacuuguagcagagaauuuuaucuacuucucaaccugcuucagaauacccauuugagauguuccccuggaaagaugaacacaauacugcaucugaagccauuucuucccaccuaacauucuuaaaaugauuagagucuaaacuuugucauucauuccuaauucuggagcucugagguugagguguucagaguuuggugaauaauuggguuuaaguuuuaacauuuuaguaauaauaaaagcaaacacauacauguuaaggccugacaauagguugcaauacccaugcauugggacucauacccagcauaaauggugagggacugaacauuagugcuuugagcaagaauugguuaacuaccugagaucucuaaaacaguaauuugaauuacuaauacauaaaccacaagucucuucgaauuguuaauugccuaaauuuacccuaaaacuuaguuaacgcugcagugccuuuauuaaagcuuuuuuuugggggggggugugggcacagcuacuccauaacuuuaaauuuuaaagcaugaaggugaucuagcuaguguuagugcuugaguugguaguuacauaggcugcucuugaaucguccuguuuucuuugccuaguauuagcaccacagguacauauuuguaaaauaagcauuaaaaguacuuuguccagc

SEQ ID NO: 57 - RNA, 4879 nt, Homo Sapiens
gcugccgcuuggacgucguccugucugggugucgcgggccggccccgcggggagcgcccccggcgcgaugcccuucaggaaaggaggcugacguacgcgucugcggccagcccggacucuuuaaaagccggcggugcgcggggcaucccagccaagccggagaggaggcgagcagcagggccugguggcgagagcgcggcugucacugcgcccgagcaucccagagcuuuccgagcggacgagccggccgugccgggcauccccagccucgcuacccucgcagcacacgucgagccccgcacaggcgaggguccggaacuuagcccaaagcacguuuccccuggcagcgcaggaaacgcccggccgcgcgccggcgcacgccccccucuccuccuuuguuccgggggucggcggccgcucuccugccagcgucgggaucucggccccgggaggcgggccgucgggcgcagccgcgaagaugccguuggaacugacgcagagccgagugcagaagaucugggugcccguggaccacaggcccucguugcccagauccugugggccaaagcugaccaacucccccaccgucaucgucauggugggccuccccgcccggggcaagaccuacaucuccaagaagcugacucgcuaccucaacuggauuggcguccccacaaaaguguucaacgucggggaguaucgccgggaggcugugaagcaguacagcuccuacaacuucuuccgccccgacaaugaggaagccaugaaaguccggaagcaaugugccuuagcugccuugagagaugucaaaagcuaccuggcgaaagaagggggacaaauugcgguuuucgaugccaccaauacuacuagagagaggagacacaugauccuucauuuugccaaagaaaaugacuuuaaggcguuuuucaucgagucggugugcgacgacccuacaguuguggccuccaauaucauggaaguuaaaaucuccagcccggauuacaaagacugcaacucggcagaagccauggacgacuucaugaagaggaucaguugcuaugaagccagcuaccagccccucgaccccgacaaaugcgacagggacuugucgcugaucaaggugauugacgugggccggagguuccuggugaaccgggugcaggaccacauccagagccgcaucguguacuaccugaugaacauccacgugcagccgcguaccaucuaccugugccggcacggcgagaacgagcacaaccuccagggccgcaucgggggcgacucaggccuguccagccggggcaagaaguuugccagugcucugagcaaguucguggaggagcagaaccugaaggaccugcgcguguggaccagccagcugaagagcaccauccagacggccgaggcgcugcggcugcccuacgagcaguggaaggcgcucaaugagaucgacgcgggcgucugugaggagcugaccuacgaggagaucagggacaccuacccugaggaguaugcgcugcgggagcaggacaaguacuauuaccgcuaccccaccggggaguccuaccaggaccugguccagcgcuuggagccagugaucauggagcuggagcggcaggagaaugugcuggucaucugccaccaggccguccugcgcugccugcuugccuacuuccuggauaagagugcagaggagaugcccuaccugaaaugcccucuucacaccguccugaaacugacgccugucgcuuauggcugccguguggaauccaucuaccugaacguggaguccgucugcacacaccgggagaggucagaggcugccaaaaguacaacacugugcuaguacuagucagaccuuucucuuagaccgagcgugacuuucugucauggcguucccgaaacaggaugcaaagaagggaccuaacccgcucaugagacgcaauagugucaccccgcuagccagccccgaacccaccaaaaagccucgcaucaacagcuuugaggagcauguggccuccaccucggccgcccugcccagcugccugcccccggaggugcccacgcagcugccuggacaaccuuugcuagggcaagccugucuguaaguaucucuccgaucaucgcugcugcuugcacugcuuucuuccugcuugcucauuuggccuccugccuguuaaaacgaacugucugucacauuuucucaaaguuuucuccuuacuaacuguggaagaacaugaaaggcucccggagcagcgcugacuccuccaggaaacacugaggcagacgugucgguuccauuccauuuccauuucugcagcuuagcuuguguccugcccuccgcccgaggcaaaacguauccugaggacuucuuccggagagggugggguggagcagcgggggagccuuggccgaagagaaccaugcuuggcaccgucuguguccccucggccgcuggacaccagaaagccacgugggucccuggcgcccugccuuuagccguggggcccccaccuccacucucuggguuuccuaggaauguccagccucggagaccuucacaaagccuugggagggugaugagugcugguccugacaggaggccgcuggggacacugugcuguuuuguuucguuucugugaucucccggcacguuuggagcugggaagaccacacugguggcagaauccuaaaauuaaaggaggcaggcuccuaguugcugaaaguuaaggaauguguaaaaccuccacgugacuguuuggugcaucuugaccugggaagacgccucaugggaacgaacuuggacagguguuggguugaggccucuucugcaggaagucccugagcugagacgcaaguuggcugggugguccgcacccuggcucuccugcagguccacacaccuuccaggccuguggccugccuccaaagaugugcaagggcaggcuggcugcacggggagagggaaguauuuugccgaaauaugagaacuggggccuccugcucccagggagcuccagggccccucucuccucccaccuggacuuggggggaacugagaaacacuuuccuggagcugcuggcuuuugcacuuuuuugauggcagaagugugaccugagagucccaccuucucuucaggaacguagauguuggggugucuugcccuggggggcuuggaaccucugaagguggggagcggaacaccuggcauccuuccccagcacuugcauuaccgucccugcucuucccagguggggacaguggcccaagcaaggccucacucgcagccacuucuucaagagcugccugcacacugucuuggagcaucugccuugugccuggcacucugccggugccuugggaaggucggaagaguggacuuuguccuggccuucccuucauggcgucuaugacacuuuuguggugauggaaagcaugggaccugucgucucagccuguugguuucuccucauugccucaaacccugggguaggugggacggggggucucgugcccagaugaaaccauuuggaaacucggcagcagaguuuguccaaaugacccuuuucaggaugucucaaagcuugugccaaaggucacuuuucuuuccugccuucugcugugagcccugagauccuccucccagcucaagggacagguccugggugagggugggagauuuagacaccugaaacugggcguggagagaagagccguugcuguuuguuuuuugggaagagcuuuuaaagaaugcauguuuuuuuccugguuggaauugaguaggaacugaggcugugcuucagguaugguacaaucaagugggggauuuucaugcugaaccauucaagcccuccccgcccguugcacccacuuuggcuggcgucugcuggagaggaugucucuguccgcauucccgugcagcuccaggcucgcgcaguuuucucucucucccuggauguugagucucaucagaauauguggguaggggguggacgugcacgggugcaugauugugcuuaacuugguuguauuuuucgauuugacauggaaggccuguugcuuugcucuugagaauaguuucucgugucccccucgcaggccucauucuuugaacaucgacucugaaguuugauacagauaggggcuugauagcugugguccccucuccccucugacuaccuaaaaucaauaccuaaauacagaagccuuggucuaacacgggacuuuuaguuugcgaagggccuagauagggagagagguaacaugaaucuggacagggagggagauacuauagaaaggagaacacugccuacuuugcaagccagugaccugccuuuugaggggacauuggacgggggccgggggcggggguuggguuugagcuacagucaugaacuuuuggcgucuacugauuccuccaacucuccaccccacaaaauaacggggaccaauauuuuuaacuuugccuauuuguuuuugggugaguuuccccccuccuuauucuguccugagaccacgggcaaagcucuucauuuugagagagaagaaaaacuguuuggaaccacaccaaugauauuuuucuuuguaauacuugaaauuuauuuuuuuauuauuuugauagcagaugugcuauuuauuuauuuaauauguauaaggagccuaaacaauagaaagcuguagagauuggguuucauuguuaauugguuugggagccuccuaugugugacuuaugacuucucuguguucuguguauuugucugaauuaaugaccugggauauaaagcuaugcuagcuuucaaacaggagaugccuuucagaaauuuguauauuuugcaguugccagaccaauaaaauaccugguugaaauacauggacgaa

SEQ ID NO: 58 - RNA, 3246 nt, Homo Sapiens
uggcagacguggagcggcgcgcaugcgcagcagcucacucugcugaagggcugagaggcgcacccgggcggccagcugggcucggagcggaacggggucaggauggacgaggacgugcuaaccacccugaagauccucaucaucggcgagaguggggugggcaaguccagcgccugccugguucccggccuuugccaggcccaaguucucugggucgcucucccuccuguagcgccgagaaaacaccauuccgagggccgccgcucggccggcagucggcugugaaagaacuggaucuugugacugcuggaaaauuucgcuuuaguguaagguccgagugcuucagccgugggccaccuuugaaaauaaaauguaauuguuauuucucauuuugccacauccuguggagacagaagauuaguguugugcuuucauuuuuuacuuuuuccuuggggaaaauaauauugacaguggaguugaguauaagccugcucuugagguucacagaugauacguuugauccagaacuugcagcaacaauagguguugacuuuaaggugaaaacaauuucaguggauggaaauaaggcuaaacuugcaauauggguuacuuugcaucagcagacugcaaacuuuuucuuaaagagccagauaggaaauaguccaauccugaagugggccauguggcaauacgauacugcuggucaagagagguuuagaacauuaacucccagcuauuauagaggugcacaggguguuauauuaguuuaugaugucacaagaagagauacauuuguuaaacuggauaauugguuaaaugaauuggaaacauacuguacaagaaaugacauaguaaacaugcuaguuggaaauaaaaucgauaaggaaaaucgugaagucgauagaaaugaaggccugaaauuugcacgaaagcauuccauguuauuuauagaggcaagugcaaaaaccugugaugguguacaaugugccuuugaagaacuuguugaaaagaucauucagaccccuggacugugggaaagugagaaccagaauaaaggagucaaacugucacacagggaagaaggccaaggaggaggagccuguggugguuauugcucuguguuauaaacucugggaaauuccaucucuugcauauuugaucagauagugacaucuuucuguauauaaacucuuuaacugcuauuuuagggaccuugcaguuugcacauaauuguuuuauaucauagcaguaaauauuugcaagaaaucccacucaucgaccccggguaaaauguuaugguaagcaugcacaguuugcagucuacaguuuuuuuauguagcacaaaauagguguaccuuuauaaguacauucaauuuuaugauuuacauuuaucauguaauuuuuaaaaaaauccaucuaucuaggauauguugauacaaagucugcuuuugcuauucuuuuugcuuaaauacuccuaucauuuucugaauuacuugguauuuagaacuccuagcaccacggggaagaauagagguaucaucaaacguggcaaauuuucuuucaggaauaauaaagagcaugauuccacagcuuuucugggauguuugagauucuuuuuuaguacuaagcaaaauucucaucacagaauguagcccaggccaauuuauaacuaaaucucuauuuguucagaugaugcuucuaaaacagcauugauagguuaaagaagcuugguauuuuuaauuuacuucaaugauuagcucaguugcuuaacuggaguuuuaauccugugauauguacauuggauucaugacugugcagcauuuuuaguuaugugguguuuggcagaaugacaauaagguuuucccccauuuugguuucaggaggacaugaauaguguguuuauuguaacuccucauacacuuuuaaaaccaacaucuuuuuucauaaauguugguaguguuuguccagguaccuuaacuguagcuuguguaauguugaugaauaucuguaucuuacggcuuccauaauggcuaguugauauucaaaaaccuauuucuguguuuugagggguggggaaaaaaaacacuaagugauaauuugaaaaaggcauauugcuuccagauucugaugugugagggaaaauacugucacaaugaaaaucuugacaauuuacuuaacaaguaaccaguaguucaucaaaaccaacuuguacagacuaauaaaucuuuuucacaguauucaguuuucucaccucuugcuauuguauauuguagauuuuuuucauucauguguuauuuaauuuacacugaucucugcuauuuuaaccccccaaauaaguuauuuguccuuuaagguugguuacuauaauaccccucaguaagauuccaguauuaauuucugggcaguuuguucucuguauacaauugcaaaugauaagcauuuuugugagugaccaccuuugcaauauguuuguuaauuuacuucauguuggguucuuucugaaauguacaucuuuacauauaaaaaccucacauucuacuugauuuacacuuccuagucuacauuacaugugguugaagguuuuauacauucuauaugcuuuuacuaaauauacaagauuuacuacuagaaauuuggagaaagaacacuaacacauguacuugugauuuguucauguuauauuaaaacuugagauuuguguauuuauguagagucuguauugacaagacuguuguuuuuugcuccuugagcuauauaauaaucuguguauuggauuguugucuugauuuggucuaaauuugaauauauaugaguuacuugaauauaacaaaaaugaauuuuguuugauagauuuauauuguaaccuuuuucuaguucuugaauaaauauagccugcuuucccuagaugcauuuguguaggaaguauauacauuucccuauuacucucaucagcugaagaauauguacuauuguguuacucaaauuauguggcuuucauuuuguuguuuuguugcaagcuuaguguuuuguaguggagguuuuguaaaugaaacaguuguaauaucuaaggucaggcaccuaguaacaggguuuuguuaauucuuuucagaaucauugaagcagucuuaaagggucuuuugcagaugguacaaauuagaacaauuagaauauaguauuuugaguucuaguaguacugagauugacccaaacaaauaaaaaacuauucaauuucugaguaauaguuaa

SEQ ID NO: 59 - RNA, 2676 nt, Homo Sapiens
aaacaaaagagucucgccggcguccccgcccgcacacucgcgcacacucgcgcucgggcgcacacggagcagggaccggcgcccggagcgagccagggagcggcuaaccggggacccaccgcgcggagccagccuagcugccagcgagcccaacccgcgacgacccacgccccugagccccgcagccgaccccugccggccgguguccccaccgccaucccugacccauggcgcugaagaggauucagaaaugucucaaaaaaaaaaaaaaagaauugagugaucuacagcgcgauccaccugcucacuguucagcuggaccugugggagaugacuuguuccacuggcaagccacuauuauggggccuccugauagcgcauaucaagguggagucuucuuucucacuguacauuuuccgacagauuauccuuuuaaaccaccaaagauugcuuucacaacaaaaauuuaccauccaaacauaaacaguaauggaaguauuugucucgauauucugaggucacaauggucaccagcucugacuguaucaaaaguuuuauuguccauauguucucuacuuugugauccuaauccagaugaccccuuaguaccagauauugcacaaaucuauaaaucagacaaagaaaaauacaacagacaugcaagagaauggacucagaaauaugcaauguaaaaaucaaaaacauuuucauauauaccagaguacuguaaaaucuagguuuuuuucaacauuagcaguaaauugagcacuguuuacuguuucauuguaccaugaaaccauuugauuuuuacccauuuuaaauguguuucugaagcaagacaaaacaaacuuccaaaaauacccuuaagacugugaugagagcauuuaucauuuuguaugcauugagaaagacauuuauuaugguuuuuaagauacuuggacaucugcaucuucagcuuacaagaucuacaaugcagcugaaaagcaaccaaauuauuuuuugcugaaacuagauguuuuuacaugagaaauacuguauguguugucuaagaugucaguuuuauaaaucuguauucagauuucauucuuuguuagcucacuuuauaauuuguauuuuuuuacuguauagacuaaauauauucuauuuacauguaugucaacucauuacuuuuuuccugugaacaguauugaaaaaccccaacggcugauaauuaagugaauuaacugugucucccuugucuuaggauauucuguagauugauugcagauuucuuaaaucugaaaugaucuuuacacuguaauucucagcauacugauuauggagaaacacuuguuuugauuuuguuauacuugacuuaacuuuauugcaaugugaauuaauugcacugcuaaguaggaagauguguaacuuuuauuuguugcuauucacauuugaauuuuuuccuguauaggcaauauuauauugacaccuuuuacagaucuuacuguagcuuuuuccauauaaauaaaaugcuuuuucuacuauuugucuugauuacuuaaaaaaauaaaaauauaaguaaggaucaaaacucuaaaauuuugcaugaaaauuacauccaaauugugaaaaucagaucuauuuuguuugccauuagucaccauuaguuauauaaauuuuauuguuuuagguuaguaucucuuuacuaaauugucagucuauaagauaauauauguugaucccuugcuguagaggagaauuuagaguaauuugggguuugucuuggauuauaucuaaauggauuauuuguuaaaaguacugaaaugaguauaaggcaguaucacccauccaaaagaaaggucuuuauagaccugcacagucacuagauuaauucauuaaaaugcccccacccugauguaauugacauuacauuucuuaacauuuuaaaaucuagaauuucuaaaauggaauuuaaugccaucacaauuugaaaaacuuuuuuuuuuuuuuuacuauagaaguuacaaaggaaguucuaaaauuaugccucccucuguuuuuauaaguugccaucgaaaagugauuuaaauaagcagguuaucuuuauagauuuuaaagaaaacuagaaaguuuuaauguuuuaacuuggggaaaaauacaucucuuuaauguuuagcaugcuugucaaccuugagugagugucauuuuuaagaacaguuguagcccuucugauuauugcaguagcuguagaaguauguaagaauaugugauggguguagucauuagcaaagcauuuaaaucacuugaguauuuugucaugguucauuauuauuaaagcacaaaauaaccuauuguuagaaaauauguguuuuuauaaaugaauguaaaauaauuaaaugaauugugaaauggauguuuaagaaaauauaggcuuaaaaaguaaaucuauaaaaugaugucuuaaaacagccauaucaugaaaaauucuacuuagcuauauuauuauaagcuacauuugcccugaauuugaacacucaacaucacuagauuuaaauauuuaguauauuuugauaguaaaggguuuuguuucuugaauaucuucacuuuaaacaaaaaaaaaaaacaacuuucauuuguguggcauuuauuuuuggaagugucuucuuuuuuuucuuuauuaaaguuuuugaaacuugc

SEQ ID NO: 60 - RNA, 1166 nt, Homo Sapiens
gagguaaauguauccauagaccacagugccuugcuuuuuccucugccagcacauggagcacgggauuagaugcacaaaccuauuuagggaacuauuuugguagauguuugaguuuauacagaaauugcagcugguauuuuauuuugcuguacauuuacucaacuuguccauuaguauuuaacuauuuccagaguuuguuuaggaguaagaauugacccauucguuaguuuaccauauuuuuuccugguauaaaaaggagccagaaauaagccuuauugcuaaauaauuaauuauguaagcccaccuagguccugcauaagaucccccucacauacuucacaauauauauguguguguguguguguguguguguguguguguguguguguguauuuggcuaaaaaauuauacugccaaaauuacugauuauaaauacuugacuacacugauugaugggacaaaaugauuaaaguauuuucagggaucuuauuccauaugucaccaccaaagauuucuacaguguuauaaaguauauaaauauuccaaauuucugugguuaaauauuuuuuucuuuuuuuuccuuuuuuagaauaacacagucugugcuuuccaaaaaugcuugaacuuuuauguuguuaagaaauauauaaugauaucuuacauuaagcaugagucuaauuuguauuaauugggauggacuaaauuuucauuugauuaucaggaaaauuaaggaguuauauauuuaaaagcaauuuucuguguuuucuucuuuguaaguugacucauuugugaagcaauuaggcaaauuuugagaagaucauuguuauugugguuugcaguauauauuucuuaguaaauaucacuuaagauuaaauuuuucagaaagaaaauuauagcuuuuuucccaaaauauuuuuaagauuuaaucuuuuuguaguaugcuacagauuuaauuauauuaacucuuuuuuaagacauugaccaugacuuaacauuuugccuucuaacaccuuuuaaaucuauguacuuuaauaguuaagagaaaauaaguuugcagauuuuuaauaaucuguuuguaaaaggcuaucucuaagccuaguauguggguaauuuuacagguguguuuuuugauaacuuuaauauaaaauaaacucauuuuauuugug

SEQ ID NO: 61 - RNA, 4711 nt, Homo Sapiens
gggaagugacgagagccggguggacccaggguggggaacuaccucuuccucuccacgcgguugagaagaccggucggccugggcaaccugcgcugaagaugccgggaaaacuccguagugacgcugguuuggaaucagacaccgcaaugaaaaaaggggagacacugcgaaagcaaaccgaggagaaagagaaaaaagagaagccaaaaucugauaagacugaagagauagcagaagaggaagaaacuguuuuccccaaagcuaaacaaguuaaaaagaaagcagagccuucugaaguugacaugaauucuccuaaauccaaaaaggcaaaaaagaaagaggagccaucucaaaaugacauuucuccuaaaaccaaaaguuugagaaagaaaaaggagcccauugaaaagaaagugguuucuucuaaaaccaaaaaagugacaaaaaaugaggagccuucugaggaagaaauagaugcuccuaagcccaagaagaugaagaaagaaaaggaaaugaauggagaaacuagagagaaaagccccaaacugaagaauggauuuccucauccugaaccggacuguaaccccagugaagcugccagugaagaaaguaacagugagauagagcaggaaauaccuguggaacaaaaagaaggcgcuuucucuaauuuucccauaucugaagaaacuauuaaacuucucaaaggccgaggagugaccuuccuauuuccuauacaagcaaagacauuccaucauguuuacagcgggaaggacuuaauugcacaggcacggacaggaacugggaagacauucuccuuugccaucccuuugauugagaaacuucauggggaacugcaagacaggaagagaggccgugccccucagguacugguucuugcaccuacaagagaguuggcaaaucaaguaagcaaagacuucagugacaucacaaaaaagcugucaguggcuuguuuuuaugguggaacucccuauggaggucaauuugaacgcaugaggaaugggauugauauccugguuggaacaccaggucguaucaaagaccacauacagaauggcaaacuagaucucaccaaacuuaagcauguuguccuggaugaaguggaccagauguuggauaugggauuugcugaucaaguggaagagauuuuaaguguggcauacaagaaagauucugaagacaauccccaaacauugcuuuuuucugcaacuugcccucauuggguauuuaauguugccaagaaauacaugaaaucuacauaugaacagguggaccugauugguaaaaagacucagaaaacggcaauaacuguggagcaucuggcuauuaagugccacuggacucagagggcagcaguuauuggggaugucauccgaguauauaguggucaucaaggacgcacuaucaucuuuugugaaaccaagaaagaagcccaggagcugucccagaauucagcuauaaagcaggaugcucaguccuugcauggagacauuccacagaagcaaagggaaaucacccugaaagguuuuagaaaugguaguuuuggaguuuugguggcaaccaauguugcugcacguggguuagacaucccugagguugauuugguuauacaaagcucuccaccaaaggauguagaguccuacauucaucgauccgggcggacaggcagagcuggaaggacgggggugugcaucugcuuuuaucagcacaaggaagaauaucaguuaguacaaguggagcaaaaagcgggaauuaaguucaaacgaauagguguuccuucugcaacagaaauaauaaaagcuuccagcaaagaugccaucaggcuuuuggauuccgugccucccacugccauuagucacuucaaacaaucagcugagaagcugauagaggagaagggagcuguggaagcucuggcagcagcacuggcccauauuucaggugccacguccguagaccagcgcuccuugaucaacucaaauguggguuuugugaccaugaucuugcagugcucaauugaaaugccaaauauuaguuaugcuuggaaagaacuuaaagagcagcugggcgaggagauugauuccaaagugaagggaaugguuuuucucaaaggaaagcuggguguuugcuuugauguaccuaccgcaucaguaacagaaauacaggagaaauggcaugauucacgacgcuggcagcucucuguggccacagagcaaccagaacuggaaggaccacgggaaggauauggaggcuucaggggacagcgggaaggcagucgaggcuucaggggacagcgggacggaaacagaagauucagaggacagcgggaaggcaguagaggcccgagaggacagcgaucaggagguggcaacaaaaguaacagaucccaaaacaaaggccagaagcggaguuucaguaaagcauuuggucaauaauuagaaauagaagauuuauauagcaaaaagagaaugauguuuggcaauauagaacugaacauuauuuuucaugcaaaguuaaaagcacauugugccuccuuuugaccacuugccaagucccugucucuuucagacacagacaagcuucauuuaaauuauuucaucugaucauuaucauuuauaacuuuauuguuacuucuucaucaguuuuuccuuuugaaagguguaugaauucauuacauuuuuauucuaauguauuaucuguagauuagaagauaaaaucaagcauguaucugccuauacuuugugaguucaccugucuuuauacucaaaagugucccuuaauaguguccuucccugaaauaaauaccuaagggaguguaacagucucuggaggaccacuuugagccuuuggaaguuaagguuuccucagccaccugccgaacaguuucucaugugguccuauuauuugucuacugagacuuaauacugagcaauguuuugaaacaagauuucaaacuaaucuggguuguaauacaguuuauaccaguguaugcucuagacuuggaagauguaguauguuugauguggauuaccuauacuuauguucguuuugauacauuuuuagcuucucauuauaaggugauucaugcuuuagugaauucuucauagauaguauauauaaaaguacauuuuaauagaaagccaggguuuuaaggaauuucacauguauaagguggcuccauagcuuuauuuguaaguaggcuggauaaauggugcuuaaaugguaauguacuccacuucuuccuauuggaagauuaacauuauuuaccaagaaggacuuaagggaguagggggcgcagauuagcauugcucaagaguauguaaaaaaaaaaaaaaaaaaaaagaaccaaaccacuggaaauaaucaaaugcaaaaagguaacaaauucauaacuggaaagcaaagagaagaacaaguaugauuuggaugauaaagcauuguuuuaauggugaaaacuucacagaucacuaauguuucuagagguuaacuucaagugggcaagcugggguuuuuagguagucaguggccuaguuccuaaagccacaguauaggaucuguuaaacugaaugucuguugaaaguuuguuuuagcugcuuggaggcuuccuuuuaagacaaacuguaugugauuaaguuguuuugagggaacugaagaaccugauguagccccuggccagauaacugccugauuucucagauauuauuucucugggaaacauucuacauagcacaggagcuuaagaguggcauuaucuucucgccuuaauuuccagagauuauuucuguacugagaauccuggaacuacuaugcuaggaaauuuaaagcugcauggucugucuuguuuucauuuaauuauugugaauaccuagaaucuuucuugguccugauuucucuugcuuaauccagucuuuaucucuaacugccccuuauuugaucaccauguacuaggagcucugauagccagcucagcuccuaauccuugaggcaacauucuuuuucuauuugaacuucaguucuguccuugaaucccgacuagauauuucuugcccucuggucucagaauucucuuggcuuuuauuccuugauccacuugccaguuuuaucacuuuacccuuguuccucauggcuucccaucaagccauggguauuaggugacaguguaauuuauuagauucugguuuugcccaaauacugggcaugcuuuaauaauaacugaaccauuucauuauuuggauaggcauggguaccuuaucaagcagauuaaaaggauaugguacccguccuuuagaaaagaacagcuaaaaccuuguuguggauuauggauuuagccuaaagaaaaauaaucuggcauaaauuaagaguaagagagaagauuaauagaaauuucacuucacauaacuuaaaacauggcuauuucaauaaaggacuaaaguuucuccuggaucccagaauucaaccuguauuuauaaauguauaauguauuuagcuacuuuuugguuuaaaugaacuuguuggguuagcuugguaaauguuauaauuuuuacuauuuucuacaaagaaaauauuuucuaauuuaaguuggagcuaucugugcagcaguuucucuacaguugugcauaaauguuuuuacuauaaaaugagcuaauguauaaaauacugcuguauaccauaauaaagauaguaauacuugauuuua

SEQ ID NO: 62 - RNA, 2828 nt, Homo Sapiens
gguagggccccgccucccgaagcaguuccgguucggcuccgagcagcugccggcgcggcggugacggcggccgggacgaugccugcgcgcagucgccaccgcccccgccuccacuccggcuccccgccccgggcuccgcccccgccgcuugaggcgcuucacuccggcgaggcggggagggccccggacuccgacggcggcucggacgccgacucggagguggguccggggagcccgacucggaccgcggaggugagcgggagcugaggcugaggagaggggagcuuggggggcgccugcugccaagggcagcggaggaggaaauggcagguccuaaucaacucugcauucgccgcuggacuaccaagcauguagcuguguggcugaaggaugaaggcuuuuuugaauauguggacauuuuaugcaauaagcaccgacuugauggaaucacauugcuaacauugacugaauaugaucuccggucuccuccucuggaaaucaaagucuuaggggacauuaaaagguuaaugcucucaguccgaaaauugcagaaaauacauauugauguuuuagaagagaugggcuacaacagugacagucccauggguuccaugaccccuuucaucagugcucuucagaguacagacuggcucuguaauggggagcuuucccaugacugugacggacccauaacugacuugaauucugaucaguaccaguacaugaaugguaaaaacaaacauucuguucgaagauuggacccagaauacuggaagacuauacugaguuguauauauguuuuuauaguauuuggauuuacaucuuucauuaugguuauaguccaugagcgagugccugacaugcagaccuauccaccacucccagauauauucuuagacagcguuccuagaaucccaugggccuuugccaugacggaaguauguggcaugauucugugcuauauuuggcuccugguucuucuucuucacaagcacaggucaauacuucugcgaaggcucuguagucugaugggaacuguauucuugcuucgcugcuuuaccauguuugugaccucccucuccgugccaggacaacaccugcaguguacuggaaagauauauggcaguguaugggagaaauuacaucgagccuuugccauuuggaguggcuuugguaugacccugacuggcguucacacauguggagauuacauguuuaguggccacacagucguccuaacuaugcugaauuucuuugucaccgaauguaaguaucuuuuuagugcuucuaugcguauuagguaacuagcugcagugaaggcugugggaagggugucagauccugugaagaauggcaaaacagccugaccugagaaacgugacugagaagcauuggaaggaauguagcuuuaaaaugaucuuucuguccuuuuccuagauacaccaagaagcuggaauuucuugcacacuuuauccuggguucucaaccucuuuggaaucuucuucaucuuggcugcccaugaacauuauucuauugauguguuuauugcuuuuuauauaacaacaagacucuuuuuguacuaccauacucuggccaauaccagagcauaucagcagaguaggagagcaaggauuugguuucccauguucucuuuuuuugaaugcaauguuaauggcacaguaccuaaugaauauuguuggccauuuucaaaaccagcaauaaugaaaagacuaauuggaugaauacuaucuuucuaaugaauuugugauuaaauauauaauaguuguugaaaaugaguaacuuugcguucucccccuagguuguucuuagaugccuggcuuauguguugacaaaguaaaguuuucuguucugagcaaaguuaugauuauaaaaagcaagaaagaacaaucaagaguccuuauguagcuauuugaacagaaagcuuaaguagauguuuucugccccuucucuuuaggaagacuuaauguugugauugaagucaggcuguacccuuaccuguugaguauuugcuuauugaacuuuaaacaagucaacuugagcaguuugcugguugaggaauuuucauugauuuccaguagggcucuagucaagaaauaauauguuuugaagcuccuuauuaccuuuagaagaagaaacccuaacaagugacaguacuuguucuuuggacuaaucuuuguuucauuuuaaaaaaugcaacccugggacaugaucuguuuuacugacaaagaguuuuugccuucugaaccaucuuuaaauauacugagcauaccaggaugccugaaauaagaagagaaugaaagaggccauagaugacgugacagaguacuggcuaggaugccauuggucuccucauuaaugcaaauguagggcuggcauauuucaccaaagaugcaacaaaagaugcagugccagugugacccucagugaguauucaugagggaaaaauggcugcauccauaaaaauaaaugggcuuaauguuagugguauagguacccagaauaacuucuuugugcuauaguuguuagaugacaguucaauuuuaugcuuuuuuaaugguguuauuaaaugagccaaauaggaguguuuuaccagauguuagauaaaguucuuaaugccguuaaguagggagguaugcaugcaaagaauuguuuucuccugaaaagaaacuuacagcacgcaaaauauaacuuuuugguuuuugaaauuuaucauucuuggcuguuggaaguaaacagucucagacauacuuggauaugaaaaaguuucguuguuuuuuacuuuuaaauauaaugguguauauacauuc

SEQ ID NO: 63 - RNA, 2415 nt, Homo Sapiens
aucugcagcuggcucggcgcacuccacugaccgucccgacgaugcuacgcgcgcccggcugccuccuccggaccuccguagcgccugccgcggcccuggcugcggcgcugcucucgucgcuugcgcgcugcucucuucuagagccgagggacccgguggccucgucgcucagccccuauuucggcaccaagacucgcuacgaggaugucaaccccgugcuauugucgggccccgaggcuccguggcgggacccugagcugcuggaggggaccugcaccccggugcagcuggucgcccucauucgccacggcacccgcuaccccacggucaaacagauccgcaagcugaggcagcugcacggguugcugcaggcccgcggguccagggauggcggggcuaguaguaccggcagccgcgaccugggugcagcgcuggccgacuggccuuugugguacgcggacuggauggacgggcagcuaguagagaagggacggcaggauaugcgacagcuggcgcugcgucuggccucgcucuucccggcccuuuucagccgugagaacuacggccgccugcggcucaucaccaguuccaagcaccgcugcauggauagcagcgccgccuuccugcaggggcuguggcagcacuaccacccuggcuugccgccgccggacgucgcagauauggaguuuggaccuccaacaguuaaugauaaacuaaugagauuuuuugaucacugugagaaguuuuuaacugaaguagaaaaaaaugcuacagcucuuuaucacguggaagccuucaaaacuggaccagaaaugcagaacauuuuaaaaaaaguugcagcuacuuugcaagugccaguaaaugauuuaaaugcagauuuaauucaaguagccuuuuucaccuguucauuugaccuggcaauuaaagguguuaaaucuccuuggugugauguuuuugacauagaugaugcaaagguauuagaauauuuaaaugaucugaaacaauauuggaaaagaggauauggguauacuauuaacagucgauccagcugcaccuuguuucaggauaucuuucagcacuuggacaaagcaguugaacagaaacaaaggucucagccaauuucuucuccagucauccuccaguuuggucaugcagagacucuucuuccacugcuuucucucaugggcuacuucaaagacaaggaaccccuaacagcguacaauuacaaaaaacaaaugcaucggaaguuccgaaguggucucauuguaccuuaugccucgaaccugauauuugugcuuuaccacugugaaaaugcuaagacuccuaaagaacaauuccgagugcagauguuauuaaaugaaaagguguuaccuuuggcuuacucacaagaaacuguuucauuuuaugaagaucugaagaaccacuacaaggacauccuucagaguugucaaaccagugaagaaugugaauuagcaagggcuaacaguacaucugaugaacuaugaguaacugaagaacauuuuuaauucuuuaggaaucugcaaugagugauuacaugcuuguaauagguaggcaauuccuugauuacaggaagcuuuuauauuacuugaguauuucugucuuuucacagaaaaacauuggguuucucucuggguuuggacaugaaauguaagaaaagauuuuucacuggagcagcucucuuaaggagaaacaaaucuauuuagagaaacagcuggcccugcaaauguuuacagaaaugaaauucuuccuacuuauauaagaaaucucacacugagauagaauugugauuucauaauaacacuugaaaagugcuggaguaacaaaauaucucaguuggaccauccuuaacuugauugaacugucuaggaacuuuacagauuguucugcaguucucucuucuuuuccucagguaggacagcucuagcauuuucuuaaucaggaauauugugguaagcugggaguaucacucuggaagaaaguaacaucuccagaugagaauuugaaacaagaaacagaguguuguaaaaggacaccuucacugaagcaagucggaaaguacaaugaaaauaaauauuuuugguauuuauuuaugaaauauuugaacauuuuuucaauaauuccuuuuuacuucuaggaagucucaaaagaccaucuuaaauuauuauauguuuggacaauuagcaacaagucagauaguuagaaucgaaguuuuucaaauccauugcuuagcuaacuuuuucauucugucacuuggcuucgauuuuuauauuuuccuauuauaugaaauguaucuuuugguuguuugauuuuucuuucuuucuuuguaaauaguucugaguucugucaaaugccgugaaaguauuugcuauaauaaagaaaauucuugugacuuua

SEQ ID NO: 64 - RNA, 1974 nt, Homo Sapiens
agaacucuguggaugaaccuugaaggagccuccaagccugaaccaaagcacuacagaucaccugcuaucuucauagcaccaugagagugaagaaucugauggaaagcuuauugaagacagccugauucagcugagaugucacuuuacauggaaguuguuaauugaagccccugaaauuccugauuuagaaaacaggaucugggaagagauucaguuccuggacaccaaauacaaugugggaauacacaaccuacuagccuaugugaaacaccugaaaggccagaaugaggaagcccuggucagcuugaaaaaggcugaagacuuaauucagaaagaacaugccaaccaagcagauauuagaagucuggugaccuggggcaacuuugccuggguguauuaccacaugggcagauuggcagaagcccagacuuaccuggacaagguggagaacacuugcaagaaguuugcaaauccuucccgcuauagaauggaguguccagagguggacugugaggaaggaugggccuuggcgaagugugguggaaagaauuaugaacgggccaagaccugcuuugaaaaggcucuggaagggaacccugaaaacccugaauucaauacuggguacgcaaucaccgucuaucgccuggauaaauuuaacacagcaucagggaggaauaaggcauuuucucugcacguccuaaaacgagcugucaggcuaaauccagaugauguauauauuaggguucuccuugcccugaagcuucaggaugaaggacaggaagcugaaggagaaaaguacauugaagaagcucugaccaguauaucuucacaggccuaugucuuucaauaugcagccaaguuuuaucgaagaaaagggucuguggauaaagcucuugagcucuuaaaaauggccuuggagacaacacccacuucugccuuccugcaucaccaaauggggcuuugcuacagggcacaaaugauccaaaucaaggaagcuacaaacuggcagccuagagggcaagauagggaaacuguggacagauugguucaauuggcuauaugcaaauuugaaaagacuauaauguuaaagcgaacauuugagauggccuauguugaccuggcugaaacguaugcagaaauaggccaccacagaaaggcugaggaacauuuucagaaaggguuacgcaugaagaucuuugaagaucagcuaaagcaagagauucauuaccacuacggccguuuccaagaacaucaugggaaaucucaagauaaagcaauuacccauuauuuaaaagguuugaaaauagaaaaaaugucccauuccagggaaaaacuucucaaugcuuuagagaaauuggcuaaaagauguauucaccagaauguacggguuguggaaagugucagccuccuugggcuuauccacaaauugaaaggagaaguaagugaugcuuugcugugcuaugagagggcucugaggcuggcugcugaccugaacccuauauuuuaacauagaggucaccauuauccauuuaauggucuuauaacuaaauagaaugacuaugaaauuaaauaaugcaaacuuaaagcuguuggaaauuuaccuuauuuugagccuugagaggaauguggcuguguggccugaguuauguagcaugcaacugcaacuucugcuuuuuccuguaaaugaucaggaaaggccuuguggcaccagacauaagacccccugaaaguaucaucccuccugauggaaugguaaagcaaucuuucuuggaacauagcaaguaguaaccgaucaaauugcuauaacguguguacugaccuuauguggaaaaugcugcaacccuguuuacugccuauguaagugaaaucuuaacuuccccauuuuggaaugcugacuccagucauuaggugucuguauuuccugagugguuacccucaagcuuugugcucaaauaaacucuauacuuaaucaua

SEQ ID NO: 65 - RNA, 7040 nt, Homo Sapiens
ccgcggccugggccugcgccgcucagcucucuggaaacuagcgccucagcugcgcggcgcguaggucgcggggagcuccgaaccgccggcgcccggccauggcggucuccaggcuagaucgccuuuuuauuuuacuggauacuggcacuacuccuguuacaagaaaagcugcugcacagcaacuuggagaaguggugaagcuucauccccaugaacuaaauaaucuccugucuaaaguguugauauauuuaaggagugcaaauugggauacccggauugcagcaggacaagcuguugaagcuauagugaaaaauguaccugaguggaauccagugccgagaaccagacaagaaccuacuuccgaaaguucuauggaagauucaccuacuacagagcgauugaauuuugacagauuugauauauguagauuguuacaacauggugcaucacuccugggaucugcuggugccgaauuugaaguccaagaugaaaaaucaggugaaguggauccuaaagagaggauagcacgccaacgaaaauuauuacagaagaaacuuggccuuaauaugggagaagcaauuggaaugaguacugaagaacuuuucaaugaugaggauuuggauuauaccccaacuucagcauccuuuguuaacaaacaaccuacucuucaggcagcugaauugauugacucagaguuucgagcaggaaugagcaauagacaaaagaacaaagcuaaaagaauggccaaguuauuugcaaaacagagauccagggaugcaguggaaacuaaugagaagagcaaugauagcacugauggggagccagaagaaaagagacggaaaauagcaaauguuguuauuaaucagucugcaaaugauuccaaagucuugauugauaauauuccagacagcucuuccuuaauugaagagacaaaugaauggccuuuggaaagcuuuugugaagaacuuugcaaugaccuuuuuaaucccuccugggagguucgacauggugcaggcacuggacuuagggaaauucuuaaagcucaugggaaaaguggugguaaaaugggugacagcacuuuagaagagaugauucagcagcaucaagagugguuggaagacuugguuauuagacuccuuuguguuuuugcauuagacagauuuggagacuuuguuucugaugaaguuguggcaccaguucgugaaacuugugcucaaacauuaggugugguuuuaaaacacaugaacgaaacaggaguucauaagacuguggaugugcugcuaaaauuacuuacacaagaacaaugggaaguuagacaugguggucugcugggaauaaaauaugcuuuggcaguccgucaggauguaauuaauacuuuauugccuaaaguuuuaacuagaauaauugaaggacuccaggaucuugaugaugaugucagagcuguugcugcagcaucauuagugccuguaguagaaagccuugucuaucuucagacacaaaaggugcccuucauuauaaauacauugugggaugcucuucuggaauuagaugaucuaacagcuucaacaaauaguauuaugacucuccuuucauccuuguuaacuuacccucagguccaacaaugcaguauucagcagucacugacaguuuuaguuccacgugucuggccuuuuuugcaucacacuauaucaucaguucgaagagcagcauuggaaacucuguuuacguuauuaucaacacaggaccagaacucuucaucuuggcuuauaccuauacugccugauaugcuccgacacauuuuucaguucuguguuuuggaaagcagccaggaaauucuggaccuuauucacaagguuuggauggaacuguugaguaaggcuucaguucaguaugugguagcagcugcuugcccauggaugggugcuuggcuuugcuugaugaugcagccuucucauuuaccuaucgauuuaaauauguugcuagaaguaaaagcuagagccaaggaaaaaacaggugguaaggugcgccaaggccaaagccagaauaaagaaguacuucaggaguauauugcaggugccgacaccaucauggaagacccagccaccagggauuuuguaguuaugcgggccagaaugauggcagccaaguuguuaggagcacuuuguugcuguauuugugauccagguguaaaugugguaacucaagaaauuaaaccagcugaaucccugggccaguuacuacucuuccauuugaacuccaagucugcuuuacagaggauuaguguagcuuugguaaucugugaaugggcugcuuuacaaaaggaguguaaagcuguuaccuuagcugugcagccgcguuuacuugauauccuuucagaacauuuauauuaugacgaaauugccguuccauucacacgaaugcagaaugaauguaaacaacuuauaucaucauuagcugauguacauauugaaguugguaaucgaguaaacaacaauguuuuaacaauagaucaagcuagugacuuggucacuacuguuuuuaaugaagccacaucaucuuucgauuuaaauccucaaguguuacaacaguuagauaguaaacgacagcagguccaaaugacaguuacagagaccaaccaggaguggcaaguguugcaguugagagugcauacuuuugcugccugugcaguugugagcuugcagcagcuuccggagaaauuaaauccuaucauaaaaccauuaauggagacaauuaaaaaagaagagaauacacuagugcaaaacuaugcagcucagugcauagcuaaacuccuucagcagugcacaacaaggacgcccugucccaauucaaaaauuauuaaaaaccucuguagcucacuuuguguggacccauaucuaacuccuugugucacauguccaguaccaacacaaaguggccaggaaaauucuaaaggauccaccucagaaaaagauggaaugcaccauacugucaccaagcacagagguauaauuacacucuacaggcaccagaaagcugccuuugcuaucacaaguaggcgagguccuacccccaaagcaguaaaagcucaaauagcagaucuuccugcaggaaguaguggaaauauucuuguugaacuugaugaggcccagaagccuuaccugguacaacggagaggagcugaauuugcuuugacaacuauaguaaagcauuuugguggugaaauggcagugaaguugccacaucucugggaugcuaugguuggcccauugaggaauacaaucgacauaaauaauuuugauggaaaaucccuccuggauaagggagauagcccugcucaagaauuggugaauucucugcagguuuuugaaacagcagcagcuucaauggauucugagcuucaucccuuguugguccagcauuugccacaucuuuauaugugccuucaauaccccaguacugcagugaggcacauggcugcucguuguguaggugucaugagcaaaauagcuaccauggaaacaaugaauauuuuuuuggagaagguucuuccguggcugggagcaauugaugacagugucaaacaagagggugcaauugaagcacuugccuguguaauggaacaacuagauguugguauuguuccauauauuguccuuuuaguuguuccuguauuaggaagaaugagugaucagacagacagugugagauucauggccacgcagugcuuugcaacgcuaauuagacucaugccacuugaggcaggcauuccagacccuccaaacaugucagcagaauuaauccaauugaaagccaaggagcgacacuuuuuggagcaauuguuagaugggaaaaaauuggaaaauuauaaaauuccaguaccaaucaaugcugaacucagaaaauaucagcaggauggugugaacugguuagcauuucuuaauaaguauaaacuucauggaauucugugugaugacauggguuuaggaaaaacuuuacaguccaucugcauucuagcaggagaucauugucauagggcccaggaauaugcaagaucaaaauuagcagaauguaugccacuuccuuccuuagugguuuguccgccaacauuaacaggccauuggguggaugaaguagguaaauuuugcucuagagaauaucucaacccguugcauuacacuggaccucccacugaaagaauaagguuacagcaccaaguaaaaaggcacaaucuaauaguggcuucauaugauguugugaggaaugacauagauuucuuuagaaauauuaaauuuaacuacugcauucuugaugaaggccaugucaucaaaaauggaaaaacaaaguugucaaaagcaguaaaacaacugacugcuaauuauaggauuauucuuucuggaacaccaauccagaacaacguuuuggagcuguggucauuauuugauuuccucaugccaggauuuuuggguacugaacgccaguuugcugcucgauaugguaaaccuauauuagcaaguagggaugcucgaagcuccagucgagagcaagaagcagguguucuugcuauggaugcgcugcaccgccaaguacuaccguuucuuuugagaagaaugaaagaagauguuuugcaggaucuuccaccuaaaauuauucaagacuauuauuguacucuuaguccucuccagguucagcucuaugaagauuuugcuaagucucgugccaagugugauguugaugaaacaguuucuucagcuacacuuucugaagaaacugaaaaaccaaagcuuaaagcuacaggccacguauuccaggcauuacaguacuuacguaaacugugcaaccauccagcauuagucuuaacaccucaacauccagaauucaagaccacugccgaaaaacuggcaguucagaauucuucucuacaugauauucaacaugccccuaagcucucagcuuugaaacaauugcuguuggacugcgguuugggaaauggcagcacuuccgagaguggcacagagucuguuguggcccagcacaggauacugauauucugucagcugaaaagcaugcuugauauaguagagcaugaucuccucaaaccucacuugcccucugucacuuauuugagauuagauggcagcauaccuccuggucagaggcauuccauuguuucccgguuuaauaaugauccaucuauagacguucuguuacuuaccacucacguugguggccugggacuuaauuugacaggcgcugacacaguaguauuuguggagcaugacuggaauccuaugcgagaucuacaagccauggaccgggcccaucgcauugggcagaaacgugugguuaacguauaccgauugauaaccagaggaacauuggaagaaaaaauaaugggguugcagaaauucaagaugaacauagcgaauacuguuauuagccaagagaauucuaguuugcagagcauggggacugaucagcuucuugaucuguuuacucuugauaaggauggcaaagcagaaaaagcugacaccucuacuucugggaaagcaaguaugaaaucaauucuugaaaaccugagugaucuuugggaucaagagcaguaugauucagaguacagccuggaaaauuuuaugcauucucucaaguaacuaucaaauauuguaaaugcaauugcugcuaguucaguuacauuucugcugauauucagcaaauuucuaaguuuauggugaacuuuuaacucaauguguaaauagaucuggagaauauucagcauaaugcuggcucuuguuucacugggggaaacaaguuauucucaaauauuugcacuguauuaaauuuaaauguuaaugugaaaugguuuaaauuuuacaugcugaaaagcugcagagcagaggaaccaaaccagguuuauuugugcuaccaggagguguucuuaaugggaacaggccuccuaucuuuagucacuuuguacaggaugauauccaugaguacuuuaguguuuguauauguuuuuucuuuuaaauagaacuuguuuuuauaauugauuuaaaauagggcuuuuuuucuauaaaagccuuaaugagccauaauuuuaagaauauaagaauaaugacuaugauauuggucagucuuagaacaugaaaaugucagacaaugaauuuaaucgggcccuugguggaaacauuuauauauuuaaugcagaugcauaguguuuuucaaaucuuuaacaucauuuuuucaacuuuuaagauauaauaucaacuauucuaaauacagguaaugguauauuuaaggcuaccauaacauccuauuuagagggugguuuuuuuuaauuuaucuaauggcuacgauauagccagauucaaauaacauauguacucaauagguuucaaucauauauauaauauauuuuuuguaacuaugaacauacacaguuuuccagaaauagauuuuacacuguuuagaauuccaacaccuacaguggaaagacuguuuauuguaguaaugcauggcugaagcauaaaagggagagagaauuucuuuauauacacaaacauacaugaauaugcauaucuauaugcauagauguaccuauccugcacccaaaaaggugccugguauuggcacuaaaaucauguaguuauacugggcagcaauaauaauugggcaugaggcugauuacucaauggugaggguagguauauguagauagaugugcauguauguguuuguauauauaauuuuauaaguuucacgcauaaauuaauacaugccugugugcauacauauguaugggauauauuuguauauauauguacagguaauaaacauccccaagguuuguggcuggccauacacauaggcaucaguuuaacaaccaucagaccucagcuguacaauaacagguguuuuguuuaauuaaaauuauacuguucugcagcauuuagacauuugucacauuucauuagcuuugacaaccauacuguaacauuaaaccuagcauuccacaagagaauaaauauaagauugaaacuguaaaa

SEQ ID NO: 66 - RNA, 8838 nt, Homo Sapiens
cagcuggaaaauuaggggccugucgagcgauguuggaagaagaaacagaucaaaccuaugagaauguccuggcugagauucagucuuucgaacugccuguugaagcuacuuuaaggucguucccgcggcgccgcgccucgcuggcuccucagcuuccagccaaaauggcggagaacagcgagagucugggcaccguccccgagcacgagcggaucuugcaggagaucgagagcaccgacaccgccuguguggggcccacccuccggucuguguaugaugaccaaccaaaugcgcacaagaaguuuauggaaaaguuagaugcuuguauccguaaucaugacaaggaaauugaaaagauguguaauuuucaucaucaggguuuuguagaugcuauuacagaacuccuuaaaguaaggacugaugcagaaaaacugaaggugcaaguuacugauaccaaccgaagguuucaagaugcuggaaaagaggugauaguccacacagaagauaucauucgauguagaauucagcagagaaauauuacaacuguaguagaaaaauugcaguuaugccuuccugugcuagaaauguacaguaagcugaaagaacagaugagugccaaaaggugaguugguuuuuuuccuauuguuuuaaauaagaauuuuuuucuauuauugaaaggacagauacauuuacuauaaaucauagugaaucaugaguuuugcuuucuucauuacacuaaccuuuguacuuaaaauuugcgcaucaggauaauccacuaaagcaaaucuuagccuuuuauuaauaaaucauuguccuuuauaaaugauaucaaggauugguaauguugaucaaguacaaauagccgaacaggaaugaaaauauugauuagcuuaccaacauacuaauauugcauguaacuaagggcuaagugcauauuguggaaggaaaagaguguaggcaguuauauuuugacagucugggugaauguaguaguucacauucuguuuuauaacucaaaugcauauaugacaguugaaaaagaaaguaauuuaaaguaguuuauugauugccauaggagcauuggauauagugauguuuaaaauauuuuaaagacgaacaguuuuggccaggugucauggcucaugcuuguaaucccggcacuuugggagucugaggcaaggggaucacuugaacccaggaguuugagaccagcgugggcaauauagggagaccucauuucaccuccccacccccuuccccccaaaaaacaaaagaaaaaaaacaaaugauucaaaaguaacauagaaaaaccagaauaaauuagacaauuuggacuagggaaaaaaugauuucuucuugguuaguaacuacuuaauuaucagaacacaucuuauacagaccuauaguaaaagauguguguauguccugcuucauugugcuacauguugaauuucauuaggcuuuaccaguuaauacaauuuaguagaaugauuuuuucccuguaauaaacaagccaaaaacuauucugaaagucuuauuuucuuucacguauguauuaauaauauauucucuuuuuaaaucaauguuauauauccucacauuuuaaagauucaaauaauuuuccuacgcguuugcugccaaaaaaaaaaaaaacagauaucaccuuuccuauuucccauucaccauuccuucuuuauaggagcaaaaacuuuuaccucuuuuaauggauuauuuugguauuuauauuuaugucuuuaaauaacuaacuuuuaauuauuaccauauuauuuuccaguuuggggcauuaucgguuuuucaguaauauaaucuaauauuuauacucacauuuucucaacuauccccaaaaugucuuacgucuuuuucccucccugaaaacauugauuuguauguguucuuuugucccuuuuaaucuagaacaguccuccuguucuuuguuuuuuucauggaagagugcaggucaguucucuuguagaccagggcauuuuggauuuaucuaguuguuucuucauguuuagauucaaguuaaaagguuuuggcaagaguauagcauaagugauaccucacauugcaugacaucaggaggcuuauaaagucauguuguccuuagguuaugcuaaauuugaucauuugguuaaggggaagucuaccagaugucuuuugaaaagguauauuuuucucuuugcaauuaauaaguaauauguggguccuguuuccuaacagguuuucacccaguaguuuuaucauucuugccuuaauccguuauuauauuggauuuacaagauguugauuuaaaaaauucuauuauuucuuaaacauuuauuaacuggcuguuuuauauauaaagaagagcuuuuuauuccccaccaccaccuuuuuucuuuuuuuccgauuauggcugugaacuuacgcauuuuuaaaauaaauauauuauaauuuauuauugucauuauucauuuugaugcacaaauuguuucaaauuuaacaagagaaacuucucaagccaauuccugugucuuugucuuugaguauuuuuguguuuauuguaucguaagauguuccaagcucucauugugccuuuuuuuuuuuuuuuugccucagaucuggaagcagccauucuccaggguacccuagcuccuuuuaguauuaaugguauuuagaaacuaagauguauggguugggagcaguggcucacaccuguaaucucagcacuuugggaggcuaaggcagguggaucgcuuaagcucaagaguuugagaccagccuggcccguaugguaaaaccccaucucuacugaaaaaaaaaaaaaaaguacuauucugcccuaaaaacuauggaacaauuagagaauguguacuuucccuggguuagucaauaccgguuuugucagcucaugauagaaaaucuucccaaacuccgugaggauauuaaagaaaucuccaugucugaucucaaagacuuuuuggaaaguauucgaaaacauucugacaaaauaggugaaacagcaaugaaacaggcacagcaucagaaaaccuucaguguuucucugcagaaacaaaauaaaaugaaauuugggaaaaauauguauauaaaucgugauagaauuccagaggaaaggaaugaaacuguauugaaacauucacuugaagaagaggaugagaaugaagaagagaucuuaacuguucaggaucuuguugauuuuuccccuguuuaucgauguuugcacauuuauucuguuuugggugacgaggaaacauuugaaaacuauuaucgaaaacaaagaaagaaacaagcaagacugguauugcaaccccagucgaauaugcaugaaacaguugauggcuauagaagauauuucacucaaauuguaggguucuuugugguagaagaucacauuuuacaugugacccaaggauuaguaaccagggcauacacugaugaacuuuggaacauggcccucucaaagauaauugcuguccuuagagcucauucauccuauugcacugauccugaucuuguucuggagcugaagaaucuuacuguaauauuugcagauacuuuacaggguuaugguuuuccagugaaccgacuuuuugaccuuuuauuugaaauaagagaccaauacaaugaaacacugcuuaagaaaugggcuggaguuuucagggacauuuuugaagaagauaauuacagccccaucccuguugucaaugaagaagaauauaaaauugucaucagcaaauuucccuuucaagauccagaccuugaaaagcagucuuucccaaagaaauuccccaugucucagucagugccucauauuuacauucaaguuaaagaauuuauuuaugccagccuuaaauuuucagagucacuacaccggagcucaacagaaauagacgauaugcuuagaaaaucaacaaaucugcugcugaccagaacuuugaguagcuguuuacugaaccuuauuagaaaaccucauauagguuugacagagcugguacaaaucaucauaaacacaacacaccuggagcaagcuuguaaauaucuugaggacuuuauaacuaacauuacaaauauuucccaagaaacuguucauacuacaagacuuuauggacuuucuacuuucaaggaugcucgacaugcagcagaaggagaaauauauaccaaacugaaucaaaaaauugaugaauuuguucagcuugcugauuaugacuggacaaugucugagccagauggaagagcuagugguuauuuaauggaccuuauaaauuuuuugagaagcaucuuucaaguguuuacucauuugccugggaaaguugcucagacagcuugcaugucagccugccagcaucugucaacauccuuaaugcagaugcuacuggacagugaguuaaaacaaauaagcaugggagcuguucagcaguuuaacuuagaugucauacagugugaauaugagguguugcuguguugcccagacuggucucaaacuccuggccucaagucauccuccugccuuggcaucccaaaaugcuggaauuagaggcgugagcuacugugccuggccauuuuuauaagcuuuuaagcugaaacuggcuaauuuuaauuuuuuuuuguagagauggggccuugcuauguugcccaggcuggucuuaaacuccuggcuucaagcaauccuccagccuuggcuucccaaaauacuaggauuuauaggcaugagccaccaugcccagccaaaaaaaguauuuuuuuaaaguuagaaaacaccuuuaauuuaaacaccuuuuaugauuauaauauaaaaggccaacauaaaauaauguauuuuacuauguaauauaaaagguauaauuuugcuuaucguuuuucaguuaagauguaaugauacuagagaaaggcaacucagcuaccuaggccauuuucaguuaagacguaaugauacuagagaaaggcaacucagcuaccuagggcauaguaggggguaauggugauaccacuguaugaaaguauaccacuuauugucuaggguaauggugauaccacuguaugaaaguauaccacuuauugucuaacaagacagugauaugaauaaauuguacuaaauacugaaaaguguggcuagauuuggucacuaaauuuugguuuucuagaaaaaaggggucugagaauggugaauuuagucacuuaucuaaugaccauaaccuagcagagaaccaagaacaaagggggaaaaguggugcaucucugaguaaccaaaagguuacucauucucaaaagguacaugugcucaaaggaacguguauaaaaccuauuaaccuuacuaguaggagaggcccuuacuuagguuguauuugcucuuacuuuagacauaauucuaguaauugauuagcuggcuuaccugcucaagaagaguaaagauaaaauuaauaagacagaugagggagagaguagggaguaagaauucauguuaaaacuaccagggagaaggcagaaaaauuagaaaagcuagacacaagaacucaaauagcgcagcuuuuuaauagaacaaaaaaacagcucuuacuuccauaacagccccugggaauuuuacuuuauagaacaaaauguauucuuaauggugacccagagaauuacgauacauuuuagaauuuuguaaaauaugccuaagauuaaagaaaaauucugaugcuuaaagcaaaaauuauacaacagcaacauuccccagagaugccagauaaauuaagcugugcaaauuuucauuuauuuauuguuuuuaauuguugauuuugagccuuucuaaacuauauuucacacagaauacacuaaauuuaagaauugcuuuuguuauuccaagaacuauauaggcugaaauuuuaaauagcuuccaaaauucuagcucagauaaauucacaaauggaacaucuauaauguucucuaaaaaaaucagaauauccagcacuuugggaggccaagacagggguguugcuuuaggccaggaguucaagcccagccugugccacauagcaauacccuaucucuaccaaaaaaacccccaaaaaaacaaaaaaaucauuagccaaguguggagaugcaugccuguagucccagcuacuugggaggcugauuccuugagcccaggaguucgagguugcagugaguuauaaucaugccacugcagccugggugacagaucgagaaaaagaaaaaaaagaagaagaaaagaaaauuagaaauuaauggggugggaaaaugauuacaggcauucuuaucagagaagcuugcauguaaaaugacagggucuuuuuuaugagccaaguguuuuaaguuuuuaaaauaacuaauauuggaauugucuuuaguuuaauuaaguaagcuauguuaguaguauuaaaaauuuuaaaccacaaaaaauuauugaaggaaucuguggaaauuuuaaaaauucucguugagauuuuuuuuuaguugaggcaugaauccuuucuaaaaaaaucacuggccgagcgugguggcucacaccuguaauccuagcacuuugggaggccgaggcagguggauugccugagcucaggaguucaagaccagccugggcaacauggugaaacuccaucucuacuaaaauacaaaaaaaauuagccggccguggcggcaugcgccuguagucccagcuacucgggaggcugagauaggagaaucacuugaaccugggaggcagagguugcaaugagccgagauggcgccacugcacuccagccugggugacagaaugagacuccgucucaaaaaaaauaaaaauaaaaauaaaaauaauuaaaaggcaugaacagacauuccugcaucauccugauuuuucuacuuagaacauuuuacuuauugucugcauguaaaguugacuucuuaccuuggugucugccuuuuauugcuauuagcuagaggugggauuuuuuaauagcaccuauucuuuaccaaagcaaauguuucaaaauauguugacagccauggaauugguaucauuuuuaaaugcuucuacaaucguucaccuaaggcuaaaaagggucagaaagcuuuacuugauugaaguacguuacuguuaaauuuuaguaagaaaacccuccuaaauuuauugugauuaggauuacagugauuaaauggcagauuagaaauuuaaaauuauuaaaacacuugagguaauggauguggagaacuuucucaguaguggaaauugaaguuuauaaauaaucuucauuugaaaugauuauguguaaauauuauaaugcauuuauaaugaguagaaauuaauuuaucaguuaaacucuuguauauuuugugaucucauuuuuauucuuuuuuuuucuuucuuuuaauaguguuugccagcucugagccugugccaggauuccagggggauacccugcagcuagcauucauugaccucagacaacuccuugaccuguuuaugguuugggauuggucuacuuaccuagcugauuaugggcagccagcuucuaaguaccuucgggugaauccaaacacagcccuuacucuuuuggagaagaugaaggauacuagcaaaaagaacaauauauuugcucaguucaggaagaaugaucgagacaaacagaaguugauagagacagucgugaaacagcugagaaguuuggugaaugguaugucccagcacauguagaccucacauggcuugcacucagugacaccaaauccaugauucaauguugaucuugagcaaguauuggucaugauacaguaauuuguuuacagaauccaaaaauacaauagagaagauacaugagggcuuaaacaagaaauaguaauaaauaucauuuguauggauuuuuaaauaaucgaauacuauuuuauauauggaaaaaaaugaccauuuuuucacuuuuaggggaaaaugcaaaaguguaauacauaaauugucacaaauuauacaugaaauugauuacaaauacauuugaaaaacauaugccucuacucauaaguauuuuuuucuauuuagacuugaaugauaaucuguuuuuugaucaguauauggcuuuggaauucaaucaugucugauaugguaguauuucacuaccauuuucugacuuuuagcuuuuauuuucaccucaaugugauuuaagcagaccaaaauuucuaauucugcuaauucugaaggggaaauagacaaaucuuaaaagcugccugaaaucaaacuugauuuaacucaguaagaaugugaauuauuuguucuacuugggugguuuaauuuaaucguucugaauaugaacaaaagguuuuggauuuucuaaagaugcaguguuguuucuguucaucaggguuaauauuucuaacuauauugcuuguaggugaccccauucuggauuuguuugguuugguuugguuccaguuaaaagagaggacaggaacuaaauggggcuaaccacuucaggugcagcuugugcgaggguagaugguuccugcacacagaaguuaccacaggggucagguuacuuucuucaaauagcagauuucaguacuuuauccucauuguggaaacaagccaaaccaaaugaacucuggaaaaccuaaaacaaauguacauuuuccuuuguguauguuuccgugguccaaauggcaauauaaauccagucuuuauucucccuuuguuguauuuaugcugaaucuucccuuugccuuuucaggauuuaggccuguaagaaacuaugccugauucuguaaaauaaguguaaagaauuauauguacaucucuggauuuugugaugaaauauuaaaaauauugagcaaguuguugaaaaugca

SEQ ID NO: 67 - RNA, 2939 nt, Homo Sapiens
ggccgucccuggcggcggagauggcggcgacagcggcggaggcuguggccucuggcucuggagagccccgggaggaggcuggagcccucggccccgccugggaugaaucccaguugcgcaguuauagcuucccgacuaggcccauuccgcgucugagucagagcgacccccgggcagaggagcuuauugagaaugaggagccuguggugcugaccgacacaaaucuuguguauccugcccugaaaugggaccuugaauaccugcaagagaauauuggcaauggagacuucucuguguacagugccagcacccacaaguucuuguacuaugaugagaagaagauggccaauuuccagaacuuuaagccgagguccaacagggaagaaaugaaauuucaugaguucguugagaaacugcaggauauacagcagcgaggaggggaagagagguuguaucugcagcaaacgcucaaugacacugugggcaggaagauugucauggacuucuuagguuuuaacuggaacuggauuaauaagcaacagggaaagcguggcugggggcagcuuaccucuaaccugcugcucauuggcauggaaggaaaugugacaccugcucacuaugaugagcagcagaacuuuuuugcucagauaaaagguuacaaacgaugcaucuuauucccuccggaucaguucgagugccucuacccauacccuguucaucacccaugugacagacagagccagguggacuuugacaaucccgacuacgagagguucccuaauuuccaaaaugugguugguuacgaaacagugguuggcccuggugauguucuuuacaucccaauguacugguggcaucacauagagucauuacuaaauggggggauuaccaucacugugaacuucugguauaagggggcucccaccccuaagagaauugaauauccucucaaagcucaucagaaaguggccauaaugagaaacauugagaagaugcuuggagaggccuuggggaacccacaagagguggggcccuuguugaacacaaugaucaagggccgauacaacuagccugccaggggucaaggccuccugccaggugacugcuaucccguccacaccgcuucauugaugaggacaggagacuccaagcgcuaguauugcacgcugcacuuaauggacuggacucuugccauggcccaggagucagguguuuggagcgaggcagggcaguuggcacuccacuccuauuuggagggacuucauacccuugccucuugugccccagcaccuucucucucugccccccgccuaaaguccugcauucaguguguggagucccagcuuuugguugucaucaugucuguguguauguuagucugucaacuucggaaugugugcgugugugugcaugcacacgcauguauguaucuguucccuguuccuucugggucaggcugucacuuccggcucucagcccuaucuccugcaaccucagugccucagccugagagagagaugagaugcucuuggacuccccacugcaucugggcugcagggccagagcuagucugaccauuaggucagucugccuccugacaguuuuugcguagucaagcucuaggcgguaugggaauggcuaccgggacucuaauggggugaaagagaggggaggcuugccuuugagagccuauauagccuuccugugagagaggauuagauaggguuccaacugggccuacaagcucaagccauacauaaaaggaccuugggacauaagaaccaaugauugugcauaaguucuaaauuagagacacauauaguuucucucuuucagcaccagcucuugccccuaugcuggguaccaagggaguucuccuagcuguggcuucucuagguucuaggggugcaagccucuguguguuuguuugugugugucugugugugcguauccacacuaggggugcaagccucugggugugugugugugugugcgugcguguguguguguguguccguguguguguguguguguguccacacuggccagccucccuacuuaccaagguucuccacugcuuaccuuuuccagugggacaguacagugugagcccccgggaaguacugccugaccuauccuaagcuuuuacacuuggauuuuagccaucauauguuggccaggucucacugcagccugcccgaggcuaacuggcuagagccuccaggcccuaugaugcucccugcccaggccauauccuuuauuccugcugagcuuccuggcugaauagaugaaauggggucaagcccaggcagcucauucacuaccugugauccaccucagggcacgggcaaacacauaggcuugcgucuuaaagccagcuccucugccagaccccguuguaaugugccacaacacccucaauagucagggcaacugguggagcauggaagucgaauuuccuuuucuguuaggagcuacuccugggaaccccucucagggcugcagcuuacaggugggcagcugugauugcacaacuugaagggccaucauucacaucuauucagugggaguggggucccugggauugggcagugugguggcccugugucuccucaccucugcuccugucuucaucaccuucucucuggaagggaagaggaguuggaaggucucugguuuucuuuucuuuuuuuuuuuuuuugccaaagguuuacuuccagcaucugagcucuggcucucaccccugaagcucaguuauagugcacugaugaacugagaggaugcguguggaugugugugcaugccugagugcguuuuuuggggagggguguuuauuuuuaguaccccauucugggguucucugaugcaguguggaugugaagauaugguaccuucucaaguguagcucuuucaaauauagucaaugcugggaaauguga

SEQ ID NO: 68 - RNA, 4087 nt, Homo Sapiens
auacacacagacucacagcgagaccgacacacacucccauacacucacacacacaacugcaggcagcgaggcucgggaagucaggccggcuuuucgccccggcgccuucucugcuccagccggccgggucucccugggggcccggagcucggccgggccgcgcagccccguuagaggacgagcucggcggacccccgcuccuccaugggcaaacgcgggcggccgcgcaaggaggcgcgcugcgagggcgcggggcuggcccccgccgcgcccccggcugugccccccgccguggccgcgccccagcccccggcccugcccgaggaccccgcuggggccaagcccaggugccccuucucagacauuuucaacaccagcgagaacucgauggagaagcacaucaacacuuuucugcagaacgugcagauucugcucgaggccgccagcuaccuggagcagaucgagaaagaaaacaaaacaucgcccgaggcguccgcccugcaaaucugccagcccccgagagggguuuggaaccuuagcacccaagucuaagucaacuucauagguaaacaaaccacgcgcgggcugcccgcggcacggcgggcgcggcuggcgcggcuggggcggcaggggcggcggagagcgcgccgagccgcggccgagcuggcccgcccgcccgucgcacauguuccggaacggcgcccggccguagccgccugcggcgccuccugucggcccgagaagggagugcggagaggcgccggucgccacccgcggugcccauggagcgggugaagaugaucaacgugcagcgucugcuggaggcugccgaguuuuuggagcgccgggagcgaggugugugugagggcaggggcgcgcgugcguggggagcccuuuagcgguggcagcccaaggggcuguagagauggcgcagaaagaccaggaacucggagacuguggugucgagagagaaaaugucuuucuaagacuuguucgaaguacacaaaaauauugggcuuaaagagacucuuuagaacagagagaguugaaaguaaaggggaauuuuugaggcaagcgaagucaaugaggugaaugagugugaacauggcuacgccucuucauucccguccaugccgagcccccgacugcagcauucaaagcccccacggagguugagccgggcacagaaacacagcagcgggagcagcaacaccagcacugccaacagaucuacacacaaugagcuggaaaagaaucgacgagcucaucugcgccuuuguuuagaacgcuuaaaaguucugauuccacuaggaccagacugcacccggcacacaacacuugguuugcucaacaaagccaaagcacacaucaagaaacuugaagaagcugaaagaaaaagccagcaccagcucgagaauuuggaacgagaacagagauuuuuaaaguggcgacuggaacagcugcaggguccucaggagauggaacgaauacgaauggacagcauuggaucaacuauuucuucagaucguucugauucagagcgagaggagauugaaguggauguugaaagcacagaguucucccauggagaaguggacaauauaaguaccaccagcaucagugacauugaugaccacagcagccugccgaguauugggagugacgaggguuacuccagugccagugucaaacuuucauucacuucauagaacccagcaugacauaacagugcagggcaaaauauucacugggccaauucaauacaaacaaucucuuaaauuggguucaugaugcagucuccucuuuaaaacaaaacaaaacaaaacaaaacuauacuugaacaaaagggucagaggaccuguauuuaagcaaauacuuagcaaaaaguggggcagagccucccaaggagaacaaauauucagaauauucauauuggaaaaaucacaauuuuuaauggcagcagaaaacuugugugaaauuuucuugauuugaguugauugagaagaggacauuggagaugccauccucuuucucuuuucuaguuugcucauacuacauugaguagacacauuuaaggaugggguuaugaacccuuccugagcuuuaugguccuaaaagcaaaauaaaaacuauucgaaugaaaagacaagaaaaucagguauuaaucuuggauagcuaauaaugagcuauuaaaacucagccugggacaguuuaucaugaagccuguggaugaucaauccuuuauuauuauuuuuuuuuuuugaaaaaagcucauuucaugcucugcaaaaggagagacucccaugaagccuuuugaaagggaucaucaugcagcucaacuuucuguuggauuccaugcuaagcaagcuaaccuuauccugcauuguuagcacuaggcacccagcugccaccucuccauccugcugcccuuaggccacaugggagcaguccaugcaugacagccucuauccuacaaggccuaugaguauggauugggggggccaaaaggaaaaagcuccaugugccucuuugucugcgugggucagaagaguugugcacgcagauuagcaggccaaggucugagccacagcagcauuuuuauuucagauuuugauaacuguuuauauguguugaaaaccaaaaugacaucuuuuuaaagcuuauccauaaaaaaaaauagaugucuuuuauaguggaaaaacacauggggaaaaaaaucaucuauuuugaugcagcauuugauaaugauaaaacaccucacaccucacucuuuauagugcacaaaaugaaugaggucugggcuagguagaaaaagggucaaugcuauuuuuguuuuuagaaucauuaccuuuuaccagcuuuuaaccaucugauaucuauaguagacacacuaucauaguuaacauaguaaguucagcacuugucucauuuuaauguaaagauuugcuuccauuuuccuacaggcagucucucucuuccucacagucccacugugcaggugcuauuguuacucuuacgaauauuuucaguaauguuauuuucuucuaagugaaauuucuagccugcacuuugaugucauguguucccuuugucuuucaaacuccaagguucccuuguggcccucucccuuacccugggaaggccucuuggagaccuuaccccuggcuguuuggacuuuguauacuuuaaauaauuuaacuacccuuaauuacuuaaaaaaaaaaaaaagcuuuaugauuuucauaacuuauugcugauuuuaauggauuguuaauuucaguccuguaguuuuauuuuauguuuagauagggcugggcaaggaaaaagaaaauaaagacaaccauauuuagcagugcaguugaguuguguguuaauguuagacuaucccuuugugagugacacuuuaacagcauucacugcuucuauauauaguguaccaucuuggucauacauuacgccucaacauauacuugugcucuuccuuugccuccagaagaaguuuuuccuugauugugcuauguuucaguggaagaaauucuuugaaguagaugugagugaaaaacugcaugccuuuagaagcccaguaucagaacuugcuacguuucaggugcuagggacuuaaugaaaaacaggacaaaacaauuccuuuuuguggcccagguaaauuauuucugguuucacuuauaauuacuaauggcugagucaagauguugucucuguguuugcuuacucuugaucaagugugagacaguuugaagacugugcuaccauacaaagugaaugaagccagugacuaagcuucuguuuguuuuguuauucucauggccuucgcuugcauuauuugggccuucauucagaugaacuugaggugccauuuuguugcauauguacaggauuaugggcuggaaagcauuuguuauaaaccuauagugcacauuuuaacugcccccuaaauuacccuucccuggguuuguuuuccuuggggugguguagauuguaugaguaagaaguauuaauuuuuuaaaagacaaaucaacuuugaagacacaaaaguuaauuggaagaaauaaaaacugugaacgaagaa

SEQ ID NO: 69 - RNA, 100 nt, Homo Sapiens
ggcuggucugagugcagugguguuuacaacuaaucgaucaaaaccaguuacaaauuuauuccuuccuucucuauuaucacugcuucacuugaccagccuu

SEQ ID NO: 70 - RNA, 2775 nt, Homo Sapiens
ggcuuccgccccgcagccccgaggggucugggcgcgcugaagaccccuucggcugcugggccaacgcccccacccuuggucacguacuccugccgccgagcgguucgcgggagguggccucgggggucguagcuacucaccggcggggcgcuccgaguccaucugccccguagcccggcagccggggcgggagggcugcgagcccggggcgcgguccgccugaggccugagacccggggccgccugcgcucagggccgcggugccggccgcgcgggagccuggcggggacggcgcggucaguguucggcuccuccgcagugacucaccagcguccugaagcuuuugaucaccauuggcugggaaggaaaaacagaaucagcuguucccugcgaaagguaucauauguuucuuacaaaguggagguuuguggcagcccugcauggagcaagucugucagcaccaucuuucuaacaggguggggcguguugacccccuuaaaggcgccagagcccgcggucacggcucagguucccggugcuucgcgcgucugccguugucacaggccagggagguggcaccaccaggcgaagcuuggcgagauugugucgucaagcgcguacgggcgccaauuggccgggcgauguggcguggacuggcgcuggcgcgagcgauuggcugcgcggcccgggggcggggccagugggcggugcgcgccgcagacugugcucaaagcgggcgccauccgggaccggcgguugucuguggccggaggcugaucaguguucuagaacagaucagacauuuuguaaugaugccugaaauaaacacuaaccaccucgacaagcaacagguucaacuccuggcagagauguguauccuuauugaugaaaaugacaauaaaauuggagcugagaccaagaagaauugucaccugaacgagaacauugagaaaggauuauugcaucgagcuuuuagugucuucuuauucaacaccgaaaauaagcuucugcuacagcaaagaucagaugcuaagauuaccuuuccagguuguuuuacgaauacguguuguagucauccauuaagcaauccagccgagcuugaggaaagugacgcccuuggagugaggcgagcagcacagagacggcugaaagcugagcuaggaauucccuuggaagagguuccuccagaagaaauuaauuauuuaacacgaauucacuacaaagcucagucugaugguaucuggggugaacaugaaauugauuacauuuuguuggugaggaagaauguaacuuugaauccagaucccaaugagauuaaaagcuauuguuaugugucaaaggaagaacuaaaagaacuucugaaaaaagcagccaguggugaaauuaagauaacgccaugguuuaaaauuauugcagcgacuuuucucuuuaaauggugggauaacuuaaaucauuugaaucaguuuguugaccaugagaaaauauacagaaugugaauauguagguaaaugauuacagaaaaauuuaucugcuuaacaaacuuagaaugacuuuuuccuuuuaaauuuaguucuaucauuaauuuaucauuaaauuuaguucuaucauuugguacuaucauuaauguauuauauacacugauacuuuaaaacuuguguggaaaaaacuaacuuauaauuuuguaucacacacccuggauauguguucuguuucuaagcgacauuugugagagauuauuguaaaaugagagcgagcaaauaaaacuuaauuuaaucuuugcagauacauacuuaugggaaauuugaacaaaugagugaaacucuguuuuuaguaggcugugauaaacauuuccggagcacuugcagaggacuugcuauuugccaggugcuuuauguaucauuaaauuuuucucauaguucagaaaaaugugcaaaggaaacuauugucucgcuccuucaaaacagucuuaauuaacuuucauauuagcagauuaaacuagcagagcagguucaagggaaauuaaaugauauggacccuaauuuguaucauucugaguugauugugugguuuauucauucuggaaacauguugauacuuacagucagccacugcuuuugauaagugauauugauuagguugaaucuucuuguaaauaguauuuaccaguuagcaaagucuguguuuucagaauuacagugagcacagagguguucauaaaaugggaauugagucccacucgguaagaguugcuuaaacuugacacuguugacauuugggcuggauaaaaccccugugguggggucugugcugugcauugcaggauggugagcagcgucccucucaugugacacccacaguuaugccggauguugccagaugccccuaggggacagagucaacccccaacugaggaccacuguccuacagagucaggaaauauuguagggagaaaaaaauaacaacaacaaaggccuguguuaauguuaaauagaugagauuauggaauguguauauuaauguuaaaaauuguaccuugaucaauguacuuuuuauaaacuugccauagauaucucagauuugaaaccucaagacagauuuauuauucuuaaaugcuguaugauaaugaagaaaaauaaaaauuuauuucuugcaaaguuaaauguuuguuaaauucaauagaaugacucauuuaugguuaacuuugggcaauuuauaauuucagacaagacuguuuagcaaguauuuuauugaaaaguaaaaaaaauugcaauuuaa

SEQ ID NO: 71 - RNA, 3877 nt, Homo Sapiens
aaguggcaccagcacuuccgguacggaaaacucgcugcugccccaaccuggcuugacaggcuuggucucugcaaguggcucucagccccuucuucuuuccugccucaccuuccaauucguuugccgccgccgucccgcagcugcuguuuccggaguugccccuuccccauguuccggggcaggaguccgcaaagcgaagauccgcccgccgguuccucaucauguccgaacugacuaaagagcugauggagcugguguggggcaccaagagcagccccggucucucggacaccauuuucugccgcuggacgcaagaggguuuguguuuagugaaucagagggaucugcauuagaacaguuugaagguggccccugugcuguuauugcaccuguucaggcauuucuuuugaagaagcuccuguuuucuucggagaagucuucuuggcgggauuguucagaggaagagcagaaggaacuccuuugucauaccuugugugauauuuuagaaagugcuuguugugaccacucuggaucauacugcuugguuucaugguuaagaggaaagacaacugaggaaacugcuaguauuucugggaguccugcagagucuaguugccaaguggaacauucuucugccuuggcugucgaagagcuuggcuuugagcgauuucaugcauuaauucaaaaaagaucguucagaaguuuaccagaauuaaaagaugcugucuuggaccaguauucaauguggggaaauaaauuuggaguauugcuuuuucuguauucuguauuacugacaaagggcauugaaaacauaaaaaacgaaauugaagaugcaagugaacccuugauagauccuguauauggacauggcagccaaaguuuaauuaaucuccugcugacgggacaugcuguuucuaauguaugggauggugauagagagugcucaggaaugaaacuucuugguauacaugaacaagcagcaguaggauuuuuaacacuaauggaagcuuuaagauacuguaagcucugcuguucccaaaccauccuuccuacuuuacuggcucaacauugccacauuagcacaucuaacucaucccucccaucauaggacaaaaauacuaguuucucuguccauggauacaaaagaguaccuauuuuccacuucccuccuagugauaagaauaaauuccacagggccaggguggugguugaagcaggggcugcuggcugauuaggaaagaauuuuuggccugacugccacaaacagccacuuggaauuccccaauuauaggcagucuguaagaaaaaggaaaaugcagcaaauuguauugcuaagauucgucauuuuuaaguuaaaguuucugucuucauaugagaguggaauugaguggugugaacguguuggguuucauaagucuauucuguuuguuuaguauuaaacuuuuuuuuucucagucacacacacacaaucguguucucaaguuuuugguauaguaauguucacagauuauguaaccuugagagcagaguacaaauacagcuuuuuauacauuuuaaagagacuguucauacugugaaacuuugaaccuaccuucuaucaugaagagucaaauaacaggacacuuacauacuuaaaugguuuaaauuguaauuuuucuugauuauuugggagcaaagauguucuuucccuuugauuauucauaaaucuacucauuugauaaacuauaauuauuuuccuuauaaaguuauuaucgucaaguuuauaguuuuaggguuugagguuucaugcugaaauucuaagaaguggucauuuuaucuaggaacuuuagcaaaaccugagaaugacucuuagggcuaaauaguuaucuccagcuguguuaaaucuauauuguuguuguuuuaaugucaaagcacaauauaagcucaguacugacagucuucuaacacucauuuuuacauucagcauuugaucucuaugggugaagugcucgggcacaauacauuauuucaguuaaauacaaauuggacacuuuaugcuucagauauuuaugggcaaauaagaggcaguauaaauuuuuaauuuguuuauuuguuuuauuuugcuacauuuguucuagguugguucuuacuugaaaucuccaaaauucccuauuuggauuguuggcagugagacucaccucaccguauuuuuugccaaggagauguuaccuuuaagaggaguucccagugaagaguuguuuuuuccccuugaaauaaaaguaaaacaaagcuggaaguucaccuaaaugguaaauaagaacaauaauacuugaucacauuuauugaguccuguuuuagauuuguuaaauauaaacugauguucauauagucuucaccacauaaaaaauacuggaaauuucgcucuucuuaaaauuauaacaagaaucauuauucggccauuccuucuuuaacauuucugcauuugagcaagcaguuuuggcuguggguuuuucuuuuuucuuuuucuuuuuuuuuuuuuuuugaguuuuggugaguuugcuuuauuauacauucaguggccugaaacaacauuguuuuaauuuuuccccagcaguuccuugauauggcuuuaguugccccugaagcuccuucagaacaagccagaagaguuuuucaaaccuacgacccagaagauaauggauucauacccgauucacuucuggaagaugugaugaaagcauuggaccuuguuucagauccugaauauauaaaucucaugaagaauaaauuagauccagaaggauuaggaaucauauuauugggcccauuucuucaagaauuuuuuccugaucagggcuccagugguccagaaucuuuuacugucuaccacuacaauggauugaagcagucaaauuauaaugaaaaggucauguacguagaagggacugcaguugugauggguuuugaagaucccaugcuacagacagaugacacuccuauuaaacgcugucugcaaaccaaauggccauacauugaguuacucuggaccacagaucgcucuccuucacuaaauuaauuugucuaaguauuuauaaggaagaucuuaauaacagauguugaaagaaggagucaagacuggcaauuggcuggauuaagcuaaacacugguaucacugauuaacuguaaauaacaauuaaaaacacauuuucaguguuuaugauauguuuaaauuauuuguccuaaagcuuuauguuaaagauuauccuauuuuaccccuucgugugaaauuuacuagcaaaauuaagcuuucaucaaaguucaucacuuuugcauucagauacuuggucauuuacuuaccaaauuacaaacgcaauacuacagcauuuguauauuaaguaucacaguuacuauugauaaacuacuuuuggguuuuauuucauugaggcacuuuuuuuauuguuugaaugauuccggcuuguaauauaucagccucuacaaugaaaugcagaagaguucauuuuucuaagaucuguuuuucauuagaaauauugacaaauaacacauugucaaccuggauccuuugacaauuuacuuaacucuggcauguucacaaaaaguagaaacucuaagagaccauuaccauuuauucacagauguauaggggauguauucuaaaaacugacagaaaagagaaucugauagucaacacuguuaacuuuuacuguguaauugccaaauacacuuuuccaaauuugucccaacagcccuguaagccagcuuucuucuauauuuauaaacacgauaaaugcaugagaagaucuguuauuacauuaguauauuacguuauuuauuaugauccuaguugauggccuaaauaaacaccuuuuucuuuaacugu

SEQ ID NO: 72 - RNA, 3465 nt, Homo Sapiens
gggggcccagcggcccgcgccccguggcuugaccuccccgacugcugggcccgugacgucaccccgcugugacgcgcacgcuguaggaaaacuaauuaauuaaaaggauuuacgguauaucuuaugacucuacaggagccuugggauauagauaaaaaugaaugccauuucccauccaguacugaaguguuaaaguuagaagacauuugcuaagucaaaucacuucagaagcagagcucgggaaagaaauugaagaagaaaaugaaacugucaaaugaaaacaacauuggaaggaguacaagagaaaaagaugauacaggaaaaacagugaggucauggaaauuagacaugagagaggaagcucauccugggaguggaggaacagauguucugucauugccacauucuucuggacacagacuggagaacuauaggaauguauguugaagaaaguacgcacaucuuaucuucugaacauuuugauggaauuaaccacaaacuucaugcaagaacaguaaaaggaaagauacuauucaaguccaguacaucauaaugcagaauucuguaucaguaccaccaaaagaugaagauccaauccuuugauggcaauggaggaggaggaggacacacguugcacauucuccaaauauccaacagccuuucuggauuucucagaguccuauggauagugaaucaaacaucccuucuggaacaauacagaguaggaaagguuugcagaauaagagucaguuuaggaccauugcaccaaaaauugugcccaaaguccuaacguccagaaugcugccaugucauucaccaucacgcucugaucaggugaaucugggacccuccaucaacuccaagcugcuggggauguccacccagaacuaugcccugaugcagguugcuggccaggaggggacauuuucucuuguugcucugccacauguugccucagcucagccaauucagaaacccagaaugucccuaccugaaaaccugaaacuuccuauuccuagauaucaacccccuagaaauagcaaagcaucaagaaagaaacccauccugaucuuuccuaagaguggcuguagcaaagcuccugcccaaacccaaauguguccucagauguccccuuccccaccucaccacccugaacuccuguacaaacccaguccauuugaggaaguaccaucacuagagcaagccccagccagcauuagcacagcugcgcugaccaauggaagugaccauggggacuugagaccaccagugaccaacacccauggcagucugaacccuccugcuaccccagcaucauccacaccagaggagccugccaagcaggaccucacagcucuuucagggaaagcacacuuuguaagcaagauaacaucuaguaaaccuucugcuguugccagugaaaaauuuaaagaacaaguugaucuugcaaaaaccaugaccaauuuaucaccaaccauucuuggcaaugcaguucaguugaucucuucaguccccaaagggaaacugccaaucccacccuacucaagaaugaagacaauggagguuuacaaaaucaaaucagaugcuaacauugcagguuuuucuuuaccaggaccuaaggccgacugugauaagauacccuccaccacagaaggcuuuaaugcagccaccaagguggcaagcaggcuaccuguuccacaagugucacagcagagugccugugaaagugccuuuuguccacccaccaaacuugaucuuaaccacaaaacaaaacugaacaguggagcagcaaagagaaaaggaagaaaacggaagguaccagaugaaauuuuggcauuucagggaaaaaggaggaaauauaucauuaauaaguguagagaugguaaagaaagaguaaaaaaugauccccaagaauucagagaccaaaagcuggggacccugaaaaaauaccguagcauuaugcccaaaccuaucauggucauacccacuuuggccucccuggcuucuccaacuacacuacagucccagaugcuugggggccuaggacaggauguuuuguuaaauaauucacucacuccuaaauaucuuggcuguaagcaagacaacagcucuuccccuaagcccagcuccguguucagaaauggauucucuggcauuaagaagccuuggcacagaugucacgucugcaaccaccacuuccaguucaaacagcaccuucgagaccacaugaauacacacaccaacagacgcccuuacaguugucggauuugucgcaaguccuauguacguccuggcagccugagcacacacaugaaacuucaucauggugagaaccgucugaagaaacucauguguugugaguuuugugcaaaaguguuuggccacauccgagucuauuuuggccaucugaaagaagugcauaggguugugaucagcacugagccugcgcccagugaacugcagccaggagacauaccaaagaacagagacaugagugugcgaggcauggagggaucauuggagagggaaaacaaguccaaccuggaagaagacuuccuucuaaaccaggcagacgaagucaaauuacaaaucaaauguggucguugucagauuacugcucagucuuuugcggaaauaaaauuucauuuacuugauguucauggagaggaaauugagggcaggcuacaagaagggaccuucccaggaagcaaggggacucaggaagaguuggugcagcacgcuagccccgacuggaaaaggcauccugagagagggaagccggagaagguucauuccuccuccgaggaaucacaugcauguccaagacugaaaaggcagcuccaccuucaucagaauggcguggaaaugcucauggaaaaugaaggaccccagucaggaaccaacaagccaagggaaaccugccagggcccugaguguccuggccuccacacguuucucuuguggucccauucaggcuuuaacugccugcuuugugcagagaugcugggacggaaagaggaccuccuccaccacuggaagcaccagcauaacugugaggacccuuccaaacugugggcuauuuuaaauacggucuccaaccagggagugaucgaacuuuccagugaagcugagaaaugagaccccaaggcagccugggguuaaggagagagcucugccgccaccuuccuucagagcuucgugcuuuaugguggugcuuagucacaaagaucaaacaacaggauuggugugagugaacagaaaugauuuuuguacaugguuuuauuuucuuaacgaaauaaaauauaagcucucgaagcauauuuuucuaacuauaugcagucuuauuuuaaaauacguacugauucuuaauaucuuagacuuucagaauaaauaaaaagaucaaaauuugaagauugaaauuuagcagaauauaggcuguucuucaaauacagcucucagugaaaa

SEQ ID NO: 73 - RNA, 400 nt, Homo Sapiens
gaguuucacucuuggugcccaggcuggagugcaauggcgcgaucgcagcucgccacaaccucugccucccagguucaagcaauuauccugccucaaccucccgaguaguuggcaucacaggcaugugccaccauggccggcuaauuuuguauuuuuaguagagacgggguuucuccauguuggucaggcuggucucaaacucccgaccucaggugauccaccugccucagccuccaaaauagcugggacuacaagugugcaccaccacgccuggcuaauuuuuauauuuuuaguagagacaggucucgcucuguuacccaggcuggagugcaguggccugaucucagcucacugcaagcuccgccucccggguucaggccagucgccugccucagccucc

SEQ ID NO: 74 - RNA, 100 nt, Homo Sapiens
ggcuggaccaagugcaaugguguuuacaacuaauugaucacaaugaguuacagguuucuuuguuuuuucugcacucccauugcuuuacuugacuagcuua

SEQ ID NO: 75 - RNA, 1596 nt, Homo Sapiens
auugggcugggcucucuggaaggugugcugcugccugagcugcuggaaaagcacugacagguguuugcuagaaaagcacuccuggagcuugccaccagcuuggacuucuagggacuuuccucucagccaggaaggauuuugauauucaucagaaauaccuccagaagauucaaggagcuguagaggugaaguaagccugugaaggaccagcaugggaauccuauacucugagcccaucugccaagcagccuaucagaaugacuuuggacaaguguggcggugggugaaagaagacagcagcuaugccaacguucaagauggcuuuaauggagacacgccccugaucugugcuugcaggcgagggcaugugagaaucguuuccuuccuuuuaagaagaaaugcuaaugucaaccucaaaaaccagaaagagagaaccugcuugcauuaugcugugaagaaaaaauuuaccuucauugauuaucuacuaauuauccucuuaaugccuguucugcuuauuggguauuuccucaugguaucaaagacaaagcagaaugaggcucuuguacgaaugcuacuugaugcuggcgucgaaguuaaugcuacagauuguuauggcuguaccgcauuacauuaugccugugaaaugaaaaaccagucucuuaucccucugcucuuggaagcccgugcagaccccacaauaaagaauaagcauggugagagcucacuggauauugcacggagauuaaaauuuucccagauugaauuaaugcuaaggaaagcauuguaauccuugugaccacaccgauggagauacagaaaaaguuaacgacuggauucuaucuucauuuuagacuuuuggucugugggccauuuaaccuggaugccaccauuuuauggggauaaugaugcuuaccaugguuaauguuuuggaagagcuuuuuauuuauagcauuguuuacucagucaaguucaccauggccguaauccuucuaagggaaacacuaaaguuguuguagucuccacuucagucagaaacugauguuucagcuaggcacagugguacaugccuguaaucccagcuacuugggaggcugaggugggaggaucacuugaacucaggaguuugagagcagccagggcaacacagcgagacccugucucaaaaaaaaaaaaaaaaaaaaaagcccugguguuccaaacucagucuuuccugaagaagaggaucugaguuaucuucugaaacagcguucucccuucccaguuguaucacucuuauaaaaagacuguccagucuaugucaugcccuaggagacaaacuguuccucccagcccccuuugaguauugagcagaagaaucaaauuauuaaauacguauguuuguacagaaugguauuuguguaugugugugggcuuagagauucacaaguaaauauuccuuuggugaaggaauuucaauaaaaacaucuaucaagugucagcggugaguguguuuacaccacagaaauuggcaaauugacaaaucagaguuuguuuuuguuuuuuuguuuuuuacuuuccauaaaguucguuuaccagcauaccacuagagauuucggu

SEQ ID NO: 76 - RNA, 6484 nt, Homo Sapiens
ggucccggccccgcugccgccgccgccacaccggcccuucgggagcgucugaggaggcgcgggccgcugcgggcucgggcgccgcagcgcgccggcccgagccccuggacgaggcccacggagccgcucgccccgacccagccgcccgauguccucaaaauggaggcagcgggggcggcggcgugaagaaagcggcgcugugggcgcgggaguaggggcccgggcggaggcgguggcgggauggggcugcugcucaugauccuggcgucggccgugcuggguuccuuccucacgcuccucgcccaguucuuccugcuguaccgcagacagcccgagccgccggcggacgaggccgcccgcgcgggcgagggcuuccgcuacaucaagccagugccgggccugcuccuaagggaguaccuuuauggcggcggccgggaugaggagcccuccggagcggccccugagggcggcgcgacccccaccgcggcccccgagacccccgccccgccgacgcgggagacuugcuacuuccucaacgccaccauccuauuccuguuccgggaguugcgggacaccgcgcugacccgccgcugggucaccaagaagaucaagguggaguucgaggagcugcugcagaccaagacggccgggcgccugcuggaggggcugagccugcgggacguguuccugggcgagacggugcccuucaucaagaccauccggcucgugcggccagucgugcccucggccaccggggagcccgauggcccugaaggggaggcgcugcccgccgccugccccgaggagcuggccuucgaggcggagguggaguacaacgggggcuuccaccuggccaucgacguggaccuggucuucggcaaguccgccuacuuguuugucaagcugucccgcguggugggaaggcugcgcuuggucuuuacgcgcgugcccuucacccacugguucuucuccuucguggaagacccgcugaucgacuucgaggugcgcucccaguuugaagggcggcccaugccccagcucaccuccaucaucgucaaccagcucaagaagaucaucaagcgcaagcacacccuaccgaauuacaagaucagguuuaagccguuuuuuccauaccagaccuugcaaggauuugaagaagaugaagagcauauccauauacaacaaugggcacuuacugaaggccgucuuaaaguuacguuguuagaauguagcagguuacucauuuuuggauccuaugacagagaggcaaauguucauugcacacuugaguuaagcaguaguguuugggaagaaaaacagaggaguucuauuaagacgguugaauuaauaaaaggaaauuuacaaaguguuggacuuacacuucgucuuguccagucaacugauggguaugcugggcacgucaucauugaaacuguggcuccaaacucgccugcugcaauugcagaucuucagcggggagaucgacuuaucgccauuggaggugugaaaaucacaucaacacugcaaguguugaagcuuaucaagcaggcuggugaccgaguccugguguacuaugaaaggccuguuggccagaguaaucaaggugcagugcugcaagauaacuuuggccaguuggaagaaaacuuuuugucaagcucaugccaaucggguuaugaagaggaagcugccggguugacaguagauacugaaaguagagagcuggauucugaauuugaagacuuggcaagugaugucagagcacaaaaugaguucaaagaugaggcacaaucauuaagucauagucccaaacguguuccaacaacacuuucuauuaaaccccuuggagcuauaucaccaguuuuaaaccguaaauuagcuguaggaagucacccacuaccaccgaaaauucaguccaaagauggaaauaaaccuccaccccuaaaaacuucugagauaacagacccagcacaagugucaaaaccaacccaaggaucugcuuucaaaccaccugugccaccacgaccacaagcgaaaguuccuuugccuuccgccgaugcuccaaaucaggcagaaccagauguucucguugaaaagccagagaagguggugccaccuccucuuguagauaaaucugcugaaaagcaagcaaaaaauguggaugccauagacgaugcagcugcaccuaagcaauuuuuagcaaagcaagaaguggccaaagaugucacuucagaaacuuccugcccuacuaaggacaguucggacgaccgucaaacaugggaaucaucagaaauucuuuaucguaauaagcuaggaaaauggacaagaaccagagcauccuguuuguuugacauagaagccugucacagguacuuaaacauugcauuguggugcagggauccuuucaaguugggaggucucaucuguuuggggcauguuaguuuaaaacuugaagauguggcuuuaggaugccuagcuacaucaaacacggaauaccuuuccaaauugagacuggaagcccccucaccuaaggcuauagucacuagaaccgcacuacgcaaucugaguaugcaaaagggauucaaugacaaauuuugcuauggugacauuacuauucacuucaaauauuugaaagaaggagaaucagaccaccauguaguuacuaacguagaaaaagaaaaagaaccccauuugguugaagaaguuucuguucucccuaaagaggagcaauuuguuggacagauggguuuaacagaaaacaaacacaguuuucaggauacucaguuccagaacccaacauggugugacuacuguaagaaaaaaguuuggacuaaagcagcuucccaguguauguuuugugcuuauguuugccauaaaaaaugucaagaaaagugucuagcugagacuucuguuuguggagcaacugauaggcgaauagacaggacacugaaaaaccuuaggcuggaaggacaggaaacccucuuaggccugccuccucguguugaugcugaagcuagcaagucagucaauaaaacaacagguuugacaaggcauauuaucaauacuaguucucguuuauuaaauuugcgucaagucucuaaaacucgccuuucugaaccaggaaccgaucucguagaaccuucaccaaaacacacacccaacacgucagacaacgaaggcagugacacggaggucugugguccaaacaguccuucuaaacggggaaacagcacaggaauaaaguuagugagaaaagaggguggucuggaugacaguguuuucauugcaguuaaagaaauuggucgugaucuguacaggggcuugccuacagaggaaaggauccagaaacuagaguucauguuggauaagcuacagaaugaaauugaucaggaguuggaacacaauaauucccuuguuagagaagaaaaagagacaacugauacaaggaaaaaaucacuucuuucugcugccuuagcuaaaucaggugaaaggcuacaagcucuaacacuucuuaugauucacuacagagcaggcauugaagauauagaaacuuuagaaagucugucuuuagaccagcacuccaaaaaaauaagcaaguacacagaugauacagaagaagaccuugauaaugaaauaagccaacuaauagacucucagccauucagcagcauaucagaugacuuauuuggcccauccgagucuguguagcagacaggucuauuuaagcuuucaaaugaacaggguaaaguugcaucuaaaguaccacagauacaaccauguuuaaauccucguaugcacucuggccugcuucuccaguuacuugcuuguguaagaacaaaaaugagaaagguuguuuuccaguaaaaacaugaccagcuuacuaauugguuguuuuggauugcauuuauagcuaugcuuuuuuggguuuauacugggaauuuauuuuuacuaaauuauuuaacuuuucuaauuauguaauuauguaagcuagcuuuucauguuuauguauguaugguguccccuuguguuauuuuucuuccucuugguuuuugaauuaguguuaaauagaauacugucuagauucuuaaaauauuuucauuuccaucaugguuauaacaaauuugcugcaugcccaaacugacaacagcaaucacugagggaacagguuuugaaucuuucuuuuguguuaugaaguuuaucgucucuacuugcuugagauuuuuguuauuuuggggguuugggggugcuuuuuguuuuguuuuugccaaauguaacaugaaagcagaugcugcagcuuuagucuguuaugcugauuuaguaaaaaaaaauuuuuuacauauauugcuugcuuucgaugcuucugugaaauuuuuuucuaaagcuuuugugcagcuguaugguaaaaauauggugauuaauuugaagagcuuacauugaaagacaauguaauaggaaauaaauguagauugcaguuggucaagaauuuuguagagaggauaacaagacuuaauuacugaaaaacaguaacauagcauuuugaaauauaaucuuuuaaaauauugaugcuuuccuuuuaaauggaaauuuaaauuuuauaauuaaaaguuuaaacauuuaugauaauuuuccucaucaguucucccauaggaaauaaagcaugugaaaggguauuuaaaguuuuggaggacucuuuuuaaaaugacuguguugauaacuaguuugggcugguuuuguuuuagaaaaaacauuuucauguaggaguauucugugaaggaaaggaaucaugcaaaauauacuuuuugcuuuggcgucuuacaguuguaaaggaauggugaucauucugaauacuucuguagugaguauucauuaagaaaagaaugacaaaaauaguauucauacauaggaauugggaccaguucucugaaaaugaagauauacucacacuggguccauuuuacgggucccaguaacauuugacugagggaaaacaaguaagcucgacuguuguugggguaccuuaaugguuucggucuguuauauaccuauaaaauagacaaguauauguuugucccuuuguagguaacugcuaugaugauugcuauauagugaaacugacaugaguuuaaaacuagauggagcagcuuuuauugcuggcaggaaaaagcaugguguaauauuaaggacuggggcccaggucuagacuccaggacuccauaaaagaguuuaaguucaagcccuuccauuaaugaacuguguaagcauaggcaguuacaaaaggacccaucucuaaaaugggaauaauaauacuuuaccucccucacaguauuguugugagggaaacaauagcauaacugcaaaagugcuuugaacaguaaaaagauauacaaguaaaaggcauuauuuauaugaguaagaaagacauuuuugaggggagaaaaguuauuccacuuuaaaaaucaauagccaagucucaugccuuuuguuacuuuaguaagcgaaaauuucagguacuaaauaccuuucuuagccaaguuuauaacaaaaacaucucaguauacuucauuacuuauuuaagcgugaugucuuuuuuuuuuuuuuuuuuuuuuuuuuuuuuuuuuuuuuuugagacagagucucgcugucucccaggcuggagugcaguggcaugaucucggcucacugcaagcuccgccucccagguucacgccauucuccugccucagccuccggaguagcugggaguacaggcgcggcuaauuuuuuguauuuuuaguagagacgggguuucaccauguuagccaggauggucucgaucuccugaccucgugauccaccugccucggccucccaaagugcugggauuacaggcgugagccaccacgcccggccacgugaucuuauuuuaaaagaacacugcuauagaagaauuuacacaccaaauucccugaaagcuaaaguauuguuccauaacuuacacuugaggcaaucugcucaguguguaaccacuuuauaaaaaauaacuuaccauugauaaccuggaagguggacuacuuguaaguagcugguguuuauugauuaaaccauggaaguuuucaugauacccaagcauguugcugaaacugaugcauuugaaagagcuguugaaauaaugcaaaacuuugguuuuauaagaaucuacucauguuuuaaaaguauuuaacucuguagaccacaauuauagaaagcucaguaaugcugcuaaugacauuuguaaacuauaucuguaauguagugcaauauuuuuauauuucacugggagaggcaguagagacaucauaguuguacuuuagugcaagugggggaacacuccaaauagccuagaguauaguaagguacaaagcuucaaugaaaaaagcuguauuauauuacauuacugauguaaucuugcugccaugcuauguaucaauagcuaaaaaauaauaauaaagacuaccacagaaaacaagaa

SEQ ID NO: 77 - RNA, 5490 nt, Homo Sapiens
uccuuccuuuccgucucuggccggcugggcgcgggcgacugcuggcgaggcgcgugggaccuuacgcugguuccccuucgucuccucucccggcccgggccacuagagaguucgcugacgccgggugagcugagccugccgccaagaugccggccuauuuucagaggccggaaaaugcccucaaacgcgccaacgaauuucuugagguuggcaaaaagcagccugcucuggauguucuuuaugauguuaugaaaaguaaaaaacauagaacauggcaaaagauacacgaaccaauuauguugaaauacuuggaacuuugcguggaucuucgcaagagccacuuggcaaaggagggguuauaccaguauaagaacauuugucaacaggugaacauaaaaucucuggaggauguuguuagggcauauuugaaaauggcagaggaaaaaacugaagcugcuaaagaagaaucucagcagauggucuuagauauagaggaucuagauaauauucaaacuccugagaguguucuccuaagugcuguaaguggugaagacacucaggaucguacugacagauuacuuuuaacuccauggguuaaauuccugugggagucuuacaggcaguguuuggaccuucuuagaaacaauucuagaguagagcgccuguaccaugauauugcccagcaagcuuucaaauucugccuccaauacacgcguaaggcugaauuccguaaacugugugacaauuugagaaugcacuuaucgcagauucagcgccaccauaaccaaaguacggcaaucaaucuuaauaauccagagagccaguccaugcauuuggaaaccagacuuguucagcuggacagugcuaucagcauggaauuguggcaggaagcauucaaagcuguggaagauauucacgggcuauucuccuugucuaaaaaaccaccuaaaccucaguugauggcaaauuacuauaacaaagucucaacuguguuuuggaaaucuggaaaugcucuuuuucaugcaucuacacuccaucgucuuuaccaucucucuagagaaaugagaaagaaucucacacaagaugagaugcaaagaaugucuacuagaguccuuuuagccacucuuuccaucccuauuacuccugagcguacggauauugcucgacuucuggauauggauggcauuauaguugaaaaacagcgucgccuugcaacacuacuaggucuucaagccccaccgacacgaauuggccuuauuaaugauauggucagauuuaauguacuacaauauguugucccagaagugaaagaccuuuacaauuggcuugaaguagaauuuaacccauuaaaacucugugagcgagucacaaagguucuaaauuggguuagggaacaaccugaaaaggaaccggaauugcagcaguaugugccacaacugcaaaacaacaccauccuccgccuucugcagcaggugucacagauuuaucagagcauugaguuuucucguuugacuucuuugguuccuuuuguugaugcuuuccaacuggaacgggccauaguagaugcagccaggcauugcgacuugcagguucguauugaucacacuucucggacccugaguuuuggaucugauuugaauuaugcuacucgagaagaugcuccgauugguccucauuugcaaagcaugccuucagagcagauaagaaaccagcugacagccauguccucaguacuugcaaaagcacuugaagucauuaaaccagcucauauacugcaagagaaagaagaacagcaucaguuggcugucacugcauaccuuaaaaauucacgaaaagagcaccagcggauccuggcucgccgccagacaauugaggagagaaaagagcgccuugagagucugaauauucagcgugagaaagaagaauuggaacagagggaagcugaacuccagaaagugcggaaggcugaggaagagaggcugcgccaggaagcaaaggagagagagaaggagcguaucuuacaggaacaugaacaaaucaaaaagaaaacuguccgagagcguuuggagcagaucaagaaaacagaacugggugccaaagcauucaaagauauugauauugaagaccuugaggaauuggauccagauuuuaucauggcuaaacagguugaacaacuggagaaagaaaagaaagaacuucaagaacgccuaaagaaucaagaaaagaagauugacuauuuugaaagagccaaacguuuggaagaaauuccuuugauaaagagcgcuuacgaggaacagagaauuaaagacauggaucugugggagcaacaagaggaagaaagaauuacuacaaugcagcuagaacgugaaaaggcucuugaacauaagaaucgaaugucacgaaugcuugaagacagagauuuauucguaaugcgacucaaagcugcacggcagucuguuuaugaggaaaaacuuaaacaguuugaagagcgauuagcagaagaaaggcauaaucgauuggaagaacggaaaaggcagcguaaagaagaacgcaggauaacauacuauagagaaaaagaagaggaggagcagagaagggcagaagaacaaaugcuaaaagagcgggaagagagagagcgcgccgaacgagcaaaacgcgaggaagagcuacgagaguaucaggagcgggugaagaaauuagaagaaguggaaaggaaaaaacgccaaagggaguuggaaauugaagaacgagaacggcguagagaggaagagagaagacuuggcgauaguucccuuucuagaaaggacucucguuggggagauagagauucagaaggcaccuggagaaaaggaccugaagcagauucugaguggagaagaggcccgccagagaaggaguggagacguggagaagggcgagaugaggacaggucucauagaagagaugaagagcggccccggcgucugggggaugaugaagauagagagcccucucuuagaccagacgaugaucggguuccccggcguggcauggaugaugacagaggcccuagacgugguccugaggaagauagguucucucgucguggggcagacgaugaccggccuuccuggcguaacacagaugaugacaggccucccagacgaauugccgaugaagacaggggaaacuggcgucaugcggaugaugacagaccaccuagacgaggacuggaugaggacagaggaagcuggcgaacagcugaugaggacagaggaccaagacgugggauggaugaugaccgggggccgaggcgaggaggcgcugaugaugagcgaucauccuggcguaaugcugaugaugaccggggucccaggcgaggguuggaugaugaucggggucccaggcgaggcauggaugaugaccggggucccaggcgaggcauggaugaugaccggggucccaggcgaggcauggaugaugaccggggucccaggcgaggguuggaugaugaucgaggaccuuggaggaacgccgaugaugacagaauucccaggcguggugcagaggaugacaggggcccuuggagaaacauggaugaugaucgccuuucaagacgugcugaugaugaucgguuucccagacggggugaugacucaagaccugguccuuggagaccauuagucaagccagguggauggagagagaaagaaaaagccagagaggagagcugggguccaccucgagaaucaaggccaucagaagaacgugaaugggacagagaaaaagaaagggacagagauaaucaagaucgggaggagaaugacaaggacccugagagagaaagggacagagagagagauguggaucgagaggaucgcuucagaagaccuagggaugaagguggcuggagaagaggaccagcugaggaaucuucaagcuggagagacucaagucgccgggacgauagggauagggaugaccgucgccgugagagggaugaccggcgugaucuaagagaaagacgagaucuaagagacgacagggaccgaagaggaccuccacucagaucagaacgugaagaaguaaguucuuggagacgugcugaugacaggaaagaugaccggguggaagagcgggacccuccucgucgaguuccucccccagcucuuucaagagaccgagaaagagaccgagaccgagaaagagaaggugaaaaagagaaggccucauggagagcugagaaagauagggaaucucuccgucguacuaaaaaugagacugaugaagauggauggaccacaguacgacguuaagucucaagauaauggauuuaaacuggugucuuaaauagguuugaucacauucaaggauuauuauacuugugcuucaaccaaucuaaauuggauucuuuaauguuguuucaccauaacacaaaaagcaugaacuuguauuaauccuauauaauagauugaucaugcaccauauccacaggagguuggaaaaaccaugccauuuucuggaauuuaaggguguugcauuauuucaucaaucauuuguugacaaaaaagaaaaacuaaaaaauaaauuuaaaaugugacccuucagguauugaguaacaccuuuaucuugguauagaacugauacuuuuuuuuugauuuugaaauaucugauaauaauuuggaaugaaguaagguucuguuaaaauauauuugaagacccuuuaaagcagugaaucugaaacaauuuucacacccuuaagugguugauacguaccuauuuuagguauuuugagguauuuaccauaaacuaaauuuagaaauuuuuuagauucacuugaaguaaacauuacaaacauuggauacggugggguuuucuuuagauuuuacuugagagaaggugaguacaaagcaauuugcaguuguuguaaugacaagauuacugcgcaagugugaauccaaacaguauagcuuuuaaauuuuaaagcauuugguaaauuaucgcugaguuuuuuucuguugccaauagcaaacugcuuuuccauuaauggagaauucaugccuuucaagcauuuuaaauaugacaauauuuauaaauguaugguuuggaggaaucguuuaaauucucuuuccuaauuuucuuucuuuugaagauagauucuuucaacaaguaauuuguaguaaugacuguguugacuucaauuuuggagcgcaguagcuauguuaaagaugaacuauuuggucucauugaagccaacacagaacuugcugcuguguuuuuucuucagugauaaauaaaauacuuacagaauuuguuuuaguguugauuugugguuauaguauuuuguuuauaaugguaaguuugcauauucaguugaguuuuuuuuacuugaauuuuuaucagugccauuaaaugucuguguuuaguaucaaugaaaaugaaccuaaauauaacaaagaaagcauauguggcuaggaugucccccuaacaugucuuccuuuguuaaugcag

SEQ ID NO: 78 - RNA, 129 nt, Homo Sapiens
gugcacauuucauugaccugcuuucuuuuaugugaguaguguuauuucuuaugugcuauacaaauaauugaaggcuaauuagcaguauaacuauaaauaguaaugcugccagucuccuucagacaaaaa

SEQ ID NO: 79 - RNA, 4654 nt, Homo Sapiens
gggcgggaagggagucggagacacaacaaagauggcggcggcgacugugacggugacgaagacggcggcggcggcgacggcauuuaacaaggcggugugguuuacuccaugcaguugucaggagucggacggcggcgacgcggcaggacagggcggauaagaaggagcggccggagacuggagcuggguucguggcgggccggcugauccggacggagacucaaccucuguauggcuuuucaauuuuaguugaaauucucucuccauggccuuuuggagucccuugcuguaucuccgaaguaaauuucaauuacucuacauuucaucaauguuggaguggcaagaaaaaggaggaacagauuuggggugaaaaguuuuguuuucuaggucuaacaaacuguaaauguuaaaaaagcaaagaugggugaaaaaaaaccagagccuuuggacuucgugaaagauuuucaggaauaccugacucagcagacccaucacgugaacaugauuucuggaucaguuaguggggacaaagaagcagaggcucuucagggagcuggaacagauggugaucaaaauggacuugaucacccaucuguugaaguuuccuuggaugaaaacucaggaauguuaguagacggguuugaaaggaccuuugaugggaagcuuaagugucgguacugcaacuaugccagcaaaggaacagcccggcuuauugaacacaucagaauccacacaggugaaaaaccucaucgaugucaucuuuguccauuugcaucugcuuaugagcgucaucuggaagcccauaugcguucucauacuggagaaaaaccauacaaaugugaauuauguuccuuccgcugcagugaucgaaguaacuugucccaucaucgaaggcgcaagcauaaaaugguaccaauuaaagguacuaggucuuccuuaagcagcaagaaaaugugggggguuuuacagaagaaaacaagcaaucugggcuauagcagaagagcacuaaucaacuuaaguccaccuuccauggugguucagaaaccagacuaccuuaacgauuuuacccacgaaaucccaaauauccagacugacuccuaugaaaguauggcaaaaaccacaccaacugguggccuuccaagggacccccaagaacucaugguugauaacccuuugaaucagcucucgacucuagcagggcaguuguccagucugccacccgaaaaccaaaacccugcauccccugauguaguucccugcccugaugaaaagccuuucaugauucagcagcccucuacccaagcaguaguuucugccguaucagcaaguauuccucagagcuccucucccacaagcccagaaccucggccaucccauagucaaaggaacuauaguccaguggcagguccaagcagugagccaagugcccacacgagcacucccagcauaggaaacagccagccaagcaccccagccccagcccugccgguccaggacccucagcuucugcaccacugccagcacugugauauguacuuugcagacaacauccuuuacacuauucauaugggaugucauggguaugaaaauccuuuucaguguaauauauguggaugcaaauguaaaaacaaguaugauuuugccugucauuuugcaagagggcaacauaaccaacauugauugaaaauagucauauuuuacuuaguuuugcuguuuuugugguuugguuuuuuuuguuuuuuguuuuggucaucccuaauaaagugucugcuaauucaaggcuuauacauuauauuuauagaauauaaauuugucaguggaauaaaauuuccccuuuuuuucauaaaaaucuggucagggucauuuauauauuagaacaguuagacacauuggugucucuuuuuuccuuuccuuucgacauuggagaauuggagugcagucauaaucuuacaagauguucauuugaauuucucacauuuaugguccauaaaaacuucaaggcuuauccauacuuuugauguuucaauaugcauugaacuggauguuauuucugccauauuucaaaaugguagaauaaauuacagaauuuauuacuacucauuucaguguuuaguacagaaauugccuuaaaaauugcuauuaauugaaauaucauuuaguucacauuccuuaaguugaaucgguaguuucauuucaacugauaauaguaaagcuauuucaguuuaguaaaaauuuucuuuuuuccacaagaggaaauguaaaacaguuaagacuugaaauugaaaauucuuuuaauauuuaaaauaacuuguuuauucaaugucuaaacacaugucaguuuuccacuggauuuuuauuuucacagguaaauacacuagagugcuagaugccuuuuuccccugucaguuugacuuucauuuaaauccuucauucugauaucauuacuguuaggugagguggauaacuauaaugagaaucucuuauucuuccuauuccuuugaugaccaaagagauaaagugaagucauccuuauuauuaaaaugcagccuccaaacaaauuucucaagauuccuuuuccuuccuucuauccauuuucugcccauaauuuccaagaaaagguggguauggaaacacaugagagaaugugauagugaagucauauuuacaaaacugagaacauguccaaaauggauucuugucuccucuucagaauuagccauuuaaaauauuuucugugacuucaaauuguaauucuuauuugcaguuuuaccagucuucauguacagugacgaaacuguguagaaacuaaaucaucgcuuuaguaagaaaggauaaaaagguguggaagugaauauaaaaugcaucuaaacaugacauuuaauuuguuuauaaaaauaagacuuacuaaauauagaguaauucauuuugaauaggaggcuauuguuuuuauauuguguaauaacucacguacucugaagagagcuuggucaaacaauaaaauacauuguuacuaacuugguuucuuuucuguguacuuugcaaaaauucuauuuuuaauuuuguucauauguugaaugugccccuaauuggcaucuuaaagagaauaguaagcaucuauuaaccaaaaaagaacucuaauaguaaaggaaagggaaauauuggugguauguacccacaaaacccccaagugccaaguuaauggaaucucugcuuucccuuucagaugcuagaaagccacuguaaugaguucuugcaguuuagcauccagucuaagcuacugcauuguuuaaagagcagcaucaaggacacuuucuccaaacuggaacucucuucuuugucaaaucuuguacuuuaaaauucuacaauucuguuacauuguuguuuaaaucacagacugcucagauccauuuuacugcaguaguuuccaaguguguaacuuggcuuuaguauuuaucaguugccagaaagaaacagguugucauuuggaaguuuuugugguuauuuuuucccauuuuuauucuucagauaaaagcaguaccccaaaauagaaaaugaaaauuuucaugaaacaaagagaacucccuuguuaaaaccagcuuauuaacucuguauucugucaaaugcauuuuuuucuaacaacugaccauggauguugugaaggugcauuuuaauuuaaacauggaaaagauuuuuuucauaauuacauacuagaauguaaaauuauaauuuugccaugacuuaaagagcacaguugauaucccaaagguuuugaugcuaagaagcuacaguuauucuaaaugcacuaaaauguuugaggcaaaucuaccuuagaggcuuuuuugguaugguauuuuuuaaaauauuuagauuuuauuuaaauuuccugugaguuauucuguauuugaaaagauguucgugucuuccccucuguauugaauguuucacucauuuuauuuuuaaucaaauauuuuauagaaaugaguuguugggaagaguuuaacaugcacuauuuauaguacuuugccguuaacaggcaauguucugaaacuaaauuuauuuuuguucagugaacauaaguuuagauuuuuaaaguugguagauaauuuaucuccacuaauauuuuuuuaagaaacugugaagagauuaacugggaauaauuuuauuucagauuuuacuaauguaguauguagcuacaacuucuugaacuucaaguuaaggcuagacauuuacuuugaaaaaauuccacuggguguuuccagggcuauuucauuuuagaaauaaguguuugccauucuucugcaaaaacuggacaaggggaauacuacaaaaaauacucagagauaaaauccucauuucaaguucuacaaaauauuuaucaaaugaauguuaauuuuuuuuuaauucccugcuaaagacguuuucauuagucuuagaggguauaugcuuucuagaacuuguuuuuguuaacaugugcuuugauguaaagaacauauuuuguaugcaaaacauaacuugcauuaugguuguacaauacacuauauuguuuagggauuccggaaagcaguuuaaugcagaaauaacuauaucuaguaugcaguucauauugugaaugaagcuuugcuuuuguaauaaauaaauaagacuuucuaaugac

SEQ ID NO: 80 - RNA, 5351 nt, Homo Sapiens
gggcgugccacugcccguccgcucuucagcagccggucgcgggcgguggaaaagcgagugaagagagcgcgacggcggcggcggcggcggcgcagcuauugcuggacggccagugggagagcgaggccugagccucugcgucuaggaucaaaaugguuucaaucccagaauacuaugaaggcaagaacguccuccucacaggagcuaccgguuuucuagggaaggugcuucuggaaaaguugcugaggucuuguccuaaggugaauucaguauauguuuuggugaggcagaaagcuggacagacaccacaagagcgaguggaagaaguccuuaguggcaagcuuuuugacagauugagagaugaaaauccagauuuuagagagaaaauuauagcaaucaacagcgaacucacccaaccuaaacuggcucucagugaagaagauaaagaggugaucauagauucuaccaauauuauauuccacugugcagcuacaguaagguuuaaugaaaauuuaagagaugcuguucaguuaaaugugauugcaacgcgacagcuuauucuccuugcacaacaaaugaagaaucuggaaguguucaugcauguaucaacagcauaugccuacuguaaucgcaagcauauugaugaaguagucuauccaccaccuguggaucccaagaagcugauugauucuuuagaguggauggaugauggccuaguaaaugauaucacgccaaaauugauaggagacagaccuaauacauacauauacacaaaagcauuggcagaauauguuguacaacaagaaggagcaaaacuaaauguggcaauuguaaggccaucgauuguuggugccaguuggaaagaaccuuuuccaggauggauugauaacuuuaauggaccaaguggucucuuuauugcggcagggaaaggaauucuucgaacaauacgugccuccaacaaugcccuugcagaucuuguuccuguagauguaguugucaacaugagucuugcggcagccugguauuccggaguuaauagaccaagaaacaucaugguguauaauuguacaacaggcagcacuaauccuuuccacuggggugaaguugguaugauuuuaccuguguuuuugaauguuagaauaaaucuuaaagaaccaaaguaccauguaauuuccacuuucaagaggaauccucucgaacaggccuucagacggcccaauguaaaucuaaccuccaaucaucuuuuauaucauuacuggauugcuguaagccauaaggccccagcauuccuguaugauaucuaccucaggaugacuggaagaagcccaaggaugaugaaaacaauaacucgucuucacaaagcuaugguguuucuugaauauuucacaaguaauucuuggguuuggaauacugagaaugucaauauguuaaugaaucaacuaaacccugaagauaaaaaggcaagcaaucucucaaaaaaaaaaaaaaaccuucaauauugauguacggcaguuacauugggcagaauauauagagaacuacugcuugggaacuaagaaguacguauugaaugaagaaaugucuggccucccugcagccagaaaacaucugaacaaguugcggaauauacguuaugguuuuaauacuauccuugugauccucaucuggcgcauuuuuauugcaagaucacaaauggcaagaaauaucugguacuuugugguuagucuguguuacaaguuuuugucauacuuccgagcauccagcacuaugagauacugaagaccaaggauucagcauuagaacaucuauacauauggugaucuaaauguacaaaauguaaaauguauaagucaucucacuuuuugucaagacauuaaaccaucuuagaucggagugugaaguaaauuaugguauauuuuauguaacauuuuaauguuuaugcucauaaaacuuagugaacacacuguguuaugccagcucaaaucuacaguagccaccaaaaccaugacuuaauauuuugagcccuagaagaaaggggugugcugaggacaagaguggggaaauaggaacacugaccaguauaacugugcaauucuggaacauauuaauuaaaauaauaugccuuaacauauagugaauuucuaauucuaauguucagugcaauggaagacauuuauuuggacaguaauacuagcaaaguugguagauauuugauucuucauuuuuuguuuuuuucauuaguugaaguggguuuuaguuuuguuuaaaauuauaaccagcguauuuucacaucauucuguaaguuaaaugauaucaaacaugaaagagauguucucauuuuucuuuuucugauuaaacgucugaugcauaucauuuuucuauaaguaaucaguugcuuuuaaaaucagaaggcuauauuauucuaaugacccuauucgaucuaaauggguuugagaauccauaucagcaacauacguguuuuuugacagaaagugaaaacaaauuccguaaaacuguuaguaucaaaaagaauaggaauacaguuuucuuuuccacauuaugaucaaauaaaaaucuugugagauuguuuauguuuugaagcaggaggauuucuugagauuugauggaagugggaguugggaaggauucaccauacuuguguucuccucccuuuauaaauuuuauucauaggacuuuuaaaaggcuugugcuaucuuuccagugaaaacugaaagugcauuauuauggaagaauguauuugcagguaguaauagcauuaaaaaauauacucguguguaaacacauacuaauuuugaccuugaaagaugaauuccuucaagaaaaauaaaauaaugcuuaagauaauguguacgaaauuaaauaaaggacuuuauuuacauacuacauaagguagcaaacuguugaaugaguuugaagguaucacuuauuuuuuaugcaugugauuuuagcuuuagaaagaaaugcguuauagaaacaaguaauagcaagaaaauugauguauauuuuaaugauacauuaaaauucccuuuuaaucauaauaguuaacucuacuuacuguuuuaacauacauuugauuuaacaaauuguucagcauaacacuucuaauuaaguuuaucaaguuguacuguauuagauaaucagcaguguaucuggaguauguuuaaagagaacaguucgcaauacaaaaaguuacauggagcuuuacaucuuaacuuucuuugucaauuuaaaugcaauguauaaaaaguuuauuuugcuauugugaaaaacuaaauguaaaggaaaucaccuacuuucaugcagguguauaaucuugaaaaggaaaaaugcuuccauguugaagccagauuuucuguaguaaaacuuuuaaauauuauuuuaaaagaaauauguauauaaauaucucuauauucuuuggaaugauacuaaagucucuggucuaggaccauaccuuauauaaagguauaagagaccaugacaaugucugaaaauggaauagauaaugaugccuuuuauuuaaaguggcccacauaauauacauugaguacuccaucucuccaaauguauuuccauaauguguugaaaacaugcuaacauuuguaugauuuuuauacuucugccgaauagacuuagaaucagaugaauugucugugugucuugcaaaagaguuggggacaacuugggcaggccuaugaagugcauagggaguguaugucuucugaaugguuuuauuguucuuguaaucuagcuuaaagaaauguuaacugggagggugcugaggccacucacugcauuaauuuuguguguuuagaguucuguugucaaaagaaaacuaaugaauaaauuaguuugucauucuagaauuuaaaguucuaagauuaguauaaagaguauauagauuguuaauccccaccagcuagacuuugaacuuaagucagacuuaaagauuugagaaauuauuugugucauuuacuagacgugauuuuuaguucuguuugauuauauuuccuacacaaacuucuuauuuaacaggauagccuacuaaauuaaauguuucuuauuucacuuaacucauuugauuaaacuguauucuaaaacauuugggguuuuucccccuauucaguuuuaaucuuggaauaugcauuuguaaauugugaugucauugagacuauauuuauauuugacuuggcaacauuaacauguccuaagacuuagugcagagaagcuuggcaguacguucuuugacuuaaggauggcauaaaauaaucauuuuugaaccuguguaauaaagcuugaaagcagggaaaagaauuuccuuuucccccuuuuuuguguugucuauaggaauuaacuugggauuguuuuguggguuuuuguuuguuuuaaauguaaauugagaaucuuuuauaagaaauaaaagcauuauugggugccuuuguuuguaaaccaaaaaguaauaaaugaaucccuauauuuccauuauaguauuuauuguauuuuuauguucugaaaauuacccauggaacaauaugcuuaggauuacaggaagcaguccuuacuuacacuucuugucuguuuuagguguacuuguuaauucuuauguccuaauuuuauuuaauucugaguuccuuacacagcauuuuagggaaagaauacaggcaggaugacacuuuguguuaaaguguuauuuuuauguauuaccuggaaugaggcagguuuuuuucuguuuucuaaaaagaguaaccaagauaccuccagggugucauuggguuccagcugcucuccuccacauugaaugauaucuuguuaauuuauaggcacauuugugguaauuuauaugucuauagaguaaguauaagagauaauucauuaguaauaggaauuaacugaccccuuuuggaugggggagagcaucaggcuggggucagguaaguguaaauggccuucugagcaugcucuucuaggcugacucccagcccugacuugaaaccauuagcgcuaacuugcucuguuuugagaaaaacuuuccaaacuuuugcaugagaaacuagaaaaaggaauguaugccacguaacuggauuacagaaaugaguuaauugucucugugauaaaaaaaaaaaaugaaauauuuucuuauugaauuaauauuuuugucuugaagcauuuucuagugauagaauguauuugucuuuuuuccuggugguacccucuuagcauauaucuuugcuauccuuaagauccuaaacaaaucaucuuugucaguuaaguauaguugcgcaaaaauuguuaaauccuuugucuuuauuaaagaaaaauuugaguaacauuaa

SEQ ID NO: 81 - RNA, 1276 nt, Homo Sapiens
gucgcgcggcccaguucccuuuuccggucggcguggucuugcgaguggaguguccgcugugcccgggccugcaccaugagcgucccggccuucaucgacaucagugaagaagaucaggcugcugagcuucgugcuuaucugaaaucuaaaggagcugagauuucagaagagaacucggaagguggacuucauguugauuuagcucaaauuauugaagccugugaugugugucugaaggaggaugauaaagauguugaaagugugaugaacagugugguaucccuacucuugauccuggaaccagacaagcaagaagcuuugauugaaagccuaugugaaaagcuggucaaauuucgcgaaggugaacgcccgucucugagacugcaguuguuaagcaaccuuuuccacgggauggauaagaauacuccuguaagauacacaguguauugcagccuuauuaaaguggcagcaucuuguggggccauccaguacaucccaacugagcuggaucaaguuagaaaauggauuucugacuggaaucucaccacugaaaaaaagcacacccuuuuaagacuacuuuaugaggcacuuguggauuguaagaagagagugaugcugcuucaaaagucaugguggaauugcucggaaguuacacagaggacaaugcuucccaggcucgaguugaugcccacagguguauuguacgagcauugaaagauccaaaugcauuucuuuuugaccaccuucuuacuuuaaaaccagucaaguuuuuggaaggcgagcuuauucaugaucuuuuaaccauuuuugugagugcuaaauuggcaucauaugucaaguuuuaucagaauaauaaagacuucauugauucacuuggccuguuacaugaacagaauauggcaaaaaugagacuacuuacuuuuaugggaauggcaguagaaaauaaggaaauuucuuuugacacaaugcagcaagaacuucagauuggagcugaugauguugaagcauuuguuauugacgccguaagaacuaaaauggucuacugcaaaauugaucagacccagagaaaaguaguugucagucauagcacacaucggacauuuggaaaacagcaguggcaacaacuguaugacacacuuaaugccuggaaacaaaaucugaacaaagugaaaaacagccuuuugagucuuucugauaccugaguuuuuaugcuuauaauuuuuguucuuugaaaaaaaagcccuaaaucauaguaaaacauuauaaacuaaaaaaa

SEQ ID NO: 82 - RNA, 3182 nt, Homo Sapiens
ggaggcugagcgggcggcgcgacgcgggggccgacgggggcgccggguggccgcgccggaagugccuugcgcggcagaggaagcgcagggacagagcggagcaggccgagccggcggaaagggucuuugcugcugcgcccgggcaggggcugccgcggccccaggucccgcuucgagacgcggcgcgguccaggcgggaggcgacucccuaggaagggacccggggcgggaggaggaagugaggccgcgcggaaggaaggcggcgagccccggggccccgaggccuuggccgcgucacagcacccacauggccucuggagugggcgcggccuucgaggaacugccucacgacggcacgugugacgagugcgagcccgacgaggcuccgggggccgaggaagugugccgagaaugcggcuucugcuacugccgccgccaugccgaggcgcacaggcagaaguuccucagucaccaucuggccgaauacguccacggcucccaggccuggaccccgccagcugacggagagggggcggggaaggaagaagcggaggucaagguggagcaggagagggagauagaaagcgaggcaggggaagagagugagucggaggaagagagcgagucagaggaagagagcgagacagaggaagagagugaggaugagagcgaugaggagagugaagaagacagcgaggaagaaauggaggaugagcaagaaagcgaggccgaagaagacaaccaagaagaaggggaauccgaggcggagggagaaacugaggcagaaagugaauuugacccagaaauagaaauggaagcagagagaguggccaagaggaaguguccggaccaugggcuugauuugaguaccuauugccaggaagauaggcagcucaucuguguccuguguccagucauuggggcucaccagggccaccaacucuccacccuagacgaagccuuugaagaauuaagaagcaaagacucagguggacugaaggccgcuaugaucgaauugguggaaagguugaaguucaagagcucagacccuaaaguaacucgggaccaaaugaagauguuuauacagcaggaauuuaagaaaguucagaaagugauugcugaugaggagcagaaggcccuucaucuaguggacauccaagaggcaauggccacagcucaugugacugagauacuggcagacauccaaucccacauggauagguugaugacucagauggcccaagccaaggaacaacuugauaccucuaaugaaucagcugagccaaaggcagagggcgaugaggaaggacccaguggugccagugaagaagaggacacaugaaggcuugcuacccccaguggaaaaucauccccuccccuuguguguaugugacagcguguauguaacggcuucugauuucugugaaagcugcucagcaacaaacguacuuccaccagauguguccccagauccacagcaggcacauaucucuccaagggaugaccaguuuuaugcuuacugugugcuucucauccccugguugugguaggucaaggaaaagagccccuuugauccaccaggagcaauuaagaaagguccuucagguaaucccucaauggcugcuuugaacuuacucaggaaagccagcccccauaauauuguauuaccaaacaguaucgcuuuguuaggaaggaucuggaauaaucuugaagggaagucagaguuuucucccugccuauuaacaaaaacccaauuuuguucauauugaagcaugaaauaaaugagagcaagguagggccaaauuaacucuuguggacagucccuaaaaguccaguucuacauuugugaaaauuguggugccaugaauuaagauggaugacuggaaaaagguguuggagaaagaguuaaagaugaggaagagauauuuuuaguauaugaaguuauccaggacuugauauucauaauucagugcuguggaaaugaaaaaaaugauugaagagguggaacggaaaugaccuuagggggaaaaaaaaggaccaaagaagucugauuaaaaguugaaaucaguauuucugaauucaaauugcuugaauuuccaaaauagucaguaaaggaucuaauagaaccagaauuauuugggugaauucugcagguuuuaugggcuugucacaacgugaagggcuggaauguauauuaccaaaugggaauuuccauuguagguuuuugcuagucccacccccauuuuagccuaauuuggcuuaaacgcaguauggggagaauuguucccauuccauguguucugaauucagcucaucucccagcauauagauauauccuccuuuaacuccgaccagaacccuucuuccuguggcacuccccacccauagaccuucagaucaucucccacacccuggaucucacucuccucuuaguaacagagacacuccugagguuggacuuccuugcuuuucucuacuuccaaaucacaauuucuuacaaccaagcuuugugcucccgaguaagcagggauguacuaggggaauguaaaacugcaaacuuaaaaaccugcaucuucuugaagcaucaguuuuacuuaccaaaugguuuagagucauaagaugaccuauuuuuauauaaaaguuauauuauagaauaaaauguucauacgcauagacuguuaagauaaaaaaauaggaaucuugcaagguaauucuuauuugcaaguggguuauguguucacucuccucuaccuuuaugguauuuugguguucacuuacgaagcauacaacuagaaccauauccaagcagacucuggguugcuguuaacccagggccuagacuucuagugccucugaggcagaaccaaaggagccugcacugggggaaaucccuuuuccugccugccugucugccugugaccuguguacguauuacaggcuuuaggaccagcugauuguuaugcuugcaggaugguuuugaaacagaaacaauacuuguuuacuguaggaauccuauuuauauuauuuuucaguccugugaaugcugugaaaagauuuauuccuuugaggccaggaagcucccaggcauauaugcuucuagguuaggauuguccugacucacuaaagaugccaggauauuggggcugaggggaguuugagguguuaaaaaaaaaaaaaaaaaa

SEQ ID NO: 83 - RNA, 3258 nt, Homo Sapiens
ugagacacucacagguuggguuugaucgcaugcgugucggagaggagagagcagagagagacacaggaacaagaacagcaaaggguagagcagaccugcgccaggggcgcacaacggccguguccaccucccggccccaagauggugcuucccacaggcagccacgcguagcagccagagacagcuccagacauguggcucuucuucgggaucacuggauugcugacggcagcccucucaggucauccaucuccagccccaccugaccagcucaacaccagcagugcagagagugagcucugggagccaggggagcggcuuccgguccgucugacaaacgggagcagcagcugcagcgggacgguggaggugcggcucgaggcguccugggagcccgcgugcggggcgcucugggacagccgcgccgccgaggccgugugccgagcacugggcugcggcggggcggaggccgccucucagcucgccccgccgaccccugagcugccgcccccgccugcagccgggaacaccagcguagcagcuaaugccacucuggccggggcgcccgcccuccugugcagcggcgccgaguggcggcucugcgaggugguggagcacgcgugccgcagcgacgggaggcgggcccgugucaccugugcagagaaccgcgcgcugcgccugguggacgguggcggcgccugcgccggccgcguggagaugcuggagcauggcgaguggggaucagugugcgaugacacuugggaccuggaggacgcccacguggugugcaggcaacugggcugcggcugggcaguccaggcccugcccggcuugcacuucacgcccggccgcgggccuauccaccgggaccaggugaacugcucgggggccgaagcuuaccugugggacugcccggggcugccaggacagcacuacugcggccacaaagaggacgcgggcgcggugugcucagagcaccaguccuggcgccugacagggggcgcugaccgcugcgaggggcagguggagguacacuuccgaggggucuggaacacagugugugacagugagugguacccaucggaggccaaggugcucugccaguccuugggcuguggaacugcgguugagaggcccaaggggcugccccacuccuuguccggcaggauguacuacucaugcaauggggaggagcucacccucuccaacugcuccuggcgguucaacaacuccaaccucugcagccagucgcuggcagccaggguccucugcucagcuucccggaguuugcacaaucuguccacucccgaagucccugcaaguguucagacagucacuauagaaucuucugugacagugaaaauagagaacaaggaaucucgggagcuaaugcuccucauccccuccaucguucugggaauucuccuccuuggcucccucaucuucauagccuucauccucuugagaauuaaaggaaaauaugcccuccccguaauggugaaccaccagcaccuacccaccaccaucccggcagggagcaauagcuaucaaccgguccccaucaccauccccaaagaaguuuucaugcugcccauccagguccaggccccgcccccugaggacucagacucuggcucggacucagacuaugagcacuaugacuucagcgcccagccuccuguggcccugaccaccuucuacaauucccagcggcaucgggucacagaugaggagguccagcaaagcagguuccagaugccacccuuggaggaaggacuugaagaguugcaugccucccacaucccaacugccaacccuggacacugcauuacagacccgccaucccugggcccucaguaucacccgaggagcaacagugagucgagcaccucuucaggggaggauuacugcaauagucccaaaagcaagcugccuccauggaacccccagguguuuucuucagagaggaguuccuuccuggagcagcccccaaacuuggagcuggccggcacccagccagccuuuucagcagggcccccggcugaugacagcuccagcaccucauccggggagugguaccagaacuuccagccaccaccccagcccccuucggaggagcaguuuggcuguccagggucccccagcccucagccugacuccaccgacaacgaugacuacgaugacaucagcgcagccuaggccggggccagccgaggcuccugggguggcucugacccucuggccuccugcucuaccuacucccuuuccccuuucccacccucccagcucaccuccccauggagcugagaggccucccuuggagagauggaaggaaacguuauaccuuguaccccucggucuccauccaucaagccaaaccugcugccacagcccucccccggccccagauagcagccccagggaggaugcugccuccaagaggugugagcccucugucucggggaugaacaagcagagucugggcuaccucuugacagcugguggaggggaguuggggagcuggacuggaugacucuggaggccccuuccaaaccucaaguguccggcgcuuugauugccugaguuucugacacuucagggcccagagguccugcgaggggcagaacuggacccccaugccagugcugcugcaggagggcccauauacuagggucugcugagcuguugucacugaucggugggcgcuggggggguaggguagcacaccagcugucccaggcuuugcuccgggcgguaacugcacuugggcagggaauauagccuuccugggcacaacuagcugacaaugacagguugacuguguacccccaaccaaggagcuggggcccaaggccaguccugccccagagacacuccaaguccgccaggggcacagaccaguucugcagugacugucccuggacaaugggucuuuauucugaguuuccuaugguuuacaaagagggccccagcccagccccaccacagaucccagagauaggggcccagucuccaugggggcaaggagcauagagauguuuuccaggaaggggcucagaagcugcacuaggccccgaguccccaugugucuccuugaauugaugaggaugcuccugggagggaugcgugacuaugugguguugcacccggggcugcaaacgucuccgugcagcccccagagagaggcccaugggcucagaccaggcuuuguuguccugcucugaguauccugagauuaaacugaauugcugaaugaaa

SEQ ID NO: 84 - RNA, 5102 nt, Homo Sapiens
gcaugcgcgcucgcgcucccgcccucuagcugcgcucggcugagucagucagucugucggagucuguccucggagcaggcggaguaaagggacuugagcgagccaguugccggauuauucuauuuccccucccucucucccgccccguaucucuuuucacccuucucccacccucgcucgcguagccauggcggagccgucggcggccacucagucccauuccaucuccucgucguccuucggagccgagccguccgcgcccggcggcggcgggagcccaggagccugccccgcccuggggacgaagagcugcagcuccuccugugcggauuccuuuguuucuuccucuuccucucagccuguaucucuauuuucgaccucacaaggcaagucuguacugacuugggcaacagcagugacuacaagugccauacugaccaauuggaagagucuuugcuuaucggagcuguucuaaaaggcuuauuaguuuuuggucuucauucuauuuaaagggauugagcucucuuugcucugaugagccaucuucagaaauuaugacuucuuccuuucuuucaucuucugaaauacauaacacuggccuuacaauacuacauggagaaaaaagccauguguuagggagccagccuauuuuagccaaagaaggaaaagaccacuuggaucuucuagauaugaaaaagauggaaaagccucaggggaccagcaacaacguaucagacucuucaguuucucuugcagcaggaguucauugugaccguccuucuauuccagccaguuucccagagcauccugcuuuucucucaaagaaaauuggucaaguggaagagcaaauagauaaagagaccaagaacccaaaugggguaucaaguagggaggcuaaaacugcauuggaugcugaugacagauucacuuugcugacagcccagaaaccaccuacugaguacucuaagguagaaggcauuuauacauauucuuugucuccauccaaaguuucaggagaugauguuauugaaaaggauuccccugaaucaccauuugaaguaauuauugacaaagcagcauuugacaaagaauuuaaagacucauauaaggagagcacagaugauuuugguagcuggucugugcacacugauaaagaaucauccgaagacauuucagagacuaaugacaagcuuuuuccacugagaaauaaagaggcaggacguuacccaaugucugcauugcucaguaggcaguuuucacacacaaaugcagcacuggaagagguguccagaugcgugaaugauaugcauaacuuuacuaacgaaauacugacuugggaucugguuccccaagugaaacaacagaccgauaaaucuucugacugcaucacaaaaacuacaggacuugacaugagugaauauaauucagaaauuccaguuguaaaucuuaaaacuagcacucaucagaaaacuccuguauguucuauugaugggagcacucccaucacuaaaucaacaggugauugggcagaagcaucucuccagcaagaaaaugcuauuacuggaaaaccuguaccugacucuuugaauuccacaaaagaauucaguaucaaaggugugcaaggcaauaugcagaaacaggaugacacacuugcagaauuaccuggaucuccaccugagaaaugugacucuuuggguucuggaguggccacagugaaagugguuuuaccugaugaccaccugaaagaugaaauggacuggcagagcucugcauugggagaaaucacagaagcugauaguucuggugagucugaugacacaguaauagaggacaucacagcagauacaucauuugaaaauaacaaaauucaggcugaaaaaccuguuuccauuccaagugcuguuguaaaaacaggugaaagagaaaucaaagagauucccaguugugagagagaagaaaaaacaucuaaaaacuuugaagaauuggucagugacucugagcugcaucaagaucagccugauauucuuggaaggaguccagcuagugaggcagcauguucaaaaguacccgauacgaaugucuccuuagaagaugugagugaaguugcuccugaaaagccuauuacuacugagaaccccaaacuuccuucaacagugucuccaaauguuuuuaaugagacagaauucucauuaaaugugacaacaucugccuauuuggagucauuacaugggaaaaauguuaaacauauagaugauuccuccccagaggaccugauagcagccuuuacagaaaccagagauaaaggaauaguagauagugaaagaaaugcuuuuaaagcaauaucagagaagaugacagacuuuaaaacaacuccuccuguagaagucuuacaugaaaaugaguccggugguucugaaauuaaagacauuggaagcaaauacagugaacaaagcaaagaaacaaauggaagugagccucuagguguuuucccuacccaagguacuccaguagcaucucuugacuuagaacaagaacagcucacaauuaaggcucuuaaagaauuaggugaaagacagguugagaagucaacuucugcacagcgugacgcagaauugccuucugaagaaguacugaagcaaacuuucacauuugcuccagaaucuuggccacagagaucauaugacauccuagaacguaaugucaagaauggaucugaucuugggauuucccagaagcccaucacuaucagagaaacuacuaggguagaugcuguuuccagccuuagcaagacugaauugguaaaaaagcauguccuagcaagacuucugacagacuucucagcuugcacgaucugauuuucuggagagaugugaagaagacuggguuugucuuuggcaccacgcugaucaugcugcuuucccuggcagcuuucagugucaucagugugguuucuuaccucauccuggcucuucucucugucaccaucagcuucaggaucuacaaguccgucauccaagcuguacagaagucagaagaaggccauccauucaaagccuaccuggacguagacauuacucuguccucagaagcuuuccauaauuacaugaaugcugccauggugcacaucaacagggcccugaaacucauuauucgucucuuucugguagaagaucugguugacuccuugaagcuggcugucuucauguggcugaugaccuauguuggugcuguuuuuaacggaaucacccuucuaauucuugcugaacugcucauuuucagugucccgauugucuaugagaaguacaagacccagauugaucacuauguuggcaucgcccgagaucagaccaagucaauuguugaaaagauccaagcaaaacucccuggaaucgccaaaaaaaaggcagaauaaguacauggaaaccagaaaugcaacaguuacuaaaacaccauuuaauaguuauaacgucguuacuuguacuaugaaggaaaauacucagugucagcuugagccugcauuccaagcuuuuuuuuuaauuugguguuuucucccauccuuucccuuuaacccucaguaucaagcacaaaaauugauggacugauaaaagaacuaucuuagaacucagaagaagaaagaaucaaauucauaggauaagucaauaccuuaauggugguagagccuuuaccuguagcuugaaaggggaaagauuggagguaagagagaaaaugaaagaacaccucuggguccuucuguccaguuuucagcacuagucuuacucagcuauccauuauaguuuugcccuuaagaagucaugauuaacuuaugaaaaaauuauuuggggacaggagugugauaccuuccuugguuuuuuuuugcagcccucaaauccuaucuuccugccccacaaugugagcagcuaccccugauacuccuuuucuuuaaugauuuaacuaucaacuugauaaauaacuuauaggugauagugauaauuccugauuccaagaaugccaucugauaaaaaagaauagaaauggaaagugggacugagagggagucagcaggcaugcugcgguggcggucacucccucugccacuauccccagggaaggaaaggcuccgccauuugggaaagugguuucuacgucacuggacaccgguucugagcauuaguuugagaacucguucccgaaugugcuuuccucccucuccccugcccaccucaaguuuaauaaauaagguuguacuuuucuuacuauaaaauaaaugucuguaacugcugugcacugcuguaaacuuguuagagaaaaaaauaaccugcaugugggcuccucaguuauugaguuuuugugauccuaucucagucugggggggaacauucucaagaggugaaauacagaaagccuuuuuuucuugaucuuuucccgagauucaaaucuccgauucccauuugggggcaaguuuuuuucuucaccuucaauaugagaauucagcgaacuugaaagaaaaaucaucugugaguuccuucagguucucacucauagucaugauccuucagagggaauaugcacuggcgaguuuaaaguaagggcuaugauauuugauggucccaaaguacggcagcugcaaaaaguaguggaaggaaauugucuacgugucuuggaaaaauuaguuaggaauuuggauggguaaaagguacccuugccuuacuccaucuuauuuucuuagcccccuuugaguguuuuaacugguuucauguccuaguaggaagugcauucuccauccucauccucugcccucccaggaagucagugauugucuuuuugggcuuccccuccaaaggaccuucugcaguggaagugccacauccaguucuuuucuuuuguugcugcuguguuuagauaauugaagagaucuuugugccacacaggauuuuuuuuuuuuuuuaagaaaaaccuauagaugaaaaauuacuaaugaaacuguguguacgugucugugcgugcaacauaaaaauacaguagcaccuaaggagcuugaaucuugguuccuguaaaauuucaaauugaugugguauuaauaaaaaaaaaaaaaacacaaacaa

SEQ ID NO: 85 - RNA, 3545 nt, Homo Sapiens
cgggagauucgauuggaaggcugccggcgugcuacugaguucggccgguccgagucacugugcgucgccugggcccguuccuggucuucucccccagggucuugcucugucacccaggcuggagugccauggcaucaucauagcucacuauggccuugauccuccugccuuagccucccaagcagcugguauuacaguuguuuugcagaccacggugugaacacaugaacagaagacgaaaauuucuucuagccucaguacuugcucuccagaauucaaguuuuauauauccaucaugucagaagugcuucucuaggauaauccuggucuccaaaaggucuaauuguccaaaauguggcucuacuggugaaucuggaaaugccaauuacagauacaaacuuuccuuaaaaguugcagaaucaaacaaauuguuuguuauuacuguauuuggaaguugcuuagauacauuuuuuggucuuacugccacugguuugcacagguacauucaggauccuaauaaaauuccagaaacacuggacaaugauacaacucagaaucuauuaacuaaagcaguugaaacuugcuuuguuggacaaagcuuuauuuuuggagugacgaauuuugaaaaccaaccuggacaagguucagaugccaguaacuucuuacagcaaugcucugaccacaaaagaaaagccaaagcacuaguggcuugccagauuguucuaccagacccagguauugcaggcuuuacugucauugacuacuuccaucaacuuuugcagacuuuuaauuucaggaaacuucagugugacucucaggcaccuaacaaucacuuacuugcuuuagaucacucaaauagugaucucagcagcauauauacuucugacagcacuucugauuuuuucaaguccugcagcaaggauacuuuuucaaaauucuggcagccaucacuugaauucacuugcauuguuucacaacuaacagauaaugaugauuuuucagcuucagaacaaaguaaggccuuugguacucuucagcagaacagaaaguccaucuccauugcagaggccacugguuccaguagcugccaugaucccauucaggauucauggagccuuguuucauauauggauaaaaagaguacagcagaaaaguuggguaaagaacuuggcuuacaagcuaaggagcugagugcaguucacagcagucaucaugaaauuggaguuaaugacucuaauuuauucucuuuggaaaugcgagagccccuugagucaaguaauacaaaauccuuccacagugcaguggaaauuaaaaauaggucccagcaugagcuaccauguuuucagcaucaugguauagauaccccaacuagccuucagaagagaucugcauguuguccaccuucguuacucagacuugaagagacagccagcaguucccaggauggugacccucaaauuugggaugaucugccauucucugaaagccugaacaaguuucuggcaguucuugaaagugagauugcuguaacccaggcagaugucaguaguaggaaacaucauguagauaaugacauugauaaauuucaugcagaccacagcagguuaucugugacuccccagagaacuacuggagcccugcauacaccaccuauagcuuuaagaucaucacaaguaauagucaaagcaaacuguagcaaagaugacuuccuuuucaacuguaaaggaaaucuaaguccuaguguugaaaaggagucacaaccagauaacaaaguagaggcugucucuguaaaucauaauggaagagauaugucagaauauuuuuuaccgaauccuuaccugucagcucugucuucaucuucaaaagauuuagaaacaauaguuacucuuaagaagacuaucagaaucucaccacacagggagagugaccauucuagucuaaauaacaaauauuugaauggauguggagaaauaucaguuucagaaaugaaugaaaaguugacaacucuguguuauaggaaguauaaugaugucucugaucuuugcaaauuagaaaauaaacaauauuguaggugguccaagaaccaagaugacaguuuuacaauuugcaggaaacuuacauauccuuuagaaacucuuugcaauaguccaaauagaaguacaaauacauugaaagaaaugccuuggggacauaucaauaacaacguaacacagagcuauucuauugguuaugaagguagcuaugaugccucugcugaucucuuugaugauauugcuaaagaaauggacauugcaacugagauuaccaaaaaaucacaggauauuuuguuaaaauggggaacaucuuuggcagaaagucacccuucagagucugauuuuucacugagaucacuuucugaagacuucauccagccuucacaaaaauuauccuugcaaagccuaucugacucuaggcauucaagaacaugcucuccaacaccucauuuucaaucagauucagaauauaauuuugaaaauagucaagacuuuguuccauguucacagucaacuccaauuucaggguuccaccaaacaagaauucaugggauaaacagagcuuucaaaaaaccuguauuuuauucagaucuugaugguaacuaugaaaaaauaaggauuuucccugaaaaugacaaacagcaagccagcccaagcuguccaaaaaauauaaaaacaccuagccagaaaaucagaagcccuauuguaucugguguuucacaaccagacguuuucaaucacuacccuuuugcugagugccaugaaacugauagugaugaaugggucccuccuaccacacaaaaaauauuuccuucagauaugcuuggauuccaaggcauaggucuagggaaaugccuugcugccuaucauuucccugaucaacaagaguuaccaagaaagaaacugaaacauauuagacaaggaaccaauaaagguuuaauuaagaagaaauuaaagaauaugcuugcagcaguuguuacgaaaaagaaaacucauaaauauaacuguaaaaguucaggcuggauuuccaaauguccagacauucaagucuuagcagcaccucagcugcacccuauucuuggaccugauucuuguucagaagucaaauguugccuuccauuuucagaaaaaggcccaccuucagugugugaaacucgaagugcuuggucaccugaauuguuuucauaaaaagucaccugaacccaauuccugaacuuuuaaaucuguuuggaaauguuugccuucagggguacggaaagcauucuuuacauuuugaacacuuggagagaagcaaauugaaaacaggacucugcugggagcuacugugccuuuuaaaauauaaagccauuguuuuccccaggguuuuaucuagaauacuaugauuagguaguugagcacuuuaucuuauacuguuuauuguacuuuaauaauauuguuaagauuguuuuugaaaguauuaauguuuguuaaaaucacauauacauccagaaauaaagacuuugcaaaccaaaa

SEQ ID NO: 86 - RNA, 105 nt, Homo Sapiens
augcuggcuucggcagcacauauacuaaaaauuggaaugauacggagaagauuagcauggccccugcacaagaaugacacacaaauucaugaaguguuccauauu

SEQ ID NO: 87 - RNA, 4210 nt, Homo Sapiens
ggauggggcggcgggcuucgggagcgcccgggcugauccgagccgagcgggccguaucuccuugucggcgccgcugauucccggcucugcggaggccucuaggcagccgcgcagcuuccguguuugcugcgcccgcacugcggagugcugcuccuuccgggcucgggcggcguggggcggguggggacgcgagggcccgcgggggcccacuucccugauguggcggcgaacgaggaaggacggggccugaggcccuucggccaagggucgagggucgccgggggcucucugcuuucuacucucgccaagguuuuauuggauucggaagccccaacuucgagacuugcagucaaagcgauuuuuaaaaugacuuguuuucaagccucuggccgccgcccacucuucuggcccuuggacuuugaccaagauguuuucucgcaguuuuugcaagguuuuaaacuuagcccucggcguucuuuuaauguaauacauugaaacgaagauauuucgguggcggcgauauuucauauuucauaguugccacugcgcucugucauuccaguagucgucuguuguguauugugagaagcaacucugggaaauuauuggauuuacaacccugaagaaucucccuaucccuauuuugucccccugcaguaauaaaucccauuauggagaucucgaaacuuuauaaagggauauaguuugaauucuauggaguguaauuuuguguaugaauuauauuuuuaaaacauugaagaguuuucagaaagaaggcuaguagaguugauuacugauacuuuaugcuaagcaguacuuuuuugguaguacaauauuuuguuaggcguuucugauaacacuagaaaggacaaguuuuaucuugugauaaauugauuaauguuuacaacaugacugauaauuauagcugaauaguccuuaaaugaugaacagguuauuuaguuuuuaaaugcaguguaaaaagugugcuguggaaauuuuauggcuaacuaaguuuauggagaaaauaccuucaguugaucaagaauaauagugguauacaaaguuaggaagaaagucaacaugaugcugcaggaaauggaaacaaauacaaaugauauuuaacaaagauagaguuuacaguuuuugaacuuuaagccaaauucauuugacaucaagcacuauagcaggcacagguucaacaaagcuuguggguauugacuucccccaaaaguugucagcugaaguaauuuagcccacuuaaguaaauacuaugaugauaagcugugugaacuuagcuuuuaaauagugugaccauaugaagguuuuaauuacuuuuguuuauuggaauaaaaugagauuuuuuggguugucauguuaaagugcuuauagggaaagaagccugcauauaauuuuuuaccuuguggcauaaucaguaauuggucuguuauucaggcuucauagcuuguaaccaaauauaaauaaaaggcauaauuuagguauucuauaguugcuuagaauuuuguuaauauaaaucucugugaaaaaucaaggaguuuuaauauuuucagaagugcauccaccuuucagggcuuuaaguuaguauuacucaagauuaugaacaaauagcacuuagguuaccugaaagaguuacuacaaccccaaagaguuguguucuaaguaguaucuugguaauucagagagauacucauccuaccugaauauaaacugagauaaauccaguaaagaaaguguaguaaauucuacauaagagucuaucauugauuucuuuuugugguaaaaaucuuaguucaugugaagaaauuucaugugaauguuuuagcuaucaaacaguacugucaccuacucaugcacaaaacugccucccaaagacuuuucccaggucccucguaucaaaacauuaagaguauaauggaagauagcacgaucuugucagauuggacaaacagcaacaaacaaaaaaugaaguaugacuuuuccugugaacucuacagaaugucuacauauucaacuuuccccgccggggugccugucucagaaaggagucuugcucgugcugguuuuuauuauacuggugugaaugacaaggucaaaugcuucuguuguggccugaugcuggauaacuggaaacuaggagacaguccuauucaaaagcauaaacagcuauauccuagcuguagcuuuauucagaaucugguuucagcuagucugggauccaccucuaagaauacgucuccaaugagaaacaguuuugcacauucauuaucucccaccuuggaacauaguagcuuguucagugguucuuacuccagccuuucuccaaacccucuuaauucuagagcaguugaagacaucucuucaucgaggacuaaccccuacaguuaugcaaugaguacugaagaagccagauuucuuaccuaccauauguggccauuaacuuuuuugucaccaucagaauuggcaagagcugguuuuuauuauauaggaccuggagauaggguagccugcuuugccuguggugggaagcucaguaacugggaaccaaaggaugaugcuaugucagaacaccggaggcauuuucccaacuguccauuuuuggaaaauucucuagaaacucugagguuuagcauuucaaaucugagcaugcagacacaugcagcucgaaugagaacauuuauguacuggccaucuaguguuccaguucagccugagcagcuugcaagugcugguuuuuauuaugugggucgcaaugaugaugucaaaugcuuuuguugugaugguggcuugagguguugggaaucuggagaugauccauggguagaacaugccaagugguuuccaaggugugaguucuugauacgaaugaaaggccaagaguuuguugaugagauucaagguagauauccucaucuucuugaacagcuguugucaacuucagauaccacuggagaagaaaaugcugacccaccaauuauucauuuuggaccuggagaaaguucuucagaagaugcugucaugaugaauacaccugugguuaaaucugccuuggaaaugggcuuuaauagagaccuggugaaacaaacaguucaaaguaaaauccugacaacuggagagaacuauaaaacaguuaaugauauugugucagcacuucuuaaugcugaagaugaaaaaagagaagaggagaaggaaaaacaagcugaagaaauggcaucagaugauuugucauuaauucggaagaacagaauggcucucuuucaacaauugacaugugugcuuccuauccuggauaaucuuuuaaaggccaauguaauuaauaaacaggaacaugauauuauuaaacaaaaaacacagauaccuuuacaagcgagagaacugauugauaccauuuugguuaaaggaaaugcugcggccaacaucuucaaaaacugucuaaaagaaauugacucuacauuguauaagaacuuauuuguggauaagaauaugaaguauauuccaacagaagauguuucaggucugucacuggaagaacaauugaggagguugcaagaagaacgaacuuguaaaguguguauggacaaagaaguuucuguuguauuuauuccuuguggucaucugguaguaugccaggaaugugccccuucucuaagaaaaugcccuauuugcagggguauaaucaaggguacuguucguacauuucucucuuaaagaaaaauagucuauauuuuaaccugcauaaaaaggucuuuaaaauauuguugaacacuugaagccaucuaaaguaaaaagggaauuaugaguuuuucaauuaguaacauucauguucuagucugcuuugguacuaauaaucuuguuucugaaaagaugguaucauauauuuaaucuuaaucuguuuauuuacaagggaagauuuauguuuggugaacuauauuaguauguauguguaccuaagggaguagugucacugcuuguuaugcaucauuucaggaguuacuggauuuguuguucuuucagaaagcuuugaauacuaaauuauaguguagaaaagaacuggaaaccaggaacucuggaguucaucagaguuauggugccgaauugucuuuggugcuuuucacuuguguuuuaaaauaaggauuuuucucuuauuucucccccuaguuugugagaaacaucucaauaaagugcuuuaaaaaga

SEQ ID NO: 88 - RNA, 4068 nt, Homo Sapiens
gcuuggggccgccaucuuggcaagaggcgaagcggcagcgguuccugucaagggggcagcagguccagagcugcuggugcucccguuccccagacccuaccccuauccccaguggagccggagugcgggcgcgccccaccaccgcccucaccaugauaacuugauuuaaaacaucguccaguguaccugagagauggcagaauguaauuugguggcaauccuaauaaguucuauugacaacccuuuagauaagaacuuggauaauggggggaauucaugcuuggacuuuaggccacugaacagcuuuucucagccucaggugcuguuggcagcagcggucugcacaaaagcaggaaaggcuauuguuucucgacaguuuguggaaaugacccgaacucggauugagggcuuauuagcagcuuuuccaaagcucaugaacacuggaaaacaacauacguuuguugaaacagagaguguaagauaugucuaccagccuauggagaaacuguauaugguacugaucacuaccaaaaacagcaacauuuuagaagauuuggagacccuaaggcucuucucaagagugaucccugaauauugccgagccuuagaagagaaugaaauaucugagcacuguuuugauuugauuuuugcuuuugaugaaauugucgcacugggauaccgggagaauguuaacuuggcacagaucagaaccuucacagaaauggauucucaugaggagaagguguucagagccgucagagagacucaagaacgugaagcuaaggcugagaugcgucguaaagcaaaggaauuacaacaggcccgaagagaugcagagagacagggcaaaaaagcaccaggauuuggcggauuuggcagcucugcaguaucuggaggcagcacagcugccaugaucacagagaccaucauugaaacugauaaaccaaaaguggcaccugcaccagccaggccuucaggccccagcaaggcuuuaaaacuuggagccaaaggaaaggaaguagauaacuuuguggacaaauuaaaaucugaaggugaaaccaucauguccucuaguaugggcaagcguacuucugaagcaaccaaaaugcaugcuccacccauuaauauggaaaguguacauaugaagauugaagaaaagauaacauuaaccuguggacgagacggaggauuacagaauauggaguugcauggcaugaucaugcuuaggaucucagaugacaaguauggccgaauucgucuucauguggaaaaugaagauaagaaaggggugcagcuacagacccauccaaauguggauaaaaaacuuuucacugcagagucucuaauuggccugaagaauccagagaagucauuuccagucaacagugacguaggggugcuaaaguggagacuacaaaccacagaggaaucuuuuauuccacugacaauuaauugcuggcccucggagaguggaaauggcugugaugucaacauagaauaugagcuacaagaagauaauuuagaacugaaugaugugguuaucaccaucccacucccgucuggugucggcgcgccuguuaucggugagaucgauggggaguaucgacaugacagucgacgaaauacccuggaguggugccugccugugauugaugccaaaaauaagaguggcagccuggaguuuagcauugcugggcagcccaaugacuucuucccuguucaaguuuccuuugucuccaagaaaaauuacuguaacauacagguuaccaaagugacccagguagauggaaacagccccgucagguuuuccacagagaccacuuuccuaguggauaaguaugaaauucuguaauaccaagaagagggagcugaaaaggaaaauuuucagauuaauaaagaagacgccaaugauggcugaagaguuuuucccagauuuacaagccacuggagaccccuuuuuucugauacaaugcacgauucucugcgcgcaaggacccucgacucacccccauguuucagugucacagagacauucuuugauaaggaaauggcacaaacauaaagggaaaggcugcuaauuuucuuuggcagauuguauuggccagcaggaaagcaagcucuccagagaaugcccccaguuaaauaccuccucuaccuuuaccuaaguugcuccuuuauuuuuauuuuauuauuauuauuauuauuauuauuauuuuuugagauggagucucacuuuguaacccaggcuggaaugcaauggcaugaucucagcucacugcaaccuccgccuccuggguucaagcaagucuccugccucagccuccgaguagcugggacuacaggugcacgccaccacgccuggcuaauuuuuuguauuuuaguagagacgggguuucaccguguugcccaggcuggucgcgaacuccugagcucaggcaauccgcccaccucagccucccaaaguguugggauuacaggcaugagccaccaugcccagcugcuccuuuauuuuaaucccuaaauauaaucccuaaauauaguuauauuucauacuuaguuuguuuuuaaaaaguuuucucuguagaaaauuuuaaucauucauacccuuuaccuuuagguuuuucuuucuauacauucagucaggcacugggaucaucuguuuacaggcauuauauuuauuuggcacuccuggaacaaguauaucuaacccauucuugauuuuuggacuauucaggugaacuauuugagggguauggggucuagaaguuaaaagauacgcaugucuucuguucuuuucccguaucaauucauuccuucaucucuuugccaaguuguuuuccuuucagggccuguccuuccaguuuagaacaguaccaugaaucccacuugugucaauauuaaagauagcugagaagcaccuuucaaauggcacagucccucuucaagaugucuaaaagaaugguuaugucuguccaguuagggauuucacauccacauguaaucaugucugcugcuguugcuacccaaauuuucauuucuccacauuuuggguacuuaagcuaaaacguaauggccacagucuguaauccauucacauuccucaguuucaccaccucccucuuccagacugcacucucugucaucaguccccuccuuucuaacagaaaugggguuaugauuuugaaggcuguggguucagggagucuuugccaauccuguuggcccuaaacuaucaaggaggcuccauuucaccauuugauuuuuugcauuucaggaggcaacugauuguuucgauauguacauauuacucacguauaccccauuuccuuccagucagcccaacauuuuccaccagucuguccccaucucugaaauccuuccuucucuuucccccuaagucuuuugagugucaucauguacuggugguuucucgguuccaucucauccauuuccuuuucaauggagacuacagcgucagccagcucagccuuggcuuuuaacucaauauuccaguccauaggggugguuaaaaguugcugcaaggcugcaggcacuggcagugggaagaggcagacgacuagaugacuucugcacuuuuagcugguugaaaaguaccacucccacucugaacaucuggccgucccugcaaagaguguacugugcuugaagcagagcacucacacauaaauggcuguguguggaauugcuugccaaagaaguuucuagccuuucccuuuccccuaacugcaucagggaagaauucuuaucucuagcuugguuuccacaugagguuuuucugagaagggcuugggacaagaagucugucauguuaguuaagcaggcaagaaauccuacuaauccaguuuuguuugaaaguuguuuguccguaugauuuuuuaaaagucaaguuuaauuucaaaaaaccuuuuuuuucugagauuacuuuugggguaauauuuaaaaugagagacauuuuguaacccuguaaaauacauagggaauauaacauuccaguguauacaaagaaggcaaauucuuuaaucaaauaaagcgcauuauaaaaugaga

SEQ ID NO: 89 - RNA, 1601 nt, Homo Sapiens
ccggaagugacgcgaggcucugcggagaccaggagucagacuguaggacgaccucgggucccacguguccccgguacucgccggccggagcccccggcuucccggggccgggggaccuuagcggcacccacacacagccuacuuuccaagcggagccaugucugguaacggcaaugcggcugcaacggcgaguguccugguuacugcagcggcagcaacagcagguccuacuaucgccucccucuagucucugcuucucuggaucccugaggagggcagaaggaagaaaacagcccaaagaugagagugauucgcguggguacccgcaagagccagcuugcucgcauacagacggacagugugguggcaacauugaaagccucguacccuggccugcaguuugaaaucauugcuauguccaccacaggggacaagauucuugauacugcacucucuaagauuggagagaaaagccuguuuaccaaggagcuugaacaugcccuggagaagaaugaaguggaccugguuguucacuccuugaaggaccugcccacugugcuuccuccuggcuucaccaucggagccaucugcaagcgggaaaacccucaugaugcuguugucuuucacccaaaauuuguugggaagacccuagaaacccugccagagaagaguguggugggaaccagcucccugcgaagagcagcccagcugcagagaaaguucccgcaucuggaguucaggaguauucggggaaaccucaacacccggcuucggaagcuggacgagcagcaggaguucagugccaucauccuggcaacagcuggccugcagcgcaugggcuggcacaaccggguggggcagauccugcacccugaggaaugcauguaugcugugggccagggggccuugggcguggaagugcgagccaaggaccaggacaucuuggaucuggugggugugcugcacgaucccgagacucugcuucgcugcaucgcugaaagggccuuccugaggcaccuggaaggaggcugcagugugccaguagccgugcauacagcuaugaaggaugggcaacuguaccugacuggaggagucuggagucuagacggcucagauagcauacaagagaccaugcaggcuaccauccaugucccugcccagcaugaagauggcccugaggaugacccacaguugguaggcaucacugcucguaacauuccacgagggccccaguuggcugcccagaacuugggcaucagccuggccaacuuguugcugagcaaaggagccaaaaacauccuggauguugcacggcagcuuaacgaugcccauuaacugguuuguggggcacagaugccuggguugcugcuguccagugccuacaucccgggccucagugccccauucucacugcuaucuggggagugauuaccccgggagacugaacugcaggguucaagccuuccagggauuugccucaccuuggggccuugaugacugccuugccuccucaguaugugggggcuucaucucuuuagagaaguccaagcaacagccuuugaauguaaccaauccuacuaauaaaccaguucugaaggugu

SEQ ID NO: 90 - RNA, 58 nt, Homo Sapiens
aagauuagcacagacccugcgcaaagauaacacgcaaauucgugaagcguuccauauu

SEQ ID NO: 91 - RNA, 792 nt, Homo Sapiens
cgcggcgcgagcggaagcggaagcggcucuguucgccgccucucccaccggcccgaugagcugcagcggcuccggcgcggaccccgaggcggcgccggccuccgccgccucggccccgggccccgcgcccccggucucggcucccgccgcgcugcccuccagcaccgccgcggagaacaaggccagccccgcggggacagcggggggaccuggggcuggagcagcugcugggggcacgggacccuuggcggcgcgggccggggagccagcugagcggcguggggcggcuccggugucggcggguggcgcggcgcccccggagggggccauaucuaacgggguuuacguacugccgagcgcggccaacggagacgugaagcccgugguguccagcacgccuuugguggacuucuugaugcagcuggaagauuacacgccuacgaucccagaugcagugacugguuacuaccugaaccgugcuggcuuugaggccucagacccacgcauaauucggcucaucuccuuagcugcccagaaauucaucucagauauugccaaugaugcccuacagcacugcaaaaugaagggcacggccuccggcagcucccggagcaagagcaaggaccgcaaguacacucuaaccauggaggacuugaccccugcccucagcgaguauggcaucaaugugaagaagccgcacuacuucaccugagccacccaaccuaaauguacuuaucuguccccauguccccacaccagccuguuuucauaauaaacuuuauugugacaggc

SEQ ID NO: 92 - RNA, 71 nt, Homo Sapiens
guuuauguagcuuacuuccccaaagcaauacacugaaaauguuucgacgggcucauaucaccccauaaaca

SEQ ID NO: 93 - RNA, 4084 nt, Homo Sapiens
gaggugcgaccgggucccggccugagucgcggccacccgcaggucugagcugugggcugaggcagcgcagccgcugccgcagggugcgcgaugccuugaaccugggaaacuaugugaagcaacacucuggauuuugaaagacaucuuuucaucaugggacagcaaauuucggaucagacacaguugguuauuaacaaguuaccagaaaaaguagcaaaacauguuacguugguucgagagaguggcuccuuaacuuaugaagaauuucuugggagaguagcugagcuuaaugauguaacggcuaaaguggcuucuggccaggaaaaacaucuucucuuugagguacaaccugggucugauuccucugcuuuuuggaaagugguuguacggguggucuguaccaagauuaacaaaagcaguggcauuguggaggcaucacggaucaugaauuuauaccaguuuauucaacuuuauaaagauaucacaagucaagcagcaggaguauuggcacagagcuccaccucugaagaaccugaugaaaacucauccucuguaacaucuugucaggcuagucuuuggaugggaagggugaagcagcugaccgaugaggaggaguguuguaucuguauggaugggcgggcugaccucauccugccuugugcucacagcuuuugucagaaguguauugauaaauggagugaucgacacaggaauugcccuauuugucgccuacagaugacuggagcaaaugaaucuugggugguaucagaugcacccacugaagaugauauggcuaacuauauucuuaacauggcugaugaggcaggccagccccacaggccaugaccuugaagugaaagucuucuguugcuauugugggcucaaauauuuggucaugggggaagaauguaggguuguggcacuggcacagacacaggaaaauccauuuuccccacucuuuuauuuuugcuauucugaucauuugucccccuuuuaaaaauaaacuucccaugucuuccauuugugguacuaaaauuugcuacuguuuuagaccauauuuuccuauuauuuaucuguucaaauuuguauuauuacaacuaauagcucuugaauucuuugcuaaagguaacagcaacacuuccagaggcuucuaaaacacuacuguuuugcagggcaggaguauucuggaaucuuuuuacuuagauauaaaauaaaccucgaauauuaaaaaguuguagccaucugagagaggaaaguuuaagugacugaaaauguagaauacuucaacgugcauguuacuacuuaaaacuagucuuucugcuggaaucuaaggaguauauauauauaugcccccuugugguuaauuauugcuccuuuaauaauuuuuacuugaaaugauccacaauuauuucauaacuuuagcaguguguuuuggaacuacuguacuuaaagguuuguuuguuuguuuuugccauacuguauaauuugggugaggucuacaaaauugggugugacuuuccuuugcaaauggauuucuccuggggaauuuucuuggcuguucuggaaaugcuuucccacagcuggguaacuguucuaaauggcuuugauaaugcucacacaucuuggaguuucagaaggaaauuauucugcaucacaaauacuaaauuuuauauuucuaaauuacuauaggucauuuaauauugguuuauggugcuuuuauuuccuuaacuugaaaacaucuuucugagauuucagaguccucaaauuucuuagauuaagagacaagaggccagugcagugguucacaccuguaaucccagcacuuugggaggccgagguggguggaucauuugagguuaggaguuugagaccagccuggccaacauggcgaaauccucucucuacuaaaauacaaaaauuagcugggcaugguggcaggugccuguaaucucagcuacucgggaggcugaggcagaauugcuugaacccaggagguggagguugcagugagccgagaucacaccacugcacuccagccugggagacagaacgagacuccuaaucaaaaaaaaaacacaagaaaauagagugaggcuuuuuuaccguauauacauaaaauacuuaugaaaauuagaagauaauuuggcauuccuacuguuucacuguacuuccauugaaauacucuuuccauuaaaauauucugaaacaauauaguaauaauggaauugugaucuucaguugcaccucaaccauuuuuuuugcuuaugaacuaaaauuucuaacauuaacauuucggcauguaauaaaacaagggccuaucuccuuuaaaauuuaacauuccauguaacuuuucugacuuaucauucauaaguugcaaauauuacuauuuuccuaaaccaggguacacaauuuaaguugccacuuauugaugacagaauuucuggauaguaggauuuuaauaggcgagcaaauaaaauucaaaucaauuucaaggaaaaacaucuggccagggguagcuugauuucgcccccaaaaauacugaagacuaauccauugacauucauaaugggacagcuaaguaccaaauagcuaacuacucccuauggagguuuaugcaagcagaguaccagggguuccaucauaucaaccuggcaaugcacuuggugguugugugaccuugagaaagucucuuacucuuguuuauguguucuuacuuuagaaacugagacuuuauuugugguuuucacacuauuucagcagcaaaaacuuuuucaaggaaaaucuuacagaaccuuuaaacacgugugcauacacacauacccuauaccccacuauauaaaagucauauuauuauaaauuuccuuauuauauaaacuuuauauacuauaaaugugauuaagucaaugaauaaaaacauuaaugcauuggugauauccagcauguuugaauuuggugaguaacacacauauagugggagucguuuuuuuuaaaaaaauuuuuuaauuaaauucaagucaaauuugcagaacccuguaucuccuccauagauucuuaguauuccauggaacauauuuugaaaaccuugggauagaugauccacugaaaucuuuuccagcucuaagauuuuaaauuguccuuuuagauuagacuugcugaguuuaauucagauuaccuaauuuuaaaauguuucugaaaagugaacagaguuaccuuacagaguuuuggaucuuuccagggauagccaaugauuuuaucccccagaauccuucaccuuucaaggaguuauuuaacaaugagcccagugacucaauagggcccaaaccuuuuuauuuuacaauaugagcuccaagacacuuacugaucuacugugaauauaaaauguuauuagccuuaucaaauaaauaaaugagcacagcucuuuguucgcucuauugaacugggugauaauuauuuagaugugaauguuaggucaguucuacuguaauaacuaaucguaaaaguuguaaauuuguuuaauggaugaaauguacacuuuuuguauucuguacagcuuugucuuuuuuaaauaugaaguacuuaaauguacuuacuaugauaggaaauauaaugugugccuucuaggauuugugaagugguuucaugaacucuaaggaauuuguuuucccuauccuaacucaguaacagaggguuuacuccgauuauguauagaaccuuaguuugagaaaaugaauuuuacuauguacugaauuuagagguugagaauaauaggaucuguguuauucuuaguacccacugauaaauugugcaauaaauaaucuuucgcaagugauuuuagcuaauugaagagauuauuuuccuauguaauuucacauucuaauauacuaaauguuuauauuccuuagagaacuauuuuauauugugcgcugggggcuugugauguuugugugcuguuuuaaaauucauuucaaauuggacucgauuuccuuauaucuaauauauaucugggagaaaaggcugcuugaaaauaucuuuugauucagugauuuuuaacauugggaaguugaguuuauuaaaagguagucug

SEQ ID NO: 94 - RNA, 2510 nt, Homo Sapiens
gcauugugagcucucgcgguaagaggcugaggagccggccugcaaccugccggggcggcuccgcuacgcgcagccgccucaguggcuuccuccacagccaccuccggagggaucuggcugaggaggaaguggaggugucacuggccccggccuuugccccaaucuugugugggcacugaagggggacuacagguucgagaguuaugggugcuacaugugugcuuucagagcaguagugugaggaagcuuggagugggauggcaggacggccucaucccuaugaugguaacuccagugauccagagaauugggaucggaaauugcauaguagaccucguaaacuuuauaaacauucaaguacuuccucgcguauugcuaaaggaggaguugaccacaccaaaaugagucuacauggugcuagugggggacaugagagaucaagagauagacgaaggucaagugacagaucacgagauucaucucaugaaagaacggagucucagcucacuccuuguauuagaaaugugacuucuccaacacgacagcaccauguugaacgagaaaaagaucacaguuccucucguccaagcaguccgcguccucaaaaagcauccccaaaugguuccauuagcagugcugggaacagcagcagaaacaguagucagucaaguucagaugguagcuguaagacagcuggggagaugguguuuguauaugaaaaugcaaaagaaggagcucggaauauaagaacgucagaacgagugacacuaauaguggauaacacuagauuuguuguagacccauccauuuuuacugcacagccaaauacaauguugggcagaggauguuuggaucuggccgagaacauaacuuuacacgacccaaugagaaaggagaguaugagguggcagagggaauugguuccacuguguuucgagcgauucuggauuacuauaaaacaggaauaauccguuguccugauggcauaucuauuccugaacugagagaagcaugugacuaucuuuguaucucuuuugaauauagcacuauuaaauguagagaucucagugcccuaaugcaugaguuaucaaaugauggugcucguagacaauuugaauuuuaucuggaagaaaugauccucccucucaugguagcuagugcccagaguggggaacgggaaugucauauaguggugcuuacagaugaugaugugguugauugggaugaagaauauccaccacagaugggagaagaauauucacaaauuauuuauagcacaaaauuauauagauuuuucaaguauauugaaaacagagauguggccaagucaguuuugaaggagaggggucuuaagaagauuagauugggaauagaagguuauccuaccuacaaagaaaaaguaaagaaaaggccuggaggccgcccagaagugaucuacaacuauguccaaagacccuuuauucgaauguccugggagaaggaagaaggaaagagucggcauguagacuuucaguguguaaagaguaaaucuaucaccaaucuugcagcagcugcagcagacauuccccaggaccagcugguagucaugcauccaacuccacaaguggaugagcuggauauucucccuauccaucccccuucuggcaacagugaccucgauccugaugcacagaauccaaugcugugaugcugaucuuccuugaaaccauagcaugcuacucuucacagugacguuguacucuccucauucugcacugcaaggccacucuucuucauugugagaugcacauaacaauguuuaggauauugcaguguaggcuuuuuuaaagaccaaagguagcugaaugguuuuuuuuuaaaugaguacaacucuagcauuuugaaguuccaguuguaaauguauuuguuuaccaguagguuugugaaauugguucuuuguaugggggaugguccuuuuucacacagcuaggucuuuucagaagugguggaaauuggcagcugggguacuuucaguuuggacugauauucaucacaccucagauaaaaugcagaguaauauauaguugcacuuuauaaauggugguuaaauggaaauguucaagccauuuuauaguugugaugcacaauauaauuuaagugcuucugucaaaguauuccuccaguacaauuuguauaguuugcugcccuugaugagcaaaaaguauuuaucuugggcuuaucugaaugaucaggaugagauuuaaugcccauaucuuaccaguucaguuaucuccagagccauuucacccuuuagagugagucacaugcagggagugugaaugucagaggugguuuauuauccagucugccuuacccuuaaucuguucacagauauuuauuuacuaaugcuuuuuuuuucuuaagaguuaugggauaggaaaaugaaguguuugcucuucauuuacuaaaugauuguaaacuugaguuuuucaucaaaauaaaauuccauuguuuuaauguuucugaccaaa

SEQ ID NO: 95 - RNA, 532 nt, Homo Sapiens
cgcucuccuuucguugccugaucgccgccaucaugggucgcaugcaugcucccgggaagggccugucccagucggcuuuacccuaucgacgcagcguccccacuugguugaaguugacaucugacgacgugaaggagcagauuuacaaacuggccaagaagggccuuacuccuucacagaucgguguaauccugagagauucacaugguguugcacaaguacguuuugugacaggcaauaaaauuuuaagaauucuuaagucuaagggacuugcuccugaucuuccugaagaucucuaccauuuaauuaagaaagcaguugcuguucgaaagcaucuugagaggaacagaaaggauaaggaugcuaaauuccgucugauucuaauagagagccggauucaccguuuggcucgauauuauaagaccaagcgaguccucccucccaauuggaaauaugaaucaucuacagccucugcccuggucgcauaaauuugucuguguacucaagcaauaaaaugauuguuuaacuaaaa

SEQ ID NO: 96 - RNA, 70 nt, Homo Sapiens
guuugugaugacuuacauggaaucucguucggcugaugacuugcuguugagacucugaaaucugauuuuc

SEQ ID NO: 97 - RNA, 73 nt, Homo Sapiens
acuccaugaugaacacaaaaugacaagcauauggcugaacuuucaagugaugucaucuuacuacugagaagug

SEQ ID NO: 98 - RNA, 75 nt, Homo Sapiens
cuacggggaugauuuuacgaacugaacucucucuuucugauggauuaguggagaaaacagaaaauucugaguagc

SEQ ID NO: 99 - RNA, 69 nt, Homo Sapiens
cuuccuaugaugaggaccuuuucacagaccuguacugagcuccgugaggauaaauaacucugaggagau

SEQ ID NO: 100 - RNA, 146 nt, Homo Sapiens
agcuuugcgcaguggcaguaucauagccaaugagguuuauccgaggcgcaauuauugcuaauugaaaacaaaacauuagccaugcaugaugacuggcaccuguaaucccagcuacucaggaggcugaggcauuaaaaucacuugaa

SEQ ID NO: 101 - RNA, 5872 nt, Homo Sapiens
ggugcugcggcccgcgccgccaucuuggauuuuacucuccauuuuucucuggaauuauuuuuggugauuaauuuucugggggggacugggacgcggggcccggcggcgcggccccgcaucgcagcggccgggcagcggggccugggacgcgccccgaggaggagcggggcggcgcaggcggagagaacauugaaaguauucucuaagcuauuugaagagagugacuaaaugcaccugggucaggcugucuguggguaugaagugguugggagaauccaagaucaugguggugaauggcaggagaaauggaggcaaguugucuaaugaccaucagcagaaucaaucaaaauuacagcacacggggaaggacacccugaaggcuggcaaaaaugcagucgagaggaggucgaacagauguaaugguaacucgggauuugaaggacagagucgcuauguaccauccucuggaauguccgccaaggaacucugugaaaaugaugaccuagcaaccaguuugguucuugaucccuauuuagguuuucaaacacacaaaaugaauacuagcgccuuuccuucgaggagcucaaggcauuuuucaaaaucugacaguuuuucucacaacaacccugugagauuuaggccuauuaaaggaaggcaggaagaacuaaaggaaguaauugaacguuuuaagaaagaugaacacuuggagaaagccuucaaauguuugacuucaggcgaaugggcacggcacuauuuucucaacaagaauaaaaugcaggagaaauuauucaaagaacauguauuuauuuauuugcgaauguuugcaacugacaguggauuugaaauauugccauguaauagauacucaucagaacaaaauggagccaaaauaguugcaacaaaagaguggaaacgaaaugacaaaauagaauuacugguggguuguauugccgaacuuucagaaauugaggagaacaugcuacuuagacauggagaaaacgacuucagugucauguacuccacaaggaaaaacugugcucaacucuggcuggguccugcugcguuuauaaaccaugaucuuaucaacaguuaauugacuuuaucuuuuggacauuuuucagauugcagaccuaauuguaaguuugugucaacuggucgagauacagcaugugugaaggcucuaagagacauugaaccuggagaagaaauuucuuguuauuauggagauggguucuuuggagaaaauaaugaguucugcgaguguuacacuugcgaaagagacggggcacuggugcuuuuaaauccagagugggacugccugcgccugcuccuguuaucaauagcaaauauggacucagagaaacagauaaacguuuaaauaggcuuaaaaaguuaggugacagcagcaaaaauucagacagucaaucugucagcucuaacacugaugcagauaccacucaggaaaaaaacaaugcaaguaaguaagggagauuugauaagcauaucuuuuaaaaguauuuucacacaauuugcuuuauaaagugugcuucaguaguuuuaaacuuuuaaauacucagagagacugggacuugugagcuuuggcugcacuucaaggcucuagacgugauuugaguagaggcacagucuguaucccaucucuaacuucaguaccguccucuagacuauuuuucuugaauaccuugguaacuggauaugaguucuucaucauauguuccaaggucaucauauguuuuaaacauuuucaagguguuagagacugugaugaugucgcuaaguccugcaagaagacaaaaggacugaguagaauuaaauuagacucuauacauuccagugccuagccaguuuguuagaaaagaugauggacuuggggaauucauagcuucuggccuuaaggcuuccaccuuuucauugcuugcugaccuuuuucaaaacgaacugacucaguucagcagaccaccaguaccagacucagaauugugauagaggagcauuuugaacagugccguauugugacaugcuguauuggcuacuccagaaaguaggaguaaagauggaaaggagaaagaagcaaccucugagauuccaguggugugugggggcaagaucugauggaaacugaaaaagagaacgaagacuaaacaaagagaaaggaaagagaagaaacccuaaaugggcaaaggaaagcacauccuguuugcggagcuuugaaauauuggaaccauuucuaauugcuccuguuuuucuggguaacaccaguuuucuguaguugccacuaaagcaguagacucuugagucucacuugucucugagagagacagaaguuagaaaguuuugacuuggcgauuccgaaaguaugccuuuguuggcacuuaaauguccagugagacuucuuggcaccuuagagcccucugagauacugauuauuuuagguucuucucccuacuuucagauguuuucagcccaacacugggugcucucuuccacuacagagaauccugaagaaaagggaagguguuucccaugauggugaaugucacugccaugaauuccugaaucuaccugcugcugggagucagaguccaagcauaacccguguagcauaaaagcagcgcuguagcccuauuccagucuuuuucguuaauguccagagugaacaacaagaguuagucaaucauuaacuguugacuguugauucucauaauaaaugcagcauaacgaccuucuaaccgaaaaucuucaguuggcguaaaaaagaauagcaagagcagaacguuaacgaggcaaucuaugucaagaauuccagcuucuuccaacucuaccucaucuaagcuaacucauauaaauaauuccaggguaccaaagaaacugaagaagccugcaaagccuuuacuuucaaagauaaaauugagaaaucauugcaagcggcuggagcaaaagaaugcuucaagaaaacucgaaaugggaaacuuaguacugaaagagccuaaaguaguucuguauaaaaauuugcccauuaaaaaagauaaggagccagagggaccagcccaagccgcaguugccagcgggugcuugacuagacacgcggcgagagaacacagacagaauccugugagaggugcucauucgcagggggagagcucgcccugcaccuacauaacucggcggucagugaggacaagaacaaaucugaaggaggccucugacaucaagcuugaaccaaauacguugaauggcuauaaaagcagugugacggaaccuugccccgacaguggugaacagcugcagccagcuccugugcugcaggaggaagaacuggcucaugagacugcacaaaaaggggaggcaaagugucauaagagugacacaggcauguccaaaaagaagucacgacaaggaaaacuugugaaacaguuugcaaaaauagaggaaucuacuccagugcacgauucuccuggaaaagacgacgcgguaccagauuugauggguccccauucugaccagggugagcacaguggcacugugggcgugccugugagcuacacagacugugcuccuucacccgucgguuguucaguugugacaucagauagcuucaaaacaaaagacagcuuuagaacugcaaaaaguaaaaagaagaggcgaaucacaagguaugaugcacaguuaauccuagaaaauaacucugggauucccaaauugacucuucguaggcgucaugauagcagcagcaaaacaaaugaccaagagaaugauggaaugaacucuuccaaaauaagcaucaaguuaagcaaagaccaugacaacgauaacaaucucuauguagcaaagcuuaauaauggauuuaacucaggaucaggcaguaguucuacaaaauuaaaaauccagcuaaaacgagaugaggaaaauagggggucuuauacagaggggcuucaugaaaauggggugugcugcagugauccucuuucucucuuggagucucgaauggagguggaugacuauagucaguaugaggaagaaaguacagaugauuccuccucuucugagggcgaugaagaggaggaugacuaugaugaugacuuugaagacgauuuuauuccucuuccuccagcuaagcgcuugagguuaauaguuggaaaagacucuauagauauugacauuucuucaaggagaagagaagaucagucuuuaaggcuuaaugccuaagcucuuggucuuaacuugaccugggauaacuacuuuaaagaaauaaaaaauuccagucaauuauuccucaacugaaaguuuaguggcagcacuucuauugucccuucacuuaucagcauacuauuguagaaaguguacagcauacugacucaauucuuaagucugauuugugcaaauuuuuaucguacuuuuuaaauagccuucuuacgugcaauucugaguuagagguaaagcccuguuguaaaauaaaggcucaagcaaaauuguacagugauagcaacuuuccacacaggacguugaaaacaguaauguggcuacacaguuuuuuuaacuguaagagcaucagcuggcucuuuaauauaugacuaaacaauaauuuaaaacaaaucauaguagcagcauauuaaggguuucuaguaugcuaauaucaccagcaaugaucuuuggcuuuuugauuuauuugcuagauguuucccccuuggaguuuugucaguuucacacuguuugcuggcccagguguacuguuuguggccuuuguuaauaucgcaaaccauugguugggagucagauugguuucuuaaaaaaaaaaaaaaaaugacauacgugacagcucacuuuucaguucauuauauguacgaggguagcagugugugggaugagguucgauacagcguauuuauugcuugucauguaaauuaaaaaccuuguauuuaacucuuuucaauccuuuuagauaaaauuguucuuugcaagaaugauuggugcuuauuuuuucaaaaauuugcugugaacaacgugaugacaacaagcaacauuuaucuaaugaacuacagcuaucuuaauuugguucuucaaguuuucuguugcacuuguaaaaugcuacaaggaauauuaaaaaaaucuauucacuuuaacuuauaauaguuuaugaaauaaaaacaugagucacagcuuuuguucugugguaaccuauaaaaaaaguuugucuuugagauucaauguaaagaacugaaaacaauguauauguuguaaauauuuguguguugugagaaauuuuugucauaagaaauuaaaagaacuuaccaggaagguuuuuaaguuuagaaauauucaugccaauaaaauaggaaauuauaaauauauaguuuuaagcacugcaucagugggaguucuuggcuuauguuaguuuauguuaguuuauuaugaaaacaucaaagauuuuuuugacuauauuaucaguuaaacaaaaaggagucagauuuaauuuguuuuuugaagcacuuugagaaauuaauuuuaauuaacuuaaugagcaaauuuuuauuacuacuuuauguucaauaccagguucuuuucauuucucuggauuauuuugcaaaucauuggacagagaauuugggaauauaaaucuguaacagguguuugacaccaguaggucucuuuauuucugggaaauguguaccuguacuuucugauauacaguguuccuaaguaaaaaucaauucaggggauuuguauagugucuauaggaaaguagcccaugucuugaaauaugaaaaggaaucugaaggucaugaaaaguccaguggagaaaaucucaaugcuuacuguuacuacuaauugauuccuacuaguuuccagguuuggg

SEQ ID NO: 102 - RNA, 127 nt, Homo Sapiens
ugcacuuauguauguuuuuguuuaacguggacaaagacuuacagauaggugcaaaaaauaaauccucuuuugcaacccagaacucauuguucaguaugaguuuugauacauauaagaagggauauua

SEQ ID NO: 103 - RNA, 1422 nt, Homo Sapiens
gcugugcccagaguugaaggagucuuuauauuucugauagaagacaguggcaaaaaaaaaaggcguaagaauuuugaagcuauguucaaagguauccuucagaguggauuggauaacuucgugauaaaccacaugcuaaagaacaacguggcuggacaaacaucuauccagacccuaguaccuaauacggaucaaaagucgaccaguguaaaaagaagacaaccacaaaaaaaaaacaguuaagauguuggaauaccugggcaaagauguucuucaugguguuuuuaauuauuuggcaaaacacgauguucugacauugaaggaagaggaaaagaaaaaauauuaugauaccaaaauugaagacaaggcccugaucuugguagacucuuugcgaaagaaucgcguggcucaucaaauguuuacccaaacacuucucaauauggaccaaaagaucaccaguguaaaacgcucuucugcaaaucgaggcuggaccaccugagucagcagaaucuacaaauauacucaaacuuuguccucgugaagaauuccugagacuguguaaaaaaaaucaugaugagauggcugaaucuauccaauaaaaaagagagaggaccgcagacgccuggcucucaucauaugcaauacaaaguuugaucaccugccugcaaggaauggggcucacuaugacaucguggggaugaaaaggcugcuucaaggccugggcuacacugugguugacgaaaagaaucucacagccagggauauggagucagugcugagggcauuugcugccagaccagagcacaaguccucugacagcacguucuugguacucaugucucauggcauccuagagggaaucugcggaacugcgcauaaaaagaaaaaaccggaugugcugcuuuaugacaccaucuuccagauauucaacaaccgcaacugccucagucuaaaggacaaacccaaggucaucauuguccaggccugcagaggugaaaaacauggggaacucugggucagagacucuccagcauccuuggcacucaucucuucacagucaucugagaaccuggaggcagauucuguuugcaagauccacgaggagaaggacuucauugcuuucuguucuucaacaccacauaacguguccuggagagaccgcacaaggggcuccaucuucauuacggaacucaucacaugcuuccagaaauauucuugcugcugccaccuaauggaaauauuucggaagguacagaaaucauuugaaguuccacaggcuaaagcccagaugcccaccauagaacgagcaaccuugacaagagauuucuaccucuuuccuggcaauugaaaauucaaagagcacauuuaccaguauagcuugcauagucaauauuugguauuucaauaaaaguaaagacugua

SEQ ID NO: 104 - RNA, 97 nt, Homo Sapiens
ucacaaugaugaaugguccaaaacauucgcgguuuccaccagaauucaagguguuggcaacuaccuuccuuggaugucugagugacccaagauguua

SEQ ID NO: 105 - RNA, 5497 nt, Homo Sapiens
aguuggaaagagaccacagacuuugagggaagcucacucaggaucugcucuccggcaaaguaguaagugaggugcugagagcagaaugagcuacuuuguggauucugcugggagcagccccgucccuuacucagcgccucguccugcaguggugaggcaaggaccuagcaacacuuaugaagauccucgaaugaacugugguuuccaguccaauuaucaccagcaaagaccuugcuaccccuuuugggaugagauggcaacucaggaaguuccuacuggucuugaacacugugucucagcgggcgagggccgggcaggaggagcgggcgcggcgcgggcgaggcugggacccgagcgcgcucacuucgccgcaaagugccaacuuccccuggagugccgggcgcgcaccguccgggcgcgggggaaagaaaggcagcgggaauuugagauuuuugggaagaaagucggauuucccccguccccuucccccuguuacuaauccucauuaaaaagaaaaacaacaguaacugcaaacuugcuaccaucccguacgucccccacuccuggcaccaugaaggcggccgucgaucucaagccgacucucaccaucaucaagacggaaaaagucgaucuggagcuuuuccccuccccggauauggaaugugcagaugucccacuauuaacuccaagcagcaaagaaaugaugucucaagcauuaaaagcuacuuucagugguuucacuaaagaacagcaacgacuggggaucccaaaagacccccggcaguggacagaaacccauguucgggacugggugaugugggcugugaaugaauucagccugaaagguguagacuuccagaaguucuguaugaauggagcagcccucugcgcccuggguaaagacugcuuucucgagcuggccccagacuuuguuggggacaucuuaugggaacaucuagagauccugcagaaagaggaugugaaaccauaucaaguuaauggagucaacccagccuauccagaaucccgcuauaccucggauuacuucauuagcuaugguauugagcaugcccaguguguuccaccaucggaguucucagagcccagcuucaucacagaguccuaucagacgcuccaucccaucagcucggaagagcuccucucccucaaguaugagaaugacuaccccucggucauucuccgagacccucuccagacagacaccuugcagaaugacuacuuugcuaucaaacaagaagucgucaccccagacaacaugugcauggggaggaccagucgugguagguaaacucgggggccaggacucuuuugaaagcauagagagcuacgauaguugugaucgccucacccaguccuggagcagccagucaucuuucaacagccugcagcguguucccuccuaugacagcuucgacucagaggacuauccggcugcccugcccaaccacaagcccaagggcaccuucaaggacuaugugcgggaccgugcugaccucaauaaggacaagccugucauuccugcugcugcccuagcuggcuacacaggcaguggaccaauccagcuauggcaguuucuucuggaauuacucacugauaaauccugucagucuuuuaucagcuggacaggagauggcugggaauucaaacuuucugacccagaugagguggccaggagauggggaaagaggaaaaacaaaccuaagaugaauuaugagaaacugagccguggccuacgcuacuauuacgacaaaaacaucauccacaagacagcggggaaacgcuacguguaccgcuuugugugugaccugcagagccugcugggguacaccccugaggagcugcacgccaugcuggacgucaagccagaugccgacgagugauggcacugaaggggcuggggaaacccugcugagaccuuccaaggacagccguguugguuggacucugaauuuugaauuguuauucuauuuuuuauuuuccagaacucauuuuuuaccuucaggggugggagcuaagucaguugcagcuguaaucaauugugcgcaguugggaaaggaaagccaggacuuguggggugggugggaccagaaauucuugagcaaauuuucaggagagggagaagggccuucucagaagcuugaaggcucuggcuuaacagagaaagagacuaauguguccaaucauuuuuaaaaaucauccaugaaaaagugucuugaguuguggacccauuagcaagugacauugucacaucagaacucaugaaacugauguaaggcaauuaauuugcuucuguuuuuaggucugggagggcaaaaaagaggugggugggaugaaacauguuuuggggggggaugcacugaaaaucugagaacuauuuaccuaucacucuaguuuugaagcaaagauggacuucaguggggaggggccaaaaccguuguuguguuaaaauuuauuuuauuaaauuuugugccaguauuuuuuuucuuaaaaaucgucuuaagcucuaagguggucucaguauugcaauaucauguaaguuuguuuuuauuugccggcugaggauucugucacaaugaaagaaaacuguuuauauagaccccauuggaaaagcaaaacgcucucacugagaucagggaucccaaauucaugggacuuauauaagaaggacaauuaaugcugauuuggguacaggggaauuaugugugugaaugucaucuacaauuaaaaaaaauuagcacaucccuuuacuuacuuguuaucaguggauucucgggguuuggacuuaauguugagcuaagaagcauuaagucuuugaacugaauguauuuugcaucccugguuuuggacgacaguaaacguaggagcacuguugaaguccuggaagggagaucgaaggaggaagauugacuugguucuuucuuaguccuauaucuguagcauagaugacuuggaauaaaagcuguaugcaugggcauuaccccucagguccuaagaaauaaguccugaaugcaugucguuccaaacuaacacucuguaauuuuucuuuuaugucuuauuuuccaagaguccuccauuuuuugcacccccucaccgccaacucuguuauucaguagagagaaguguacggcuuucugauuggugagugaaaaaguaacuugagacacgaccuaaguugaagaguuuagacuugcugaguuuuagaagugauggaaauuaagagagcauuucaauaaaaugugacuuggcugucuuuggaagagaagugcaaggcuuuccuuugaagaauuuaaauuaguccgguaggaugucaggugagacuguguaugcaaaaugaauggcacaggugaugccagggccucuugcuugggucugaugucuuggcacaggguaagugaagguuaauuccagaagagaggaaugacuugaaggcaaaggaaacuaaggaaggagguucagugaggaaaauaagguuguccaugagauuugaauagauuuuuaguucccccaagguuuaaauacaaacauagucaagcaagguagucaucuuucugcugguugugagggggaaucugaaaauggaguuuuagaggaaaagucaacaucuaacuagugaggaaaagugccuaauacaauuagaaucucccucacucuauaguugcccaguugaaaggauaaggaggagggguggcuuuuauggacuuccaugagagaaggaaagaaauauuucagguaagcuucucagggcuggcccuuuuugggauuuggaugagaaauuggaaguacuaacuacuuucuagcauaucuuuaagaaaauugauuguuauuuacucccagauccucuugcagacccagaauuaucaggaacauagcucugugauucaugaguguccccauacugaugaauuggagcauccauauggaaagcaaaggcagaauuaucccagcuguauuauuuugaucuuuuggaugcaggugccuuaaugaagcucucaaaauauuuuaggagcugcucagggaguguuggguggaacuguuuggacuacauuguuuucucuuagauuaugugauuuuuguugggcacuggcaaaaggugugugugugaaugugugcaugugugugaauguuguguguguguguguguguguguguguguguguguguguguguguuugcagacaugcaaaacugcagcugaaauaauaccuuagauuucuagguaagucuuuccacauuucaauaauggguaagaguagaaccagggccggguaucaauuauugcuugcuguuugcaaccaggcauaaaaucacuuucucaaaucauccaccguuccuauuaaauuuaugccggaaacucuccuucugugaguauaacuccugcaguuccuauagcagauaagauauaagaaagugccuccuagugcuccuccgcccgcuuguuugcuaaaauucccuuucucucuaaguccaccauuuucaagauuuguagauaguguauuaguuaagacagcuuugucgaucuggccagauguuuuuucuccuuuguccaaaggccagagaccaucccaggaagaguggugggugguuuauacacuggaaauguugcguuuaugcuuuuuaaaaacacacguuaacuucagaggaaggaugggcaaaucuggucuagcugggugaaacccuuauuuucccagagaugccuuaaccuuuguugguuuuggcuuuaggguucagagucacuuuuguucccuucuccauucuggagagggacuuccccuacauagagcccugauuuuuguggcuguggggauuggagguagcauucaaagaucagaugugcuuuuccucacuuuggagaugaacacucuggguuuuacagcauuaaccugccuaaccuucauggugagaaauacaccaucucucuucuagucaugcugugcaugccgcuuacucuguuggggucuauauaaauuuguugaacucuuaccuacauuccaaagaaguuucaaggaaccauaaauauauguauacauauacauauauaaaauauauauauuaaaauaaaauuaucaggaauacugccucaguuauugaacuuuuuuuuuuaagaauacuuuuuuuuuaagcugagaaguauagggaugaaaaagauguuauauuguguuugacuauuuuccaacuuguauuuucauauaauuuauauuuuuuaaaagcugaaaauuuagaagcaagaugaaaaaaaggaaaagcaggugcuuuuuaaaaaucagaacugagguagcuuagagauguagcgauguaagugucgauguuuuuuuaaaaaaaaaugcaaaaaaauucuuauggcggaguuuuuuguuuguuuauuuuaguagcugaugcuggcacaucauuuugcuggagaguuuuuuauauacuguagccugauuucauauuguauuuuaaacugugugaaauuaaaaacaaagaauuucauucauaa

SEQ ID NO: 106 - RNA, 390 nt, Homo Sapiens
augaucaaguggguuucauaccagggaaugcagggaugguuuaacauacuuaagccaauaauugugguacaccacauaagcagaaugaaaaauggaaaucacaugaucaucucaauagaugcaagaaaaggauuugacaaaauccagcaucccuuuaugaugaaaacccucagcaaaauuggcauagaagggacauaccuuaagguaauaaaagcuaucuaccacaaauccacagccaacauuauacugaauggggaaauguugaaagcauucccucugagaacuggaacaagacagggaugccuacuuucaccacuucuauucaguauaguacuggaaguccuagccagagcaaucagagaaagaaagaaagcgcauccaaaucgguaa

SEQ ID NO: 107 - RNA, 5549 nt, Homo Sapiens
aaguuuuggagcgccggacaagcugagguccgcgacucgucgcuaagauuccccaaaacugagauuucaagaaaauucacccuuuccgcuuucuuuggcguccuucaaccgugaaggaaaugaagguugagaaccuggaacccgcuuccaaugaccaagcccuuucucugugccucacaacagucuuccgcuguagcuguuuuuauuaccccuauuuuacuacuggggaggagauuugagguccugaaagugaagugacuugcuggacgucacuuagcagaggagauggcgaaaccuggauuagaggcgaugccuucuaacucccagcguggacuugccuccuuuccugggggugacugaaugcccagccagggacgcgacgucucuggccagcagaaauacggccuccuccccgccgacugggcaaagggggaccuugcggccaaggagggauucgcaggcgggccgggggugggagcgggggccggagccggagccuuggcccgcccccgggcggcgcugugauuggccggccgcuccggcgggcgucgcgauuggccguccugcagccguugagauuugaacucgguauuuguggcuuugcccgcgcguugccagacucagaggcggcccuuugccucugccugccggggauuggccggauucuccgccgacuugaaaacugccuugcuaauuggugcguguugugcacgcguguuuuuuccuuuucauuucagccugacugccggaaucagagccgcgggugagauccccagagcccugugagccuguaggaguagaauggcuccccaaauguaugaguuccaucugccauuauccccagaggaguuguugaaaaguggaggggugaaucaguauguugugcaagagguacuguccaucaaacaucuuccaccacagcuuagagcuuuucaggcugccuuucgagcucaggggccccuggcuaugcugcagcacuuugauacuaucuacagcauuuugcaucacuuucgaaguauagauccuggccucaaagaagauacucugcaauuccugauaaaagugguaucccgccacucccaggagcuuccagcuauccuggaugauacaacuuugaguggaucagauagaaacgcccaucuaaaugcccucaaaaugaacuguuaugcucugauacgucuccuggaauccuuugagaccauggccagccagacaaaccuuguggaccuggaccuuggugggaaggguaagaaagcucggaccaaggcagcccauggcuuugacugggaagaagagaggcaaccaauucuucagcuuuuaacacagcuacuucaguuggacauccgucaccuguggaaccacucaauaauugaagaagaauuugucaguuugguuacuggcuguugcuaccgccuucuggagaaucccaccauuaaucaccagaagaaccgccccacucgggaagccauaacacaccugcuugguguagccuugacccguuauaaccauaugcucagugcuacagugaagaucauccagaugcugcagcacuuugaacaccuggcaccuguacugguugcagccgugagucuaugggcaacugacuauggaaugaagagcauagugggagagauuguaagagagauuggacaaaaguguccccaagagcugagucgagacccuucagggacaaagggcuuugcagcauuccugacagaacuagcagaacgugucccagcuauccugauguccagcaugugcauuuugcuagaucaccuggauggagaaaauuacaugaugcguaaugcugugcuggcagccauggcggagauggugcugcagguucucaguggcgaucaacuggaagcagcagcccgagacaccagagaccaguucuuggauacuuuacaagcccauggccaugaugucaacuccuuugugcggagccguguuuugcagcucuucacccgaauuguccagcagaaggcucucccccugacacguuuccaggcagugguggcuuuagcugugggacgucuggcagacaagucagugcuaguauguaaaaaugccauccagcugcuggccaguuuucuagccaauaauccuuucuccugcaagcuuagugaugcugaccuugccggaccacugcagaaggagacccagaaauuacaagagaugagggcccagaggcgaacugcagcagcuucugcagugcuggacccagaggaggagugggaagccaugcugccagaguugaagucuacccugcagcagcuucuacagcuuccccagggagaggaggagauuccugagcaaauugccaauacagagacaacugaagaugugaaaggacgcaucuaucaacugcuugccaaagcuaguuacaaaaaggccaucauucucacucgagaagccacaggccacuuccaggaguccgaacccuucagucauauagacccagaggagucagaggagaccaggcucuugaauaucuuaggacuuaucuucaaaggcccagcagcuuccacacaagaaaagaauccccgggagucuacaggaaacauggucacaggacagacugucuguaaaaauaaacccaauaugucggauccugaggaauccaggggaaaugaugaacuagugaagcaggagaugcugguacaguaucugcaggaugccuacagcuucucccggaagauuacagaggccauuggcaucaucagcaagaugauguaugaaaacacaacuacaguggugcaggaggugauugaauucuuugugauggucuuccaauuugggguaccccaggcccuguuuggggugcgccguaugcugccucucaucuggucuaaggagccugguguccgggaagccgugcuuaaugccuaccgccaacucuaccucaaccccaaaggggacucugccagagccaaggcccaggcuuugauucagaaucucucucugcugcuaguggaugccucgguugggaccauucagugucuugaggaaauucucugugaguuugugcagaaggaugaguugaaaccagcagugacccagcugcugugggagcgggccaccgagaaggucgccugcuguccucuggagcgcuguuccucugucaugcuucuuggcaugauggcacgaggaaagccagaaauugugggaagcaauuuagacacacuggugagcauagggcuggaugagaaguuuccacaggacuacaggcuggcccagcaggugugccaugccauugccaacaucucggacaggagaaagccuucucugggcaaacgucacccccccuuccggcugccucaggaacacagguuguuugagcgacugcgggagacagucacaaaaggcuuuguccacccagacccacucuggaucccauucaaagagguggcagugacccucauuuaccaacuggcagagggccccgaagugaucugugcccagauauugcagggcugugcaaaacaggcccuggagaagcuagaagagaagagaaccagucaggaggacccgaaggagucccccgcaaugcuccccacuuuccuguugaugaaccugcugucccuggcuggggauguggcucugcagcagcugguccacuuggagcaggcagugaguggagagcucugccggcgccgaguucuccgggaagaacaggagcacaagaccaaagaucccaaggagaagaauacgagcucugagaccaccauggaggaggagcuggggcugguuggggcaacagcagaugacacagaggcagaacuaauccguggcaucugcgagauggaacuguuggauggcaaacagacacuggcugccuuuguuccacucuugcuuaaagucuguaacaacccaggccucuauagcaacccagaccucucugcagcugcuucacuugcccuuggcaaguucugcaugaucagugccacuuucugcgacucccagcuucgucuucuguucaccaugcuggaaaagucuccacuucccauuguccggucuaaccucaugguugccacuggggaucuggccauccgcuuucccaaucugguggaccccuggacuccucaucuguaugcucgucuccgggacccugcucagcaagugcggaaaacagcggggcuggugaugacccaccugauccucaaggacauggugaaggugaaggggcaggucagcgagauggcggugcugcucaucgaccccgagccucagauugcugcccuggccaagaacuucuucaaugagcucucccacaagggcaacgcaaucuauaaucuccuuccagauaucaucagccgccugucagaccccgagcuggggguggaggaagagccuuuccacaccaucaugaaacagcuccucuccuacaucaccaaggacaagcagacagagagccugguggaaaagcugugucagcgguuccgcacaucccgaacugagcggcagcagcgagaccuggccuacugugugucacagcugccccucacagagcgaggccuccguaagaugcuugacaauuuugacuguuuuggagacaaacugucagaugaguccaucuucagugcuuuuuugucaguuguaggcaagcugcgacguggggccaagccugagggcaaggcuauaauagaugaauuugagcagaagcuucgggccugucauaccagagguuuggauggaaucaaggagcuugagauuggccaagcagguagccagagagcgccaucagccaagaaaccauccacugguucuagguaccagccucuggcuucuacagccucagacaaugacuuugucacaccagagccccgccguacuacccgucggcauccaaacacccagcagcgagcuuccaaaaagaaacccaaaguugucuucucaagugaugaguccagugaggaagaucuuucagcagagaugacagaagacgagacacccaagaaaacaacucccauucucagagcaucggcucgcaggcacagauccuaggaagucuguuccuguccucccugugcaggguauccuguagggugaccuggaauucgaauucuguuucccuuguaaaauauuugucugucucuuuuuuuuaaaaaaaaaaaaggccgggcacuguggcucacgccuguaaucccagcacuuugcgauaccaaggcggguggauaaccugagguagggaguucgagaccagccugaccaacauggagaaaccccaucucuacuaaaaauaaaaaauuagccgggcguauuggcgugcgccuguaaucccagcuacucaagaggcugaggcaggagaaucgccugaacccagaggcggagguuguagugagccgaaaucacaccauugcacuccagcuugggcaacaauagcgaaccuccaucucaaauuaaaaaaaaaaugccuacacgcucuuuaaaaugcaaggcuuucucuuaaauuagccuaacugaacugcguugagcugcuucaacuuuggaauauauguuugccaaucuccuuguuuucuaaugaauaaauguuuuuauauacuuuu

SEQ ID NO: 108 - RNA, 586 nt, Homo Sapiens
gcaugauccugaagcccaacuuccacaaggacuggcagugguguggccauguggcucagccagcccauggggcagaccugcagaagcaagguggccagcaaaagcaggcugcauggcccacugauaugggcccauccacccauaguaaggugccccaugcugaggcaucacuacaaagcacaagcuggcaggggccucagcuuggaggaguuaaggguggcuggcauuuacaagaagguggcccagaccauuggcaucucugaggaugcaaggaggaggaaccaguccacccaggcccugcaggccaaggugcagaggcugaaggaggaccgcuccucacucauccucuuccccaggaagcccuuggcccccaagaagggagacaguucugcugaagaacucgaacuggauacucagcugacaggaccagaaaugcccaucggcaaugucuacaaggagaaagccagagucaucgcugacuaggaggaaaacuuccaggccuuguuagucucuguauggcccaugcaaaugcccagcucuucggcauauaggcacaaagagccaaggaagcuguagaagaggacgc

SEQ ID NO: 109 - RNA, 1962 nt, Homo Sapiens
cuuugaaaaagacuucuuuugagcuaacuuucuuauacugguaccuuucuaaucucacuacaauauguaacauugguguucgaucucaaguauuucugaauauauuccccuauccacagaaauauacucugggggaaaaaaaauagaacaaauucuugccguccugaccauugaacaagagacuaauuagacaauggggcuagaaaaaccucaaaguaaacuggaaggaggcaugcauccccagcugauaccuucgguuauugcuguaguuuucaucuuacuucucagugucuguuuuauugcaaguuguuuggugacucaucacaacuuuucacgcuguaagagaggcacaggagugcacaaguuagagcaccaugcaaagcucaaaugcaucaaagagaaaucagaacugaaaagugcugaagggagcaccuggaacuguuguccuauugacuggagagccuuccaguccaacugcuauuuuccucuuacugacaacaagacgugggcugagagugaaaggaacuguucagggaugggggcccaucugaugaccaucagcacggaagcugagcaggaauuucucuguccuguuaugccucuaacuuuauuauucaguuucuggauagacggcuuuccuauuuccuuggacuuagagaugagaaugccaaaggucaguggcguuggguggaccagacgccauuuaacccacgcagaguauucuggcauaagaaugaacccgacaacucucagggagaaaacuguguuguucuuguuuauaaccaagauaaaugggccuggaaugauguuccuuguaacuuugaagcaaguaggauuuguaaaauaccuggaacaacauugaacuagaaacucagaaagugguccuugugauggaaagagaaaagaaaaaccaauuagaauaaggcagaauguacgugcgucauuggaacacagaaaacaugcugguucauacagcguuuuuagucauaauggucuuuuuuauuuuguuugauucauucgagacaacauguguguauguguguguguguguguguagauaaugugguuuuuguaugguguuugauggaaggaauaaucuuucuuugcuuucuuaguaguauuucaagguguuuacuuuucaauuggugugcacugaaugcauguauggaagaauagcgugaauaaugcaaucucuuugucauuuuuccccuucucagacucuuagcucuuaaaauucaaagaugggauauucuaacugguaguggugcaucauuuuuaacccaaauauugcaagcacuuuaaagauuugaaaccacauuuuuauuguuugauguuucauuuucagacuuuuuaaugucagucauuacaauuacauugcaugaggaaaauuuuuccagaacaacaguguggaauaguucugaauuaugcuguucuacagauagaaaaaaaguccaaaugccuuuaaaaauuuacuucuuacuccacccaacacguuuuugcaaagcaagaagucuuuguaagacaccuuaaacaaaguccuucaauucuacagcagaggaaauaaaaucccccagaagccaaagggcucaccuucacauuguuaguucaugacagacccaggugugcuucauuagagauaacauacauucccuuugguaucacaggaaguuacuggggauuacucgaccucauuacuuagcuaacgacuggauaaaauuucuuaauuguuugaaguaacauuguauucguguuugcauuauuaauuugaauagaaaauaaucacauuuucaacccauuuauacaaauuguuaauguuucuuuagagcuguauaacuauaguuugaacuagcaaggaaguuauuguuuugacaaccagaaauuaugcuuuucuggugcaugaaacauuaauugcaaagggcagucacauccaacuuuaauaaaauaugguggucuuucuuaaaa

SEQ ID NO: 110 - RNA, 1840 nt, Homo Sapiens
auggcgggcggagaagcuggggugacucuggggcagccgcaccuuucgcgucaggaucucaccaccuuggauguuaccaaguugacgccacuuucacacgaaguuaucagcagacaagccacaauuaauauagguacaauuggucauguagcucaugggaaauccacagucgucaaagcuauuucuggaguucacaccgucagguucaaaaaugaacuagaaagaaauauuacaaucaagcuuggauaugcuaaugcuaagauuuaucaacuugaugacccaaguugcccucggccagaauguuaucgaucuugugggagcaguaugccugaugaguuuccuacagacauuccaggaaccaaagggaacuucagauuagucagacauguuuccuuuguugacuguccuggccacgauauuuugauggcuacuaugcugaacggugcagcagugauggaugcagcucuucuguugauagcugguaaugaaucuugcccucagccucagacaucugaacaccuggcugcuauagagaucaugaaacugaagcauauuuugauucuacaaaauaaaauugauuugguaaaagaaaggcaggcuaaagaacaauacgagcagauccuugcguuuguccaagguacaguagcagagggagcucccauuauuccaauuucggcucagcugaaauacaauauugaaguuguuugugaguacauaguaaagaaaauuccaguacccccaagagacuuuacuucagagccccggcuuauuguuauuagaucuuuugaugucaacaaaccuggcugugaaguugaugaccuuaagggagguguagcuggugguaguauccuaaaaggaguauuaaaggugggccaggagacagaaguaagaccugguauuguuuccaaagauagugaaggaaaacucauguguaaaucaaucuuuuccaaaauuguuucacuuuuugcggagcauaaugaucugcaauaugcugcuccaggcggucuuauuggaguuggaacaaaaauugaccccacuuugugccgggcugacagaaugguggggcaaauacuuggugcagucggagcuuuaccugagauauucacagaauuggaaauuuccuauuuccugcuuagacggcuucuagguguacgcacugaaggagacaagaaagcagcaaagguucaaaagcugucuaagaaugaagugcucauggugaacauaggaucccugucgacaggagggagaguuagugcugucaaggccgauuugggcaaaauuguuuugaccaauccagugugcacagagauucaucuaauucaccuugauuugauuaaggaauuagaauggggcccaguucuuaccaaugagacacagaggaagucugcagcaaacuucuaggaaaucauuucuuucuuuaaagaaaaaagacaaaagaaaacaugauccccuuucugcucuggagauucuuugcaggcugugaugcccggaauugugacaaccauaucacaauuaugggaagaacuuagguuccugaaaaucuuauugcaacauguuuacagccagcccuacaccuggacuucauguuuauuauuuauaucaguccaaguucuugaaaugaugcugcuuucaucugaaauacacaaacaaauaaaauuauauuuauauacacauaaacauguauauacauacauguauauauuuuuauagaguauuagaaugcuacucuuucucaaaauauguuaaauauaaacuaaacuugacuguuaauuaugauguguccuaauuuaauuauaugaaaaauucugauguuuaaaaaauaaaaaaugaaguuauauug

SEQ ID NO: 111 - RNA, 10072 nt, Homo Sapiens
gcgcuggcugcgggcggugagcugagcucgcccccggggagcuguggccggcgccccugccgguucccugagcagcggacguucaugcugggagggcggcggguuggaagcaggugccaccauggcuaguggcagcugucaggggugcgaagaggacgaggaaacucugaagaaguugauagucaggcugaacaauguccaggaaggaaaacagauagaaacgcugguccaaauccuggaggaucugcugguguucacguacuccgagcgcggccuccaaguuauuucaaggcaaaaauauccaugugccucuguugaucgucuuggacuccuauaugagagucgcgagugugcagcagguggguuggucacuucugugcaaauuaauagaagucuguccagguacaaugcaaagcuuaaugggaccccaggauguuggaaaugauugggaaguccuugguguucaccaauugauucuuaaaaugcuaacaguucauaaugccaguguaaacuugucagugauuggacugaagaccuuagaucuccuccuaacuucagguaaaaucaccuugcugauauuggaugaagaaagugauauuuucauguuaauuuuugaugccaugcacucauuuccagccaaugaugaaguccagaaacuuggaugcaaagcuuuacaugugcuguuugagagagucucagaggagcaacugacugaauuuguugagaacaaagauuauaugauauuguuaagugcguuaacaaauuuuaaagaugaagaggaaauugugcuucaugugcugcauuguuuacauucccuagcgauuccuugcaauaauguggaaguccucaugaguggcaaugucagguguuauaauauugugguggaagcuaugaaagcauucccuaugagugaaagaauucaagaagugaguugcuguuugcuccauaggcuuacauuagguaauuuuuucaauauccugguauuaaacgaaguccaugaguuuguggugaaagcugugcagcaguacccagagaaugcagcauugcagaucucagcgcucagcuguuuggcccuccucacugagacuauuuucuuaaaucaagauuuagaggaaaagaaugagaaucaagagaaugaugaugagggggaagaagauaaauuguuuuggcuggaagccuguuacaaagcauuaacguggcauagaaagaacaagcacgugcaggaggccgcaugcugggcacuaaauaaucuccuuauguaccaaaacaguuuacaugagaagauuggagaugaagauggccauuucccagcucauagggaagugaugcucuccaugcugaugcauucuucaucaaaggaaguuuuccaggcaucugcgaaugcauugucaacucucuuagaacaaaauguuaauuucagaaaaauacuguuaucaaaaggaauacaccugaauguuuuggaguuaaugcagaagcauauacauucuccugaaguggcugaaaguggcuguaaaaugcuaaaucaucuuuuugaaggaagcaacacuucccuggauauaauggcagcagugguccccaaaauacuaacaguuaugaaacgucaugagacaucauuaccagugcagcuggaggcgcuucgagcuauuuuacauuuuauagugccuggcaugccagaagaauccagggaggauacagaauuucaucauaagcuaaauaugguuaaaaaacaguguuucaagaaugauauucacaaacugguccuagcagcuuugaacagguucauuggaaauccugggauucagaaauguggauuaaaaguaauuucuucuauuguacauuuuccugaugcauuagagauguuaucccuggaaggugcuauggauucagugcuucacacacugcagauguauccagaugaccaagaaauucagugucuggguuuaagucuuauaggauacuugauuacaaagaagaauguguucauaggaacuggacaucugcuggcaaaaauucugguuuccagcuuauaccgauuuaaggauguugcugaaauacagacuaaaggauuucagacaaucuuagcaauccucaaauugucagcaucuuuuucuaagcugcuggugcaucauucauuugacuuaguaauauuccaucaaaugucuuccaauaucauggaacaaaaggaucaacaguuucuaaaccucuguugcaaguguuuugcaaaaguagcuauggaugauuacuuaaaaaaugugaugcuagagagagcgugugaucagaauaacagcaucaugguugaaugcuugcuucuauugggagcagaugccaaucaagcaaaggagggaucuucuuuaauuugucagguaugugagaaagagagcagucccaaauugguggaacucuuacugaauaguggaucucgugaacaagauguacgaaaagcguugacgauaagcauugggaaaggugacagccagaucaucagcuugcucuuaaggaggcuggcccuggauguggccaacaauagcauuugccuuggaggauuuuguauaggaaaaguugaaccuucuuggcuugguccuuuauuuccagauaagacuucuaauuuaaggaaacaaacaaauauagcaucuacacuagcaagaauggugaucagauaucagaugaaaagugcuguggaagaaggaacagccucaggcagcgauggaaauuuuucugaagaugugcugucuaaauuugaugaauggaccuuuauuccugacucuucuauggacaguguguuugcucaaagugaugaccuggauagugaaggaagugaaggcucauuucuugugaaaaagaaaucuaauucaauuaguguaggagaauuuuaccgagaugccguauuacagcguugcucaccaaauuugcaaagacauuccaauuccuuggggcccauuuuugaucaugaagauuuacugaagcgaaaaagaaaaauauuaucuucagaugauucacucaggucaucaaaacuucaaucccauaugaggcauucagacagcauuucuucucuggcuucugagagagaauauauuacaucacuagaccuuucagcaaaugaacuaagagauauugaugcccuaagccagaaaugcuguauaaguguucauuuggagcaucuugaaaagcuggagcuucaccagaaugcacucacgagcuuuccacaacagcuaugugaaacucugaagaguuugacacauuuggacuugcacaguaauaaauuuacaucauuuccuucuuauuuguugaaaaugaguuguauugcuaaucuugaugucucucgaaaugacauuggacccucagugguuuuagauccuacagugaaauguccaacucugaaacaguuuaaccugucauauaaccagcugucuuuuguaccugagaaccucacugaugugguagagaaacuggagcagcucauuuuagaaggaaauaaaauaucagggauaugcucccccuugagacugaaggaacugaagauuuuaaaccuuaguaagaaccacauuucaucccuaucagagaacuuucuugaggcuuguccuaaaguggagaguuucagugccagaaugaauuuucuugcugcuaugccuuucuugccuccuucuaugacaauccuaaaauuaucucagaacaaauuuuccuguauuccagaagcaauuuuaaaucuuccacacuugcggucuuuagauaugagcagcaaugauauucaguaccuaccaggucccgcacacuggaaaucuuugaacuuaagggaacucuuauuuagccauaaucagaucagcaucuuggacuugagugaaaaagcauauuuauggucuagaguagagaaacugcaucuuucucacaauaaacugaaagagguaagacgauuauugccacuuaaaaaauauacuuuaugauuugcaucauuacaaauuaucauuuuaagugauauuuagcuucuaaauaccaauuucaugaaacuagaagcuuccuguuaacuauaaauuccugucaacuauaaauccagauuuccauuaaauuuaaaaauaagaacagcuacuaaugaugugucacuuaauuuaauuuccauucucacaccgacaauuuaaaaaaaucuacuuuuaaaaauaagguaguagccuuaauacuuccacuaaacaauaaaacaauaugcuauacuuaucagaaccuuuuaaucugaaagcuaaacagcuagauauaaauuugucuacccaacauuuguacaaaguaaaaauuauuagaauauucauuucaaauuaugugugauguuaucauauaacauauuauagauuaacucaaauuauucuuaacuguuacuuaacuaugacaaaacaacuuagaacgcuuugcuaauacacaagauaguauaaggauaaaaauucuuuauaguacuagcucauaaagaguguucuauggaauaguaguggaugucauuuaauaacuauaaauucaaaauaagcauuguaaauaucaauaccauucaauuuuuuuuuguuuuuuaaacaaguuguaagccuacccuaugguaaauggauaugguaacacagcauaauuuccucaaaaaauuacuuuugugauauacuuuuaaaggauuauaugaauauauacauaauuauagaugaaugugaugcugugugucauuguaucaccaaaucucuguccaaucuguuaacagacucuuaaauaaaccauuuuucucauuccuccugagauuggcugucuugaaaaucugacaucucuggaugucaguuacaacuuggaacuaagauccuuucccaaugaaauggggaaauuaagcaaaauaugggaucuuccuuuggaugaacugcaucuuaacuuugauuuuaaacauauaggauguaaagccaaagacaucauaagguuucuucaacagcgauuaaaaaaggcugugccuuauaaccgaaugaaacuuaugauugugggaaauacugggagugguaaaaccaccuuauugcagcaauuaaugaaaaccaagaaaucagaucuuggaaugcaaagugccacaguuggcauagaugugaaagacuggccuauccaaauaagagacaaaagaaagagagaucucguccuaaaugugugggauuuugcaggucgugaggaauucuauaguacucauccccauuuuaugacgcagcgagcauuguaccuugcugucuaugaccucagcaagggacaggcugaaguugaugccaugaagccuuggcucuucaauauaaaggcucgcgcuucuucuuccccugugauucucguuggcacacauuuggauguuucugaugagaagcaacgcaaagccugcaugaguaaaaucaccaaggaacuccugaauaagcgaggguucccugccauacgagauuaccacuuugugaaugccaccgaggaaucugaugcuuuggcaaaacuucggaaaaccaucauaaacgagagccuuaauuucaagauccgagaucagcuuguuguuggacagcugauuccagacugcuauguagaacuugaaaaaaucauuuuaucggagcguaaaaaugugccaauugaauuucccguaauugaccggaaacgauuauuacaacuagugagagaaaaucagcugcaguuagaugaaaaugagcuuccucacgcaguucacuuucuaaaugaaucaggaguccuucuucauuuucaagacccagcacugcaguuaagugacuuguacuuuguggaacccaaguggcuuuguaaaaucauggcacagauuuugacagugaaaguggaagguuguccaaaacacccuaagggcauuauuucgcguagagauguggaaaaauuucuuucaaaaaaaaggaaauuuccaaagaacuacaugucacaguauuuuaagcuccuagaaaaauuccagauugcuuugccaauaggagaagaauauuugcugguuccaagcaguuugucugaccacaggccugugauagagcuuccccauugugagaacucugaaauuaucauccgacuauaugaaaugccuuauuuuccaaugggauuuuggucaagauuaaucaaucgauuacuugagauuucaccuuacaugcuuucagggagagaacgagcacuucgcccaaacagaauguauuggcgacaaggcauuuacuuaaauuggucuccugaagcuuauugucugguaggaucugaagucuuagacaaucauccagagaguuucuuaaaaauuacaguuccuucuuguagaaaaggcuguauucuuuugggccaaguuguggaccacauugauucucucauggaagaaugguuuccuggguugcuggagauugauauuuguggugaaggagaaacucuguugaagaaaugggcauuauauaguuuuaaugauggugaagaacaucaaaaaaucuuacuugaugacuugaugaagaaagcagaggaaggagaucucuuaguaaauccagaucaaccaaggcucaccauuccaauaucucagauugccccugacuugauuuuggcugaccugccuagaaauauuauguugaauaaugaugaguuggaauuugaacaagcuccagaguuucuccuaggugauggcaguuuuggaucaguuuaccgagcagccuaugaaggagaagaaguggcugugaagauuuuuaauaaacauacaucacucaggcuguuaagacaagagcuuguggugcuuugccaccuccaccaccccaguuugauaucuuugcuggcagcugggauucguccccggauguuggugauggaguuagccuccaaggguuccuuggaucgccugcuucagcaggacaaagccagccucacuagaacccuacagcacaggauugcacuccacguagcugaugguuugagauaccuccacucagccaugauuauauaccgagaccugaaaccccacaaugugcugcuuuucacacuguaucccaaugcugccaucauugcaaagauugcugacuacggcauugcucaguacugcuguagaauggggauaaaaacaucagagggcacaccaggguuucgugcaccugaaguugccagaggaaaugucauuuauaaccaacaggcugauguuuauucauuugguuuacuacucuaugacauuuugacaacuggagguagaauaguagaggguuugaaguuuccaaaugaguuugaugaauuagaaauacaaggaaaauuaccugauccaguuaaagaauaugguugugccccauggccuaugguugagaaauuaauuaaacaguguuugaaagaaaauccucaagaaaggccuacuucugcccaggucuuugacauuuugaauucagcugaauuagucugucugacgagacgcauuuuauuaccuaaaaacguaauuguugaaugcaugguugcuacacaucacaacagcaggaaugcaagcauuuggcugggcugugggcacaccgacagaggacagcucucauuucuugacuuaaauacugaaggauacacuucugaggaaguugcugauaguagaauauugugcuuagccuuggugcaucuuccuguugaaaaggaaagcuggauugugucugggacacagucugguacucuccuggucaucaauaccgaagaugggaaaaagagacauacccuagaaaagaugacugauucugucacuuguuuguauugcaauuccuuuuccaagcaaagcaaacaaaaaaauuuucuuuugguuggaaccgcugauggcaaguuagcaauuuuugaagauaagacuguuaagcuuaaaggagcugcuccuuugaagauacuaaauauaggaaaugucaguacuccauugauguguuugagugaauccacaaauucaacggaaagaaauguaauguggggaggauguggcacaaagauuuucuccuuuucuaaugauuucaccauucagaaacucauugagacaagaacaagccaacuguuuucuuaugcagcuuucagugauuccaacaucauaacaguggugguagacacugcucucuauauugcuaagcaaaauagcccuguuguggaagugugggauaagaaaacugaaaaacucuguggacuaauagacugcgugcacuuuuuaagggagguaaugguaaaagaaaacaaggaaucaaaacacaaaaugucuuauucugggagagugaaaacccucugccuucagaagaacacugcucuuuggauaggaacuggaggaggccauauuuuacuccuggaucuuucaacucgucgacuuauacguguaauuuacaacuuuuguaauucggucagagucaugaugacagcacagcuaggcaagaagccuuaaaaaugucaugcugguauugggcuacaaccggaaaaauacugaagguacacaaaagcagaaagagauacaaucuugcuugaccguuugggacaucaaucuuccacaugaagugcaaaauuuagaaaaacacauugaagugagaaaagaauuagcugaaaaaaugagacgaacaucuguugaguaagagagaaauaggaauugucuuuggauaggaaaauuauucucuccucuuguaaauauuuauuuuaaaaauguucacauggaaaggguacucacauuuuuugaaauagcucguguguaugaaggaauguuauuauuuuuaauuuaaauauauguaaaaauacuuaccaguaaauguguauuuuaaagaacuauuuaaaacacaauguuauauuucuuauaaauaccaguuacuuucguucauuaauuaaugaaaauaaaucugugaaguaccuaauuuaaguacucauacuaaaauuuauaaggccgauaauuuuuuguuuucuugucuguaauggagguaaacuuuauuuuaaauucugugcuuaagacaggacuauugcuugucgauuuuucuagaaaucugcacgguauaaugaaaauauuaagacaguuucccauguaauguauuccuucuuagauugcaucgaaaugcacuaucauauaugcuuguaaauauucaaaugaauuugcacuaauaaaguccuuuguugguaugugaauucucuuuguugcuguugcaaacagugcaucuuacacaacuucacucaauucaaaagaaaacuccauuaaaaguacuaaugaaaaaacaugacauacugucaaaguccucauaucuaggaaagacacagaaacucucuuugucacagaaacucucugugucuuuccuagacauaauagaguuguuuuucaacucuauguuugaauguggauacccugaauuuuguauaauuaguguaaauacaguguucaguccuucaagugauauuuuuauuuuuuuauucauaccacuagcuacuuguuuucuaaucugcuucauucuaaugcuuauauucaucuuuucccuaaauuugugaugcugcagauccuacaucauucagauagaaaccuuuuuuuuuuucagaauuauagaauuccacagcuccuaccaagaccaugaggauaaauaucuaacacuuuucaguugcugaaggagaaaggagcuuuaguuaugauggauaaaaauaucugccacccuaggcuuccaaauuauacuuaaauuguuuacauagcuuaccacaauaggaguaucagggccaaauaccuauguaauaauuugaggucauuucugcuuuaggaaaaguacuuucgguaaauucuuuggcccugaccaguauucauuauuucagauaauucccugugauaggacaacuaguacauuuaauauucucagaacuuauggcauuuuacuaugugaaaacuuuaaauuuauuuauauuaaggguaaucaaauucuuaaagaugaaagauuuucuguauuuuaaaggaagcuaugcuuuaacuuguuauguaauuaacaaaaaaaucauauauaauagagcucuuuguuccaguguuaucucuuucauuguuacuuuguauuugcaauuuuuuuuaccaaagacaaauuaaaaaaaugaauaccauauuuaaauggaauaauaaagguuuuuuaaaaacuuuaaa

SEQ ID NO: 112 - RNA, 282 nt, Homo Sapiens
augucaacagacacagguguuucccuuccuucauaugaggaagaucagggaucaaaacuuauuggaaaagcuaaagaggcaccauuuguacccguuggaauagcagguuuugcagcaauuguugcauauggauuauacaaacugaagagcaggggaaauacuaaaauguccauucaucugauccacaugcguguggcagcccaaggcuuuguuguaggagcaaugacuguugguaugggcuacuucauguaucgggaauucugggcaaaaccuaagccuuag

SEQ ID NO: 113 - RNA, 6271 nt, Homo Sapiens
augcucuggggcgugccgccgccgucgcugccaccuccccuaccgcuaguggaagaagauggcggaaggcggagcggcggaucuggacacccagcggucugacaucgcgacgcugcucaaaaccucgcuccggaaaggggacaccugguaccuagucgauagucgcugguucaaacaguggaaaaaauauguuggcuuugacaguugggacaaauaccagaugggagaucaaaauguguauccuggacccauugauaacucuggacuucucaaagauggugaugcccagucacuuaaggaacaccuuauugaugaauuggauuacauacuguugccaacugaagguuggaauaaacuugucagcugguacacauugauggaaggucaagagccaauagcacgaaaggugguugaacaggguauguuuguaaagcacugcaaaguagaaguauaucucacagaauugaagcuaugugaaaauggaaacaugaauaauguuguaacucgaagauuuagcaaagcugacacaauagauacaauugaaaaggaaauaagaaaaaucuucaguauuccagaugaaaaggagaccagauuguggaacaaauacaugaguaacacauuugaaccacugaauaaaccagacagcaccauucaggaugcugguuuauaccaaggacagguauuagugauagaacagaaaaaugaagauggaacauggccaagggguccuucuacuccuaaaaagccacuagagcagaguugcuagugaacaguuuaauuuccacauacgucacagaaagagagcuaaagggcucugguuaucauccacagacugaccagucaaccccuaaauaaccugauauuaacuccacaaauguuagcuagauuggaccauguguaaucugagucagaagucggaaucagaagagauaaaugaugcguuaucacucaacaguaaugucugcaacaguauuguaaaauuguuguacuuuaccugucgaccacauccauccuuagcucucugaucaccuuacuauuuaaggacagucccucuacucuaccuguaguauuuaucucaaugcuuccugguccuugcuuuuucuuuuauuaucuccucucuccuacauauauaaaugccuagcauagugccacacauaugguaaacaccaguuuauuauuuuuauuucuuuucuaaugucaucuucccccucagccuaugaauauaaacacaucuucaucuuuaaaaccaaaaaccauauacuuccuccauuuaccauccuuaagcuuuuuuuucuuugacagccaccuacauuuaaaaggcuauacuuaauguugcuugccacccauucaggauuuaacaaaguucuuauuugucuuucuuuuaaccuaguuuauuugaccugucuuuaguauuucuuuuugauaaccaucuucuaaagaaauucucugaauuugaaugcaugauacgaccuuuuaugccaaggacuuugccucucugaccaguccuuugucugucuagcucgguuccucuuuaggguugccacauuuaguuuugcaaauugugcacagcucuaggaggcaucauucauaucauauguagucuaugugauaggcccuccuuggcacggugcagugcagcuucacuaacuguuugcagcagcucuacucagaccuuaaaugcauugacauucacuaaauuucugucagaagaccucuuuuaucauaccauaguagguguucaaaauuaggugauucuaugcuaauccucucccccagcucaaacugacacaaaauaugccauucuguauuucuagacuagaccacuuuucugaauuccagauuuuucauaaauuucauguaggacucaccaccucaaauuaaaccaaaucuuuuuaccccuccuucucccauccccucaaccuaaacugucuucauuuccuguauugccuauuucaaguaccauccaagagccauccugaguuccuccuccagccuuucuucucuugucuaguuagucagcaagucuugcagauucugccuccucaccugaaguuuucaaacaguaccccuuuacauucuugaaaauuauuaaagauccaaagaacuucuguuauauggguuauagcuguuaauauuugucauauucgaaauugaaauaagauuuuaagguauuuuaaaauaacaguacaaaaccauuguauuuugacaugaauaacacuuuuaugaaaauaacuauauuccaaaacaauaaaauuaccaaaaaguguccccaggugcauccaauuuuucaacuuuaccaaagaucucuccuucaucucuaucaaauaauuauaacaacaugaacaacagaaaugugaaaaacucaaauuacugucuuccaucauauaccgcuuauaagaacuaugauuauucggaaccuggaagaaacaaugaacagccaggccucuguggccuaaguaacuugggaaauacguguuucaugaacucagcuauucaguguuugagcaacacaccuccacuuacugaguauuuccucaaugauaaguaucaagaagaacugaauuuugacaaucccuuaggaaugagaggugaaauagcuaaaucuuaugccgaacugaucaagcaaauguggucuggaaaguuuagcuacgucaccccaagagccuuuaagacacagguaggacguuuugcaccucaguucucuggauaucagcagcaagacugucaagaacuguuagcuuuccuauuagauggauuacaugaggauuugaauagaauuaggaaaaaaccauauauacaauuaaaagaugcagauggaaggccagauaaggugguugccgaagaagccugggaaaaccauuuaaaacgaaaugauucuaucauaguagauauauuucauggccuuuucaaaucaacuuuaguuuguccugagugugcuaagauuucaguaacauuugauccuuuuuguuacuugacacuuccauugcccaugaaaaaagaacgcaccuuggaaguuuacuuaguuagaauggauccacuuaccaaaccuaugcaguacaaagugguuguccccaaaauuggaaacauauuagaucuuuguacagcauugucugcuuugucaggaauaccugcagauaagaugauaguuacugauauauacaaucauagauuucacagaauauucgcuauggaugaaaaccuuaguaguauuauggaacgggaugauauuuauguguuugaaauuaacaucaauaggacagaagauacagagcacgugauuauuccuguuugccuaagagaaaaauucagacacucgaguuauacccaccauacugguucuucacuuuuuggucagcccuuucuuauggcuguaccacgaaacaauacugaagacaaacuuuauaaucuccugcucuugagaaugugccgauaugucaaaauaucuacugaaacugaagaaacugaaggaucccuacacugcuguaaggaccaaaauauuaaugggaauggcccaaauggcauacaugaagaaggcucaccaagugaaauggaaacagaugagccagaugaugaauccagccaggaucaagaacuucccucagagaaugaaaacagucagucugaagauucaguuggaggagauaaugauucugaaaauggauuauguacugaggauacuugcaaaggucaacucacgggacacaaaaaacgauuguuuacauuccaguucaacaacuuaggcaauacugauaucaacuacaucaaagaugauaccaggcauauaagauuugaugauaggcagcuuaggcuagaugaaagaucuuuucuugcuuuggauugggauccugauuugaaaaaaagauauuuugaugaaaaugcugcugaggacuuugaaaaacaugaaaguguggaguauaaaccuccuaaaaaacccuuugugaaauuaaaagauugcauugaacuuuuuacaacaaaagaaaagcuaggugcugaagaucccugguauuguccgaauuguaaagaacaucagcaagccacaaagaaauuggauuuauggucccugccuccaguacuuguaguacaucucaagcgauuuucuuacagucgauacaugagagacaaguuggauaccuuaguugauuuuccuaucaaugacuuggauaugucggaauucuuaauuaauccaaaugcagguccuugccgcuauaaucugauugcuguuuccaaccacuauggagggaugggaggaggacacuauacugcuuuugcaaaaaauaaagaugauggaaaaugguacuauuuugaugacaguagugucuccacugcaucugaagaccaaauuguguccaaagcagcauauguacucuucuaccagagacaagacacuuucaguggaacuggcuuuuuuccucuugaccgagaaacuaaaggugcuucagcugccacuggcaucccauuagaaagugaugaagauagcaaugauaaugacaaugauauagaaaaugaaaacuguaugcacacuaacuaaugaaaguccuagaagccauaaaagagacacuuuccugcuggugguaucuauggaaaugaugaaguuacccaccacauuaaaacaaaagucugagauggggaguuucagauaaccgaauguaaauccuuuaucagauuuuaacuugugcaguacuugaagugaaacacaaugaaaacuuuaacagaaauugucucuuaauacauuuacagucuuguauuuacaagcuaaauauauauaggaaaucacaaauaaaucccuuuuaaguuugcugcuguuuugauuaauuauguuuccuuuaauuuuuuggaugugaguugaugacaaauguuaaauuuguggauguuggucauuuauuuugcucuaauaauacugcaagaaaacuauggcugaacuuaguuuuuggauaaucuaguucaugugcauuaggcugccguauauacuacuaugauauuuagcugcaguaucaauguggcauaaauacugcggcagcauucuucgaaaaccgcauuuucaaauuuauccccguaaucaaugugggccuauuaaaaaaccaaaucaugauacaagaaacaaccuuggaaaaguuauuucccuuuguaauaccuuuaaaaauccagaguauuauauucauuuuacugccacuguggaaacagguucuagauuucauacuccaucuaaagucauuuuucaguuacauguaaguauuauuuacugcuauugggaucuauucuucagauauucaaaaacauuuuuugcuuuaaaaugcauaucuuuaauuggguguugguccaaaauuaaaauuuuugcugucuguuuuucucuaccccauuuugugguaauuuggcaacuugagcucucccaauuauuguaauauaaggacagacauaauaguauucuguacccauaguaauaauugcaucaagcuuagaugagaaauuuuuuucauauacuggccuuuaaaucauuaauggacaauuggcuauaaagguaggucuguuaacuuucuuuguguguuccugauggaauucaccauagccuuacagcuuuucucagaagguaacuuguuauaagagaaauggcauuugcauguuccagagucagaaccuguacaguauauaaagcauaaacaccuugaauuugauuuuaguucaccacauucaaggauccaggaugccaaaaauaugugugaacauuugaaacauuuuuauuugcugcuuuuucccuuugauauaguugaaagaauguauuguaaauuggcauacaauacugccuuuaauagaaaaccuaaaugcuggggcacauuucacauaucgacuaccugagaaauugcuuugugucccacuguuauuaaagcaaaaaguauaauguucuucacuugaacuaaucaaauacaauagauuauaaauuguguauuguaaauaaaaguucacucugugagugcacauuuugguaaauuauuuauuuauguuagcauuuaaaaguuuaaaaaaaaugcauuugaccaggauaaaugagguauguugaucauggcuuugcuuuauaucuugauauuaaagcugguuuaucauccugguauuuuaaaagcugcuuugggguuuuuuuuuucuuuuuuuuuuuuuuaauguaaacuaaccuccugcaugacagagguuaaaauuuugucugcacuugaguucacuugaguuuacauuugaaaugugcauguuuauuuauauagauuucaauaaagcuauucaaggccuu

SEQ ID NO: 114 - RNA, 3019 nt, Homo Sapiens
ggaaguguccugagucucgaggaggccgcgggagcccgccggcgguggcgcggcggagacccggcugguauaacaagaggauugccugauccagccaagaugcagagcacuucuaaucaucuguggcuuuuaucugauauuuuaggccaaggagcuacugcaaaugucuuucguggaagacauaagaaaacuggugauuuauuugcuaucaaaguauuuaauaacauaagcuuccuucguccaguggauguucaaaugagagaauuugaaguguugaaaaaacucaaucacaaaaauauugucaaauuauuugcuauugaagaggagacaacaacaagacauaaaguacuuauuauggaauuuuguccaugugggaguuuauacacuguuuuagaagaaccuucuaaugccuauggacuaccagaaucugaauucuuaauuguuuugcgagaugugguggguggaaugaaucaucuacgagagaaugguauagugcaccgugauaucaagccaggaaauaucaugcguguuauaggggaagauggacagucuguguacaaacucacagauuuuggugcagcuagagaauuagaagaugaugagcaguuuguuucucuguauggcacagaagaauauuugcacccugauauguaugagagagcagugcuaagaaaagaucaucagaagaaauauggagcaacaguugaucuuuggagcauugggguaacauuuuaccaugcagcuacuggaucacugccauuuagacccuuugaagggccucguaggaauaaagaagugauguauaaaauaauuacaggaaagccuucuggugcaauaucuggaguacagaaagcagaaaauggaccaauugacuggaguggagacaugccuguuucuugcagucuuucucggggucuucagguucuacuuaccccuguucuugcaaacauccuugaagcagaucaggaaaaguguugggguuuugaccaguuuuuugcagaaacuagugauauacuucaccgaaugguaauucauguuuuuucgcuacaacaaaugacagcucauaagauuuauauucauagcuauaauacugcuacuauauuucaugaacugguauauaaacaaaccaaaauuauuucuucaaaucaagaacuuaucuacgaagggcgacgcuuagucuuagaaccuggaaggcuggcacaacauuucccuaaaacuacugaggaaaacccuauauuuguaguaagccgggaaccucugaauaccauaggauuaauauaugaaaaaauuucccucccuaaaguacauccacguuaugauuuagacggggaugcuagcauggcuaaggcaauaacagggguuguguguuaugccugcagaauugccaguaccuuacugcuuuaucaggaauuaaugcgaaaggggauacgauggcugauugaauuaauuaaagaugauuacaaugaaacuguucacaaaaagacagaaguugugaucacauuggauuucuguaucagaaacauugaaaaaacugugaaaguauaugaaaaguugaugaagaucaaccuggaagcggcagaguuaggugaaauuucagacauacacaccaaauuguugagacuuuccaguucucagggaacaauagaaaccagucuucaggauaucgacagcagauuaucuccagguggaucacuggcagacgcaugggcacaucaagaaggcacucauccgaaagacagaaauguagaaaaacuacaaguccuguuaaauugcaugacagagauuuacuaucaguucaaaaaagacaaagcagaacguagauuagcuuauaaugaagaacaaauccacaaauuugauaagcaaaaacuguauuaccaugccacaaaagcuaugacgcacuuuacagaugaauguguuaaaaaguaugaggcauuuuugaauaagucagaagaauggauaagaaagaugcuucaucuuaggaaacaguuauuaucgcugacuaaucaguguuuugauauugaagaagaaguaucaaaauaucaagaauauacuaaugaguuacaagaaacucugccucagaaaauguuuacagcuuccaguggaaucaaacauaccaugaccccaauuuauccaaguucuaacacauuaguagaaaugacucuugguaugaagaaauuaaaggaagagauggaaggggugguuaaagaacuugcugaaaauaaccacauuuuagaaagguuuggcucuuuaaccauggaugguggccuucgcaacguugacugucuuuagcuuucuaauagaaguuuaagaaaaguuuccguuugcacaagaaaauaacgcuugggcauuaaaugaaugccuuuauagauagucacuuguuucuacaauucaguauuugauguggucguguaaauauguacaauauuguaaauacauaaaaaauauacaaauuuuuggcugcugugaagauguaauuuuaucuuuuaacauuuauaauuauaugaggaaauuugaccucagugaucacgagaagaaagccaugaccgaccaauauguugacauacugauccucuacucugaguggggcuaaauaaguuauuuucucugaccgccuacuggaaauauuuuuaaguggaaccaaaauaggcauccuuacaaaucaggaagacugacuugacacguuuguaaaugguagaacgguggcuacugugaguggggagcagaaccgcaccacuguuauacugggauaacaauuuuuuugagaaggauaaaguggcauuauuuuauuuuacaaggugcccagaucccaguuauccuuguauccauguaauuucagaugaauuauuaagcaaacauuuuaaagugaauucauuauuaaaaacuauucauuuuuuuccuuuggccauaaauguguaauugucauuaaaauucuaaggucauuucaacuguuuuaagcuguauauuucuuuaauucugcuuacuauuucauggaaaaaaauaaauuucucaauuuuaaugu

SEQ ID NO: 115 - RNA, 2340 nt, Homo Sapiens
gcgguuguguaacggccugucgcaggcgugcagggaccuggacuccgccucguccccggggcucgggcagccgagccauggcggggaacuguggggcccgcggcgcgcugucggcgcacacgcugcuguucgaccugccgcccgcgcugcucggagagcucugcgcuguucuggacagcugcgacggcgcgcugggcuggcgcggccuggcagagagacuuucaagcagcuggcuggauguucgucauauugaaaaguauguagaccaagguaaaaguggaacaagagaauuacuuugguccugggcacagaaaaacaagaccaucggugaccuuuuacagguccuccaggagaugggacaucgucgagcuauucauuuaauuacaaacuauggagcaguguugaguccuucagagaagaguuaucaggaagguggauuuccaaauauauuauucaaggaaacagccaaugucaccguggauaauguucuuauuccugaacauaaugaaaaaggaauacugcuuaaaucuuccaucagcuuucaaaauaucauagaaggaacuagaaauuuccacaaagacuuccuaauuggagaaggagagauuuuugagguauacagaguggagauucaaaaccuaacauaugcugucaaauuauuuaaacaggagaaaaaaaugcaguguaagaagcauuggaagagguuuuuaucugagcuugaaguuuuacuacuguuucaucacccaaacauacuagaguuggcugcauauuuuacagagacugagaaguucugucugauuuauccauacaugagaaauggaacacuuuuugacagauugcaguguguaggugacacggccccacucccuuggcacauucgaaucgguauauuaauaggaauauccaaagccauucacuaccugcacaacguucaaccaugcucggucaucuguggcaguauaucaagugcaaacauccuuuuggaugaucaguuucaacccaaacuaacugauuuugccauggcacacuuccggucccaccuagaacaucagaguuguaccauaaauaugaccagcagcagcaguaaacaucugugguacaugccagaagaguacaucagacaggggaaacuuuccauuaaaacagaugucuacagcuuuggaauuguaauaauggaaguucuaacaggauguagaguaguguuagaugauccaaaacauauccagcugcgggaucuccuuagagaauugauggagaagagaggccuggauucaugucucucauuucuagauaagaaagugccucccugcccucggaauuucucugccaagcucuucuguuuggcaggccggugugcugcaacgcgggcaaaguuaagaccaucaauggaugaaguuuuaaauacucuugaaaguacucaagccagcuuguauuuugcugaagauccucccacaucacuaaaguccuucagguguccuucuccucuauuccuggagaauguaccaaguauuccaguggaagaugaugaaagccagaauaacaauuuacuaccuucugaugaaggccugaggauagacagaaugacucagaaaacuccuuuugaaugcagccagucugagguuauguuucugagcuuggacaaaaagccagagagcaagagaaaugaggaagcuugcaacaugcccaguucuucuugugaagaaaguugguucccaaaguauauaguuccaucccaggacuuaaggcccuauaagguaaauauagauccuucuucagaagcuccagggcauucuugcaggagcaggccaguggagagcagcuguuccuccaaauuuuccugggaugaauaugaacaguacaaaaaagaauaaauucuaccagaagauaaagaaaaaagcaaguauugcauaggcaccugagcauagguaugaccuugggaagacauuggcuccauaagcaaugccaagagaaugaucaauagugaguuugggugaugcagauaaacaaucuggauaauuccauuucuuuuuucccaaacccucaaacagagugccuuaaaaaauuguuuuaucaggauaauugucucaugaccaaauccacgcucaauuagagccauucaaaauuccuuaagaucauggguucugacuucagccaaacaaaacaaucaaaaccuaccaaaaagggacuggauuguaauguccucuccaucauccucagugugaguccucagagccuccaucugccaagaacauucaguuggauuccaucguuugguuuagcuugcuugcacggguuguaggaaaugucuaauuuguaaauguuaauagauaccuuuggaaagaa

SEQ ID NO: 116 - RNA, 3212 nt, Homo Sapiens
auuaccaggcacgcgcaggaaacauggcggcggcggguguugugagcgggaagauuauauaugaacaagaaggaguauauauucacucaucuuguggaaagaccaaugaccaagacggcuugauuucaggaauauuacguguuuuagaaaaggaugccgaaguaauaguggacuggagaccauuggaugaugcauuagauuccucuaguauucucuaugcuagaaaggacuccaguucaguuguagaauggacucaggccccaaaagaaagaggucaucgaggaucagaacaucugaacaguuacgaagcagaaugggacaugguuaauacaguuucauuuaaaaggaaaccacauaccaauggagaugcuccaagucauagaaaugggaaaagcaaauggucauuccuguucaguuugacagaccugaaaucaaucaagcaaaacaaagaggguaugggcugguccuauuugguauucugucuaaaggaugacgucguucucccugcucuacacuuucaucaaggagauagcaaacuacugauugaaucucuugaaaaauaugugguauugugugaaucuccacaggauaaaagaacacuucuugugaauugucagaauaagagucuuucacagucuuuugaaaaucuucuugaugagccagcauaugguuuaauacaagcaggacugcuagacagaagaaagcuguugugggccauucaccacuggaaaaaaauuaaaaaggacccuuauacggcaacuaugauaggauuuuccaaagucacaaacuacauuuuugacaguuugagaggcagcgaucccucuacacaucaacgaccaccuucagaaauggcagauuuucuuagugaugcuauuccaggucuaaagauaaaucaacaagaagaaccaggauuugaagucaucacaagaauugauuugggggaacgcccuguuguucaaaggagagaaccgguaucacuggaagaauggacuaagaacauugauucugaaggaagaauuuuaaauguagauaauaugaagcagaugauauuuagagggggacuuagucaugcauugagaaagcaagcauggaaauuucuucuggguuauuuucccugggacaguaccaaggaggaaagaacccaauuacaaaagcaaaaaacugaugaauacuucagaaugaaacugcaguggaaauccaucagccaggaacaagagaaaagaaauucgagguuaagagauuauagaagucuuaucgaaaaagauguuaacagaacagaucgaacaaacaaguuuuaugaaggccaagauaauccaggguugauuuuacuucaugacauuuugaugaccuacuguauguaugauuuugauuuaggauauguucaaggaaugagugauuuacuuuccccucuuuuauaugugauggaaaaugaaguggaugccuuuuggugcuuugccucuuacauggaccaaaugcaucagaauuuugaagaacaaaugcaaggcaugaagacccagcuaauucagcugaguaccuuacuucgauuguuagacaguggauuuugcaguuacuuagaaucucaggacucuggauaccuuuauuuuugcuucagguggcuuuuaaucagauucaaaagggaauuuaguuuucuagauauucuucgauuaugggagguaauguggaccgaacuaccauguacaaauuuccaucuucuucucuguugugcuauucuggaaucagaaaagcagcaaauaauggaaaagcauuauggcuucaaugaaauacuuaagcauaucaaugaauuguccaugaaaauugauguggaagauauacucugcaaggcagaagcaauuucucuacagaugguaaaaugcaaggaauugccacaagcagucugugagauccuugggcuucaaggcagugaaguuacaacaccagauucagacguuggugaagacgaaaauguugucaugacuccuuguccuacaucugcauuucaaaguaaugccuugccuacacucucugccaguggagccagaaaugacagcccaacacagauaccaguguccucagaugucugcagauuaacaccugcaugaucacuguucuugcuuuuuugggaagagacacuuuguugcaacccuuuuucaaguacuugaaaguugaaaauuugaaaucuugguauugaucaugcuuuaagguuuauguaaagaaaguguacugauguucuuacauuaaagcuuuacaaagauuuaaacuaauuauuuuuguaguuacuucuaccaaauagccuuuccuuuucgauaacauuccucaguauuuuuauagccaaguacauuuuauuuucuugcugaugaacuggaauuggauaaauauugcaaguggaugaguuggaaauuaugcacuuugaaaaacauucacuuuguuuaagcuuauuggguuucagauuugauuaaauuaaauguggaggcuuucuauagcauucuaagcugagaaguagauuguuacccaguaaugaaauaaaaaauaaaaauaaaaggauuuuuuucucuauuguuuacgacaguacucagcuuaaauauuuaugcuggucaaaugugauuuaaauuggacauuuucaucaaugcagucuaauguguagauaaauauuucaaccauaauaaguggauuggcaguauauuuuuuacauugaacuuuucuucacuuguauauaaagauuauauauaaguacuuauuuaugaguauaagaaagguuaggcauauuuucauuaacugaauaaacgacuugauuuauauaaccugguuuaucaaaauuuaacauggcuucaguaugagaucuuuuucaaaacuauuuucuuaaacauuuauuucaugagauuauguucaacccuguaccugguguaauuuuaaaauuaauugcuuguaaccucacuuuacuaauaauguuuauuaucuuuccuaauaaugcauuaacugauuaaucagguguuuaaauuuuuauaaaauacucuugcaaaaaguuuauuugaaaaauuucuagauggucucaugaguuucaaaauaauaauuuuuguguaugaacaaagcuguuguuuuuaccaugcaguauugcaugauuuuaaguuauguggaauuaacauaacugauuuuguuuuaauuguaaguuguuaacuccuguauauaucauuaaaauaaaucugaaguugaaguag

SEQ ID NO: 117 - RNA, 5389 nt, Homo Sapiens
uuguauccauguuuuuccgggcgucccccggagggacagguugcgggugaccuuuucaaguguggaggaaagggaagcugcuuuugucuucaggaaugaugcaggucucgacucaagccugacgggcccaaaccucccuggagcuggcugacgacucugcccgaguuccugaagaggggucccgggggucccggagcggaagugggagcgcgugggcgugggcuccucggcugccuggggcuccagacuugugcugcgugcggcuccggagcucuguucucgcuccugagcagcugcuagguuucccaagcgacugucucaaccgcccggccgccucccccgggcagccagagcuucacaucuaccuccagccgggacccgcccccgagccgcggggcccacgcccagagcccuccgccguccccagcgcagugcagcagagcgcgauccagucuggggccgggccgcgcuuccgcgcacgcgcggagaaacccgcgcccuccgaggggggaggggacagagggggcgucacgggggcaggagaagaaggaggaggaggcccgcgucgccuccggcggggcucgcgcucgccccgcgcucgcccuccgccucgcccgagccccgggagggugaaacgcuuucucccagcaugcagcgggaggagggauuuaacaccaagauggcggacggcccggaugaguacgauaccgaagcgggcugugugccccuucuccacccagaggaaaucaaaccccaaagccauuauaaccauggauauggugaaccucuuggacggaaaacucauauugaugauuacagcacaugggacauagucaaggcuacacaauauggaauauaugaacgcugucgagaauugguggaagcagguuaugauguacggcaaccggacaaagaaaauguuacccuccuccauugggcugccaucaauaacagaauagauuuagucaaauacuauauuucgaaaggugcuauuguggaucaacuuggaggggaccugaauucaacuccauugcacugggccacaagacaaggccaucuauccaugguugugcaacuaaugaaauauggugcagauccuucauuaauugauggagaaggauguagcuguauucaucuggcugcucaguucggacauaccucaauuguugcuuaucucauagcaaaaggacaggauguagauaugauggaucagaauggaaugacgccuuuaaugugggcagcauauagaacacauaguguggauccaacuagauugcuuuuaacauucaauguuucaguuaaccuuggugacaaguaucacaaaaacacugcucugcauugggcagugcuagcagggaauaccacagucauuagccuucuucuggaagcuggagcuaauguugaugcccagaauaucaaggcaauccuuaggugucacauggcccucuaguggaagggaugcucagcuggaccgaggcaacugcaggauauucccggggaguuguuacccaagggauugcuuuuauucagggcgaaucagcgcuugauuuggcaaaacagagaaaaaauguguggaugaucaaccacuuacaagaggcaaggcaagcaaaaggauaugacaauccguccuuccuuagaaagcugaaagcugauaaggaauuucggcagaaaguaauguuaggaacuccuuuccuaguuauuuggcugguuggguuuauagcagaccuaaauauugauucuuggcucauuaaagggcuaauguauggugguguuugggcuacaguacaguuucuuucaaaauccuuuuucgaucauucaaugcauagugcauugccccuugggauauauuuggcaaccaaauucuggauguaugugacgugguucuucugguuuuggaauggguuugggcacaucucaacuuuuuauuuauccaucuuccauuccuugccaauaguguugcacuuuucuacaauuuuggaaaaucuuggaaaucagauccagggauuauuaaagcaacagaagagcaaaagaaaaagacaauaguugaacuugcagagacaggaagucuggaccucaguauauucugcaguaccuguuugauacgaaaaccggugagguccaaacauuguggugugugcaaccgcuguauagcaaaauuugaucaucauugcccauggguggguaacuguguaggugcaggcaaccauagauauuuuaugggcuaccuauucuucuugcuuuuuaugaucugcuggaugauuuaugguuguauaucuuacuggggacuccacugugagaccacuuacaccaaggauggauuuuggacauacauuacucagauugccacguguucaccuuggauguuuuggauguuccugaacaguguuuuccacuucauguggguggcuguauuacucaugugucagauguaccagauaucauguuuagguauuacuacaaaugaaagaaugaaugccaggagauacaagcacuuuaaagucacaacaacgucuauugaaagcccauucaaccauggauguguaagaaauauuauagacuucuuugaauuucgaugcuguggccucuuucguccuguuaucguggacuggaccaggcaguauacaauagaauaugaccaaauaucaggaucuggguaccagcugguguagcgacaucuuauccuaugaagcauauugcugaguggugccugaaaauugugucuguccgugucuuucucacacucgaauccacauccuuugaacaagagcaugcuauguguagggcuaauggugaauuuuacagucuuuuuuucaacacuuuuauuaacaaaaguaaacauggacagaacacacugccauuucugggaagaguaaagaugauaaaaaauaauuuuaaugguucuuaauguggaaauucacaacauacucaacuuuuggguuuuguucucacaguauuuuucacaaaaaaaggguaaacuuauucuauugacagacaugguguacugaucagaaauguucaguuuuaacuaaaacuaaauuuauguuauuuggcuaaauguuaugaugcagucuaguacgaguauugcaucuaauuccaggagcauuguuuuaaguugauugacuaguuauuauguacauuucagaauguacacauaaauacugugaugaaaaucaugugauugggaucuacugugauguugucuucaaaggcaggagaaaauaauguucacaauaaaaugugcuaacaauguuuuguuucuaucagcuguugcaaugcugauauauuucuaguucagugaaauaauuuguaguaaccuuacucugagguuuuacggucugauaaugaagcacuugcaugaguauaguaagucauguuuuuuuguucaaauuuaaaagcccugcuaauugcaugacacaccacauagaauguauacuagcagauacuauccagugaagcauaaauuagaauuuaauuugauguucaaaaacaguuccauuuuuaaggguuaaggugguauuuucaagaaaaggcagaacaaauaaugcaaaauucucaguaauagugauacauggauauacuuccuuuuaaauucucagcugcaaaauaauuguagacaaaauaauggcauuuaacuaaagauggagcaugaucuaaguacauagcacaugugaauaaaagaaaagcugacaguauauucugguuucaauaaaaugaccuaucagaaaguagaauuucauccccaagaguauuucaguuuauccaauauugaguaaguucugaaacaguuuuagaaaaaauuuucuuuuuguuaaaugugaugcacugaucaauuuuugucacagcauuuucauaccuucaugguggacuacuagucacugcuuccauaaauauuguuuacagggugagauuugguuuauucaucuuaagugcuguagcaaacugugguucgagcaaccugugggaaaucugugagagggaauggggugggagaugugggggaaugguggucagacugaugacagauccuagaccaauguaaagaauguguaucuguauauaaauaauuuaucaaauaguuuucucuuugugucuguguuaguguuuuuaaagcugcucauuucauuuuguccaaccaaaaagaaaagggagauaacuaaugagcuucuagugauguucaaaauugcuguuaauaggcauuauacccugcaaguucacugcaugucugaugcuugguaaaacuagucuucccuguaaaaugcagauuacagguauuaaagcaaucuagugguauacccgccccuugccuuaguaagaggagcagugaaauguauauaguugauguucaguauuuccaaguaccauuuuuauauaguagcuuauuugaccauaagucacacaucaaaaaaagauuacccuuaguguauguguuuuaauauuagaaaauuggcauauguacuuuauuuuugaaaagggaagagaugggugugggguggcaauagcauugugccauuuugucauagaauguaaaaauugguuaacuuuacaaaugucagcuaguuuugacuacuaauugggggaaauuuuagauaauuuuuaaauucaaaguuauuuauaaaaugcuagaauuuguuuuaauuuuuuguauuuugagccacuucacaugaagacucaguugcauuuuuaucgaauacauuuuuaucaacaguuaaagacuauggugguuuuuucagaguuuggcuaagaauguuguuaccaucuucuuuguuugugguacaauauuuucagugcaaaagagaugucauucaguuaaaaagacaaaccucuagauguguaauuacauggaaaauacuagcaaugugaaugcuuuuguaguaaccaucuuguaguaccugugaaaucuauaacucagaaauggucagauggucaggagccagcuaugcagcaguauaccaucuguuuaauuauuuuguagguccuguguguggaaccaacuauaaacccaguucuaaaguuguguaugauggugaaccuuugggaauaguucuuaucaacuuaauuggauacuuuuagcaaauaggaacuuaauucucagcacugaacaugaauuacuuccuuggaguuuuuuuucauucauauuuuuguuguuuccaggaauuuauuugauauuaaugggcguaaaacagcaucauuguacuuaagcuauggauguuuuuauuuuauauuuucuuuauuuauaacugugccaaguauuauuuugcuacuuaccguguuauucuguggaaagaaaaaccuguaaaguguuuaauaaauuagcccuccuuacauaaauuaaaugucaaaauuuuguaaaauauuaaucagaauaaauacugacucuuaaaaaaaaaaa

SEQ ID NO: 118 - RNA, 3543 nt, Homo Sapiens
gagccagcgcgguagggccagagugggaaggccagagcgggcguccccgccagugaccccacgccgcccguccgcgcccaacccggccuccgccgaguguccaaaccaaaagcgaaaggaacccgaccccgcguccccuccggcggcuccguagucgcguccgcuuggagcucgccgggcgccuccgacccugccgggccgcuuugugacuucacucguuucgcaacaagcccgggcagcccgcgccccacccacucuggcccggcagccucgccgcccgcagccucgcuccgcuccucgcgcuuccccucccuccggggcugggccugccccggccgucgcggagccuccccucccaccguccgugaguguacgcgcccggccgccgccuccaggcagcccggagcaacccggcgcccggccccgcugggcgcagcacuccgucggcggcggcggcggcgcgaugcugugcuuccugaggggaauggcuuucguccccuuccucuuggugaccuggucgucagccgccuucauuaucuccuacguggucgccgugcucuccgggcacgucaaccccuuccucccguauaucagugauacgggaacaacaccuccagagagugguauuuuuggauuuaugauaaacuucucugcauuucuuggugcagccacgauguauacaagauacaaaauaguacagaagcaaaaucaaaccugcuauuucagcacuccuguuuuuaacuuggugucuuuagugcuuggauuggugggauguuucggaaugggcauugucgccaauuuucaggaguuagcugugccagugguucaugacgggggcgcucuuuuggccuuugucuguggugucguguacacgcuccuacaguccaucaucucuuacaaaucauguccccaguggaacagucucucgacaugccacauacggauggucaucucugccguuucuugcgcagcugucauccccaugauugucugugcuucacuaauuuccauaaccaagcuggaguggaauccaagagaaaaggauuauguauaucacguagugagugcgaucugugaauggacaguggccuuugguuuuauuuucuacuuccuaacuuucauccaagauuuccagagugucacccuaaggauauccacagaaaucaauggugauauuugaagaaagaagaauucagucucacucagugaaugucgcaggccauuucuaaaagugcuacagaggacagacaggguuuugaggccacccugauuauugggaugcaucugcagcacauccaggacuugaauuucauuacgaguuccuaauaguuguauuucuaaagauguguuuccuagagaauguacagccuuaugacacuguagugauguuuuuauaauuuucuaaguagauuuuuuuauauuaacaaauucauauacagaaaaaauaagguguuacaaaaaauggagagcucuuauuuuuguacagauucugucguuuuuguuuuauuugugugagauuuauggaaauacacuaaaugaguaauucagguucaguacauuuauuacaaagugaaaucaggggauauucauuuguaaauuuuauucuuagugaaugaacuguauaauuuuuuuuaucaggagagcacuuauaaaauucaauuuauaaagaucauauacccaaaucauaaagauuuaguugauacauuaacacuaagauacucugauuuuuagccgaacuaaacaaagugcuucuacugagaggccuuuauaccaccauguacaguaacucuaagugaauacggaagaccuugguuuugaaauucugccaccuuguuucucccugcucaugaggucgcaccuuuugcucuugcugcuaauugcccauucguaguggguguaaugccagguggaaugguuucaacaagucaggugaaaaccauccuuuauuguugcuggcacaacuugauauauagucugacucagaacugaagcucacaucucaaauucauuucaugccaguaaauguggcaaagagaagaaaggcccaagagcgagacaagaagaauggagaagggggcagccaagaagaacuucuggguucaggguacuguuuauuugcuccuucucuucaugccuguggcuggaugucccacaacacuauaagaaauauaagucaagcccuuuguguuaagcaagaacuacagacuccaucuuuucacccaaaucaugaaugaccaauaaaaagcaaguuauuccagaggaagaagcagcccuugaaauguuaaggcuuaggcuugaaaggugaagagcaggaauucucucuuucaaauccuagagcauaaacccauguguggccaagugagaucagcccucaagggcacaugccaagggcagagcagcccauguagacagcuucggagggcauggggguguagggaguucgggguagcuccucauuaacuauuuguugggugaguaaaggggugaggcucaguggcagguaccucugcaaugacaagcugccuccccucuauguguuuagcauauguuauuagaacauguccgacaccccuaccgcugccauuugggcccuuuaauaaagccaaguagagaaaucuggcaauaaaaggcaaauguaagcaugcuuucuuuaagacgcaucauaaaugguuuucuuuaagugaauggaagaguuugacagagauacaccuuuguaagaaaacauuaagaaugcuggcuggcugugguggcucacaccuguauucccagcacuuugggaggccuaggcaggaggauugcuugagccugggacuucgagaccagacugggaaacauggcaaaaucccaucucuacaacaaaaauacaaaaauuagccaagugcgguggugugccuguaguccuaguuacuugggaggcugaggugggagaaucaccugagcccaggagguggaggcugcagugagccaugccaaugcacuccagucugggcaacagagugagacccugucucaaaaauaaauaaauaaauaaaugaauaaagagaaugcuaaucauuucuggguucacugcgacucacuguagugcuggggaucccccuuguaacacuggaacugaaagacagugaugaaagcuaugucaagcauucauuauucugaagaggaggagaaaugccacauaccuuucccaugggaccugugguggaaugaauccauacuucugccucacuucgagcagacuuuuguucucggcgcuccucacgauggaguuucaugcuucauuuucacaucucucugcacaauuagauugggagcuccuugagggcagaguacgugccuuaaucuuuaucuuuguaaugccacaaugaacagagugccuccugguacacuguaggagcuuaagaaauacucacugaaugcaugaaugaaugaaugaacaaaugaaggaaugacuaaggauguuuguagugcuauaauauagaaugggauuuacucugcuuuaccaguuaguuucauaauaaacaaauagucuguaucgccugguaa

SEQ ID NO: 119 - RNA, 4950 nt, Homo Sapiens
gggugauucagcgcccggcgaggcggaagcggccgcaagaggaggaggggagagcccguccgcgccugggcucccgggguggcacgagcccgcggccggagugcgaggcggaggcgaggaggccgcggggacgggaggcgaggccggccgggcccccgaagccauggagaacgcgcacaccaagacgguggaggaggugcugggccacuucggcgucaacgagaguacggggcugagccuggaacaggucaagaagcuuaaggagagauggggcuccaacgaguuaccggcugaagaaggaaaaaccuugcuggaacuugugauugagcaguuugaagacuugcuaguuaggauuuuauuacuggcagcauguauaucuuuuguuuuggcuugguuugaagaaggugaagaaacaauuacagccuuuguagaaccuuuuguaauuuuacucauauuaguagccaaugcaauuguggguguauggcaggaaagaaaugcugaaaaugccaucgaagcccuuaaggaauaugagccugaaaugggcaaaguguaucgacaggacagaaagagugugcagcggauuaaagcuaaagacauaguuccuggugauauuguagaaauugcuguuggugacaaaguuccugcugauauaagguuaacuuccaucaaaucuaccacacuaagaguugaccagucaauucucacaggugaaucugucucugucaucaagcacacugaucccgucccugacccacgagcugucaaccaagauaaaaagaacaugcuguuuucugguacaaacauugcugcugggaaagcuaugggaguggugguagcaacuggaguuaacaccgaaauuggcaagauccgggaugaaaugguggcaacagaacaggagagaacaccccuucagcaaaaacuagaugaauuuggggaacagcuuuccaaagucaucucccuuauuugcauugcagucuggaucauaaauauugggcacuucaaugacccgguucauggaggguccuggaucagaggugcuauuuacuacuuuaaaauugcaguggcccuggcuguagcagccauuccugaaggucugccugcagucaucaccaccugccuggcucuuggaacucgcagaauggcaaagaaaaaugccauuguucgaagccucccgucuguggaaacccuugguuguacuucuguuaucugcucagacaagacugguacacuuacaacaaaccagaugucagucugcaggauguucauucuggacagaguggaaggugauacuuguucccuuaaugaguuuaccauaacuggaucaacuuaugcaccuauuggagaagugcauaaagaugauaaaccagugaauugucaccaguaugauggucugguagaauuagcaacaauuugugcucuuuguaaugacucugcuuuggauuacaaugaggcaaaggguguguaugaaaaaguuggagaagcuacagagacugcucucacuugccuaguagagaagaugaauguauuugauaccgaauugaagggucuuucuaaaauagaacgugcaaaugccugcaacucagucauuaaacagcugaugaaaaaggaauucacucuagaguuuucacgugacagaaagucaaugucgguuuacuguacaccaaauaaaccaagcaggacaucaaugagcaagauguuugugaagaucccgggugcuccugaaggugucauugacaggugcacccacauucgaguuggaaguacuaagguuccuaugaccucuggagucaaacagaagaucaugucugucauucgagagugggguaguggcagcgacacacugcgaugccuggcccuggccacucaugacaacccacugagaagagaagaaaugcaccuugaggacucugccaacuuuauuaaauaugagaccaaucugaccuucguuggcugcgugggcaugcuggauccuccgagaaucgagguggccuccuccgugaagcugugccggcaagcaggcauccgggucaucaugaucacuggggacaacaagggcacugcuguggccaucugucgccgcaucggcaucuucgggcaggaugaggacgugacgucaaaagcuuucacaggccgggaguuugaugaacucaaccccuccgcccagcgagacgccugccugaacgcccgcuguuuugcucgaguugaacccucccacaagucuaaaaucguagaauuucuucagucuuuugaugagauuacagcuaugacuggcgauggcgugaacgaugcuccugcucugaagaaagccgagauuggcauugcuaugggcucuggcacugcgguggcuaaaaccgccucugagaugguccuggcggaugacaacuucuccaccauuguggcugccguugaggaggggcgggcaaucuacaacaacaugaaacaguucauccgcuaccucaucucguccaacgucggggaaguugucuguauuuuccugacagcagcccuuggauuucccgaggcuuugauuccuguucagcugcucugggucaaucuggugacagauggccugccugccacugcacugggguucaacccuccugaucuggacaucaugaauaaaccuccccggaacccaaaggaaccauugaucagcggguggcucuuuuuccguuacuuggcuauuggcuguuacgucggcgcugcuaccgugggugcugcugcauggugguucauugcugcugacggugguccaagaguguccuucuaccagcugagucauuuccuacaguguaaagaggacaacccggacuuugaaggcguggauugugcaaucuuugaauccccauacccgaugacaauggcgcucucuguucuaguaacuauagaaauguguaacgcccucaacagcuuguccgaaaaccaguccuugcugaggaugccccccugggagaacaucuggcucgugggcuccaucugccuguccaugucacuccacuuccugauccucuaugucgaacccuugccacucaucuuccagaucacaccgcugaacgugacccaguggcugauggugcugaaaaucuccuugcccgugauucucauggaugagacgcucaaguuuguggcccgcaacuaccuggaaccugguaaagagugugugcagccugccaccaaauccugcucguucucggcaugcaccgaugggauuuccuggccguuugugcugcucauaaugccccuggugaucugggucuauagcacagacacuaacuuuagcgauauguucuggucuugacugacaguuuuccauaaagaagauguuuaacuuaaucaauuaauuuuuuuauuguuuaaagcaacugucuauuucugcugaauuuucacaugaacauacuggcuggugauggagguuucauacucuagauuuuguuuugcuuuuucugacuccaguggggcaagauuuuccuuuuuuauacacauaauuaaaguguccauugacauguacagagaacuaacacuauuuuaugcaaauauuuuuuuguagaugaaaaagcauguacaguguucuguuuaauacucauccuuguauaaaaaaaauaguugagccagcagacauugucagcaaauuaauuggcagcagauuuuaggaaaugaaugugugugguuuuuuuucuaaaacuaaauagcauguauugugucuuuugcaugaugauccggauuuaauuugauaucacagucuaauuuuuauucauaagccaauuuuucugcacugagcagagucuugcuaccucagucaguauuguuuugguuugcuacuucccucacccacuuuggccuccguucaccccaccccaccccaccucuccccaccuuacccccgccccgcuuggcuucuucuuuaggauugugaugguucguucuguuuacaucaguuuuaacgagagguaugccuguacucgcuugugcagaaaacauuguuccagauucaaucgacuggguuuaugucccuucacauaguuuuuaagguuauuuauuuaaaugucuaauguauuuuauuguaacagacauuguuuugccaacauugccuauuucaguggcacgucaucuaguuuuaaaaaaauaaaacauuuuaaauggacagagaaaaacaauacuggaguaaccgcuuccuaaaccauuuugcagaaauguaaggguguucgguugcgugcaugugcguuuuuagcaacacaucuaccaacccugugcaugacugauguuggggaaaaagaaaaguaaaaaacuucccaacucacuuuguguuauguggaggaaauguguauuaccaaugggguuguuagcuuuuaaaucaaaauacugauuacagauguacaauuuagcuuaaucagaaagccucuccagagaaguuugguuucuuugcugcaagaggaaugaggcucuguaaccuuaucuaagaacuuggaagccgucagccaagucgccacauuucucugcaaaaugucauagcuuauauaaauguacaguauucaauuguaaugcaugccuucgguuguaaguagccagaucccucuccagugacauuggaacaugcuacuuuuuaauuggcccuguacaguuugcuuauuuauaaauucauuaaaaacacuacagguguugaaugguuaaaauguaggccuccaguucauuuucaguuauuuucugagugugcagacagcuauuucgcacuguauuaaauguaacuuauuuaaugaaaucagaagcaguagacagauguuggugcaauacaaauauugugaugcauuuaucuuaauaaaaugcuaaaugucaauuuaucacugcgcauguuugacuuuagacuguaaauagagaucaguuuguuucuuucugugcugguaacaaugagcgucgcacagacaugguuucagguaaauaaaucuauucuaugau

SEQ ID NO: 120 - RNA, 6579 nt, Homo Sapiens
cggccgcgguuuccaggaggaagcaaggaugcuuuggacacugugcguggcgccuccgcggagcccccgcgcugccauucccggccgucgcucgguccuccgcugacgggaagcaggaaguggcggcgggcgucgcgagcggugacaucacgggggcgacggcggcgaagggcgggggcggaggaggagcgagccgggccggggggcagcugcacagucuccgggauccccaggccuggaggggggucugugcgcggccggcuggcucugccccgcguccggucccgagcgggccucccucgggccagcccgaugugaccgagcccagcggagccugagcaaggagcggguccgucgcggagccggagggcgggaggaacaugacaucgcggagagaugguuucacccaaauaucacugguguggaggcagaaaaccuacuguugacaagaggaguugauggcaguuuuuuggcaaggccuaguaaaaguaacccuggagacuucacacuuuccguuagaagaaauggagcugucacccacaucaagauucagaacacuggugauuacuaugaccuguauggaggggagaaauuugccacuuuggcugaguugguccaguauuacauggaacaucacgggcaauuaaaagagaagaauggagaugucauugagcuuaaauauccucugaacugugcagauccuaccucugaaaggugguuucauggacaucucucugggaaagaagcagagaaauuauuaacugaaaaaggaaaacaugguaguuuucuuguacgagagagccagagccacccuggagauuuuguucuuucugugcgcacuggugaugacaaaggggagagcaaugacggcaagucuaaagugacccauguuaugauucgcugucaggaacugaaauacgacguugguggaggagaacgguuugauucuuugacagaucuuguggaacauuauaagaagaauccuaugguggaaacauuggguacaguacuacaacucaagcagccccuuaacacgacucguauaaaugcugcugaaauagaaagcagaguucgagaacuaagcaaauuagcugagaccacagauaaagucaaacaaggcuuuugggaagaauuugagacacuacaacaacaggagugcaaacuucucuacagccgaaaagagggucaaaggcaagaaaacaaaaacaaaaauagauauaaaaacauccugcccuuugaucauaccaggguuguccuacacgauggugaucccaaugagccuguuucagauuacaucaaugcaaauaucaucaugccugaauuugaaaccaagugcaacaauucaaagcccaaaaagaguuacauugccacacaaggcugccugcaaaacacggugaaugacuuuuggcggaugguguuccaagaaaacucccgagugauugucaugacaacgaaagaaguggagagaggaaagaguaaaugugucaaauacuggccugaugaguaugcucuaaaagaauauggcgucaugcguguuaggaacgucaaagaaagcgccgcucaugacuauacgcuaagagaacuuaaacuuucaaagguuggacaagggaauacggagagaacggucuggcaauaccacuuucggaccuggccggaccacggcgugcccagcgacccugggggcgugcuggacuuccuggaggaggugcaccauaagcaggagagcaucauggaugcagggccggucguggugcacugcaggugacagcuccugcugccccucuaggccacagccugucccugucuccuagcgcccagggcuugcuuuuaccuacccacuccuagcucuuuaacuguaggaagaauuuaauaucuguuugaggcauagagcaacugcauugagggacauuuugaucccaaggcauauuucuccuagacccuacagcacugccauuggccauggccauggcaacaugcucaguuaaaacagcaaagacuaagucagcauuaucucugaguccaccagaaguugugcauuaaacaacuucauccuggugcuggaauuggccggacagggacguucauugugauugauauucuuauugacaucaucagagagaaagguguugacugcgauauugacguucccaaaaccauccagauggugcggucucagaggucagggaugguccagacagaagcacaguaccgauuuaucuauauggcgguccagcauuauauugaaacacuacagcgcaggauugaagaagagcagaaaagcaagaggaaagggcacgaauauacaaauauuaaguauucucuagcggaccagacgaguggagaucagagcccucucccgccuuguacuccaacgccacccugugcagaaaugagagaagacagugcuagagucuaugaaaacgugggccugaugcaacagcagaaaaguuucagaugagaaaaccugccaaaacuucagcacagaaauagauguggacuuucacccucucccuaaaaagaucaagaacagacgcaagaaaguuuaugugaagacagaauuuggauuuggaaggcuugcaaugugguugacuaccuuuugauaagcaaaauuugaaaccauuuaaagaccacuguauuuuaacucaacaauaccugcuucccaauuacucauuuccucagauaagaagaaaucaucucuacaauguagacaacauuauauuuuauagaauuuguuugaaauugaggaagcaguuaaauugugcgcuguauuuugcagauuauggggauucaaauucuaguaauaggcuuuuuuauuuuuauuuuuauacccuuaaccaguuuaauuuuuuuuuuccucauuguuggggaugaugagaagaaaugauuugggaaaauuaaguaacaacgaccuagaaaagugagaacaaucucauuuaccaucauguauccaguaguggauaauucauuuugauggcuucuauuuuuggccaaaugagaauuaagccagugccugagacugucagaaguugaccuuugcacuggcauuaaagagucauagaaaaagaaucauggauauuuaugaauuaagguaagagguguggcuuuuuuuuuuuucuuuuuuccagccguugaccaauuauaguucggcuguugacugagaaguuuguggugggaaaacguuugccauauuuucuuugcauuugaauaauugucuuguacuuagaaaaaaggcgucuaugaaugaccaguguuuuuggucgccaaauguugcugacaaacuuaucccaaaacuuuaguggcuuaaaaaaaccugcccccaacuguuagucaaucugagcugggcucagcugggcuguucuucugccagccugcagguggccacucauguggucagcaggucggcggagagacugggauggcugggcuucucucucugccugcaguccugagucucuccuucuucguguagucucuuucaguggccuggcuggcaggguagcuagaccucucacaugcagcucagagcucccaagagcucaaaagcagaaauggccaggccuucugaaaacuuaaguccagaauugucacagugucccuucuacuucccucuauugaugaugaugaugaugaugaugaugaugaugaugaugaugaugaugguuuuuucuaaucagaagaaagcugggguaugcccucuacuuacuaaacaagucacaagcccagcucagauucaagaaaagggugugaaguagaggugcaguuaaguggggggccacuagucuaacagacggucacaaccagugccauggaaaaccaaggauauuagcaaaagcagaaguugcuagugaccuugggaagccgaagcugcuuacaguagcugggacaagcugaaagucagacuaagaaauaaagagagggccuucaagaagcuuccugaaugauuucugcuagcccugagccuauuuuuggaaccagcacuuggggaaacugaucuugugaggauggauguguuuagggacacagggcuuuugagagcagcaccaccccacuggggcauccccagacuugggaaacgugacucuuucuuaaugccacuggguuuuagucaggccacagugagaaggaacagcccuaacaggccuccagccagguugaaugagcucauuuuuguuguagccaaccaguaagauuugcuaauguucuacauuaagugccuucuccaaagacaucccucuuugccucauauguugaaucauccagugcggauauuucaaugaaaauaucauugguugacuuuugugaugguaauaaugcuauggcaucuuugccaugaaguuguggccuccuuggauucuucugacuuuggcuucugaaaggaaggccuagauccagcccuggugguaguuccuuucugaggucucucagucccuugagacuuugggguaguuuggcugccauucucacugacaaaauguauaucagcccccaccuccaccccccaauauuccuugaacuuugaauugcuucagaacacagguguggccugaagguauucccuuauuagggaagugucacugcugucuucuagucaaacuuguaaagaaaaagauuccaguucaguauuugcagcaagaagcuugaaugcuguucuuuuuaucgcauuguuacaucgacucauucuccauuuugcuuugguuuugucuugacuugacuugacuuuggggguaaagucuuucaccagcacacaagaguuugauuguacaaauauaucuucugcauuaacaucucugccuguugcuuaagaucaguugcuuuuauacucagaauggaaauaccugaucuuggcuaguuuuguuauaagauauugauuucauuuagauuucccuccacgaggucagcaaacuaucauguucuuauguaaacuuaggccaaggccagaguuaucauagucccuagguugcuacggcuuaucaugugcuugguaaaaggugaucgcagguucucagacgaguuuacuuuacaugagauggaaucaggcagagaggcugggaugauggagaaagcucgaggugaaguuuuaaaaaaaaaguuguggaaaggaaaguuccaaagaggugguuucugaggaagucagagcgcccagggccagagcagucaguaaugggugaaugagguuguuuggaaagucggugugacagacacauggaugccaucuacuucuagguugcugguggguauuaaauaugcacaauauuccauagcucacugaggauuuuaaaauuauaagcauaggauuuuauauuuuggggugaaagaauuaucuggcacauuagguauuggaguuuaaaaaaaaagccaaauuucacagucuuaauaacuuuuuuuaaaaaaaacuaaaaggcgcuucauguccaguguguggcccuucugaaacuuauggucaucucucccacugaaaccaaggucuuuucaaauguggcuaaauggggaugaggagacacggguaggacuuucuuggugugugugcauucuuuaaagagccaaguugcuucggggaaacagccaggaaaauggucaagauuauuuuuagagguuauuuuauuggggauuuuaagaacuaauaacaucuugaguuauuuuuaauucagggggauguggaaagguuugcaauugucaaguguuuuguuguagcuuaguauccauaagggaaacuuagacuauagacauaacuacaaagccagugcagcuuuuguuuucuguauguuguugggggaucaacuuucacacauagcaagcacauggccucccugaugucaggaugccuuuguuaggaucuguauuugcccuuaauuuuguugaaaucuuuuuuccuucuuccucuugaaaaguuccaaaauauaguuuauuguaucuuucaucacuaaaaauuuguuccuuuuucacuaugggcaguucacacaaggcaaaaacuauugaacaguugguuuuaguguguuguauaacuuugcuguauaucaaacuaauuuugacaaguuuucauccuaagccucaaaucauguaauuaauaauuugccuguuuauuuaugaccuaauugugauucuuuuauuaauaaaagcuaaugggaaaaggaucccugauuaagcugaugacuagaccuacaauuaauuuuccugcaguauaugaaguauuguaccagaguauuaaaagauauguaauauuuuauugauaaaucuauccuuuaaaaggaauacguuuuaggaugucaucauuuugaugugaaucauguaaauguugauaauaugcuguuuauuauacauuuaguguuucaagagauucacuuaauugccuuuuugcccacguauauuauguagucuauuugcaacuguucuuaaaaaaaugacauuaaaagaauaguuuauguagagaaacauuaguggauguuaauugucuccccaccuauauuuauggguguuagcgcaacugcuuugcuaguugcaaagcuguauuaucagaguaaaaguguauuuguaaacuguaugggaacuaaaaauuaggaauaaaaccauuuucuuauauga

SEQ ID NO: 121 - RNA, 984 nt, Homo Sapiens
gggagagccuggggccgggccguguggaugccauccccgagcgcgguucgcgcucggcugaggcgcuggacaaguggcuugggcucccgcgccucaguuucucucuguggcgccgccuaccucacagacuugugagcacucacugacguggguagcgcccagggccugcggggcgcaggagagcuggagucaggcggagaccgcaggcugaccccgcagcggccgggcugucgcggcccccaccucagggcgggagcagggcggggccugagcacuaggcggcggcggcuggcguggggcugcuuagaugcgccacgguuucgguagcgacgguaucucuagccgggccugagcugugcuagcaccucccccaggagaccguugcagucggccagcccccuucuccacggccuugcccacuagguaaccaugugcgaccgaaaggccgugaucaaaaaugcggacaugucggaagagaugcaacaggacucgguggagugcgcuacucaggcgcuggagaaauacaacauagagaaggacauugcggcucauaucaagaaggaauuugacaagaaguacaaucccaccuggcauugcaucguggggaggaacuucgguaguuaugugacacaugaaaccaaacacuucaucuacuucuaccugggccaaguggccauucuucuguucaaaucugguuaaaagcauggacugugccacacacccagugauccauccaaaaacaaggacugcagccuaaauuccaaauaccagagacugaaauuuucagccuugcuaagggaacaucucgauguuugaaccuuuguuguguuuuguacagggcauucucuguacuaguuugucgugguuauaaaacaauuagcagaauagccuacauuuguauuuauuuucuauuccauacuucugcccacguuguuuucucucaaaauccauuccuuuaaaaaauaaaucugaugcagaugugua

SEQ ID NO: 122 - RNA, 273 nt, Homo Sapiens
uccaagauggcgucagucauaccagugaaggacaagaaacuucuggaggucaaacugggggaguugccaagcuggaucuugacgcgggacuucagcccuaguggcauuuucggagcauuucgaagaaguuacuaccgguacuacaacaaguacaucaaugugaagaaggggagcaucucggggguuaccauggugcuggcaugcuacgugaucuucagcuacugccucuccuacaagcaucucaagcacgagcggcuccgcaaaugcuacuga

SEQ ID NO: 123 - RNA, 3916 nt, Homo Sapiens
guggggugggguggggcugggggcuugucgcccuuucaggcuccacccuuugcggagauuauaaauagucaugaucccagcgagacccagagaugcuguaaugguaagacuuuggauccuuccugaggacguggagaaaacuugcugcugagaaggacauuuugaagguuuuguuggcugaaaaagcuguuucuggaaucaccccuagaucuuucuugaagacuugaauuagauuacagcgauggggacacagaagaggucaccccagcucugauauuugccaucacaguugcuacaaucggcucuuuccaauuuggcuacaacacuggggucaucaaugcuccugagaagaucauaaaggaauuuaucaauaaaacuuugacggacaagggaaaugccccacccucugaggugcugcucacgucucucugguccuugucuguggccauauuuuccgucggggguaugaucggcuccuuuuccgucggacucuucgucaaccgcuuuggcaggcgcaauucaaugcugauugucaaccuguuggcugucacugguggcugcuuuaugggacuguguaaaguagcuaagucgguugaaaugcugauccugggucgcuugguuauuggccucuucugcggacucugcacagguuuugugcccauguacauuggagagaucucgccuacugcccugcggggugccuuuggcacucucaaccagcugggcaucguuguuggaauucugguggcccagaucuuuggucuggaauucauccuugggucugaagagcuauggccgcugcuacuggguuuuaccauccuuccugcuauccuacaaagugcagcccuuccauuuugcccugaaagucccagauuuuugcucauuaacagaaaagaagaggagaaugcuaagcagauccuccagcgguuguggggcacccaggauguaucccaagacauccaggagaugaaagaugagagugcaaggaugucacaagaaaagcaagucaccgugcuagagcucuuuagaguguccagcuaccgacagcccaucaucauuuccauugugcuccagcucucucagcagcucucugggaucaaugcuguguucuauuacucaacaggaaucuucaaggaugcagguguucaagagcccaucuaugccaccaucggcgcgggugugguuaauacuaucuucacuguaguuucucuauuucugguggaaagggcaggaagaaggacucugcauaugauaggccuuggagggauggcuuuuuguuccacgcucaugacuguuucuuuguuauuaaaggauaacuauaaugggaugagcuuugucuguauuggggcuaucuuggucuuuguagccuucuuugaaauuggaccaggccccauucccugguuuauuguggccgaacucuucagccagggcccccgcccagcugcgauggcaguggccggcugcuccaacuggaccuccaacuuccuagucggauugcucuuccccuccgcugcucacuauuuaggagccuacguuuuuauuaucuucaccggcuuccucauuaccuucuuggcuuuuaccuucuucaaagucccugagacccguggcaggacuuuugaggauaucacacgggccuuugaagggcaggcacacggugcagauagaucuggaaaggacggcgucauggagaugaacagcaucgagccugcuaaggagaccaccaccaaugucuaagucgugccuccuuccaccucccucccggcaugggaaagccaccucucccucaacaagggagagaccucaucaggaugaacccaggacgcuucugaaugcugcuacuuaauuccuuucucaucccacgcacuccaugagcaccccaaggcugcgguuuguuggaucuucaauggcuuuuuaaauuuuauuuccuggacauccucuucugcuuaggagagaccgagugaaccuaccuucauuucaggagggauuggccgcuuggcacaugacaacuuugccagcuuuuccucccuuggguucugauauugccgcacuaggggauauaggagaggaaaaguaaggugcaguucccccaaccucagacuuaccaggaagcagauacauaugaguguggaagccggaggguguuuauguaagagcaccuuccucacuuccauacagcucuacguggcaaauuaacuugaguuuuauuuauuuuauccucugguuuaauuacauaauuuuuuuuuuuuaacuuuaaguuucaggauacaugugccgaaugugcagguuuguuacauagguauauauaugccaugauggaaauauuuauuuuuuuaagcguaauuuugccaaauaauaaaaacagaaggaaauugagauuagagggagguguuuaaagagagguuauagaguagaagauuugaugcuggagagguuaaggugcaauaagaauuuagggagaaauguuguucauuauuggaggguaaaugauguggugccugaggucuguacguuaccucuuaacaauuucuguccuucagauggaaacucuuuaacuucucguaaaagucauauaccuauauaauaaagcuacugauuuccuuuggagcuuuuuucuuuaagauaauaguuuacauguaguaguacuugaaaucuaggauuauuaacuaauaugggcauuguaguuaaugaugguugauggguucuaauuuuggauggaguccagggaagagaaagugauuucuagaaagccuguuccccucacuggaugaaauaacuccuucuuguaguagucucauuacuuuugaaguaaucccgccaccuaucucgugggagagccauccaaauaagaaaccuaaaauaauugguucuugguagagauucauuauuuuuccacuuuguucuuuaggagauuuuagguguugauuuucuguuguauuuuaacucauaccuuuaaaggaauuccccaaagaauguuuauagcaaacuuggaauuuguaaccucagcucugggagaggauuuuuuucugagcgauuauuaucuaaaguguguuguugcuuuaggcucacggcacgcuugcguaugucuguuaccaugucacugugguccuaugccgaaugcccucaggggacuugaaucuuuccaauaaaccagguuuagacaguaugagucaaugugcaguguagcccacacuugagaggaugaauguaugugcacugucacuuugcucuggguggaaguacguuauuguugacuuauuuucucuguguuuguuccuacagccccuuuuucauauguugcucagucucccuuucccuucuuggugcuuacacaucucagacccuuuagccaaacccuugucagugacaguauuuugguucuuaguucucacuguucccucugcuccuggagccuuugaauaaaaaugcacguagcugaggccggaugcgguggcucacgccuguaaucccagcacuuugggaggccuaggcgggcggucagggguucgagaccagucuggccaacaucgugaaacccugucucuacuaaaaaugcaaaaauuagccgggcgugguggcgggcgccuguaaucccagcuacuugggaagcugaggcgggagaaucaugugaacccgggacgcagggguugcagugagcggagaucgcaucauugcacucuagccugggccacagggcgagacuccgucucaaaaaaaaaaaaaugcacauagcuaucaagugugcuuuagcuugaaaaggugaccuugcaacuucaugucaacuucuggcuccucaaacaguagguuggcaguaaggcagggucccauuucucacugagaagauugugaauauuuccauauggauuuucuauuguuacucugguucuuuguuuuaaaauaaaaauucugaauguacacg

SEQ ID NO: 124 - RNA, 1042 nt, Homo Sapiens
gagaugguucaacucucuuacuugguuauuuccaucucgguuauuccuugcuccagcagaauccugaaauguccauguaucucugagcagcuaugaagaagcuuccuggaaaacaauaagcaaaggaaaacaaaugugucccaucucacaugguucuacccuacuaaagacaggaagaucauaaacugacagauacugaaauuguaaaguuggaaacuacauuuugcaaagucauugaacucugagcucaguugcaguacucgggaagccaugcaggaugaagauggauacaucaccuuaaauauuaaaacucggaaaccagcucucaucuccguuggcucugcauccuccuccugguggcgugugauggcuuugauucugcugauccugugcguggggaugguugucgggcugguggcucuggggauuuggucugucaugcagcgcaauuaccuacaaggugagaaugaaaaucgcacaggaacucugcaacaauuagcaaagcgcuucugucaauaugugguaaaacaaucagaacuaaagggcacuuucaaaggucauaaaugcagccccugugacacaaacuggagauauuauggagauagcugcuauggguucuucaggcacaacuuaacaugggaagagaguaagcaguacugcacugacaugaaugcuacucuccugaagauugacaaccggaacauuguggaguacaucaaagccaggacucauuuaauucguugggucggauuaucucgccagaagucgaaugaggucuggaagugggaggauggcucgguuaucucagaaaauauguuugaguuuuuggaagauggaaaaggaaauaugaauugugcuuauuuucauaaugggaaaaugcacccuaccuucugugagaacaaacauuauuuaaugugugagaggaaggcuggcaugaccaagguggaccaacuaccuuaaugcaaagagguggacaggauaacacagauaagggcuuuauuguacaauaaaagauauguaugaaugcaucaguagcugaaaa

SEQ ID NO: 125 - RNA, 1934 nt, Homo Sapiens
gagcccggagcaggccgggcucaagaaagaggaaaguugaggacgccccaccucggagaggcggcgccccugaguaggccaggagccucucuugcaacuucugccaccgcgggccaccgcggccgccugaucccgcagaggaaggucgcggccguggagcgaugacccgcggcgguccgggcgggcgcccggggcugccacagccgccaccgcuucugcugcugcugcugcugcugccgcuguuguuagucaccgcggagccgccgaaaccugcaggagucuacuaugcaacugcauacuggaugccugcugaaaagacaguacaagucaaaaauguaauggacaagaauggggacgccuauggcuuuuacaauaacucugugaaaaccacaggcuggggcauccuggagaucagagcuggcuauggcucucaaacccugagcaaugagaucaucauguuuguggcuggcuuuuuggaggguuaccucacugccccacacaugaaugaccacuacacaaaccucuacccacagcugaucacgaaaccuuccaucauggauaaagugcaggauuuuauggagaagcaagauaaguggacccggaaaaauaucaaagaauacaagacugauucauuuuggagacauacaggcuaugugauggcacaaauagauggccucuauguaggagcaaagaagagggcuauauuagaagggacaaagccaaugacccuguuccagauucaguuccugaauaguguuggagaucuauuggaucugauucccucacucucucccacaaaaaacggcagccuaaagguuuuuaagagaugggacaugggacauugcuccgcucuuaucaagguucuuccuggauuugagaacauccuuuuugcucacucaagcugguacacguaugcagccaugcucaggauauauaaacacugggacuucaacgucauagauaaagauaccagcaguagucgccucucuuucagcaguuacccaggguuuuuggagucucuggaugauuuuuacauucuuagcaguggauugauauugcugcagaccacaaacaguguguuuaauaaaacccugcuaaagcagguaauacccgagacucuccuguccuggcaaagaguccguguggccaauaugauggcagauaguggcaagaggugggcagacaucuuuucaaaauacaacucuggcaccuauaacaaucaauacaugguucuggaccugaagaaaguaaagcugaaccacagucuugacaaaggcacucuguacauuguggagcaaauuccuacauauguagaauauucugaacaaacugauguucuacggaaaggauauuggcccuccuacaauguuccuuuccaugaaaaaaucuacaacuggaguggcuauccacuguuaguucagaagcugggcuuggacuacucuuaugauuuagcuccacgagccaaaauuuuccggcgugaccaagggaaagugacugauacggcauccaugaaauauaucaugcgauacaacaauuauaagaaggauccuuacaguagaggugaccccuguaauaccaucugcugccgugaggaccugaacucaccuaacccaaguccuggagguuguuaugacacaaagguggcagauaucuaccuagcaucucaguacacauccuaugccauaaguggucccacaguacaagguggccucccuguuuuucgcugggaccguuucaacaaaacucuacaucagggcaugccagaggucuacaacuuugauuuuauuaccaugaaaccaauuuugaaacuugauauaaaaugaaggagggagaugacggacuagaagacuguaaauaagauaccaaaggcacuauuuuagcuauguuuuucccaucagaauuaugcaauaaaauauauuaauuugucacuuuca

SEQ ID NO: 126 - RNA, 1303 nt, Homo Sapiens
cuugcagagccggcgccggaggagacgcacgcagcugacuuugucuucuccgcacgacuguuacagaggucuccagagccuucucucuccugugcaaaauggcaacucuuaaggaaaaacucauugcaccaguugcggaagaagaggcaacaguuccaaacaauaagaucacuguaguggguguuggacaaguugguauggcgugugcuaucagcauucugggaaagucucuggcugaugaacuugcucuuguggauguuuuggaagauaagcuuaaaggagaaaugauggaucugcagcaugggagcuuauuucuucagacaccuaaaauuguggcagauaaagauuauucugugacugccaauucuaagauuguagugguaacugcaggaguccgucagcaagaaggggagagucggcucaaucuggugcagagaaauguuaaugucuucaaauucauuauuccucagaucgucaaguacaguccugauugcaucauaauugugguuuccaacccaguggacauucuuacguauguuaccuggaaacuaaguggauuacccaaacaccgcgugauuggaaguggauguaaucuggauucugcuagauuucgcuaccuuauggcugaaaaacuuggcauucaucccagcagcugccauggauggauuuugggggaacauggcgacucaaguguggcuguguggaguggugugaauguggcagguguuucucuccaggaauugaauccagaaaugggaacugacaaugauagugaaaauuggaaggaagugcauaagauggugguugaaagugccuaugaagucaucaagcuaaaaggauauaccaacugggcuauuggauuaaguguggcugaucuuauugaauccauguugaaaaaucuauccaggauucaucccgugucaacaaugguaaaggggauguauggcauugagaaugaagucuuccugagccuuccauguauccucaaugcccggggauuaaccagcguuaucaaccagaagcuaaaggaugaugagguugcucagcucaagaaaagugcagauacccugugggacauccagaaggaccuaaaagaccugugacuagugagcucuaggcuguagaaauuuaaaaacuacaaugugauuaacucgagccuuuaguuuucauccauguacauggaucacaguuugcuuugaucuucuucaauaugugaauuugggcucacagaaucaaagccuaugcuugguuuaaugcuugcaaucugagcucuugaacaaauaaaauuaacuauuguagugug

SEQ ID NO: 127 - RNA, 83 nt, Homo Sapiens
gucuguguccauaccacucugaaugcaaccgaucuccucugaucucagaagcuaagcagaguugggccugguuaguacuugga

SEQ ID NO: 128 - RNA, 5157 nt, Homo Sapiens
ggcgcggagucagaguggcgcagcaaguggccgcagguggcgacgguggcgggggguggggugugagguaauccaggggucgcggaagaggaggcugagagggucaaaagaaaacuaaagcugcaguccggccuacuguuccgggggccgcggagcccccacccggggagauggaccucaaccggaucauccaggcgcugaagggcaccaucgacccgaaguugcggauugcagccgagaacgagcucaaccaguccuacaagauuaucaauuuugcccccaguuuacuucggauuauagucucugaccauguggaauucccaguacgacaggcagcugccauuuaccugaagaacauggugacacaauacuggccagaucgagaaccuccaccaggagaagcaauauuuccauucaacauucacgaaaacgaucgccagcaaauacgugauaacauuguggaaggaauaauucggucuccagauuuagugagaguccaauuaacaaugugucuccgugccaucauaaaacaugauuuuccuggucacuggccaggaguggucgacaagauagacuauuacuugcaaucacagagcagugcaagcuggcuuggcaguuuauuaugccuguaucaacuggugaagacauaugaauauaagaaagcagaagagagagaaccucuuauaauagcaaugcagauauuccugccucguauucagcaacaaauuguucagcuccuuccugauuccuccuauuauucuguauuacugcagaaacaaauucugaaaaucuuuuaugcacuuguucaguaugcauugccucuucagcuagugaauaaccaaaccaugacaacauggauggagaucuuccgaacuauuaucgacaggaccguuccuccugagacucugcacauugaugaggaugauagaccagaacugguaugguggaaguguaagaagugggcacugcauauuguagcucggcucuuugaacgauauggaagcccaggaaaugucacaaaagaauacuuugaauuuucugaauucuuuuugaaaaccuaugcagugggcauucagcaggugcuacuaaaaauuuuagaucaauauagacagaaagaauauguagcuccccguguucuucagcaagcauucaacuaucucaaccaaggggugguucauucuauaaccuggaagcagaugaagccacacauacagaauaucucugaagaugugauuuuuucugugauguguuauaaagaugaggaugaagagcuguggcaagaagauccauaugaguauauaaggaugaaauuugauauuuuugaagauuaugcuucucccaccacagcagcccagacucucuuauauacugcugcaaagaaaagaaaagagguguugccaaaaaugauggcauucuguuaucaaauccugacagacccgaacuuugacccuaggaagaaagauggagcccugcaugugauugguucccuagcugagauuuuacugaagaagaguuuauucaaggaccaaauggagcuguuucuacaaaaucauguauuuccauuauuauugucuaaccugggauaucuucgagcuagaucuugcuggguacuucaugcauuuaguucuuugaaguuccauaaugagcucaaucuaagaaaugccguugaauuagcgaagaagagccugauugaagauaaagagaugccugucaaaguugaagcugcccuugcucuucagucuuuaauuucuaaccagauacaagcuaaggaauauaugaagccacaugugaggccuauuaugcaggaacuguugcacauuguuagagagacagaaaaugaugauguuacuaaugucauccagaagaugauaugugaauacagucaagagguagccucaauugcuguugauaugacccaacacuuggcugagauauuuggcaaaguucuucaaagugaugaauaugaagaaguugaagacaaaacaguaauggcuaugggaauuuuacauaccauugauacuaucuuaacaguuguagaagaucauaaagagauuacccagcaguuagagaauaucugucuacggaucauugaucuuguucugcagaaacauguaauugaauucuaugaagaaauucuuucccuggcauacaguuuaaccugccacaguauuuccccucaaauguggcagcuucuagguauacuauaugaaguguuucagcaggauugcuuugaauacuuuacagacaugaugccucuccugcauaauuaugugacaauagauacagauaccuuacuaucaaaugcaaaacauuuagaaauucuuuuuacaauguguaggaagguacuauguggagaugcaggagaagaugcagagugucaugcagcuaaacuucuggaagucaucauucuucagugcaaaggaaggggaauugaucagugcauuccacucuucguucaacuuguuuuggagagauuaacucgaggggucaaaacuagugagcuucguacuaugugucuucagguugcaauugcugccuuguacuacaacccugauuugcugcuacauacuuuagaacgaauucaguugccucacaacccuggaccuaucacuguacaguuuauaaaucaauggaugaaugauacagauuguuuucuuggggcaucaugaccggaagauguguauaauaggacugaguauccuuuuggaauugcaaaaucgaccuccugcaguagaugcuguggugggacagauuguucccucaauucuuuuccuuuuccuuggccuaaagcaggucugugcuacuagacaacugguaaaccgggaagaucguucaaaagcagagaaagcugauauggaagaaaaugaggagauuucaagugaugaagaggagacaaauguaacugcucaagcaaugcagucaaauaauggaagaggugaagaugaggaggaggaagaugaugacugggaugaagaaguauuggaagaaaccgcgcuugagggguucaguacuccacuugaccuugacaauaguguggaugaauaucaguuuuuuacacaagcucugauaacugugcagagucgagaugcagccugguaccagcugcugauggcaccacucagcgaggaucagaggacagcacugcaggagguguacacacuggcagagcaccgacggacgguggcagaggcaaagaagaagauugaacaacagggaggcuucaccuuugaaaacaaaggaguccucuccgcauuuaauuuugggacugugcccagcaacaacugaaggaaagaacaucagcugaccaaaugucaucgcugcauuuuauuucacaagaggagugugagggucaaggggaugaaaugaggggcugcuuuuagggcccuccugcugugccaguuaccaucuggcauuaggcagcacuuuuaucuacucuuuccccuuugaccuuugucacccugaaauauauauuuuaaacagcuacuguaaguaugaaaugaaagaaaaacaaucauuggacggaaaaggacaacccauauguuccaaaggcugaaugcccaagguuguuuuagaggauuggauagacuugcacgucucagguuuuugccaugcagaaucaauggauuuaugcggauaacagugccuucuguuguacaugaauuaucagaaaaaaauuuuuggagugcauugcaauuuuuuuuaaagcauaaaacauauuucuagauacaacauaaaccuugguuauaugucaacuauucugcauuuuacucugugaauuuauuguuaggcaguuacugcaagucacucugguuucaaaaucuucacggcucccucugcucacccugcugcuggggggcuuuuuucagggguuguauuauaaaauaugcacuggcugugguuuuucauaagauguuuuguggcuuuuuaaagaagugucuuacucccucuucucucauuuuuuucugccuugaaaaggggugguauuucuuuuggggucaacaaauacacauaucaguuucacuccuaaccuuguaaguucaggacucauuuucuuggcagcaaguggcaggggcucuuuagucacuggaguuaacaguaagucugaguauauucugaauaauguaauuaugcaauuaauugauaaucauaccuaaagcacauugaacuucuaagagacaggugcuacguaagcacacugucuuucuggauggggacuuguauuuuaaauaacuuaucauuccagcuauguuggacuaggguccaaagcauuuuauaauauuuuuuuuuaaucuaggaaaaagacccaaacaaaucuaacuucuugcuuucucaccuauuugaauuuucuccuaccuaauuuguuugugucuuuauuauagcucaguuugacuucucaaacuuuucaaggguuggggcagcugcacuuuuagguugccuauaggaaauauugcauauggagauuacaguguuuuucugaccuaguucaagaccagaacaugggucauaggguuuuuauucagcaaaaugaaaacguaucuucagaacuuaacauauuacuggaugugauacagauuuugcuuucuguggaauugaaaauucacaaaaauucacagcuuaaauuucccaucagugacuggaggaauuuuuuucaggugcuuccuauauuaccaucccucaugcauauuaacucuuuagaauuuuagguuaagugaugucuauagaaguagccuggaaaaccaugaguuuuggaguucagugacccccugcuuuccucugcuccucccuucccaaggcauugaagcugaaugugccaacuggcaguuagaagcgaaagauggcauugggagaaauuuuagagagcuuucaaacucuuuauucucauguuccacauggucuaauuuuaacauaaauaauaugccuucacacuggauuguaaaaggcaugugauuuuugagauuuuauuuugugauguauugucuucugcaguauuaaagggaaagagauauuaaugugcauuacccuaucuuguuuuugaagccaggguaguuguaugauuuuguuaccagcagugcuaaccugaaugugaccugguuaccuuggaaaugcaggaacuuauaugaauguacuauaaaauaaaaugcggacugauucccagga

SEQ ID NO: 129 - RNA, 2054 nt, Homo Sapiens
gugacgucacaaaaaccuacgcgucgcgcggugggcgggaguuggcggacggucccuggcuggguucuggaggcccugggaccgcggaagaggcuucagacgcugcagcgaugccucgcccacggcgggucagucagcuccuggaucuaugccuuuggugcuucaugaagaauauuuccagauaucucacagacauuaagccuuugccucccaacauaaaagacagacugauuaaaauaaugaguaugcagggacagauaacagauucaaauauaagugagauuuuacauccugaaguccaaacucuagaucuacggagcugcgauauaucagaugcugcucuccugcaccugucuaacuguagaaaacugaagaaauuaaauuuaaaugcuucaaaagggaaccgaguuucuguaacuucagaaggaauaaaagcuguggcuucaucuuguucauaccuacacgaagcuucuuugaaaagaugcugcaaucucacugacgaaggagucguugcucuugcacucaauugccagcugcuaaagaucaucgauuuagguggcugcuuaaguauuacugauguguccuuacaugcauuaggaaaaaacugcccauuuuugcagugugucgacuuuucagcuacucagguaucugacaguggugugauugcacuuguuaguggaccuugugcgaagaaauuagaggagauucauaugggacauuguguaaaucugacugauggggcugucgaagcuguccuuacuuacuguccucaaauacguauauuacucuuccauggaugccccuugauaacagaucauucccgagaaguguuggagcaauuaguaggcccaaacaaacuaaagcaagugacauggacuguuuauugaugcuuuuuugaagaugaucaaugcuaggaaagcuuaucaaaacuacuuucccaggaaaccaucuauagagauuugcauucuacuuaauguuaacacuauuuuuaauuauuuuauugucuuaaguuauaacucucagagaauuagcuaagucuugguauauacaugguuugugcuuuacucuuaaacaucuuuaaagugcuauuauucuauaucuguuggaugagucauuauuuuugaaaugauaauccuagcaugaacucugaucuaugguguuggauucuguuucuuaaauaacuuuaaaauuaacuguuuucccuugagauuuccuucuccuauguagguauuugagcuauuguucuaaguuuaccuguaaguauaaaccuugggagaaucuaaguaaacauauuucuaaaagcauaguuaccuuccuauuuucuggcucuuaccuucuuggaguauuuaaaugcccauuugccaaaagcagaccugaacaucaagccuguuaauucuucaaagaauuuagguauuuguuucaccgaaaugaagugacuuauuagccauucagcguauuaguauuacagaggcucuugcccagccacauccauucauugauuuuuauggcuacucuucccaguuacauuuuaugcaucuguaagcuuuccuuccuuagcaaaauugcauucaaaaauguguaaaaaugaguaaauacagaauaucacuacagagacuuguauccucagguuuauugauuucacauugugaaauaaacagcaaaggucuuaguuuucaagugaaaacuuuuugguaaucacaaaauuaccugacacauaccacgcuuaaaccaacccccaaauuuagcauauucauuuugccaugagccagucuugagauuuucuuaaaagauuucuuauuuugccucugauguagugaaaaacgggguaaguaugcuaacuuucuuguauauguugggggguacuuauucaacuccauuucuuguccuuacaagauuuauaaaugugguauguuuauaguguggauauauauguugccacugcaaagguggugcauauguauauaugugcaaaauggguaaggccuguucuaacuaugaaauuuuucuaaagacaaauucaauaaaauuuaauacugaauauuuaaccaagucaa

SEQ ID NO: 130 - RNA, 71 nt, Homo Sapiens
uaggauguggugugauagguagcauggagaauuuuggauucucagggguagguucaauuccuauauucuag

SEQ ID NO: 131 - RNA, 75 nt, Homo Sapiens
aagacuauacuuucagggaucauuuccauaguuuguuacuagagaaguuucucugagcauguggagcacugaaau

SEQ ID NO: 132 - RNA, 291 nt, Homo Sapiens
auguggauauauucaaaacuuucaaaaaggacaguguuuagaaaggguaaaacuaggacacagaaaacacugggaauuaccacgacccccaagugcuuccggcuccaggaaauaaccauucauguguuugcuggaggucacacaauuuuccccuauuaccuggugcaaaaugacucaucacuucccaaaagcuucuuuucaaaccacgauuuucccauuuauuuugguccaaugcagucccauucuuuauggccuauagucucacucccaacuaccccccugggggguuaa

SEQ ID NO: 133 - RNA, 2771 nt, Homo Sapiens
gcucugcacgcaccuauguggaaacuaaagcccagagagaaagucugacuugccccacagccagugagugacugcagcagcaccagaaucuggucuguuuccuguuuggcucuucuaccacuacggcuugggaucucgggcaugguggcuuugccaaugguccuuguuuugcugcugguccugagcagaggugagagugaauuggacgccaagaucccauccacaggggaugccacagaauggcggaauccucaccuguccaugcugggguccugccagccagcccccuccugccagaagugcauccucucacaccccagcugugcauggugcaagcaacugaacuucaccgcgucgggagaggcggaggcgcggcgcugcgcccgacgagaggagcugcuggcucgaggcugcccgcuggaggagcuggaggagccccgcggccagcaggaggugcugcaggaccagccgcucagccagggcgcccgcggagagggugccacccagcuggcgccgcagcggguccgggucacgcugcggccuggggagccccagcagcuccagguccgcuuccuucgugcugagggauacccgguggaccuguacuaccuuauggaccugagcuacuccaugaaggacgaccuggaacgcgugcgccagcucgggcacgcucugcugguccggcugcaggaagucacccauucugugcgcauugguuuugguuccuuuguggacaaaacggugcugcccuuugugagcacaguacccuccaaacugcgccaccccugccccacccggcuggagcgcugccagucaccauucagcuuucaccaugugcugucccugacgggggacgcacaagccuucgagcgggagguggggcgccagaguguguccggcaaucuggacucgccugaagguggcuucgaugccauucugcaggcugcacucugccaggagcagauuggcuggagaaaugugucccggcugcugguguucacuucagacgacacauuccauacagcuggggacgggaaguugggcggcauuuucaugcccagugaugggcacugccacuuggacagcaauggccucuacagucgcagcacagaguuugacuacccuucugugggucagguagcccaggcccucucugcagcaaauauccagcccaucuuugcugucaccagugccgcacugccugucuaccaggagcugaguaaacugauuccuaagucugcaguuggggagcugagugaggacuccagcaacgugguacagcucaucauggaugcuuauaauagccugucuuccaccgugacccuugaacacucuucacucccuccugggguccacauuucuuacgaaucccagugugaggguccugagaagagggaggguaaggcugaggaucgaggacagugcaaccacguccgaaucaaccagacggugacuuucuggguuucucuccaagccacccacugccucccagagccccaucuccugaggcuccgggcccuuggcuucucagaggagcugauuguggaguugcacacgcugugugacuguaauugcagugacacccagccccaggcuccccacugcagugauggccagggacaccuacaaugugguguaugcagcugugccccuggccgccuaggucggcucugugagugcucuguggcagagcuguccuccccagaccuggaaucugggugccgggcucccaauggcacagggccccugugcaguggaaagggucacugucaauguggacgcugcagcugcaguggacagagcucugggcaucugugcgagugugacgaugccagcugugagcgacaugagggcauccucugcggaggcuuuggucgcugccaauguggaguaugucacugucaugccaaccgcacgggcagagcaugcgaaugcaguggggacauggacaguugcaucagucccgagggagggcucugcagugggcauggacgcugcaaaugcaaccgcugccagugcuuggacggcuacuauggugcucuaugcgaccaaugcccaggcugcaagacaccaugcgagagacaccgggacugugcagaguguggggccuucaggacuggcccacuggccaccaacugcaguacagcuugugcccauaccaaugugacccuggccuuggccccuaucuuggaugauggcuggugcaaagagcggacccuggacaaccagcuguucuucuucuugguggaggaugacgccagaggcacggucgugcucagagugagaccccaagaaaagggagcagaccacacgcaggccauugugcugggcugcguagggggcaucguggcaguggggcuggggcugguccuggcuuaccggcucucgguggaaaucuaugaccgccgggaauacagucgcuuugagaaggagcagcaacaacucaacuggaagcaggacaguaauccucucuacaaaagugccaucacgaccaccaucaauccucgcuuucaagaggcagacagucccacucucugaaggagggagggacacuuacccaaggcucuucuccuuggaggacagugggaacuggagggugagaggaagggugggucuguaagaccuugguaggggacuaauucacuggcgaggugcggccaccacccuacuucauuuucagagugacacccaagagggcugcuucccaugccugcaaccuugcauccaucugggcuaccccacccaaguauacaauaaagucuuaccucaga

SEQ ID NO: 134 - RNA, 71 nt, Homo Sapiens
ccucacugaugaguacguucugacuuucguucuucugaguuugcugaagccagaugcaauuucugagaagg

SEQ ID NO: 135 - RNA, 84 nt, Homo Sapiens
ggcuguggcuggauucaaguaauccaggauaggcuguuuccaucugugaggccuauucuugauuacuuguuucuggaggcagcu

SEQ ID NO: 136 - RNA, 1047 nt, Homo Sapiens
cucagcuccgcaccgcaacugaagaucugccgccgcggaacaguugcgucuccaucuggcuaccaacccacccaagcuuucuucuccaccaccaccaccuuccuuccuucccccuccucccccuccuuuccgucuucccucuccacccccgcccccaaucuccuccuuuuuuucucacuacgagcgguugcugaugcugaagccgagcgucacuucggcucccacggcagacauggcgacauugacagugguccagccgcucacccuggacagagauguugcaagagcaauugaauuacuggaaaaacuacaggaaucuggagaaguaccagugcacaagcuacaaucccucaaaaaagugcuucagagugaguuuuguacagcuauucgagagguguaucaauauaugcaugaaacgauaacuguuaauggcugucccgaauuccgugcgagggcaacagcaaaggcaacaguugcagcuuuugcagcuagugaaggccacucccacccucgaguaguugaacugccaaagacugaugaaggccuugguuuuaaugugaugggaggaaaggagcaaaauucccccauuuauaucucucgcauaauuccuggagggguggcugaaagacacggaggccucaaaagaggagaccagcugcuaucagugaacggagugaguguggaaggagaacaccaugagaaagcuguggaacuacucaaggcugcuaaagacagcgucaagcugguggugcgauacaccccaaaaguucuggaagaaauggaggcucgcuuugaaaagcuacgaacagccaggcgucggcagcagcagcaauugcuaauucagcagcagcaacagcagcagcagcaacaaacacaacaaaaccacaugucauagccacugcucacgugggcuuuacauacauugaccuuccauucacugcagugggaauucucagugugcagagggagagguuuucuagucugcaaacugaaacaguguaagaagaauaaagucuaugacuuuuaaauaaaucaccagggccaaga

SEQ ID NO: 137 - RNA, 2603 nt, Homo Sapiens
gugcgcugccguaccggucacguggacguuuggucacgugacugcguccgugguccucccguaggaaccggcggacucgguuggcguuguggggcagggggugguggagcaagauggcggcucaucuguccuacggccgagugaaccuaaacguguugcgcgaggcggugcgucgcgagcugcgcgaguuccuggacaagugcgcaggaagcaaggcaauaguuugggaugaauaccuaacuggacccuuuggccugauugcacaguauucacuauugaaggaacaugaaguggaaaaaauguucacacuuaaaggaaaucguuugccggcagcugaugugaagaauauaauuuuuuuugucagacccaggcuagaguugauggauauaaucgcugaaaacgugcucagugaagauagacgaggcccaacgagagauuuucauauucuguuugugccacgccguagccuguugugcgaacagcgguugaaggaucugggugucuugggauccuuuauucacagggaggaguacagcuuagaucucauuccauucgauggggaucucuuauccauggaaucagagggugcauucaaagagugcuaccuggagggugaccagacgagccuguaccacgcagccaaggggcugaugacccugcaagcucuguauggaacgaucccccagaucuuugggaaaggagaaugcgcucggcaaguggccaauaugaugaucaggaugaagagagaguuuacaggaagccagaauucaauauuuccuguuuuugauaaucucuuguugcuugaucggaauguggauuuauuaacaccucuugccacucagcugacauaugaaggacucauugaugaaauuuauggcauucagaacaguuaugugaaauuaccuccagagaaauuugcaccuaagaaacagggcgauggugguaaggaccuccccacggaagcaaagaagcugcagcugaauucugcagaggagcucuaugcugagauccgagauaagaacuucaacgcaguuggcucugugcucagcaagaaagcaaagaucaucucugcagcauucgaggaaagacacaaugcuaagaccgugggggagaucaagcaguuuguuucccaguugccccacaugcaggcagcaaggggcucgcuugcaaaccauaccucaauugcagaauugaucaaagaugucacuacuucugaagacuuuuuugauaaauuaaccguggaacaggaguuuaugucuggaauagacacugauaaggucaacaauuacauugaggauuguaucgcccaaaagcacucguugaucaagguguuaagacuaguuugccuccaauccguguguaauagugggcucaaacaaaaaguuuuggauuauuacaaaagagagauucuccagacauacggcuaugagcacauauugaccuuacacaaccuggagaaggccggccugcugaaaccgcagacggggggcagaaacaauuacccaacuauacggaaaacauuacgccucuggauggaugauguuaaugagcaaaaccccacggacauaucguauguguacaguggguaugccccgcucagugugcggcuggcccagcugcuuucccggccuggcuggcggagcaucgaggagguccuccgcauccucccagggccccacuuugaggagcggcagccacugcccacaggacugcagaagaaacgucaaccgggagaaaaccgagugacucugauauuuuuccuugggggcguaaccuucgcugaaauugcugcccugcgauuucucucccaguuggaagauggagguacagaauaugucauugccaccacuaaacuaaugaauggaaccaguuggauagaggcucugauggaaaaaccuuucuaggauguucagaggagacuuaacaaguguacugcagaauaaacuaccucuuugaagaaauugcugaaaggaaguaaaaccccauagaagaaacaugggaauacagaauauauucuggggucagcuucuuaaauuauacuacuguuuacugcuuucuccgucucuuuuguauucccuuuuuuuuuuuccuuugagacggagucuugcucugucacccagacuagagugcaguggcacggucucaccucacugcaaccuccaccuccuagguucaagcaauucuccugccucagccuccugaguagcugggacuacaggcaugcaccaccacacccggcuaauuuuuguauuuuuaguagccaugguguuucaccauguuggccaggcuggucucaaacuccugaccucaggugauccaccugccucggccucccacagugcugggauuacaggccugagccaccgugccuggccccuaaucugcugaagaaagaagaauagaagaaaaucaaccugaguaaaagcagcacugguuuugaguuuucuaagcucagggucuucauuagagaccucuggaaauacauuaaggaugguggggguagauaauccauucagccagacaaacggggccagcucuuaaaauaagaaagcugagacugaggaggugaaacugaaaauaaaaagagaaaguucauccucuaa

SEQ ID NO: 138 - RNA, 2042 nt, Homo Sapiens
cgccacuuugcuggagcauucacuaggcgaggcgcuccaucggacucacuagcugcacucaugaaucggcaccaucugcaggaucacuuucuggaaauagacaagaagaacugcuguguguuccgagaugacuucauugccaagguguugccgccgguguuggggcuggaguuuaucuuugggcuucugggcaauggccuugcccuguggauuuucuguuuccaccucaaguccuggaaauccagccggauuuuccuguucaaccuggcaguagcugacuuucuacugaucaucugccugccguucgugauggacuacuaugugcggcguucagacuggaaguuuggggacaucccuugccggcuggugcucuucauguuugccaugaaccgccagggcagcaucauauuccucacggugguggcgguagacagguauuuccgggugguccauccccaccacgcccugaacaagaucuccaauuggacagcagccaucaucucuugccuucuguggggcaucacuguuggccuaacaguccaccuccugaagaagaaguugcugauccagaauggcacugcaaaugugugcaucagcuucagcaucugccauaccuuccgguggcacgaagcuauguuccuccuggaguucuuccugccccugggcaucauccuguucugcucagccagaauuaucuggagccugcggcagagacaaauggaccggcaugccaagaucaagagagccaucaccuucaucauggugguggccaucgucuuugucaucugcuuccuucccagcgugguugugcggauccacaucuucuggcuccugcacacuucgggcacgcagaauugugaaguguaccgcucgguggaccuggcguucuuuaucacucucagcuucaccuacaugaacagcaugcuggaccccgugguguacuacuucuccagcccauccuuucccaacuucuucuccacuuugaucaaccgcugccuccagaggaagauaacaggugagccagauaauaaccgcagcacgagcgucgagcucacaggggaccccaacaaaaccagaggcgcuccagaggcguuaaucgccaacuccggugagccauggagccccucuuaucugggcccaaccucaaauaaccauuccaagaagggacauugucaccaagaaccagcaucucuggagaaacaguugggcuguugcaucgaguaaugucacuggacucggccuaagauuuccuggaacuuccagauucagagaaucugauuuagggaaacuguggcagaugagugggagacugguugcaaggugugaccgcaggaauccuggaggaacagagaguaaagcuucuaggcaucugaaacuugcuucaucucugacgcucgcaggacugaagaugggcaaauuguaggcguuucugcugagcagaguuggagccagagaucuacuugugacuuguuggccuucuucccacaucugccucagacuggagggggcucagcuccuggggugauaucuagccugcuugugagcucuagcagggauaaggagagcugagauuggagggaauuguguuguuccuggaggaagcccaggcaucauuaaacaagccaguaggucaccuggcuuccguggaccaauucaucuuucagacaaucuuuagcagaaauggacucagggaagagacucacaugcuuugguuaguaucuguguuuccgguggguguaauaggggauuagccccagaagggacugagcuaaacaguguuauuaugggaaaggaaauggcauugcugcuuucaaccagcgacuaaugcaauccauuccucucuuguuuauaguaaucuaaggguugaacaguuaaaacggcuucaggauagaaagcuguuucccaccuguuugcuuuuaccauuaaaagggaaacgugccucugccccacggguagaggggugcacguuccuccugguuccuucgcuuguguuucuguacuuaccaaaaaucuaccauuucaauaaauuuugauaggagaca

SEQ ID NO: 139 - RNA, 4180 nt, Homo Sapiens
augguggagccagggcaagauuuacugcuugcugcuuugagugagaguggaauuaguccgaaugaccucuuugauauugaugguggagaugcagggcuugcaacuccaaugccuaccccgucaguucagcagucagugccacuuagugcauuagaacuagguuuggagaccgaagcagcaguuccuguuaaacaagaaccagagacuguaccuacuccagcacuauuaaaugugaggcagccuccaucuacuacaacauuugugcugaaucaaauaaaucaucuuccacccuugggaucuacaauuguaaugacuaaaacaccaccuguaacaaccaacaggcaaaccaucacuuuaacuaaguuuauccagacuacugcaagcacacgcccgucagucucagcaccaacaguacgaaaugccaugaccucugcaccuucaaaagaccaaguucagcuuaaagaucuacugaaaaauaauagucuuaaugaacugaugaaacuaaagccaccugcuaauauugcucagccaguagcaacagcagcuacugauguaagcaaugguacaguaaagaaagagucuucuaauaaagaaggagcuagaauguggauaaacgacaugaagaugaggaguuuuuccccaaccaugaagguuccuguuguaaaagaagaugaugaaccagaggaagaagaugaagaagaaaugggucaugcagaaaccuaugcagaauacaugccaauaaaauuaaaaauuggccuacgucauccagaugcuguaguggaaaccagcucuuuauccaguguuacuccuccugauguuugguacaaaacauccauuucugaggaaaccauugauaauggcugguuaucagcauugcagcuugaggcaauuacauaugcagcccagcaacaugaaacuuuccuaccuaauggagaucgugcuggcuucuuaauaggugauggugccgguguaggaaaaggaaggacgauagcaggaaucaucuaugaaaauuauuuguugaguagaaaacgagcauugugguuuaguguuucaaaugacuuaaaguaugaugcugaaagagauuuaagggauauuggagcaaaaaacauuuugguucauucguuaaauaaguuuaaauacggaaaaauuucuuccaaacauaaugggagugugaaaaaggguguuauuuuugcuacuuacucuucacuuauuggugaaagccagucuggcggcaaguauaaaacuagguuaaaacaacuucugcauuggugcggugaugacuucgauggagugauaguguuugaugagugucauaaagccaaaaacuuauguccuguugguucuucaaagccaaccaagacaggcuuagcaguuuuagagcuucagaacaaauugccaaaagccagaguuguuuaugcuagugcaacuggugcuucugaaccacgcaacauggccuauaugaaccgucuuggcauauggggugaggguacuccauuuagagaauucagugauuuuauucaagcaguagaacggagaggaguuggugccauggaaauaguugcuauggauaugaagcuuagaggaauguacauugcucgacaacugagcuuuacuggagugaccuucaaaauugaggaaguucuucuuucucagagcuacguuaaaauguauaacaaagcugucaagcugugggucaucgccagagagcgguuucagcaagcugcagaucugauugaugcugagcaacgaaugaagaaguccauguggggucaguucuggucugcucaccagagguucuucaaauacuuaugcauagcauccaaaguuaaaaggguugugcaacuagcucgagaggaaaucaagaauggaaaauguguuguaauuggucugcagucuacaggagaagcuagaacauuagaagcuuuggaagagggcgggggagaauugaaugauuuuguuucaacugccaaagguguguugcagucacucauugaaaaacauuuuccugcuccagacaggaaaaaacuuuauaguuuacuaggaaucgauuugacagcuccaaguaacaacaguucgccaagagauaguccuuguaaagaaaauaaaauaaagaagcggaaaggugaagaaauaacucgagaagccaaaaaagcacgaaaaguagguggccuuacugguagcaguucugacgacaguggaagugaaucugaugccucugauaaugaagaaagugacuaugagagcucuaaaaacaugaguucuggagaugaugacgauuucaacccauuuuuagaugagucuaaugaggaugaugaaaauggaucccugguuaauuagaaaagaccacaagaaaaacaaagagaaaaaaaagaagaaaaguauagauccagauucuauucaaagugccuuauuagcaucaggucuuggaucaaaacgaccuaguuuuucaucuacaccaguuaucucaccugcuccuaacaguacaccagcuaacaguaacaccaacaguaacaguagccuuauaacaagucaggaugcuguggaaagggcucagcagaugaagaaagaccugcuugauaagcuagaaaaauuagcugaagaccuccccccuaauacccuggaugaacuuaucgaugaacuugguggcccugagaacguugcugagaugacuggccgcaagggacggguugugagcaaugaugauggaagcauaucuuaugagucaagaucugaacuugaugugccuguggaaauacuaaacaucacagaaaaacaacgauuuauggauggagauaagaauauugcuaucaucucagaagcugccagcucggguauuucauuacaagcagauaggagagcuaaaaaucaaaggcgaagaguucauaugacuuuagaauuaccuuggagcgcugauagagcaauucaacaguucggacguacucauagaucaaaccaaguuacugcuccugaguaugucuuucugauaucugaacuggcaggagaacaaagauuugcaucuauuguugcuaaaagacuugagaguuugggggcacuuacacauggugauagaagggcaacagaaucuagagaucugagcagguucaacuuugauaauaaguauggaagaaaugcuuuagaaauugucaugaaauccauuguaaacuuggauucuccuaugguaucaccaccuccagacuauccuggagaauuuuuuaaagauguucgacaaggacugauaggcguuggccugauaaauguagaagaucgcucgggaauucuuacucucgauaaagauuauaacaacauaggaaaauucuuaaauagaauuuuaggcauggaggugcaucagcagaaugcguuauuucaguauuuugcggacacacuuacugcaguuguucaaaaugccaaaaaaaauggaagauaugauaugggaaucuuagaucuugguucuggagaugaaaaagugcggaaaagugauguuaaaaaguuucugacuccaggauauucaaccucuggccacguagaauuauacacaauuaguguagagaggggaaugucaugggaggaagcuaccaagauuugggcugagcugacaggaccagacgauggcuuuuacuugucauugcaaauaaggaacaacaagaaaacugccaucuuaguuaaagaagugaauccuaaaaagaaacuuuucuuaguuuaucgaccaaauacugggaagcagcucaaauuagaaauuuaugcugaucuaaaaaagaaauauaagaaggucgucucagaugaugcccugaugcacugguuagaucaguauaauucaucugcagauacuuguacucaugcuuauuggcgcggcaauugcaaaaaagcaagcuuggggcuaguuugugaaauaggucuucguugccguacauauuauguauuaugugguucagugcugagugucuggacaaaaguugaggguguucuagcaucugucaguggcacaaacgugaagaugcagaucgugcggcuaagaacggaagaugggcaacggauuguagguuugaucauuccggcaaauugugugucuccucuuguaaaucuccuaucaacuucagaccagucucaacagcuugcgguccaacagaaacagcuauggcaacagcaucacccucagagcaucaccaacuugagcaacgcauga

SEQ ID NO: 140 - RNA, 969 nt, Homo Sapiens
agggcgggcgcggaccgugcugggagcggcgcggcuggagcgcagcgccgaagggacuggcagggcugaagugugcgggacagcaagcccccgaauagccccggcugccaccucgcaggacccaaggccacgcgcgccgggcccagcugagccgccucaugaagccgcccgcggcgcagggcagccccgcggccgccgcggccgcagccccggcccuggacucggcggccgcggaggaccugucggacgcgcugugcgaguuugacgcggugcuggccgacuucgcgucgcccuuccacgagcgccacuuccacuacgaggagcaccuggagcgcaugaagcggcgcagcagcgccagugucagcgacagcagcggcuucagcgacucggagagugcagauucacuuuauaggaacagcuucagcuucagugaugaaaaacugaauucuccaacagacucuaccccagcucuucucucugccacugucacuccucagaaagcuaaauuaggagacacaaaagagcuagaagccuucauugcugaucuugacaaaacuuuagcaaguaugugaaacaagaaguucuggguccuuucaucauaagggagaagcuucagaaaguuccgaggaccugcuaaaaucagcuacuagaaucugcugccagaggggacaaagacgugcacucaaccuucuaccaggccacucucaggcucaccuuaaaaucagcccuugaucccauuucugggcaauuuagacagugaaacugacuuuguuuaccugcuugcagcauauuagaacagacgauccaugcuaauauuguauuuucucuuaaaacauagcuuuccuguaauuuaaagugcuuuuaugaaaauauuuguaauuaauuauauauaguuggaaauagcaguaagcuuucccauuauaauauauuuuuguauacaaauaaaauuugaacugaagucugcuuccu

SEQ ID NO: 141 - RNA, 10684 nt, Homo Sapiens
uuacaguggagauuuaauguuuaacuucaaaaagacuccauagagucugacgaaugcaaacauauuuacaguaacuuuucuuacacucacuagauuacuuugauuuucgguuuuauuggcaagagugauucgugaaaaccaugacuagaugaacauuggaggaaacauucccaagcauuaaucacuuaauuuuaguuuuguacauuuuuuucugucuaauguuaccuuuguuguaaaauuaucuuuuuuuaaggaaugcuuuguaaagcuuaguucuaauauuacagaauucauaguuauguaauuaaucucaaaaucacucaccauugaagacccuugcuauuuuuauuuccuauaacacgaagucuauuaucuccuuaauaauuuuuaauuuccauccuuagaacuucuucagcucugcuacuuuuuccuuaaggccagggucauaggcagcacacuggugauaacucacugucuagaaauauugcauuuuguuuacaaaguuauuuucuauguucagcauuuugcuggcugccuuggguacaguaccucaauugaaugucuacaccugcauauuuguggacauugaaaucaucuaccauuuuucagagacacuaccuugugauauaaaaaaacagaagccaaaaaaaaaaaaaucccaaggaauuucugaaggagccucucuucacuacucugcucuuguuagaauaaugaguaacacugguauaacauucuacaauuuacaagaauauuuaucugcuucaugaaaccucaaaacaaaccuuugagacuaucaggauccuaaccacuuuacagaugaagauaacuuacauaauaguuaugggguuuccuggaucugacuccuuuauucuucacauuacauuauguugccuuccccacaacuaaucaaggacuccguuuuuucuuuuuucuuucucgaaaccauuuccuccauauuaguucccuuuggaauagaagccuuuuuaaaaguccaccuuaguauaucuucagggaaucacaaauucacuaugcuauuuauaauucaugaguuucucuaaugguaucaaggcagcaaauacaggugaaguaauaauuauccaccugauaguacuuaacacacauaccccguguaaaaauacugcugguguacaguguguguguuggugacgccggaggaaguggccgugaacaggcuuaaugccgcauugaguaacuucaaccucaucuugcucagguucauaucucuccugaauuuccccugguaagcgcaagauucaggauccguucucacaguuuuuuguuuaccaguugauguuggcugcauucaggaacgccuugcucucuuaagccacagugccuuccuggucucuucuucacagggucuuccacaaucgcucuuuuuccugggcacggugguuugcugaaagucgggguggggggcggggcguucccaaguuuccaggccaauuaccuaccugccuuagagcaauuacgcacuucucucugguagucccugaaauguucuaaucaucagaucgccccagcuucuccugaccguuucuugcuuacggcucaguucagacaguauuuguuccgggacgcucagcgggaggcgguuuuuaccggcucacucgagaccccaauuccaggcgcccugcagcuucccucagacuccccgggaccguguuuggccuucccauucguacgcugcggcugcgcuuuccucucguaacaccacgcuggcgaaccuggaaaggaucaaauagucccacucgccaaccuagcgcggcgggaccggcccaaaagggccuuugcagccugcgcaugcggacucggcggccgccaccgacuccccgucugcuucccuccgggcggcagccgcgguuuggagcuugcugacagcucugcgaccggcgggcgcagccucgucucgugcuuccacguuauccuaucagggacggggcggggcggcggccuccgcagccuaucagcgcgaaccacgaccccggcgagcccgggaggaaagccgccagaaagaaggcgauuggauggcggcggcgcucuggggcguagcgucgcccgggccccgcccaccgcugccuuccucugcugggcuccagagccacugaggccugagcgagagccgacggcgggcgggcgcagcugcugccggagcgccggcgcgugcuggugggccacacaccuuuccuccucuucacucgcgagcccucggacaugguggcccccggcuccgugaccagccggcugggcucgguauuccccuuccugcuaguccugguggaucugcaguacgaaggugcugaauguggaguaaaugcagauguugagaaacaucuugaauugggcaagaaauuacuugcagcuggacagcuagcugaugcuuuaucucaguuucaugcugccguagauggugacccugauaacuauauugcuuauuaucggagggcuacugucuuuuuagcuaugggcaaaucaaaagcugcacuuccugauuuaacuaaagugauucaauugaagauggacuucacugcagcaagauuacagagaggucacuuauuacucaaacaaggaaaacuugaugaagcagaagaugauuuuaaaaaagugguguuuccuguuccuucucuguugggacuccagcguucucuccuagaugaucuauacuugcuauuuugguucuuccuuaugaagaaggugacuuucagaugccucucgucagccaucucugaaugccuuccucagucuuuaaauuugaugaaguucaauuuguugauuuccuuuuuacuucuguggacugugcguuuggugucaugucuaagaaguauucacuacgccguaggaucuaaaacuuuucucauaucuucuaaaaguuuuaugguuuuguguuuuauuuuuaagcccauagucuauuugaguuaauuuuuguaugaugguaugagguuuaggucgaaguucauuuguuuugccuuuagguaucagauugcuucagcaccauauuuugaaaagacuuuguuucuuucauugaauugcuuuugcaccuuauucaaaaaucaguuggcuguacuuuuaugggacuauuucuagguucuuuauucuguuccuuugaucugugugucugucccuuugucauuccugcacucuguugauuacuauagauaguauuaaaagaaaaacuuuugagaauuuaaacuuagcagaguuuauuugagcaaagaaugaucaaugaagucaucacuccucacaaccagaaaagguucagagagcugggcucugcaaugugggcagugaguacuuauagacagaaaaugugagguacagaaaucguuugacugguuacagcuaggccuuugccuuauuuggauauggucuggucaguuaccugccugugauuaguggcgguuuggcugcuuaugauuggccgagacaccacuguuauuaccuucuuaaguuagguuuucaguuuaaguuagguuguaguucauuaagugggaacugaaaguauggagacagccucaggccacuggccuccugcuuauugauugauugauugagacagagucuugcccucucaccuaggcuggaguguaguggcaugaucucggcccacugcaaccucugccuccuggguucaagcaauucuccugucucagucucccuaguggcugggaucauaggugcccgcuaccacacccagcuaauuuuuuguguuuugaguggaaauaggauuuugucauguuggccaggcuaguguugaacuccugaccucaaaugauccacccaccuuggccucccaaagugcugggauuaugggccugaaccaccacgcccggcugccuccugcuuauuuaauaguaguuauccuuaauauuggguaaagugauucuucuuuuguucuuugucaaaauuguuuuagauauuuuaagguuggugucuuuccauauacauuuuagaauaaacuugucuguguuuauaaaaagucuugagauauuugguuaggagucguaauaaacuuacagauuaauuuggggagaauugacaccuuuauuauguugaguccagugcaugaacauaguagggaugucuccauuuguugaggucuccuucaguauuuuucaucagcaauuuuuaauuuaauauacagauacuguauguguuuuuuacauuuuuuuaaaaaguguauaccuaaguauuuuauauuuuuacugugauuguaaaugguauguuuuaaauuccaacuuuugcaugggauaauauuuuugugauuauuucauaggaaaguacucaccuuguacuuaauucuaugagagaaaucuuagugggcauucagaugggagaccaaguuaaauuucaaaacuacaagucauuuuuaaaaguuauauuaaaacaauuuuguaugcauguaagaauaauuauaauuagauuggauuugguuuagagaaaaauacaagcacaggauucauauauuucagaaucauuuuauguuaagcuuuguuugaaguaaauuuaggguaccuggaauaguuuguccaaacucauuguaggacuuaaaauucagauuaacaauuggcaaauucauauguauguacuuugaucaauauguauaguccugcucaaggacgguagagagggagacacagggucauggaauuggaaugcugagaaaaauuuauuuaacauauuaaaaaauugauuaaauuuuaagcauucggaaccuugauuccacaggacagaagauaaaagaauauuaucaggcagguaacacaagaaauacaaauucaaaaucagugcauacagugcgcagucuuccaaaugaagagaugaauguuaaaacuauucagagaccacuggucauuaaguugagcaaaaaucaagacguauuuuacagcguaauauugauaggucuuaaaggaaauguuuucagucauauaauauguugacacugcaaacauaagcagagcuuuugcgguacagucuggcauuaaguauuacgagagaaaaacauuuugcccagagacacuuacuggggcucuauuugcucuggaaacuauuagagaauguuguaucuauauaauagaauaauauucauuaauaagaauuauuuaagguuugguuuauaaacuugggcauacauaauaaugucaauuaaauggcaauauaaaaauuguaaauguugauaacuacauaaaauuuuuaugucuguuaaauuaauaugauaugaaugacaauuauuugaaguuucuagcucuuuucccuugugagaguugucagaaucaaaaugaagucacuuguauuaaauucuaacaaaaaauaaauaaagccaggagguuaagaagggagcucucacacacgucuaucguaagaacugcuacaaagcaucucugaagggcucuucugcacauaugccuguaauaagaacuuuugccagcagucccugcaucucuacauccauggagccccauugacauuccccaccugcagcggccacugcagcucaaacugcagcuugcuacgugagucacaaggauagcuagcuggaugcauaagaacauuugacugacacagucuccccuguauccaauguuccucaaaucuaauccaagugaaaaugaagaaaaggaagcacagucucaacuuauaaaaucugaugaaaugcagcguuugcguucacaagcacuuaacgcuuuuggaaguggagauuauacugcugcuauagccuuccuugauaagauuuuagagguuuguguuugggaugcagaacuacgggaacuucgagcugaauguuuuauaaaagaaggagaaccuaggaaagcuauaagugacuuaaaagcugcgucaaaguugaagaaugauaauacugaagcguuuuauaaaauaagcacacuguacuaccaacuaggagaccacgaacugucccucagugaaguucgggaaugucuuaaacuugaccaggaucauaaaagguguuuugcacacuauaaacaaguaaagaaacuuaauaagcugauugagucagcugaagagcucaucagagauggcagauacacagaugcuaccagcaaauaugaaucugucaugaaaacagagccaagcauugcugaauauacaguucguucaaaggagaggauuugccacugcuuuucuaaggacgagaagccuguugaagcuauuaggguuuguucugaaguuuuacagauggaaccugacaaugugaaugcccugaaagaucgagcagaggccuauuugauagaggaaauguaugaugaagcuauucaggauuaugaaacugcucaggaacacaaugaaaaugaucagcagauucgagaaggucuagagaaagcacaaagauuauugaaacagucgcagaaacgagauuauuauaaaaucuugggaguaaaaagaaaugccaaaaagcaagaaauuauuaaagcauaccgaaaauuagcacugcaguggcacccagauaacuuccagaaugaagaagaaaagaaaaaagcugagaaaaaguucauugauauagcagcugcuaaagaaguccucucugauccagaaaugagaaagaaguuugacgacggagaagauccuuuggaugcagagagccagcaaggaggcggcggcaacccuuuccacagaagcuggaacucauggcaaggguucaaucccuucagcucaggcggaccauuuagauuuaaauuccacuucaauuaaaccaacuguuuuucugcucuucuuaauuuuuuuaaagauuaaaaacaaagaaaucuuguuccgggacccuaaugaaaaaaaauuucaaaucuuuucaguuuguccaugaccaaagaguugcuuuaauaggaaaaaaucuguucuuaucccugucagauuuaugguuaauggguuugcaacggcaaggaggcaaggaaugguucuauuucugacagagcagccugcaucugcuuuaugcugucuggagggaaguggucugaggcaggcucacccguggaagugcucacguauucuguauuauuuuucuacacuggagcugagauucuucucuucacagccuugcagaguaagucagugccuacaaguguaagaaggagcuguaaucuucaugaggaugguuauacuucaguauucuuaaagagaacaugaacauuuuugagcuguauguucuuagggacaacugugcuucgauguggucagucucgucacuugugaguagcugugaaaucuuuagugugcauguguuugcaccucuguggucugucaacguggcugucacugaaggagcaagagaccaucuuuuaggaacccugccaccaaauaauaauauauccaggcuuagacuuuggauuaauguuaaauguacauuuuuuugguucaguaccugaagaagaauacugaaacuugaaucuauaaauuccuauggacccuuuuaauauuaaacacaacaaauuaaaaguuguuauagguaaaauaaguucagauaaaauaguggugguauuuaaaauaauauugcugaagugcagauugaaauacuuuuuaaacaacugaaguucugaguuuuuauagggaauuucauguaacaagacugguuuagaaacguaaaguugcgcagucaacauaaauaaauacagaaugccauguucuccacuucuaaguaaagacagugggcagcuucuguuucuccuucuaucaaggcuucacccuaucuuaaaggucuguggugccucccacgugggaccugucugcugguauguguuaaacagcagaccggcccuucuaccagaucuugaugccucugauuuucuccugccuacaagaaaauacaggcaagguuagucaggucuggcuauauuuccacuguuguuucauuuaauaagauggcaucuccucuugagauauguucuucuuaccuuuuaagaagauacuauuuaagaagugaacuauucagucuuuguauacugaaugcuuuuucccuaaaaaauguuaaucaagaauauugaauauuuauggcacucuugaugcugcauuugaaagcugaaggaauuacuuuagauagauaggaauugcuaccuuuauucuggaaagguuuuguuucugccucaaagcauuuugaaguguuuuaaccauuaaagggucuaauuuuuuuuucuuaaugaaaucaagcauuuuaauucacugugggaggcauccugaccacggacauccauaacagcaaagcacaaaucguuuucgucuguagucauauccugaaacauagguggacaaauuuuuaacugagagacaaaaaucacauaguugaauugagcagaacacuuaagugcuuucugcaucuauuuaggagucuauuucuuaccaauaaacuugacaacgcauuuggaaaacuagugaacaccuuacagcuuucauuuugcuuuaauguuucaauucaagccgguguaaaaauaauuuccaaggcauuucuguuuauucuuuaguaaucucacuacuggcuaugucagcaauaucuuuuucaaucugguuccuuuuguauaugaugucacugugaccucuuugaaauauagugauggcuuuuaccuacuuugaaaagaauuuucacauagagucagaaaaaaaaggaaauaucaaaucacuugccuuuccacuuggagagcacgacaguugccaacaacaaggggucaagggccgcacaggagaugugugggggccuggccaccucccaccugcugcccagaggcuuguuugcauuuucauuuuuucuccacuuguaacaaccauaguuucagcuccuaaauucuuaucauggauuuacuuagucaucuuaacugaccugcaguuacuugccuguuuucagugaagagagagaagcagcucuggugccacaugccagugccauggagggaaaugaauucucugcaaucuguuguuucgcugauucaugaagaaaguaacaacuguugaguuucagccuugauggcugucggcaguuuucugguguccacccaaacggagagacagucacuccugcuuacccuaaugugugacugagaagcagccuggguguguaaagagauagucauucccccugccugucucacuguaggguagcauuauccacuguaaaaccauacuacuuucauuuucccuuggggacuacaggugccagguaaccuuuuuuuuuuuuuuuuuuuuuuuuugagacagaaucuugcucuguugcccaggcuggagugcagggacaccucccggguucaagcaguucuccugccucagccuccaaguagcugggacuauaggcacgcaccaccaugccuggcuaauuuuuguauuuuuaguagaaaugggguuucacuguguuagccaggauggucuugaucuccugaccuugugaucugcccgccuuggccuuccaaaguguugggauuacaggcgugagccacugcgccuggccaucagguaaccuuuauggcucuuucaggaaaagugaaaucagagaggcguacccuagccacagcuguuguauucugcucuucuuuccuuuuuggugagcuucauggguggaguuaucaguggucuguacuuuguggauauuuugcccagcaggaaguauuagacacaucagucuagaagcauugugaaaagguuccaaaacgggagacaaaauuuaauucauuccucaguucugaaaguuugugcuuucuuaccaugaauagaugaaaacuugaaaaaaaucuugacaguuuacuaaugugaaucagauguaacguacuacuaauucuacaaugccuuucucuuuagucaguauuaaaaaucuuuuuuaaaguauugguaugaaaacaaauuuuuguugcccugauaauggaauuuuaaaacuacccacaguuuaagagaaaacauaacuugguaaaaaagguagccaauaaaaccacaauuugaaauugauaccauuuucuacucacaauggaugaugaaaaauuucaccuuuaaaugggucagaaguugucuuugacauuuaccaugaaaaaacuacauaaaauggcucccuggugagguuacagacacggcccuggugaugggcguugcaaaguuuucacugagcacacagcaaugguaucaccuagagaaguucacgcaacuuuguugaauguaguugacuuuuccaaauuuauaaaggaaggaagaaggcaaauguuaauuugccaacaacgaauauccuuuuucuaaaucagaucauuccuuuuuuguuaguggcaguuuauccuguaauuucaaaugacguuaagaggugggauuauuuggggguuuuuuuuguuuguuuacagaugaucucauuugcugaaugauugauuuaagaguaaaauuagccacugcguggcuuuguguauaguaaccgguuuuguugcacuugucuguggcugaaacacuuaccugcaguggaaagccgagcaaggaggagguaaacauuggagauguuugugaaaauauuacucuugcugugagguuuuaguuuguuuugaaugagaaaagacuaaguaacuuaauccaucucaauguaguguuuuaauaaaaaaggaaccuaauauuugaaaugggucucagacaugucuacaaauauggguacuauuuuuaugcccguguauuuucacauuuaauaaaaauauuuauggucauaucagua

SEQ ID NO: 142 - RNA, 2664 nt, Homo Sapiens
gaaauucuuacaaaaacugaaagugaaaugaggaagacagauugagcaauccaaucggaggguaaaugccagcaaaccuacuguacaguagggguagagaugcagaaaggcagaaaggagaaaauucaggauaacucuccugaggggugagccaagcccugccauguagugcacgcaggacaucaacaaacacagauaacaggaaaugauccauucccuguggucacuuauucuaaaggccccaaccuucaaaguucaaguagugauauggaugacuccacagaaagggagcagucacgccuuacuucuugccuuaagaaaagagaagaaaugaaacugaaggaguguguuuccauccucccacggaaggaaagccccucuguccgauccuccaaagacggaaagcugcuggcugcaaccuugcugcuggcacugcugucuugcugccucacgguggugucuuucuaccagguggccgcccugcaaggggaccuggccagccuccgggcagagcugcagggccaccacgcggagaagcugccagcaggagcaggagcccccaaggccggccuggaggaagcuccagcugucaccgcgggacugaaaaucuuugaaccaccagcuccaggagaaggcaacuccagucagaacagcagaaauaagcgugccguucaggguccagaagaaacagucacucaagacugcuugcaacugauugcagacagugaaacaccaacuauacaaaaaggaucuuacacauuuguuccauggcuucucagcuuuaaaaggggaagugcccuagaagaaaaagagaauaaaauauuggucaaagaaacugguuacuuuuuuauauauggucagguuuuauauacugauaagaccuacgccaugggacaucuaauucagaggaagaagguccaugucuuuggggaugaauugagucuggugacuuuguuucgauguauucaaaauaugccugaaacacuacccaauaauuccugcuauucagcuggcauugcaaaacuggaagaaggagaugaacuccaacuugcaauaccaagagaaaaugcacaaauaucacuggauggagaugucacauuuuuuggugcauugaaacugcugugaccuacuuacaccaugucuguagcuauuuuccucccuuucucuguaccucuaagaagaaagaaucuaacugaaaauaccaaaaaaaaaaaaaaaaaaaaaaaaaaaaaaaguaguuaccauugccuuuucugugagcuauuuguuuugguuugcugaaacuaguccaaaacaggaaauuuaacagacagccacagccaaagagugucaugugaauuacaagaaauagagcccauuuagggaaagauagaacuagaaaggcuuuucauuauaauuccauguugaacaauugagucauagcuucuuaucuuggaggaaggacacaauucaaaggggcaguaaggauuuuguaaaacguggcauccauaauuuacuauggagcaagugcccacaucucuaggacauuaagacauuuaugagaaaucucaggauucaucuucuguuuuuauguuaaaugcacucccuccuuuucaguuaacauuauaaaaaguaaaaaaugaaaauuuuagaaaucuugcauuagacacaugaaaaaauaacuaaaaguuuaaauuuaaauaugaaacaauuuugcugaaaauaguauccauauacuauuuaagucuuuuaugguuauuucaaguauacaauuucuaucuguaauguaauauauuacccacacauuuuuuucacaggagagagagaauauccucauuuguuuaugcucauguguauuuucuauagugaauuucagaaacuuuuaauaucagguaauuucaauuuaugccuauaaagcauugauugaaaaauaacuagaauugugcauauauaacacauaaucuccaacagaaguuacugaauacauucauacuaauguaauguaauuucccuuuauuucuugcucuucuguuucaaacugcugcuauuguaguuuacauaucccaaccuuuaaaaauauuccucuuauuagcuuuauauucacuuuauagaaguugaguuuuaauuaaaauucuuggcauccugaaguaugucacauagcaugugcuccuuauaaauauguugauaucucagaagacagcaucccgguuuucauuuuauaaaguaccauacuuaagaaugcuguaauacuuaucuuuuauaacauguuuccuucgcuuugcuugucuuuuaugucaucaguuuuaacuguuuacuucauuuaacaguuuacaucauucaacaguuuacuucauuaaacaguagguggaaaaauagaugccagucuaugaaaaucuucccaucuauaucaaaauacuuuucaaggauauacuuuucaaaacaaacgauuuaaauuuuauguuuaaaauauaaacuuuagauuuaaacuuuauuuaaauaucugguuccuaugauuuugacuucaguaaguucaaauaaaauauauuuugcaauucauuuuuacauuauaauuuaaaaagaagaagcgauaaguggagucaguuucaaugcuagguggggugguuaaugauuuuucugguguugcugcuaauguggauuaacaaauaaaaacauucauugccuuuu

SEQ ID NO: 143 - RNA, 4503 nt, Homo Sapiens
agcgggcggaggcagcggcugcgcccugcgccggggcggagccgggggcgggccggcggccggcaggcgggggcuggggcccgaggccgggagugccugagcgccggcggcgacgacggcagcggcggcccagcgggcucggugguuggguccgcggcggcucgggguccgcccgcgggcugcggugcgagcgggcggcccggcuccccuccucccccgcccgccgccgccgcugugauuggguggaagauggcgcuggccggauggaaauccuaaugacagucuccaaauucgccuccaucuguaccaugggcgccaaugcuucggcauuagagaaagagauugguccagaacaguuuccggucaaugagcacuauuuuggauuagucaauuuugggaauaccugcuacugcaauucaguucuucaagcacuuuauuuuugucguccauuucgggaaaaaguucuugcguauaagagucaaccuaggaaaaaggagagccuucuuacaugcuuagcagaucucuuccauagcauagccacucagaagaaaaagguuggaguaauacccccuaagaaguucaucacaagauuacggaaagaaaaugagcuuuuugacaacuacaugcaacaagaugcccaugaauucuuaaauuaccuacuaaauacaauugcugauauuuuacaagaagagagaaagcaggaaaaacaaaauggucguuuaccuaaugguaauauugauaaugaaaauaauaacagcacaccagacccaacguggguucaugagauuuuucagggaacauuaacuaaugaaaccagaugucuuacuugugaaacuauaagcagcaaagaugaagauuuuuuagaccuuucuguugacguggaacaaaauacaucaauuacucacugcuuaagggguuucagcaacacagaaacucugugcagugaauacaaguauuacugugaagagugucgcagcaaacaggaagcacacaaacggaugaaaguuaaaaaacugcccaugauucuagcucuacaccugaagagauuuaaauauauggaucaacuucaucgauauacaaaacucucuuaccggguaguuuuuccuuuagaacuucgucuguuuaacacuucaggugaugccaccaauccagacagaauguacgaccuuguugcuguugugguucacuguggaaguggucccaaucgaggccauuauauugcaauaguuaagagucaugauuuuugguuguuguuugaugacgacauuguagaaaaaauagaugcacaagcuauugaagaauucuacggguugacaucagauaucucaaagaacucugagucugguuacauccuuuucuaucagucucgggacugagagggaaccgugaugaagagacacuuucugccucauuucuucucugguuauuuuggaaaggaucaagcacugauuuuucaagaaaagagaaaugcaggaagcucagggggcaguagcacacuuugcacacgauaaagcaaagacgauggauugacaagcccuuccgaucaugguaguugauuuauuugcucagguaucaugcugucuguacaguuccauacaacaaggaggugaaaucagagauaccagcuccucuuuuaaaacagccuuccagucauuggcacgcauuuucucuuuauuaauugcaccaauaaugcuuugaauuccuugggggugcaguagaaagaaucggaaucugugccguauugauaaggagaugauguugaacacacugcauaaauuugccugguucaguauguauagaagcauauucaguggucuuuucaagaguaaaccagaaauacuuuugggcccaacacuugcaguugccuuccugauguaaaaacuaacaugcuagauaauccagugucgggaagacaaagauguuuugcuucucugaagaagcuuauaauaauauacaguauauguauauguagggagcaauuggucaaaaguggcuuuuuguuuccccaaggggaaagacuggcuuuguaauuauaauuuuuuccuuauuuauuuuacuuaaaacugguagagucuaaguauuauaugaagugcccaugauucugucaguaaauuugaacauauuuuuauuaguuaaugucaguuuaaguuguccuuuuguuuguuucuauuuuuaaggugaauuuuaauuucuaucugaaaucaguuaagauaccuugagaaaaacugcagugagaggagauaaauauccuuuuucaggaggaacugauaucucuggcuaaauauuuguccuuuuauuaugguuucuaaaucaguuauuuucuucagcuuuaauuucauaaaauuaaaaaacuauuuuaaaaauuccuguaguuguuggaauaauuaaaaauucuggugcaguggugguauaccaaucuuuagaauucuuaaguauucuaauguuucaaguugagaucaugcuugggaaaaucaugucauagcauuuauguuauuuucagaugccauuuuuuacccuggaaagaagucauaauguucaucauaacccuagcagccuggauagugagcuaaacaaacccuucaaagauuaaauuuuaaucaaguagaccgggaauacaaaagacaaguccuuccuucccuuccccccaccuuuacaaaucuuacuggaaggguguucagaaauuaaaaucuguguuugcuaagacuucauucuguuggggguuuuaagaaguaauauauguaacauaaaauauauguaaacgauugcaguuuuuuuggacguuuuuccaugcaucaguaaguugucugacaguagccaaauguaacuugcagaaaauuauugaaaauuauauucagaauaauagcaaucaggccuuggauguucuuuauuaaacucuuuucaggcaguaaauuuaaaaaaaauugucauuuucuaaaguccuuuugcuaaaacuguugacuauggaaaacaacaaaaaggaauuuuuuagucugcugcuauuauuaacauuuauuaucuguaucuuuuggcucaggaaaugacuucaccuauuuuuuccauaagcagaccuuuaacagagucacuuaauugggcugcuuaaacagauguucugggagaaaauuauaauauuuaguauuuguacaaaauaucaaaaaguauuuugacaaguuucuuuuuaagauaguuccuaaagccuuacccuggcuagagguguuuuguacaaauuauauauaagccagccugaucuaccaacaugccacagagaaucacaaucaacaguguggggaaagucagggcaguggaaguggaugcacucuuuuuauuuugaaggcuuaaaccaaauugucuuggaauuaaagcuguauuucugcagcuuucgguacagagaaaaagaggaaagugaagcugugucaguuuuaacauuagcuauaucaacauguuuaagaaagauagaugaagucauuugcauaaagguacagcauugaaauacuauguuguguuuguuuuuacauuuuugcauuaaaaaaaaacaugccguaaaagccaaguuaaauuucauauuaaagcaaguucuaguguauguguugaguuccugguaaucacauacuuguucacaucuacaccguacuucauaguaugauuugucaggggagggauuguggggugacaguuuuacauuuacuuuuucuucuuaaugcagcuggaucuaaguaaaauguuuugaaguuuaucagaaacuaaauguacuuuuaaaacguauagggucaggguugggggaaaaauacagguauaguaaguaagaaaagugacccaugaagaaagcaucgugagguuguauguugguugacugugauuaaaaugcggggcugguguaaguuguaagugguggcugauugccguguaacuauguacaugauuguugggauggcugucccauauuuuguauauuggaauaaaaauuucuauaaauuauuguaacuaaaaguaaauauucuaaauuaagucccacuucuuaagucacauggcuucugucuuggaaauuuuaccuuuaaaagauuauuuaagacaggaaccaggaggcuugggaacagggaaagagggaaauguuguauuaugugggucuuggggccucuaaccaucaguauaggguuuuuucuuuccuugauggcaguagaaagaccucauuuucauaacauaacuacucuugauacuuucuuuaaaaacacuuuuuauuaaagauucuaucaugagguauuuggcugggagcugggaggcuaaagcgcucauguccuggcucuucagugaauuuaacugugugaccuugggcaagucacuuaaccucucugugcuucagucucccugucuuguaaaaugggaguaauaccuaccucacaggguuguuguggggauuaauuagagauaaugucuguaaagcauuuaagguucuugaagaaggcacuauauaaauacaaaauaauaucuauuaaaguugguuuauuugug

SEQ ID NO: 144 - RNA, 5474 nt, Homo Sapiens
aguguaagggagugggagcugguccgugccgcggcggccgcgcagggagcucucgaggcaacgccggggcgcccgaggucuggaaggcgcagaaauggagcaagagccacaaaauggagaaccugcugaaauuaagaucaucagagaagcauauaagaaggccuuuuuauuuguuaacaaaggucugaauacagaugaauuaggucagaaggaagaagcaaagaacuacuauaagcaaggaauaggacaccugcucagagggaucagcauuucaucaaaagagucugaacacacagguccugggugggaaucugcuagacagaugcaacagaaaaugaaagaaacucuacagaauguacgcaccaggcuggaaauucuagagaagggucuugccacuucucugcagaaugaucuucaggaggugcccaaguuauauccagaauuuccaccuaaagacaugugugaaaaauuaccagagccucagucuuuuaguucagcuccucagcaugcugaaguaaauggaaacaccucaacuccaagugcaggggcaguugcugcaccugcuucucugucuuuaccaucacaaaguuguccagcagaagcuccuccugcuuauacuccucaagcugcugaaggucacuacacuguauccuauggaacagauucuggggaguuuucaucaguuggagaggaguuuuauaggaaucauucucagccaccgccucuugagaccuuagggcuggaugcagaugaauugauuuugauaccaaauggaguacagauuuuuuuuguaaauccugcaggggagguuagugcaccuucguauccuggguaccuucgaauugugagguuuuuggauaauucucucgauacgguucuaaaccguccucccggguuucuucagguuugugacugguuauauccucuaguuccugauagaucuccgguucugaaauguacugcgggagccuacauguuuccugauacaaugcuacaagcagcaggaugcuuugugggggucguccuguccucugaguuaccagaggaugauagagagcucuuugaggaucuguuaaggcaaaugucugaccuucggcuccaggccaacuggaacagagcagaagaagaaaaugaauuccaaaucccuggaagaacuagacccuccucugaccaacuaaaagaagccucuggcacugaugugaaacaguuggaccaaggcaauaaggauguacgucauaaaggaaaacguggaaaaagggcuaaagauacuucaagugaagaaguuaaccugagucacauuguaccaugugagccaguuccagaagaaaagccaaaagaauuaccugaauggagugaaaaaguggcucacaacauuuugucagguauuacaguaauguuaauuuuuuucccuguaugacauuaagccuuuggaaccaaauaaagauauuguuuauuagggaauacugagaaagauaauauuuuguauuuugguuuuaaaugaucaauuuagaaauaaauguagaaggaacuagucuuuugaaacaucagauauugucauauaaguauaaauucuuccuggccuauuauucuguucuacuauugggaaaauggauagugaaaagcuucaggaaucuucaaauucuuaauaguucugaaucuaaaauuaguuauguucguuuccccuuugaagcucccucuuaaccucccccuaccccugucccucagcuguggucugaaugugucccuucaaaauucauauauugaaauccuaaccccugaggugaugguuuuaggagguggggccuuuggaaggugauuaggucaugagggaggagcccucaucaaugggauuagucccuuauaaaagagaucccaaagagcugccuugucccuuucacuaugugaggaagcaguaagaaggugucauucuaugaaccaggaagugggccccucaccagagaccaaauguaccagcaccuuagucuuguacuucccagccucuagaauugugagaaauaaauuuuuguuguuaaugugcuuccugggugaguugggguuuagucaaaggugcugagauuacugguaaggcaauccagaaaggugcuucuaaacuccgagagcggauucaaccagaagaaaaacccguggaaguuaguccagcugucaccaagggacuuuauauagcgaagcaagcuacaggaggagcagcaaaagucagucaguuccugguugauggaguuugcacuguagcaaauugcguuggaaaagaacuagcuccacaugucaagaagcauggaagcaaacuuguuccagaaucucuuaaaaaagacaaagaugggaaaucuccucuggauggugcuaugguuguagcagcaaguaguguucaaggauuuucaacugucuggcaaggauuggaaugugcagcuaaaugcaucguuaacaauguuucagcagaaacuguacaaacugucagauacaaauacggauauaaugcaggagaagcuacccaccaugcgguggauucugcggucaauguuggcguaacugccuacaauauuaacaacauugguaucaaagcaauggugaagaaaacugcaacacaaacaggacacacucuccuugaggacuaucagauaguugauaauucucagagggaaaaucaagaaggagcagcaaaugucaacgugagaggggagaaggaugagcagacgaaggaaguaaaggaggcaaagaagaaagauaaaugaugaagugcugggaaucacuuauaccaaagccuuaugaaauggaugaaauuuuguuaaauaggcaaauguggaauuccucacagauuaaccaguauuuuuuaaauguauucauuccuacaaauuaacuuucauaaauuuuauggcaugucuucuauuuaaaaggaaaagaauaaguauucuugcaucuggccuuagaaaugugaaguuauauucucaaguuuauuuuuuuccaaguguagcuaaaauauuuuugcagguaaaauaaagcugauaguacauguguuguucaaaccuuguuaaaccuaauauugaacuauuuuuauaucugcugucuuucagaaggcaaauaggaaacuauauauuugcuuaaaaauuggcauuuaguaaccuuaauucuuuuuauagaaggaaugacuuaaaguauuguccccucuuuuugcacuaauuguggauuuuuuuagaugcuucucaaaauuuucaguguguaagcuaaacaaaaacuaaaacuaagaauucucaaaaaaacuuguucaaaacagggaaagacugaugaaaaguaaaauggacuacuuuuguaacuuaccuguuuguuaggaaauggaauggucucuuugauuuaaaauaaauaaaaauagauuauuacgucuuuuguauugagacuguauuguuaugagccuaggaaauuugggaacaugauuguauuguauuaaaauucgaagugauuauuaucagcuuaauuggauuaaaaaaguacuucaagaaauuauuuuaucauaucugcuucuguuuuuccaaaagguuaaaacuuguaaaaaaaauauauauaaacaauugaguuuacuaaugguaaacauuuuuauucugggauucggucauuggaauuuauauuaaaagacaaguuauuaaaaaggaaagguucuauucauaaucaggguaaagaauaugaaaaccuuagacguaauccaugguggauaggcauuaugguuuccacuuuggcagaaggcagacuauucacagcccuauuuacuuacauaggcuaaaaaacuauguaacuaaauaccuaaugguauuuaauuuuuguuuauugaauuuaagagauugguauuaguuuucauagcuguaguccauucuaauaauuucugaucuucuaguggcuacuuaauuagacauuauuugaagcugucugaagaaugcacuuuaugaauuaaaaaacugaauugccugaccucguuaucacaugagcuuauauuuugggaacacauagaacugauggaggcuuuuccuaaggccaaggauaauguacuaguuguuaaaauggaaauaaaagugaagugguaaauagcuuacagacagucuaugcuuuguuuaagaaauggaauggcacuucauauauucucauuugugggagcuaaaaauuacaauaaucaaacuuaaggagauagagaguagaaugaugguuaccagaggcugggaggcauugaagggauggggagggaagugagguugauuaauggguacgaaaauauaguuagaacgaauuuguuguaguauuugauagcccaacagggugacuacagucaacaauaacuuuauacauuuaaaaauaaaagaguguaauugggacguuuguaacacaaaugaaugcuugaagcaguagauacacccugauguaauuauuauaaaucgcauaccuguaucaaaauaucucauguaucccauaaauauauacaccuaccauguacccauaaaaauuuaaaaagaaauggaauggcaaauaauggaacauaaacuuuaaacaguuagcuuugaccagaggucagcaaauauccuccaugggcuaaauccagauguccaccuguuuucauaaauaacguuuuauuggagcauagcuguacccauuuguuuacauauuggcuauggcugcugucuaguucaacgugagaguugaauaguugcaucagagaguauaugguccacaagccuaacuuauucacucucuggcccuuugcagaaaaagugugcugccuuagucuauagaaaauggacuuuucccaccauucacugacucauuaggagauaggcaucuucuaaagauuuuuuuuauauuguguaaugauugauauauagauaaaauuauauauuacuuguaagguaugaugaauaacaacacuuaaaaacucaucacaccuaaagacauggaaagcugccaauuaccuauauguauguucuuccuauuuucuuaccucuuuccccaugucauuuuuuauuguuccuugccauuuuuuaaucacacauguauguucuccaaacauacuguuucauuuuuugaagcuuucuacauauagugucugaaugugaagucuuacucaacuugcuuuuuugaguuuauguuuaaaauucauucuugcgcuuauaugcauggaugguuuacuugcucuauaguauucugugugaguauaccacaauuuaaguguucauuuuccuaucaguugacauuuguuuuuaguuuuuguugguagaaacaguacacucaaaacauccuugacuguccccugguacacauaugcaagagacuuuaugcguaagaguggaguuguuggcuugucaaguuuugcaaaauaaugccagguauuuuccaaaaugaugauauucucuugaguauuacuucccuuugcaauguuuuuauuguuaauguagcauauauaaaaaaguaucucauaauuuuaa

SEQ ID NO: 145 - RNA, 337 nt, Homo Sapiens
ggaugugagggcaaccuggcugugacaucugucaccccauuaaaugccaggguugauuuggcugaucuggcuggcuaggcggguggccccuuccucccuuaccgcuccaugugugucccuccugaagcugcgcacucggucgaagaggaugaccaucccugauaaagaaggaccggucuucagucaaggguauacgaguagcuaugcugucuugcuagaaccuccaaacaagcucucaagauaaacaauuguggagacaaagguuugauuaugcagcugaagccuccagguagcagguuucagagcucuuaucagaccuaaaaaggugcuagacucu

SEQ ID NO: 146 - RNA, 4734 nt, Homo Sapiens
aguucucccgggcgccuagcgggaucgccagcgcggcagugggggcuuccgcggcugcaagccagcggguccugugagggcgagcggaggcggagaaagggcgcgggagugagagagggugagucagccacugucuaugcaauaaagggaggccucaccgcgggauagggcugaauucagaagugcggcccgugccgcagucuguuccaggacgcggcuugucuuagcgucagcgagggaagguugaggaggagccagagccugguccugcagccuuucucgccgucagcgcccgucgccaucuccaccaugcagucccgggaagacgucccgcgcucucgccgccucgccaguccccguggugggaggcggcccaagaggauuuccaagcccucgguuucggccuuuuucacggguccagaggaguuaaaggacacggcccauucugcagcccugcuggcacagcucaaguccuucuacgacgcgcggcugcugugugaugugaccaucgagguggugacgccuggcagcgggccuggcacgggucgccucuuuuccugcaaucgcaacgugcuagcagcugcgugucccuacuucaagagcauguucacagguggcauguacgagagccagcaggccagcgugaccaugcacgauguggacgccgaguccuucgagguguuggucgacuacugcuacacgggucgugugucucucagugaggccaaugugcagcgccuguacgcggccuccgacaugcuacagcuggaauaugugcgggaagccugugccuccuucuuagcccgacgucuugaccugaccaacugcaccgccauccucaaguuugcagacgccuucgaccaucacaagcuucgaucucaggcccaguccuacauagcucacaacuucaagcagcucagccgaauggguucaauucgggaggagacucuagcagaucuaacccuggcccagcugcuggcuguccuacgccuggauagucuggacauagagagugagcggacuguaugccauguagcugugcaguggcuggaggcugcugccaaagagcggggucccagugcugcagaagucuucaagugcgugcgcuggaugcacuucacugaagaagaucaggacuacuuagaagggcugcugaccaagcccaucgugaagaaguacugccuggacguuauugaaggggcccugcagaugcgcuauggugaccuguuguacaagucucuggugccagugccaaacagcagcagcagcaguagcagcagcaacucucuuguaucugcagcagaaaauccaccccagagacuggguaugugugccaaggagauggugaucuucuuuggacauccuagagaucccuuucucugcuaugacccuuacucgggggacauuuacacaaugccauccccuuugaccagcuuugcucacacuaagacugucaccuccucagcugucuguguguccccagaccaugacaucuaucuagcugcucagcccaggaaagaccucuggguguauaaaccagcucagaauaguuggcagcaacuugcagaucgcuugcugugucgugagggcauggauguggcauaucucaauggcuacaucuacauuuuggggggacgagacccuauuacuggaguuaaguugaaggaaguggaaugcuacaguguucagagaaaccagugggcauugguggcuccugucccucauuccuucuauuccuuugaacucauagugguucagaacuaucuuuaugcugucaacaguaagcgcaugcuuugcuaugauccuagccacaauauguggcugaacugugcuucucuuaaacguagugacuuucaggaagcaugugucuucaaugaugaaaucuauuguaucugugacaucccagucaugaaggucuacaacccagcuaggggagaauggaggcggauuaguaauauuccuuuggauucagagacccacaacuaccagauugucaaucaugaccaaaaguugcuucucaucacuucuacaaccccacaauggaaaaagaaccgagugacaguguaugaguaugauacuagggaagaucaguggauuaauauagguaccauguuaggccuuuugcaguuugacucuggcuuuauuugccuuugugcucguguuuauccuuccugccuugaaccuggucagaguuuuauuacugaggaagaugaugcacggagugagucuaguacugaaugggacuuagauggauucagugagcuggacucugagucaggaaguucaaguucuuuuucagaugaugaagucugggugcaaguagcaccucagcgaaaugcacaggaucagcaggguucuuuguaaauaguauuuugagacacuaagauguuucuacugcuacggaauguauuuuaaacacauaucguuucuuuuucuuggaaaaaaaguugauuaggaccacagauuugguuuagaaaggguaauauuuugaaauacuacaagguuuagacaguccaugaaaucgaccuguuuaauaauuuaccauccugaaaguccagaauuaaaauauggaagcaagaacuauauaauugauuaggaugcuugguagguuuuuuucauuguucaaauauucauugcacaguggauuguuuugauuaguuaguaugcuuuuuuuuuaauuaauucagucuucuguuaauuuuuaaguuuugguuagugccacaaggaauuuaacuuuuugauuuguauaauagaaaacugaacuaggaauuguuagcgggguuuugaaggauguguacuuuccuucaaaauaaagugguagauuuucaaaauuuuacacuagucaguucuuuauauucuaaguuaaauguaguuuguaaaauuauuuugguuuucuucuacaaaggaaaaaauuggauuuauauauauaagguuacugcauaaugauuucauuuugauaaugugcagaauggccucauaagcucacagaaaguaaaaaaaaaaaaaaaaaaaaagaaaaaaucaggauuccacuguuuuaaaagaaaucucaguuuuuauuuuggaauauaaaauguguauuugguauaugugaccaauuuucuaucccaaaaaacacccauucuuaguaaugucaugaauuaaacacccuucuaaaccaaaaaaaaaaaaaaaaacgguaacuugcuuuuuauguuuguguuuuuaauuuaugcccaauacaugcuuuacugacucagaggaacaauuccuggacauauaauuggguaaugcaaauuuuuauccacuggucaugauuugucuuaaaauguuuacuugccucccuaaaauauuuuggcuguguagguuugguguuuguccuagaggauucuucaacagaaagugauuuauucuuuacuguuuugugagguaauaugguuuagaacauauguauaagcuaaaaacaguauuuuacucagaucaguaguuaucgugucuaucagcuauaaaaaaaaucaacugccagccaagaacuuuaaaacuuuaagcuguguauuauagaaccguuuuguguagcauuggaauauuguccauuuuguaagucauugugaauguucuuaauuaucagcuugaagguauuuuuguauuaaaaguugacauugaagaaccuaaguggaugaugggauuuggggccaguagugaaaguauguuuccucuaaaauauuucccuaaacagugguauacaugguuauuuuauuaugagauuuguauauguucuguguuucucugugaacaauguuucagucucucugucaccauauguaaggggaaguccacaaauauagacuacauugcacaaaacuaaaauuguuaauuacaagaaaauauaggugcuuaccuuuugaagguuuauuaauacauaugguugucacaauacguauauaugauaaaugguguacauauacagauguuuaugguguauaaauuuuucuauacccaauuagaauuaucuuccugauucuuuauucaauaacaugcuaauuccucuucuauguucuauagugacagaaugcuaacuuuucuuauacccuggcagaggacagaggagucuggucuaggauggggaacugaauuuuugaacgaaaaggaaagagaaaggaugaaaaaacaaacaaacaaaaaaacacacgauaauguuucuuagucauuuugauuggccauuugaacagucuacaaguuuaacguuauuuccagugaaguaggauggcugaccuagcaauacauguuucuucaaaaggguaaacaugcuuuagugaccuaaagcuaaauuuuguacauuugacaucagggauguuauaaguacugcacuuaauacaaagcuauuucucaauuguguuauuuuugagacaaauuuuucuucaccauuaacuucuuguugguagcuuuuuguuuuguaaaaauugagagauggcaaugcuuaucucaaccagauuauccaucugcagaauuaagguaugcaacugguaaauaaaagacaaaugcuccaguuugucuuucucaaccuuugaguucuuaaccuuugaguuaaaaccuagucuaaauagugggaaugucuugguuuacaguaagguuuucuugggaaggaucuugguuuugugaucuauuugugaauuaaggaguagauguuaaccauuauuuuauagauaagugauuuguacaugguuaguuauaaauaaaacugguacuagaacccag

SEQ ID NO: 147 - RNA, 2682 nt, Homo Sapiens
gaggccgcgccgggagcgcgguggggcuaggcguggggcgcucccggcaugucccuguaccgcagcgucgugugguucgccaaggggcugcgcgaguacaccaagaguggcuaugaaucugcauguaaagacuuugucccucaugacuuggagguccagauuccuggaagagucuuuuuggucacuggaggaaacagcggcauuggcaaagcaacugcccuugaaaucgccaagcgagaacauuuuucugcacauuguggacuugucugaucccaagcaaaucuggaaauuuguugaaaauuucaagcaggaacauaaacuccauguucugaucaauaaugcagguugcauggucaauaaaagagagcucacagaagauggacuugaaaaaaacuuugcugccaauacucuggguguguacauucucacgaccggccugaucccugugcuggagaaagaacacgacccccgagugauaaccgucuccucaggaggaauguugguucagaaacugaacaccaaugaucuccaguccgaaagaacaccauuugauggaacuauggucuaugcacaaaacaagaggcagcaagugguucugacggagcggugggcccaagggcacccggccauccauuuuucuuccaugcauccuggcugggccgacaccccagacaggaaugagcaggagcugaggaagguagugggagaggcccagacugccucaccacuccccagguuuuuggaaauaaugaugcaugaagguaaaugccagccacaaggacacagcucgaaugaucuggaagcguguuggagcagcgguggaggggagcagaauucucuuccggauuggccucaccaacuccaugaccucaggcagcucaccugggcucucugcagcucuuuccuccucuacaaacaagggaacugaaagcagcagcagccacagcacacaccccagggugcacccgcggcgccaagaacuggucucagcgcugucugcggauuaacgcauuuguccucaagccucuguggaguggccacuacugucuauuaucacacccauuuacagaugagggaacugaggcccagagaggcuaagaccucccagccgggccuggccaugggguuuugggaaucaggcucucacacacugcuggcauggccuuucugaaaaucacuauuuaucagaagccuuggaauucauccuaagaaauaaagauagggaaaacaagguugcuuaucacagugcuggugguaggagaugaaguuaauaaauuauagaacaccugugcaaaaucuguucagggcugaagacucugcugccaaucaugccuauggaaaaacccugugugcacuauaucauuaaaugaagauaccaaguucgugugaggcaggcgaugccgggguuccacgccagguucggggaccgccugcgcuccgaggcccagggcgcggacaccaugcuguggcuggcccucuccucugccgcagccgcacagcccagcggccgcuucuuucaaggugacuuccucccuggcugugaaggcagcugacacagggcuaggggcagcagcugggccuucgaggcgcaccuuccccuccgugaaaccuggggugggacuguccccuggggggugccugggcuucuuuggcgagaugauugcuuugccugcugagguuaguuuugggaagcgcuucacuccagguugguagcuucuuuggagacuugugauaacccugucaucaagguccugugagaacgggagaggcaguuccuaccuugggaauggaagauuuucucugcaguuugcugaggcccaggaggggcgcuauucaaagcugcacugcaaagggaguaacggacucugcuucucugcagugcaaaggguguaagggacucugcuucucuauuuuuggaagcagugaucuguucacgucucuccccagugggcuccuaagggggcaggcgugugaguggacgccauccgaagacagcacuugaccucggguggaagccaggcucuuugcuuggcuucucuuuccucuguucuugaugagaaccacccuugcuugaggaauucugaagcgcuggugaccccugggguauccgggaggauggccgcaccccuuccugcugaucacccaaacguggucucccguccagcccuggcugcagccucccaguucccaaacugcacuuuacauaucaauccaugcugccugaucccugugggaccuuugacagcagggaugggggucuaacagcuguagggugcugccacuccagcaggcgucgguucaaggccugagcagcacagggacauggacccagccacgcugcagcagcucacaccucucugcgguucccucucacuuuuagaucggaagccaguuucuacacacuugccucucgcuacagcguccuccucaccggccgaagaggagaaacucauugaaauccuggaacagcuggcucagacauuuaaauaggccaacccagacacagugcgguaccagaauugccuuagaagauaccagaaggugcggucuagggaccagugaauaagaagaccccacuucaacuuccccucgaagacguugugccucacagcgaggccuacaagggaugggaacuuuuauuucaaaauaaauacuaccgaggcugugaucaggcucaccuug

SEQ ID NO: 148 - RNA, 2373 nt, Homo Sapiens
guuagagaagggggacacaaaugucuucaggcuuaggucccugggggcucccaguccugccccuguuccucuacucacaucccagcuccucccaguuucuuuucggaccuccuccucuccccuuccuucucuauuccaggcuggguugggcucuaagcaaggggagggauuagagccuccuuccucucugccccuccccaugggucucuagggggcuggugcaggcagcagcagaggcacucugggcagcugggugagggcccaucugggcaaggcccccagcgccugccuucucucccggggcccugugggcaagccuccugcuucacuuucagguuucucgaagugccuucuugcuccugucuguuuccccauccugccagauuucuguuucucuugcugggcuuuuggcaguagggggcuguguuggugggcccuacgaagaugcucagugcucgagaucgccgggaccggcacccugaggaggggguaguugcagagcuccagggcuucgcgguggacaaggccuuccucaccucccacaagggcauccugcuggaaaccgagcugguaacagcugccucccaaccuggugccuccaucucccugacccccggcuccuggccagccuuaugccagcccccagcucacccuucaguagccuccuuccccaagcccucuggacaccucuccugcccgcagcugccccuucuucgucuccuacucugccuucuugcugccucuccacccggagacauuuacagcagguuucaguugcagcaggaaggacugcaguuagacagggugacuuuuugggacauugaggaagcuugagacauagggaugggacaggggcaaugacagccucuaacauggccacuucucagcacguccaagaagucuaacuaucaaaaagggcagacuuccugcaacugcacuuuaucuguggucugcugcccagaaacaucucuucucaggaaaggaucuuccccugguuacuuagcaagaccacaguguagaguuaaggccucugcacguaugccacccuaggucaucagagcuaaaggggcucccagaaaccacugggcagcaucugccuucucucuuggcauggaaucaaaggcucugguccuugucagggggcuuucaggcaucuggggguggggaaagcauuaugaggcagggggcuccucuuggucccuguggagucgggucucugugggcacaacuccaggggcuggcauucacacuguaccuaugaauuacugugggauagugcuccugggagccauauggcuuggccagacugcugggguugcugggugagcagagugggaggccggagacugcccuugaccggcaaaugcccugcaacgguggcuccugacaccaggggauagggagaugugccagaguccuuccuccccuccaaggacagguaguaggugccagccuaggggagcuuccaaggaggggaaggcaaagcccuggccccugccuguguccccuucuuggcauguuccacaugcucgguccugcaggcccugacccucaucaucuucaucugcuucacggccuccaucucugccuacauggccgcggcgcuacuggaguucuucaucacacuugccuuccucuuccucuaugccacccaguacuaccagcgcuucgaccgaauuaacuggcccugucuggcugcagggccacgggcaaucaggaggaccacauccgcuagaucuacucucccacucagcaaagguccagccccagcccuggccuggcuugacccccccgggcuggcauacuccagccgcuguccccuggguuccagccccagcgccuggcuucugguccugguugcucugguucaucugcuuccacucccuggguagcagugacuuccugcgcugugucagugccaucaucaucuuccugguggucuccuuugcagcugugaccucccgggacggagcugccauugcugcuuuuguuuuuggcaucauccugguuuccaucuuugccuaugaugccuucaagaucuaccggacugagauggcacccggggccagccagggggaccagcagugacucuggggcuaccuggcuccuaggcccagccagccagagaggacaguggagcccagacacgucuccuugggauucacuagcccccagcccgccaaaccccaccccagcccuacacagcagucuggccugagacgucacuggggacuuaucuguggagccuggugcuccaggauguggcuucucaugaagcucuggccagaggaggggaacuuauugggggaggggggguggaggggaggaaucuggaccucuaagucauucccaaauuaaaauauucaaauucua

SEQ ID NO: 149 - RNA, 71 nt, Homo Sapiens
uagauugaagcguugauuaggguguuuagcuguuaacuaaguguuuauggguuuaaguccaauugaucuag

SEQ ID NO: 150 - RNA, 2154 nt, Homo Sapiens
cuuccagcuggugggaguugacgacguggugcugggcguugggacccuacuuuaucuaguucgggaaguuggguuguggggucauaccugucugucugcucccagcuuucuuggguuucuuccgacggcguggggccucgcuaaggaauucccggccccucagggccacggcuuuagcggugucuuuugcgaguucuucguaaguacaucuuaaagcugucaagaugguucuagcagaccuuggaagaaaaauaacaucagcauuacgcucguugagcaaugccaccauuaucaaugaagagguauugaaugcuaugcuaaaagaagucuguaccgcuuuguuggaagcagauguuaauauuaaacuagugaagcaacuaagagaaaauguuaagucugcuauugaucuugaagagauggcaucuggucuuaacaaaagaaaaaugauucagcaugcuguauuuaaagaacuugugaagcuuguagacccuggaguuaaggcauggacacccacuaaaggaaaacaaaaugugauuauguuuguuggauugcaagggagugguaaaacaacaacauguucaaagcuagcauauuauuaccagaggaaagguuggaagaccuguuuaauaugugcagacacauucagagcaggggcuuuugaccaacuaaaacagaaugcuaccaaagcaagaauuccauuuuauggaagcuauacagaaauggauccugucaucauugcuucugaaggaguagagaaauuuaaaaaugaaaauuuugaaauuauuauuguugauacaaguggccgccacaaacaagaagacucuuuguuugaagaaaugcuucaaguugcuaaugcuauacaaccugauaacauuguuuaugugauggaugccuccauugggcaggcuugugaagcccaggcuaaggcuuuuaaagauaaaguagauguagccucaguaauagugacaaaacuugauggccaugcaaaaggagguggugcacucagugcagucgcugccacaaaaaguccgauuauuuucauugguacaggggaacauauagaugacuuugaaccuuucaaaacacagccuuuuauuagcaaacuucuugguaugggcgacauugaaggacugauagauaaagucaacgaguugaaguuggaugacaaugaagcacuuauagagaaguugaaacauggucaguuuacguugcgagacauguaugagcaauuucaaaauaucaugaaaaugggccccuucagucagaucuuggggaugaucccugguuuugggacagauuuuaugagcaaaggaaaugaacaggagucaauggcaaggcuaaagaaauuaaugacaauaauggauaguaugaaugaucaagaacuagacaguacggauggugccaaaguuuuuaguaaacaaccaggaagaauccaaagaguagcaagaggaucggguguaucaacaagagauguucaagaacuuuugacacaauauaccaaguuugcacagaugguaaaaaagaugggagguaucaaaggacuuuucaaagguggcgacaugucuaagaaugugagccagucacagauggcaaaauugaaccaacaaauggccaaaaugauggauccuaggguucuucaucacaugggugguauggcaggacuucagucaaugaugaggcaguuucaacagggugcugcuggcaacaugaaaggcaugaugggauucaauaauauguaaagaaaaugccuuaauauaaacugacucaguugaauaccuaauuugcugagaccucagcguuucccuucuuuuugcgaauuggggggaaaguguauuuuucuugcuuaucaugcacucuuuccuuuucuucucgcccgcuuuuccccuccuuuucuuuuuccuuccuucuuuccucccuuuaauauaagggagaaauacaugguuuuuguggaaaucauuauauguuugcuuuagauuuucuucuguuuucaccaucauaacacuuaaguuaaaucaugauguaaaauuuuaguacuuaaagguuuuuaauuaucucgaaggccaagcauugcauuuguaaacaguccuggucaguaguuaaauaauguuucaauuaaagugcuguaaaauaaacuucaaagugguuauaaguuaa

SEQ ID NO: 151 - RNA, 2965 nt, Homo Sapiens
cucagagacuuggcuaggcgcggcgcgaggcgggcgcugggcgggugagucccacuucccgacagccuggcucggccagcgacugggcggggagaccaaggauggaagugggcuuaccggccauuacccucuuucucaccagcgccagcagcccugugguggcgacgacgauggaccaggagccagugggcgguguggaacgaggagaagccgucgcagccucgggagcugcggccgccgcggcauucggggaaucugcagggcagaugaguaacgaaagaggcuuugaaaauguagaacugggagucauaggaaaaaagaagaaagucccaaggagagucauccacuuuguuaguggugaaacaauggaagaauauagcacagaugaagacgaaguugauggccuggagaagaaagauguuuugccuacuguugauccgacaaaacuuaccuggggucccuacuuaugguuuuacaugcuucgggcugcuacaucaacucucucagugugugacuuccuuggagagaagauugcaucuguuuuggguaucagcaccccaaaguaccaauaugccauugaugaauauuaucggaugaagaaggaggaagaagaagaagaagaagaaaacaggaugucugaagaagcagaaaaacaauaucaacagaauaaauugcagacugauuccauuguucagacagaucaaccagagacagugauauccagcucauuugugaaugucaauuuugaaauggagggagacagugaaguaauuauggaaagcaagcaaaauccagucucugucccaccauaaaaugaaaugacuaucaagcuucaaacucuuaaguuuuuuuuuuuuaauacaaaaacuuucacauucuuuauucagugggacuuaauacaauuauuuauauuuuaaauuauuaaaguaucuggaaagggaaaauguuuucuucauuuuuaggaucuaucuagcaaaagccagaucugaaauucagauauuuguacuguuuuuacuguguauagaaauuagugcuuugguuuuaaaaugaucuuuuaaaaaaguuaaggacauccuagagccuuaauaguuaagaagaguuaaauuaucaagccuauuugugcauuugcuuuuuuugaaaaagguaaguugcugauuaagucuaauuggaauugauaauuccauagucuuagauuaaaaugaggauauuuucuccuagauuuucucauguuaugccaugcauuuauauaucuaaccauuaauuucacacuaaggaugcuucaccauauaauaaaaggagcaagauggaagcacuuugaauuuucuuucauugagaauaacuguuuuauguaagaaucuguauuuauaacaccagauauuaagauaggcuuccauuuuuuaaugcaagccacuuacuuaaucuuguauucuuuuucaggacucaaauaacuagcuuugaacauaauauuaaaacacuacuuauagaauagauuuauuaauguuaauaccuagugaauauccauguggcauccugguuauguuaucgguucagcguuaauccuauagaaaagugguuuggaggggauugggggauagugggacagguauagauuuaauccaucaggagcaauuagauauuguauaaggugcaaugauagccuaaugaaauuacccgucauucaucauuuagaaguagcaacagugaagacuggacaguuuacuugaaucugguuggccacuccucuaccuacuugguuauuuguaaaccuuacaaauguauauauugugaagcuaauuuugaaaauauuccuaaauauggccagguacggugcucacaccuguaaucccagcacuuugggaggcugaagugggcagauuacuugaggucaggaguuugagaccagccuggccaacguagugaaaccccgucucuacaaaaauacaaaaauuagccaggcgugguggugcacgucuguaaucccagcugcucgggaggcugaggcaggagaaucacuugaaccagggagguggagguugcagugagccaagauugcaccacugcacuccagccugggcgacagagugagacuccaucuuggggggaaaaaaguauauauauauacacacacacagacacacacacacacacauauaucucuaaauguguguauagaaccuuuuaucaguauaacauugauuuauaauuaaaugugggugaggaagaauguguggaguguuucagaaauuuugaucuuaaaagccuuuucagaaacucaaagcuuucagaaauuaauaguuauauuaauagccuucuaaacagcauuaaguuuucaauuuuaauauaucuauauaaaauauagugucaaagaaaguaacaucaauauagugggucuguaauggaaaucugucaaugaacaugaacugaguucuucaacuacagguugaaggauaauuaaacuuuucauuaggaguguucagcuacauggauucauggaauggugguucauaguaagugaugguaaucuuuuuauucauggguguaaacccuuuauaacuuagugcuuaaaauauuaaucuuuugauuauauaaugucccaugaauuauaguuuaccaauaguucuaaaacaugcuaaccugaccuuuuccuucuaauuuguuuuuaacuucauucgagauaguaccucucacucacagauauuuauuugguuaucaagugaagauaggugugucuaaaagugaucuucugaauccugucucccuagagguacuaguaucuagaguuuacccagaaaauuuuaugauuguaacaaaaggaaguagugacuuaugaagguuuuguuucuugaauuuuacuuuugcuacuuguccaauaguggcuaguuuauguuuaucaauauaguuauucacugugccuuaaguuuauacuuuguuuaugcaaacuauaaaauuucccauaaauguauuc

SEQ ID NO: 152 - RNA, 64 nt, Homo Sapiens
cugugaugauggcauuucuuaggacaauuuuggauuaauuaugaaaacaacuacucucugagca

SEQ ID NO: 153 - RNA, 2275 nt, Homo Sapiens
ccgccgagcucgcuguggcccggauguucggugcagcugccagauccgcugaucuagugcuucucgaaaaaaaccuucaggcggcccauggauuuauagcgcccgucacaaagggcaggaccgcugcaaaaaaauggaaucuuaaaacuuuagccaucguucgcuaaaggaaaugaaaggagaaauucaacagucgcuuggagccuggguuuugcuuagcugucgauauucaaccagcaugccuuggacuuuauugugggaagacccuauuauuuaaaaauggcucaacugaaauauauggagaaugugggcucugucucaaaaaaaaaauaaaauaaggaaauauaaaagaauauggaggcauuaauauagucauuguucauguuggcauuuugaugucuauauuauuuuuuaaaacauuuaauaauuuuauaauaauuucuaauuuaugauuugguaccgugucuuguacaguaaguugaacaucaugaauccagaacauuuaucugcaguuauucuuauauaauguuaauaacuagguuuuucauugaauguuagucaacuauuuuaguaacuuaguaaaaggaaucuucuaagagcauuguacaaauauagcacauacaauauagauuucuuuuuauuuuacuuaugcccucuuuuuuauuucuaaaagcugcacauguaaacuuaaauauuuaaacugaaaugggaugucuuauagaaugauuuggggggguguuaauguuguaaaauaauaucuguacacaaaauauugguuuuauauauuauagguaugcccaagaggacagagaacgaaugcacagaaauauugucagccuugcacagaaucuccugaacuuuaugauuggcucuaucuuggauuuauggcaaugcuuccucugguuuuacauugguucuucauugaaugguacucggggaaaaagaguuccagcgcacuuuuccaacacaucacugcauuauuugaaugcagcauggcagcuauuaucaccuuacuugugagugauccaguugguguucuuuauauucguucaugucgaguauugaugcuuucugacugguacacgaugcuuuacaacccaaguccagauuacguuaccacaguacacuguacucaugaagccgucuacccacuauauaccauuguauuuaucuauuacgcauucugcuugguauuaaugaugcugcuccgaccucuucuggugaagaagauugcauguggguuagggaaaucugaucgauuuaaaaguauuuaugcugcacuuuacuucuucccaauuuuaaccgugcuucaggcaguugguggaggccuuuuauauuacgccuucccauacauuauauuaguguuaucuuugguuacucuggcuguguacaugucugcuucugaaauagagaacugcuaugaucuucuggucagaaagaaaagacuuauuguucucuucagccacugguuacuucaugccuauggaauaaucuccauuuccagaguggauaaacuugagcaagauuugccccuuuuggcuuugguaccuacaccagcccuuuuuuacuuguucacugcaaaauuuaccgaaccuucaaggauacucucagaaggagccaauggacacugaguguagacaugugaaaugccaaaaaccugagaagugcuccuaauaaaaaaguaaaucaaucuuaacaguguaugagaacuauucuaucauauaugggaacaagauugucaguauaucuuaauguuuggguuugucuuuguuuuguuuaugguuagacuuacagacuuggaaaaugcaaaacucuguaauacucuguuacacaggguaauauuaucugcuacacuggaaggccgcuaggaagcccuugcuucucucaacaguucagcuguucuuuagggcaaaaucauguuucuguguaccuagcaauguguucccauuuuauuaagaaaagcuuuaacacguguaaucugcaguccuuaacaguggcguaauuguacuuaccuguuguguuucaguuuguuuuucaccuauaaugaauuguaaaaacaaacauacuuguggggucugauagcaaacauagaaaugauguauauuguuuuuuguuaucuauuuauuuucaucaauacaguauuuugauguauugcaaaaauagauaauaauuuauauaacagguuuucuguuuauagauugguucaagauuuguuuggauuauuguuccuguaaagaaaacaauaauaaaaagcuuaccuacauaaaauuucaau

SEQ ID NO: 154 - RNA, 3744 nt, Homo Sapiens
aauguauuaugauguaggggagggaggaaggagggccaggguagggggcacacccucucccugaaugaaauucauuuaggggcacugucugcucgcauguucuguucugggagaaaauggguagcagaagcuacaauuuguacuaagcuaaugaaaagagagaaaagaagaauggggaagagaagggcaaagaaggcaaaaagagaagagaagaaaaagggaggagagagaaggagaaaugagaaaagaggaaaccaaaugaagaggaugugugagagaaaaaaauaugaaacaggugguuggggagggggggguggggggacucuagacagcugaggcgcgaaagcgaugaguccucggcucuuccuccuccuucuccgggacccgcucucugccucccucuccaacgcccggaugaucugagccgcgagggcgccgacagccgggggcccggacgcagcccggcuccuccccuccuccgccccuuccccagccugaccuggcccgccgcugcagcggugaccccucccccggcugccgccgucgccgccgcggugacccccuccccggcugccgccgccgccgccucggccgaccagggaccugcccgccugcggcugcuccggauuuuaaauaaacuuggagccuuuucuugaaagacagcuggcuguggagagccuucuaccaacugcaguuuuagauacguuuugaaaauuucaucaccugagaccuagaggaucaagacauaaugggagcauuuuuagacaagccaaagauggaaaagcauaaugcccaggggcaggguaauggguugcgauaugggcuaagcagcaugcaaggcuggcguguugaaauggaggaugcacauacggcugugaucgguuugccaaguggacuugaaucguggucauucuuugcuguguaugaugggcaugcugguucucagguugccaaauacugcugugagcauuuguuagaucacaucaccaauaaccaggauuuuaaagggucugcaggagcaccuucuguggaaaauguaaagaauggaaucagaacagguuuucuggagauugaugaacacaugagaguuaugucagagaagaaacauggugcagauagaagugggucaacagcuguaggugucuuaauuucuccccaacauacuuauuucauuaacuguggagacucaagagguuuacuuuguaggaacaggaaaguucauuucuucacacaagaucacaaaccaaguaauccgcuggagaaagaacgaauucagaaugcagguggcucuguaaugauucagcgugugaauggcucucuggcuguaucgagggcccuuggggauuuugauuacaaauguguccauggaaaagguccuacugagcagcuugucucaccagagccugaaguccaugauauugaaagaucugaagaagaugaucaguucauuauccuugcaugugaugguaucugggauguuaugggaaaugaagagcucugugauuuuguaagauccagacuugaagucacugaugaccuugagaaaguuugcaaugaaguagucgacaccuguuuguauaagggaagucgagacaacaugagugugauuuugaucuguuuuccaaaugcacccaaaguaucgccagaagcagugaagaaggaggcagaguuggacaaguaccuggaaugcagaguagaagguggaucauuuaacaaaaaauaaguagcuuuauuaaagaaaaaucuucaacacaaucaaacuuuaacauuuuagcuuuuagauuuuuaugugucuuugacagcuagugucuaguguaugaaaguggaaaaggacauuucuguaguagcuguuaagauguaugcaguuguccuaucacaguuauauuagaaauaacaacuaguguggaaaguaacccacauucuguucaggauacuuuuguuuuaaaaggcuaaaauguuugugugcuuuaaaauucuuaaugaauucacuggcaugaguaauuuuaugccgggaaaaucugauuuguggucuauuuaauuacaaagagauugugauggugauaauuugaauaccaucuuucuaugaaaagcuguguauauuaauuuuaaucucuagggccuuuuuucaauaacuugaaaaucacagccucaucauuagcaacuuuauauacacagcuuuaaaaaauuugcuuuaaacuguuucagagcuucuucccuaagccauaaacugucucaccuaaacaagauagaccucaauaaaagacauaauauuucuccaccuggcagaaaaguaacugccaaguaagauuaagaaauaaguugagcauuucuggaguauauuucucauaauucugcagagacuuccaguuuauugcauauaugcaguaaaguguauauauuaugcaguuucucuaaguggaaaaacuugacaugacuuuaauaguguuaaaacaugaaaaugcuggugagcugagguagaaaaaaaacaagaaaaaaauuuuaaaaauagcguuaaaaugcauuuuaggcuccuaaugucguuaauuugcacguuaaagaccucuaaucgcaugcaagcauugaccuaccacaccuacaucccacugugccugcauuauugaaauuacuacucacuuuaauuuuuuuuccccuuuuuacuguuugauaccuuuagaaaucauaaagaagcagggggaaggcguccccgacuuaguccaugugaugcgcacauuagcgagugagaacauccccagccucccaccagggggugaauuggcaagcaagaggaauguuauugaagccguuuacaauagacugaauccuuacaaaaaugacgacacugacucuacaucaacagaugauaugugguaaaacugcucaucuagccauggaguuuaccuucaccuccaaaggagaguacagcucaacuuuguugaaacuuuuaacauccauccucaacuuuaaggaaggggauaugacaugggugagaaugauuacaucagagaacuucagcaguacaacagcuagcccagaacugauuuuuuuuuuuuuuuuuguaaauuugagacuuauguaagcgugauuucaaaccauaauucguguuguaaaucagacuccagcaauuuuuguuguaugauuuuguuuuuuuguaaaguguaauuguccuuguacaaaaugcucauauuuaauuaugaacugcuuuaaaucacuaucaaaguuacaagaaauguuuggcuuauugugugaugcaacagauauauagcccuuucaagucauguuguguuuggacuugggguuggaacagggagagcagcagccaugucagcuacacgcucaaaugugcagaugauuauggaaaauaaccucaaaaucuuacaaagcugaacauccaaggaguuauugaaaacuaucuuaaauguucuugguaggggaguuggcauuguugauaaagccagucccuucauuuaacugucuuucaggauguuccuucguuguuuccaugaguauugcagguaauaauacaguguauucauaagaaucucaaucuuggggcuaaaugccuuguuucuuugcaccucuuuucaaguccuuacauuuaauuacuaauugauaagcagcagcuuccuacauauaguaggaaacugccacauuuuugcuaucaugauuggcugggccugcugcuguuccuaguaagauauucugaauuccauuuuaucaauaaagcuugauuuaacaaacaagaaa

SEQ ID NO: 155 - RNA, 3393 nt, Homo Sapiens
ggcgcaugcggcaaccguaucucaguucucgcgagguuucgucuucccggaagcguuggaggacauucccuguugacugcgucgcgauguguggcgacuguguggagaaggaauaucccaaccgggguaauaccugccuggagaauggaucuuucuuacugaacuuuacaggcugugcagugugcaguaagcgggauuuuaugcugaucacaaacaaauccuugaaagaagaagauggagaagaaauaguuaccuaugauccagauuuguguaagaauugucaucauguaauagccagacaugaguauacauucaguaucauggaugaauuucaggaguauaccaugcugugucuguuaugcggcaaagccgaagauacuaucaguauucucccugaugacccccgacaaaugacucucuuauucuaaggauccuucuacagaucuguuauaacuauauuguguugguuuacaauacagcaagccugaugguuugucuuauuucauucauacugaaaauucuuugcauauuuuuuuucugcuuagacuuacuuauucuuugaggaaaaaagguaauguaggagcucauuguucucuagagcugagcucuucugcuaaaguucaaaguucacaucaguguagccagagugaagcaucuuuguuagcaguuauguggucagaaaacaacuagaaugggagcacaccuggugcccagauuuugguuuccaauaaaaggaaccaggacuccuuagaaaaugaacugauucuagaacugggauaugaacuguacaagaugagccuagaguaucuugugccacagaaaaaugaaguacugaaauuaaaaaaaaaaaaucauagugauugggaguaugucagcaugaucgaacugaaggaucucugaaaggccacagcuggagcaauuugaguaacaaaauaaaguaguauuggguuauaacccaaacuauauaauaaauauuuacaagcccaaacuaauauaaaugauugaaugggaacaaaucucuugugcagaagaauuucaaauaauuuauguagauacuccccacuuagugggcucugcauagugacuuccuugcagaguauaauauggaaaggggggaaaagaguaacuuuacaguggagaaaucugacagacaccagcucagccaggugauugagguuaacaucauccaugauaagcccuuuugauagcauguauccuugauagcaucacaucauacagaaugugauaagaauggcacuuuaccucugugguccuccuccccagaacucagaacccaagucugaucaggagaaaaacaucacacaaauuccaauugagaagcauucuuuaaaauaccuaaccaguacuucucaaaacuaucaaggccauaaaaaacaaggaaaaucugagacauggucacagccaagaggagccugagaagacaugacugcuagauguaaugugguauccuacauggaauuauauaccacgaaaagaaaaaaaggucauuugguagaaacuagggaaaucugaauacaguguggacuucaguuaauauaaaugagaaaaugguuucauuggcuuuaaagggauuuuagaauaucuuacuuugcauaguuucaugagcacuggccaggagguuauaaacuggcauuuaggccucucugccauuuaguagcaguauagucauuaagcaaagcauuacucuggacuuuauuguccuguuucuaucaaauuggacuaacaaaaauugauauaauacauucaucacaguauuguuaggagauuuaaaugaauuagugaauguaagauacuuuagaaagcauguaaaguacuagaaacaaugagguggcuucaauuagugcucauucugagaccuaaauuuaaagggucaggcauuagaaacaaaaguguuucuucauaucuaggagauuuggaaauucugaacuaaggucuuauaagaacaagaaaugagcaaaguguucauuguagauacuagggaaaagcuuuguugaauaacaguaaugaugauaauaucugagcuuuauuaaguacuuacuacaugcuaagagcuuuuuaagcacuuauuuaauccucauuaacaaauucauaagguaggugcuauugauaguuuagccauaaccagauauggcuuguuauuuguaaguuaucaugaaaagguuuauauucacuauucuuuauuucaguguagcacuuuuagagccaaaaaaacucaggcacaaagaaguuaaauaacuugccgggugcgguggcucaccccuguaaucccagcacuuugggaggccaaagcaggcggaucaccugaggucaggaguuugagaccagccgggccaacauggugcaaccucgucuuuacuaaaaauacaaaaacaaaaauuagccagggguggugguaugcaccugcagucccagcaacaugggaggcugaacaggagaaucgcuugaacccgcgacagggagguugugaugagccaaggucaugccacugcacuccagccugggagacagagcaagacuccaucucaaaaacaaaaacaaaacaaaacaacaacaaaaaaagaaguuaaauaacuuguuuaagaucacacagcuagugcaguuacccccucucaguaauuauguuuggcaaauaugaaauacaaggaucuggcaagguuaggaagagguuaagaauaucagugacaguacucugaggcaucugggcaugucagaugaagauuuauuauucagaaaaguuaagucagcuguugcagggaucaguuguuuuauuccuggaaaauguuuuucauuuugcugcaaaucuauaucugaccugcugaggaaaucguuuggugaaaugaauccagaaagcagagaaaaugcuucauuacuuuaaauagcagcauuaagcccauuauagccucugaauugucccuuccuugaguuugcuaaugcuuccaacuuagucauuugaagcccaagagucuaauuuuauaugcccugccaauguccucaucuauugcagaauguauaauuaucuauuuguuuuggacuauauguuacaaaaauuuaaaacauaagauccucucucuauauuucauuauuggugaacccacauugugcuguguuuugugauauuuuaucauuuucuagauucuuauguggaucuaauaacgaccacuugaacccaguuucacagaauccuuauuuuucuguucaaauuaggaauuagggacauggaugaaauuggaaaucuucauucucaguaaacuaucgcaaggacaaaaaaccaaacaccacauguucucacucauagauaggaauugaacaaugagaacacauggagacaggaaggggaacaucacacucuagggacuguuguggggugagggg

SEQ ID NO: 156 - RNA, 1981 nt, Homo Sapiens
cacggggcgggcggacgcuggcgcggguagguaagagcagcggcgggcgguggcgcucacucccggcuuccaaccgcgcggagccucugccuuggagauucucagugcugcggaucaugucccuaaggggcagccucucgcgucuccuccagacgcgagugcauuccauccugaagaaauccguccacuccguggcugugauaggagccccguucucacaagggcagaaaagaaaaggaguggagcauggucccgcugccauaagagaagcuggcuugaugaaaaggcucuccaguuugggcugccaccuaaaagacuuuggagauuugaguuuuacuccaguccccaaagaugaucucuacaacaaccugauagugaauccacgcucagugggucuugccaaccaggaacuggcugaggugguuagcagagcugugucagauggcuacagcugugucacacugggaggagaccacagccuggcaaucgguaccauuaguggccaugcccgacacugcccagaccuuuguguugucuggguugaugcccaugcugacaucaacacaccccuuaccacuucaucaggaaaucuccauggacagccaguuucauuucuccucagagaacuacaggauaagguaccacaacucccaggauuuuccuggaucaaaccuuguaucucuucugcaaguauuguguauauuggucugagagacguggacccuccugaacauuuuauuuuaaagaacuaugauauccaguauuuuuccaugagagauauugaucgacuugguauccagaaggucauggaacgaacauuugaucugcugauuggcaagagacaaagaccaauccauuugaguuuugauauugaugcauuugacccuacacuggcuccagccacaggaacuccuguugucgggggacuaaccuaucgagaaggcauguauauugcugaggaaauacacaauacaggguugcuaucagcacuggaucuuguugaagucaauccucaguuggccaccucagaggaagaggcgaagacuacagcuaaccuggcaguagaugugauugcuucaagcuuuggucagacaagagaaggagggcauauugucuaugaccaacuuccuacucccaguucaccagaugaaucagaaaaucaagcacgugugagaauuuaggagacacugugcacugacauguuucacaacaggcauuccagaauuaugaggcauugaggggauagaugaauacuaaaugguugucugggucaauacugccuuaaugagaacauuuacacauucucacaauuguaaaguuuccccucuauuuuggugaccaauacuacuguaaauguauuugguuuuuugcaguucacaggguauuaauaugcuacaguacuauguaaauuuaaagaagucauaaacagcauuuauuaccuugguauaucauacuggucuuguugcuguuguuccuucacauuuaagugguuuuucaucuuuccucccuccucccacagccuggcuauacagugcauccuugaacugucagcccacagcagcaauaugcuuauucuauccacaucccuaacaucaugcauucacaaggucaaaguucugguccacaaacccuucccuauagaaguucaauggcugcgaaagaauuuguaguaaaccaggccucccaggauggcgagcuccaguaagaugauaauggaaagcagcagcuuguugguugucacucuacaaagagaagcaaaguggggaguagucagaaguuuggauaaccuuccuucuaaacauuuugggguuagaccugggaccacggcuggauacucugaggcuguauguuugaucacacagccacuuagcaggaaguacucauaagguucuuuagcugucacuuagggauaacacugucuaccucacagaaauguuaaacugagacaauaaaaaccaaagcauaaaaauggauucugaaa

SEQ ID NO: 157 - RNA, 4200 nt, Homo Sapiens
ccgggucaaggcccggucgagugcaguaccaugggcagcaccggguauagggcagagacagcuuugugucaacuuugcugcugaaccccuaggacccaucguuagagaccugcaggacuccuuuccucaucccaggcucggaggagaguuugcugggacuggugggcugguuuccugcucuggggggcggaucaccuucggggccgccucuuggagacaggggcgccuagggaacgaacagguucgcuugagucacuuacccgccgccgccuaagacauugugccacccucaauccgacaaucgaagaaaucgaucauucgcacauuuuccccauugacuuuucccaucucuguuaacccacgagaaucuaaugacuggcaucugagaacccagagccugggaccuuagauugcuguaagcuuucucuggugcuaauaucagcaaaaagggucuguugccggguacguucaagaggaaggugccucgugaacacaucugcuggugggaaggccuaaagaacuggaaagcccacucucuuggaaccaccacaccuguuuaaagaaccuaagcaccauuuaaagccacuggaaauuuguugucuagugguugugggugaauaaaggagggcagaauggaugauuucaucuccauuagccugcugucucuggcuauguuggugggauguuacguggccggaaucauucccuuggcuguuaauuucucagaggaacgacugaagcuggugacuguuuugggugcuggccuucucuguggaacugcucuggcagucaucgugccugaaggaguacaugcccuuuaugaagauauucuugagggaaaacaccaccaagcaagugaaacacauaaugugauugcaucagacaaagcagcagaaaaaucaguuguccaugaacaugagcacagccacgaccacacacagcugcaugccuauauugguguuucccucguucugggcuucguuuucauguugcugguggaccagauugguaacucccaugugcauucuacugacgauccagaagcagcaaggucuagcaauuccaaaaucaccaccacgcugggucugguuguccaugcugcagcugaugguguugcuuugggagcagcagcaucuacuucacagaccaguguccaguuaauuguguuuguggcaaucaugcuacauaaggcaccagcugcuuuuggacugguuuccuucuugaugcaugcuggcuuagagcggaaucgaaucagaaagcacuugcuggucuuugcauuggcagcaccaguuauguccauggugacauacuuaggacugaguaagagcaguaaagaagcccuuucagaggugaacgccacgggaguggccaugcuuuucucugccgggacauuucuuuauguugccacaguacauguccucccugaggugggcggaauagggcacagccacaagcccgaugccacgggagggagaggccucagccgccuggaaguggcagcccugguucuggguugccucaucccucucauccugucaguaggacaccagcauuaaauguucaagguccagccuugguccagggccguuugccauccagugagaacagccggcacgugacagcuacucacuuccucagucucuugucucaccuugcgcaucucuacauguauuccuagaguccagaggggaggugagguuaaaaccugaguaauggaaaagcuuuuagaguagaaacacauuuacguugcaguuagcuauagacaucccauuguguuaucuuuuaaaaggcccuugacauuuugcguuuuaauauuucucuuaacccuauucucagggaagauggaauuuaguuuuaaggaaaagaggagaacuucauacucacaaugaaauagugauuaugaaaauacaguguucuguaauuaagcuaugucucuuucuucuuaguuuagaggcucugcuacuuuauccauugauuuuuaacaugguucccaccauguaagacuggugcuuuagcaucuaugccacaugcguugauggaaggucauagcacccacucacuuagaugcuaaaggugauucuaguuaaucugggauuagggucaggaaaaugauagcaagacacauugaaagcucucuuuauacucaaaagagauauccauugaaaagggaugucuagagggauuuaaacagcuccuuuggcacgugccucucugaauccagccugccauuccaucaaauggagcaggagaggugggaggagcuucuaaagaggugacugguauuuuguagcauuccuugucaaguucuccuuugcagaauaccugucuccacauuccuagagaggagccaaguucuaguaguuucaguucuaggcuuuccuucaagaacagucagaucacaaagugucuuuggaaauuaagggauauuaaauuuuaagugauuuuuggaugguuauugauaucuuuguaguagcuuuuuuuaaaagacuaccaaaauguaugguuguccuuuuuuuuuguuuuuuuuuuuuuuaauuauuucucuuagcagaucagcaaucccucuagggaccuaaauacuaggucagcuuuggcgacacugugucuucucacauaaccaccuguagcaagauggaucauaaaugagaaguguuugccuauugauuuaaagcuuauuggaaucaugucucuugucucuucgucuuuucuuugcuuuucuucuaacuuuucccucuagccucuccucgccacaauuugcugcuuacugcugguguuaauauuugugugggaugaauucuuaucaggacaaccacuucucgaacuguaauaaugaagauaauaauaucuuuauucuuuaucccccuucaaagaaauuaccuuugugucaaaugccgcuuuguugagcccuuaaaauaccaccuccucauguguaaauugacacaaucacuaaucugguaauuuaaacaauugagauagcaaaaguguuuaacagacuaggauaauuuuuuuuucauauuugccaaaauuuuuguaaacccugucuugucaaauaaguguauaauauuguauuauuaauuuauuuuuacuuucuauaccauuucaaaacacauuacacuaagggggaaccaagacuaguuucuucagggcaguggacguaguaguuuguaaaaacguuuucuaugacgcauaagcuagcaugccuaugauuuauuuccuucaugaauuugucacuggaucagcagcuguggaaauaaagcuugugagcccucugcuggccacagugaggaaaguagcacaaauaggauacaguuguauguagucauuggcaacaauugcauacaauuuuacuaccaagagaagguauaguauggaaaguccaaaugacuuccuugauuggauguuaacagcugacuggugugagacuugagguuucaucuaguccuucaaaacuauaugguugccuagauucucucuggaaacugacuuugucaaauaaauagcagauuguagugucgauuagaacuaagaggacacaccagcaucggaguguauuaagccccugaaacacaugguagcuagggacugaacacaggaaccguaugacagcagcacaaacccccaaaggauguuccugccuugugggccccugagccccuugggagacugagaaucaugaccagauucauccagaacugcugcaguguuaagugaaaauccucuguaguuguucugcagaggaaccuuccuuccauuagaaaauuucugcucaauacagaaugguccacaucacccaaagugcacuguuggagaugcugugaaauuaaaaccucuuuguaccugagacaucuagauucaccucaggaggccugaaggaaauguguaacuugugggaaagaacuagacaaccauuuaggaauucucuagauauacucagccuaacccaguggcuuaacacaaggagauuggcuuugaucuuuuuuucuuguggcaucuuccagcaaguuagaagucucaugggauaagacugcaguuccccugguucaauagcuggaacagugauuuuaaaugucccuuuuucuggaucccuuguaaacaugaaaucauuccauggauggcugccuuauaauuuugucucuuuccacuuuaauugugaaugguuaaaaaaaugcuguuuucugauauuaaauuuuuauuagugca

SEQ ID NO: 158 - RNA, 3693 nt, Homo Sapiens
aagcgccacccggaggcggaaaucagcccgcguccggcgcaggcgggagaagggagaggagugacauccguuugucggaagucgcuccucccccuuccuucgcuuuuuuuccuugucauugguuccuggcacucgggccccaccuccuccggcuacgccccucacggccgcuuuucccgccuccgccggggccgagccgcuguucggcugacaguugaggauggccggagccgagggcgccgcugggcggcagucggagcuggagcccgugguaucguuggucgacguccuugaggaggacgaggagcuggagaaugaggcgugcgcuguccugggcggcagcgacuccgagaagugcuccuacucucagggcucaguaaagagacaagcacuauaugccuguaguaccugcaccccagagggagaagaaccagcaggaauuuguuuagcuugcaguuaugaaugucauggaagucacaaacuauuugagcuauacacaaaaagaaauuuucguugugauuguggaaacagcaaguuuaaaaauuuggaaugcaaauuacuuccugacaaagcaaagguaaauucuggcaauaaguacaaugacaacuuuuuuggauuguacugcauuugcaagagaccuuauccugauccugaagacgagauuccagaugagaugauccagugcguagucugugaagacugguuccauggaaggcaucuuggugccauucccccugagaguggggauuuucaggagaugguaugccaggccugcaugaaacguuguucuuuuuugugggcuuaugcugcacaauuggcaguaaccaaaauauccacugaggaugauggauuggugcggaacauugauggaauaggugaucaggaaguuaucaaaccugaaaauggagagcaucaagauaguacccucaaagaggauguuccagaacagggaaaggaugauguccgggagguuaaaguagagcagaacagugaaccaugugccggcucuaguucugaaucugaucuccagacaguguuuaagaaugaaagccucaacgcagaaucaaaaucuggcugcaaacuucaggagcuuaaagcuaagcagcuuauaaagaaagacacugccaccuauuggccccugaacuggcguagcaaguuguguaccugccaagacuguaugaaaauguauggagaucuagaugucuuauuccugacagaugaauacgacacaguucuggcuuaugaaaacaaagggaagauugcccaggccacugacaggagcgauccccuaauggauacccuuagcagcaugaauagaguccagcaaguggaacucauuugugaauacaaugauuugaagacugaacuuaaagacuaucucaagagauuugcugaugaaggcacgguuguuaagagagaggacauucagcaguucuuugaagaguuucagucaaaaaagagaagaagaguggaugggaugcaguauuacugcagcuagaguggaguaugaagcuuucucauucaagccaaugaaaaugcgcuucccauucuuggaauaaaagaggugugguucacauuuggcccccuuuccguccuccucuguuuggagaggccucgcgcucccuucauucucuuuagcugcaguagccaccguguggaugcugacuucacagccagcguccucugugacucagcugaugcagcucauuccacagacuucuccaguguacuccuacuccagugcacccaggguuauuugcauaguuuuuaaguuugauuuuguuuugagaaagcaaauuggugucuuguuuaaugaucuguuauuucacucccagauguguguguuuugccacagagcuguugccuuccagaaccuccuccgcaggcaucacggaaggcucucuucccgucaccuagaaccucuacagguccccucgccccuaugaucguggugccuugggucaaagcuuccucaagccuggucugcuccuucuuucacgucccuguuuucugagguuuggucauagcuuagaaaggaucuuggggcuuguuuucucuaggcccaaccuccagaguagccaggacugaugguuuucuggucuggaugucugucacaggcggagagauuaacagaugacaggguugaggaagcaagccuuuguuaugaauuuuacuaauacaguucaagugaaauuuucguucaugauucuauuggcacuagaauuagaauuucaguacuguagugcucacagggcuuccuggagaacauuugcccguauacuagucccuucucugcugccuagaaaacagaccgggucucaccccugugaaaucuuggugguuuacgaaguccucuggauuucuugauauuaucagggauauucauaagcauauaucaaaaauggaccuauuuugauauucuguuaugaaaauguuauuagaaccccaauaaauuauuauuuuucccccuugaaucugcuaaagaaaacagauccugacuuagcuuacuugaaauaagcagggcagggagcccuguuuuggaagagacagacuguggaagagauuacaaacaaggcccgaggcugcacgaaugaugaguuuuguguauauaauguuaauguccaccgccacuucccuaacgacuaugagaucuuuuuuuugaagauccucauggaagguuguacagagccccacauuugaggggaaguccuuucaguugauaugagaucucuuuaacaccccucagucuauguaggaaaugccuugugauacauagagaacccucagcuucucucugccucuggaggaccaaggucuuuccugacagucggagacacaccuugauguauguuaauaaaagcauuucaggcuguggggccaccauguauauuaauacuccuuauguguccagcaucuguguauucauucgagugcccaaucccuggaugagaugaacuaggccuuauaaaaagucaaagccucaaagaaauggcacaaccauguucuucggcacucaggcuccuaauugcagauccucacgaagggugguauguggagcuggaaggucuuguggccacaggacaugcuggugagcccugagcuggccuugugcagagggcuccguucaaaggcucggggugucuuugagguuguuuaucaagcuggggaacucuuccaagucugacaauguuucgaacccuuuuugcaagguugcacuauuaguauaccaucauguccggaaaacuuuuaaucuucucaaauaucugauguaacuaccagaaagucccuuacuuccuaugaccaaucaggaccaagucuuggaggugauguguuacauuacgugcagcacaauaguaccgaucaguuaacucagcgcugaagggcuuguuuuaugaaagguacuauuccuucuuucacauuaacuggaaaccucuuuuuuuaccuguuguucacaacuaguuuucuuauugacuguauuggacugucucuucuuguagagacugauuuuggccaacauauuaaugcauguuuuaugcaaaacacaaauaugauauuaguugcuuuuaaggaguucuggcauuguaugugcauuuuuguagaaauuguuacuggacuuauaauuacauacuuaacucugaucagguuucuguaaaauuuaaauaaaaccaauacaaaauaaaaaaaaaaaaaaaa

SEQ ID NO: 159 - RNA, 2170 nt, Homo Sapiens
agucgccuccggaggaaggaagaagaggacgccgggcgcgcagcagcucggugcugauuaucacaacuguuuggugaccuacuucacugaccugugaggauuccuucccuucagguacuggauucuugaucuuucugcaucaucaagaauggaaacagacuguaaucccauggagcuaagcaguaugucaggauuugaagaagguucagagcugaacgguuuugaaggaacugacaugaaagacaugaggcucgaagcugaagcaguuguaaaugauguucucuuugcuguuaacaacauguuugucucgaaaagccugcggugugcggaugauguggccuauaucaauguggaaacaaaggaaagaaacagauauugccuagaacucacugaagcagggcucaaggugguaggcuaugcuuuugaccagguagaugaucauuuacagacucccuaccaugaaacagucuacuccuuguuggauacacucagccccgccuaccgagaagcauuuggaaacgcacugcuucaaagacuggaagcuuugaaaagagauggacagucaugacuacacuuuuuccuuucagaggggcuggugcugguacagaauguugauauaaagcuuaaaauucuugcauauggucauagaaaaugcaucuuugguuuuguguuuuuaucacuugcuuccaacuuaggcuuuuggcucagaagauuauugaauaaugauuugucuuaguuucuguuucaguaagggaauucugaggccguugcuaugauaccaucauuaagacauucacaugucuucauauaauaucucuucauuucaaauccuaaucacuauuucauacuauuacagggcuuugaugcugccagcacugucuuuuacauaggaaauucuagauuugcacaguaauagaggaauuagaaguaccuaacuauacacuuugauucagccugcuaaaucagggguucaauacuagcuuggacaaacuuuguaguaauuaauugcuaccagccuuauuggaaacaaauuaucaacuaguuuccccugcacaaauuuugaaauucacugcuucacuuaaucuauuuauauuacuaauaauggauuaauaaagaugaauuaauuauauauuacuuaacuaguauuaaaugaaaaacagggacugaaauaguucuguauuccguguuugcaacagccagccaacuaagcagaggauaaaccguuagcaaaugaauguaauaauuacucauuuccaagauaucuaagcacauaagcaaauacaggaacagacuucauucuuuuucuuaacaaaaaagcaucuucagugugugauuuaaaagaaagaagauucugguuuccuagaaaacaauauuuuggccuguguugauucuuauucugaauguguguuuacauaauguacaguauauauucagaaaguauuuuugcuucaacguuuacuuucuaugauguagugcuuugguauuccuacagcaccccaccuuccccaacagauguacaguguucugucuccauucgaaaucuacaauguaauaugagugcauuguauggguuugaaaccaaaggaugaaugaagcauucagagacuuaauauuugaaaaaggaauagucaguauuuuauauuuuauuacagguacugauauuuauaaauuuaauaaacuguaccaugcugcugcauguuuucaaguacauguugaacaguaaggauuggggaguuguuuuuuaauggucaccuaaagcagcugcuauagaaauguugaacuaaaauuuugcaucuggucauaccuucaugcauuuaucauuugcagauauuuuuccaucauuauuaaaaaacaggaacuuuuaggcucugaagaucauguggaccagagcaaauuaaaguucaguuugugucacaauucauugccagacuucauuggaaugcuuuguuugaugauguauguucauucucagcuuuauuuucagaugcuuaacugggcaacgaagucuaacuucagguugaacuuucucauguuuaaucucaggcuaaauguaaaugauauuuguaaaguuugaauaaaauucuguuuacucauuuugaguuaguaugaaaaaaagugauuguauguuuaagaauugaaauuguucauuuugugauaaaugauuaauucc

SEQ ID NO: 160 - RNA, 4688 nt, Homo Sapiens
ucagaaguagaguauauuaacaaauacagacagcucgaagcacaagagcuugaugugugucgcaguguccaaccaaccagugggccagguccaaggccaucuuuggcuaaauuaagcagugugacaugcaucccagggacaacuuauaaauauccugauuugccuauaagucgauacaaggaagagguugugucuuugauagaaaguaauuccguggugauuauccauggggccacgggaagcgguaaaagcacucagcucccgcaguauaucuuggaccacuacguucagcgcuccgccuacugcagcauuguggucacccagccccggaagauaggggcaagcagcaucgccagguggaucaguaaagagcgugccuggacccugggagguguggugggcuaccagguagggcuagagaaaauagcaacagaggacaccaggcuaauuuauaugacaacuggaguccugcuucagaaaauaguuagugccaagaguuugauggaauucacacauaucaucauugaugaaguacacgaacgaacagaagaaauggauuuccugcuauugguaguccgcaaacucuuaagaacaaauucacguuuugugaaggugguccugaugucggcuaccaucagcuguaaagaguuugcagacuacuuugcuguuccuguucaaaacaagaugaauccugcauauauuuuugaaguggaaggcaagccccauucaguugaagaguauuaucuuaaugauuuggagcacauucaucauagcaagcucucuccucaucuccuggaggaaccggugauaacuaaggauauauaugaaguugcugucucucucauucagauguuugaugacuuggauaugaaggagagugggaacaaggcuuggucgggggcccaguuuguguuggagcgaagcaguguguugguguuuuugccaggucugggugaaauaaauuauaugcaugaacuucucacaagccugguucauaaaagguugcaggucuauccacuccauucaaguguggcuuuagaagaacagaauaaugucuuuuuaaguccagucccuggguacagaaagauuauucuguccaccaauauugcagagaguucugucacaguuccagaugucaaauauguuauagauuuuuguuugacuagaacuuuggucugugaugaagauacaaauuaucagagucugcgauugaguugggcuucuaaaaccagcuguaaucagagaaaaggccgugcuggacgagugucuagaggguacuguuaccggcugguacacaaggauuucugggacaacuccaucccugaucauguuguuccugagauguugcguuguccauuaggaagcacgaucuugaaagugaaauuacuugacaugggugagccgagagcucugcuggccacugcccuuuccccgccuggucugagugacauugagcgcaccauccuucuacuaaaggagguuggagcacuugcagugagugggcagagagaagaugaaaacccccaugauggugaauugaccuucuuaggaagaguuuuagcccaacuuccuguaaaucagcaacuugguaaacucauaguccuuggacauguauuuggaugucuagaugaaugucuuauuauagcggcagcucuuucuuugaagaauuuuuuugcaaugccuuuccggcagcaucucgauggauauaggaacaaagugaauuucucuggcaguagcaagagugacuguauugcacuuguugaggcauuuaaaacauggaaggcuugcagacagacaggggagcugcgguacccgaaggaugaacuuaauuggggacgguuaaauuacauucaaaucaagagaauuagagagguggcugaauuauaugaagaauugaagacuagaaucucacaguucaacaugcauguugauucucggcgaccugucauggaccaagaguauauauauaagcagcgauucauccuacagguuguauuggcaggugcuuucuauccaaauuacuuuacuuuuggacagccggaugaggagauggcggugagggagcuggcuggcaaggaccccaagacaacugucguguugaaacacauuccucccuauggauuucuuuacuauaaacaacuacagucucucuuuagacaguguggucaagucaaauccauuguauuugauggugcaaaagccuuuguggaauucucacgaaauccaacagagagauuuaaaacccuuccugcaguauauauggcaauuaagaugucucaacuaaaaguuucacuugaacucagcguucauucugcagaggaaauugaagggaaggugcaaggcaugaacgucucaaagcucaggaacacaagggugaauguggacuuccagaagcagacgguagauccuaugcaagucuccuuuaacacaucagacaggucccagacaguuacagaucuccuucuaacuauugaugucacagaggugguugaagugggacacuuuuggggauacaggauugaugaaaacaacucagagauucugaaaaagcuuacugcugaaaucaaccaacugacgcuggugcccuugcccacucacccacauccagacuuggucugucuggcaccuuuugcugauuuugauaaacaacgcuacuuuagagcucaaguccuuuauguuucuggaaauucugcugagguauucuuuguagauuauggcaauaagucucauguagaucuacaucuuuugauggagauucccugucaauuucuugaacuuccuuuccaggcuuuggaauuuaagauuugcaaaaugagaccaucagcaaagucucuuguuuguggcaagcacuggagugacggggccagccagugguucgccucucuggugagcggcugcacccuccuugugaaggucuucucuguggugcacagcguccugcacguggauguguaccaguacucagggguccaggaugccaucaacauaagagacguccucauccagcagggcuaugccgagcucacggaggaguccuacgaguccaagcaaagccaugaaguucucaagggccucuuuuccaagucaguagaaaacaugacagauggcucugugcccuuucccaugaaagacgacgagaaauaucucauccggauuuuguuagagagcuuuucuaccaauaaacuggguacuccaaacuguaaggcagaacuucacgggccuuuuaacccuuaugaacuaaagugccauaguuugaccagaauauccaaauucagguguguuuggauugagaaggagagcaucaacucugucauuaucagugacgccccugaagaccuucaccagagaaugcugguugcagcuucccuuuccaucaaugcgacuggaucuacgaugcugcugagagaaaccucucugaugccucauaucccuggccucccggcucuccucagcauguuauucgcaccggugauagaguuaaggauugaucagaauggcaaguacuauacuggaguccuuugugguuugggguggaauccagcuacaggggcuuccauacugcccgagcacgacauggagcuugcguuugacguucaauucagcguggaggaugucgucgagguuaauauucucagggcugcuauuaacaagcuagucugugauggaccaaauggaugcaagugucuugggccagagagaguugcgcagcuucaagacauugcccgucagaagcuuuuagguuucugcuuuugaauaugccauagauuaaaauauuuucugaucauaacugcauaaauguugaccuuuaaacaguuuauucuaguuccaauucugugggaagcauauaggauuuaaaucuuuaaaaaaaucacagcaguguuuucaguuacuaauauauaauuaagauaauuucuuuuuuuuuuaaauuaguuuguucugucagucaaaaccaagggagaagauuguucccaaguggcaugaaaagcccuacgaguggaaucagguugauccaaagcuggucauggagcaggccgaccgugagagcagcagagggaagaacaccuuucucuaccagcuccacaaacugguugugcucggcaccugagcauguccacagguggccuccagcacaccccucaggaagcuguggaggcuggauuccaggcucccuccgcagacugacuuuccucugugucuggguguuacagucugugcccacugcauccuaaaggccuuuucuuucuucuuuucucuuugggugauagucagagagugguguuuuuguucaggugggaaggauuggaaacucuagucuuuucuagaaacagaaaaucacuguauuaaauauuuuggaaagauuguucugaaagaagucuguuuggauaaagagcuguauuuugcuuuaaauuuauuaagguaaauauaaguaguuaaucuuagauguaagguuccagaaugugcuuacauauucuguucuguuacagugauuuaaaccaguaguauaggaaaaaacuuaaaaaaacaaaaaaaccauguaguauuuucugauuuuuuuuuccaugagggaaaauaucuaauuuuuauaagacuaaguugaguuauacuucuugguucacauuuuggaaaucagagauuacagauuacauggccauagcuuaucuguguuaaaacaauaaaagcauuaaaug

SEQ ID NO: 161 - RNA, 1027 nt, Homo Sapiens
augcugcuguggacgucugcgucguccucguguggaugcugcuguggacgucugcgucguccucguguggaugcugcuguggacgucugcguagucucguguggaugacgucugcguagucucguguggaugcugcugugcacgucugcgucguccucguguggaugcugcuguggacgucugcgucguccucguguggaugcugcuguggacgucugcgucguccucguguggaugcugcuguggacgucugcgucgucucguguggaugcugcuguggacgucugcgucgucucguguggaugcugcuguggacgucugcgucgucucguguggaugcugcuguggacgucugcgucguccucguguggaugcugcuguggacgucugcgucgucucguguggaugcugcuguggacgucugcgucguccucguguggaugcugcuguggacgucugcgucguccucguguggaugcugcuguggacgucugcgucguccucguguggaugcugcuguggacgucugcgucguccuccuguggaugcugcuguggacgucugcgucguccucguguggaugcugcuguggacgucugcguagucucguguggaugcugcuguggacgucugcguagucucguguggaugcugcuguggacgucugcgucguccucgaugcugcuguggacgucugcgucguccucguguggaugcugcuauggacgucugcguagucucguguggaugcugcuguggacgucugcgucguccucguguggaugcugcuguggacgucugcguagucucguguggaugcugcuguggacgucugcguagucucguguggaugcugcuguggacgucugcgucguccucguguggaugcugcuguggacgucugcguagucucguguggaugcugcuguggacgucugcgucguccucguguggaugcugcuguggacgucuguguagucucauguggaugcugcgaguuuucguugcucugggguagauucguagc

SEQ ID NO: 162 - RNA, 4680 nt, Homo Sapiens
ggcagaccgucacgugacgacgucgauucgcgugcggcaguggcgaaguugacaaaccccgcgaaaaucgacucuuugcaucgcacauuuuguugauuuucccucguuuuucuuucucucuuucccccguccauccgaaagaggguuggaaaaaaacaaaacaaacaaacaaacaaaaaaaaaaccuaacgcuguugggacccggaagcggaaagggcaucuuugaggucgauacuuccgggucauugggagagugcgggauuccugggccgagagcggguggcugagccgggaccucgcgugauucucggaacccgaggagaagcggcguccggggcuauggcugugacucuggacaaagacgcuuauuaucggcgagugaagagacuguacagcaauuggcggaaaggagaagaugaguaugccaacguugaugccauuguuguaucaguggguguugaugaagaaauuguuuaugccaaaucaacugccuuacagacauggcucuuugguuaugaacuaacugauacuaucauggucuuuugugaugacaaaaucaucuuuauggccagcaagaaaaaaguggaguucuugaaacagauugccaacacuaagggcaaugagaaugcuaauggagccccugccaucacacugcuaauacgagaaaagaaugaaaguaauaagaguagcuuugacaaaaugauugaagccauuaaagaaagcaagaauggcaagaagauuggaguguucagcaaagacaaauucccuggagaguucaugaagagcuggaaugacugccucaacaaagaaggcuuugacaaaauagauaucagugcaguuguggcauauaccaucgcuguaaaggaggauggggagcucaaccuaaugaagaaagcagccagcaucacuucugaagucuucaacaaauucuucaaggaaagagucauggaaauaguugaugcagaugagaaaguucgacacagcaaacuggcugagucuguggaaaaggccauugaagagaaaaaauaccuugcuggggcagacccuucuacuguggaaauguguuacccuccuaucauucagagugguggcaacuauaaucucaaguucaguguggugagugacaagaaucauaugcacuuuggggcuaucacuugugccauggguauucgcuucaagucuuacugcuccaaccuuguucgcacuuugaugguugauccuucucaagaaguucaagaaaauuauaacuuuuugcuccagcuucaagaggagcugcugaaggaauuaagacauggugugaagauaugugacguguauaacgcugucauggacgugguuaaaaagcagaagccagaacugcugaacaaaauuaccaaaaaccuaggguuugggaugggaauugaauuccgugaaggcucccuaguaaucaauagcaaaaaucaauacaaacugaagaaaggaaugguuuucagcaucaauuuaggauucucagaccugacuaacaaggaggggaaaaagccagaagagaaaaccuaugcccuguucauuggugacacagugcuuguggaugaggauggcccagcuacuguucucacuucugugaagaagaaagugaagaauguggggauuuuccuaaagaaugaagaugaggaagaagaggaggaggagaaagaugaggcagaggaccuuuugggaagagguucucgggcagcauuacuuacagaaagaacaagaaaugaaaugacugcagaagagaagcgaagagcacaucagaaagaacuagcggcucaacucaaugaagaagcaaagaggcgauugacugaacaaaagggagaacagcagauucagaaagcucgcaagucuaauguguccuauaaaaacccaucucugaugccuaaggaaccacauauucgggaaaugaagaucuacaucgauaagaaauaugagacuguaauaaugcccguguuuggcauugcaacaccguuucacauugccacaaucaagaauauaaguauguccguggaaggagauuauacuuacuugcgaaucaacuuuuauugcccaggcagugcucugggcaggaaugaaggcaacaucuuuccuaacccugaagcgacuuuugucaaggaaauuacauaccgagcaucaaauauuaaggcacccggagaacagacaguaccagccuugaaccuucagaaugcuuuccgaauuauuaaagaaguacagaaacguuauaaaacucgagaagcugaagagaaagagaaggaggggauuguaaaacaagacucacuggugaucaaucuaaaccggaguaauccgaaacugaaagaucuauacauucgcccaaauauugcccaaaagaggaugcaaggcucacuggaggcccaugucaauggcuuccgcuucacaucuguucgaggagacaaaguggauauuuuguacaauaauauuaagcaugcuuuguuccagcccugugauggagaaaugauuauugucuugcacuuucaccucaagaaugccaucauguuugggaagaagcggcacacggaugugcaguucuacacagaagugggagagauaaccacggacuuggggaaacaucagcauaugcaugaccgagaugaccucuaugcugagcagauggaacgagaaaugaggcacaaacugaaaacagccuuuaaaaauuucauugagaaaguagaggcucuaacuaaggaggaacuggaauuugaagugccuuuuagggacuugggauuuaacggagcucccuauaggaguaccugccuccuucagcccacuaguagugcgcugguaaaugcuacggaauggccaccuuuuguggugacauuggaugagguagagcugauccacuuugagcggguccaguuucaccugaagaacuuugauaugguaaucgucuacaaggacuacagcaagaaagugaccaugaucaacgccauuccuguagccucucuugaccccaucaaggaaugguugaauuccugcgaccugaaauacacagaaggaguacagucccucaacuggacuaaaaucaugaagaccauuguugaugacccugagggcuucuucgaacaagguggcuggucuuuccuggagccugagggugaggggagugaugcugaagaaggggauucagagucugaaauugaagaugagacuuuuaauccuucagaagaugacuaugaagaggaagaggaggacagugaugaagauuauucaucagaagcagaagagucagacuauucuaaggagucauuggguagugaagaagagaguggaaaggauugggaugaacuggaggaagaagcccgaaaagcggaccgagaaagucguuacgaggaagaagaagaacaaagucgaaguaugagccggaagaggaaggcaucugugcacaguucgggccguggcucuaaccgugguuccagacacagcucugcaccccccaagaaaaagaggaaguaacuucugaacuuuggcccugagcuccauucuuccuccagccaaccccugaaaauuuuacaugacauagaaacuguauuuuuccuuucguuuucauuugaaguuuugccauuuguguuuauggguuuagggggccauuuguguggaccaaucuacucggggaauuccaggcccaccaggacacgugccaauggccccauucagauggcaagggaggagguguucuugaagacaggaggaggcucccgcuguuaauaaauauuguuucauucuucucucuuccugucaccuucugccaagacauugauggcuucugacaucuuauuuggugucucaaagcuguauuuccaagacagugguacaaggugacccuuaauuacccguaucaugguucuugaccagcacauucaauccuccaaccuacccuacugccaugaccuuccgcacaucucuaaguuuuaucuuugcaauacucaagguucucggaaauuugcuaaugguugugauaaaccauacagcuugagccagugaggcagauugggcuggugccuucgucugaguuuuccugcuuuccugccucgugcagauucugagguauaucugcugccuuggaagacauaagaagcagugauacucccuggcucgguuauuuucuccauacaaugcacacaugguacaaugauagaaggcaaaauugccacugucuucuuuuuuuucucauauaucuaaggaagauauaucagguugugccucauguaccgcuucuagugaaauguagaggaaggcucaaaggagucaacauuuauaucuggaagggacaagucaugccuugggccuagaauacccugaugagaaaagagaagaggaagggaggccauaucuacaacacagccucucggcacugcugcuccuuauuuuaacuuugucuugcauuguccuguauuuaucacaguuucuguugaacagcuuuucaaguauuuggggaguuuaucuugccauccuccccuucugguucucugcacccaccugucccacugcaguuccuuccgugcucugugacuuuaagagaagaaggggggaggggucccggauuuuauguuuguuuguuuuuucuccuuagcaguaggacuugauauuuucaauuuuggaagaacuaaaagaugaauaaacuggguuuuuuuuguuguuuguuuuuguaaa

SEQ ID NO: 163 - RNA, 2055 nt, Homo Sapiens
gcguugaugugacgucccugcgcgcgccgcuuucuguugccgggcgcaauggcggauacgcuggaguccucgcuggaggacccacugcggagcuuugugcgaguuuuggagaagcgggaugguacagugcuacgacuacagcaguauagcuccgguggcguggguugcguugugugggacgcugccauuguccuuucuaaauaccuggaaacgcccgaguuuucuggcgacggggcccacgcgcugagccggcggucggugcuggagcuggguucgggcaccggggccguggggcucauggcugcuacccucggguaagagcuggcgggcgggcgggaugugggggcgccuucuugcuggggaaauccggauuacaggcuuuccccccugugccuacaccucagucgacguuauuuuauagggcugauguuguagucaccgaucuugaggaauugcaagacuugcugaagaugaauauuaauaugaacaagcaucuugucacugguucuguucaagccaagguacugaaauggggggaagaaauagaaggcuuuccuucuccacccgacuucauacugauggccgacugcauauacuaugaagagucuuuggagccauugcugaaaacucuaaaagauaucagcggauuugaaacuuguauuauauguuguuaugaacaacgaacaauggggaaaaauccagaaauugagaaaaaauauuuugagugaucacccaaacccuuauaugggcacaaaucuaucacauugugagugacuccuuuugaggguacaucuauauaggccugcaguuuugucugcuggaaggacuacuuugguuuaaugagaaagcagguauaugacugccucagcuccuucagcuagauuuugacuuugaaaaaauuccuuuggaaaaacaugaugaagaguaucgaagugaagauauucauauuauauacaucagaaagaaaaaaucgaaauuuccaucgugaagccuuuaaucaucuuacccaaggcucuaacaaccuggguaaacuaaagaugugaauagagcaugugaauacagcaugggaagauuguguucacagauuuuuuuuuccggcacguccuuagagauccgauguauagaugaugaccaccaggggcugucugcaauacgaaaaauuccugcuugccugccugccugccaauggcccugaauccagcuuagguuacuuaguucagcaucaaguucuucuuaaauguugggaaucaguuauucaaauaaaaauugguauugaggcgaggcugaaaucugccaaaaacagccaacaugauuugacuggaccuuuuacaggaagcuagagauaaauuucugaagagaacuaucugcuauuauauaauaauguuuuaaauucaaacuaguaaauuuuaguuugucuucagaguuuaaaagguuuucauuuuguacauaauuauacaauauuuaucauuuguauuuuccacuucauuucuuuuaaaauaucuuuaauacugaaauguucuuuuaauuuuaaaaagaacugagauauugucuuguauacuuauauuagccaaaguuuucuuuuccuccaccauacauaucuaugugauuuaaucaguaaauuguacuguaaugaguugcuaagaagacaaaucagaagauuggaggaacaaaagauaucuuuacagauuuuucauuugagcauggagugagaauagaaagaccaguuucaggcuuaugcacuuacguggcucaugcacuuuauguauauguuccaggaaaaucuggcuuaaaaauacugguauuguuuacaugaagcagugaaagguuuuugaauaacuacaaauguaguucuauauguauauaccaaaugaauuucuguucugugucucucuguuuuauguuaugaagccauucgcucauauacaauaaucugucaaggacuuuaaucauacuuguuccaaagaguaguaaccggauggaauucugguauuuauaggcauuggugcuagaugguacauuuuauguguuaaaauaaacauuguuuuugagaccuug

SEQ ID NO: 164 - RNA, 2838 nt, Homo Sapiens
guugaaagcugcuggcgcggcggggcggacuccaccccugcccggcagcccagcgccuccggccgcacuuccagcucucugcgcagcccgccgcgcagcccgccgccccagccauggcgaagccccugacggaccaggagaagcggcggcagaucagcauccgcggcaucgugggcguggagaacguggcagagcugaagaagaguuucaaccggcaccugcacuucacgcuggucaaggaccgcaacguggccaccacccgcgacuacuacuucgcgcuggcgcacacggugcgcgaccaccugguggggcgcuggauccgcacgcagcagcacuacuacgacaagugccccaagaggguauauuaccucucucuggaauuuuacaugggccgaacauuacagaacaccaugaucaaccucggucugcaaaaugccugugaugaggccauuuaccagcuuggauuggauauagaagaguuagaagaaauugaagaagaugcuggacuuggcaaugguggucuugggagacuugcugccugcuucuuggauuccauggcaacccugggacuugcagccuauggauacggcauucgguaugaauaugggauuuucaaucagaagauccgagauggauggcagguagaagaagcagaugauuggcucagauauggaaacccuugggagaagucccgcccagaauucaugcugccugugcacuucuauggaaaaguagaacacaccaacaccgggaccaaguggauugacacucaagugugguccuggcucugccauaugacacccccgugcccggcuacaugaauaacacugucaacaccaugcgccucuggucugcucgggcaccaaaugacuuuaaccucagagacuuuaauguuggagacuacauucaggcugugcuggaccgaaaccuggccgagaacaucucccggguccucuaucccaaugacaauuuuuuugaagggaaggagcuaagauugaagcaggaauacuuugugguggcugcaaccuugcaagauaucauccgccguuucaaagccuccaaguuuggcuccacccguggugcaggaacuguguuugaugccuucccggaucaggcaaauguggccauccagcugaaugacacucacccugcacucgcgaucccugagcugaugaggauuuuuguggauauugaaaaacugcccugguccaaggcaugggagcucacccagaagaccuucgccuacaccaaccacacagugcucccggaagcccuggagcgcuggcccguggaccugguggagaagcugcucccucgacauuuggaaaucauuuaugagauaaaucagaagcauuuagauagaauuguggccuuguuuccuaaagauguggaccgucugagaaggaugucucugauagaagaggaaggaagcaaaaggaucaacauggcccaucucugcauugucgguucccaugcugugaauggcguggcuaaaauccacucagacaucgugaagacuaaaguauucaaggacuucagugagcuagaaccugacaaguuucagaauaaaaccaaugggaucacuccaaggcgcuggcuccuacucugcaacccaggacuugcagagcucauagcagagaaaauuggagaagacuaugugaaagaccugagccagcugacgaagcuccacagcuuccugggugaugaugucuuccuccgggaacucgccaaggugaagcaggagaauaagcugaaguuuucucaguuccuggagacggaguacaaagugaagaucaacccauccuccauguuugauguccaggugaagaggauacaugaguacaagcgacagcucuugaacugucugcaugugaucacgauguacaaccgcauuaagaaagacccuaagaaguuauucgugccaaggacaguuaucauuggugguaaagcugccccaggauaucacauggccaaaaugaucauaaagcugaucacuucaguggcagauguggugaacaaugacccuaugguuggaagcaaguugaaagucaucuucuuggagaacuacagaguaucucuugcugaaaaagucauuccagccacagaucugucagagcagauuuccacugcaggcaccgaagccucggggacaggcaauaugaaguucaugcuaaauggggcccuaacuaucgggaccauggauggggccaauguggaaauggcagaagaagcuggggaagagaaccuguucaucuuuggcaugaggauagaugauguggcugcuuuggacaagaaaggguacgaggcaaaagaauacuaugaggcacuuccagagcugaagcuggucauugaucaaauugacaauggcuuuuuuucucccaagcagccugaccucuucaaagauaucaucaacaugcuauuuuaucaugacagguuuaaagucuuugcagacuacgaagccuaugucaagugucaagauaaagugagucagcuguacaugaauccaaaggccuggaacacaaugguacucaaaaacauagcugccucggggaaauucuccagugaccgaacaauuaaagaauaugcccaaaacaucuggaacguggaaccuucagaucuaaagauuucucuauccaaugaaucuaacaaagucaauggaaauugaacucuagaauugucucuagaaaacauagcuucuuacugaacuugaacauuuuuacaacauucacugguuuuuguuuuguuagcuaauaaucuauaauaguugaguaucucugggaauggggagggaaauuauauguaauagagcuuaaaaauaaagugucaauuuccaagggc

SEQ ID NO: 165 - RNA, 4147 nt, Homo Sapiens
cgacugggccaggcgccggggcaggaagggaggcggccgccgugccauucuuaaaggcgcccgaguguaggcgacaggccgcugacggccggaaggaaaauggagugagucuuugguuguuugugauguugccgaagauuuaguggaaaagcugagaaaguuucguuuucgcaaagaaacgaacaacgcugcuauuauaaugaagauugacaaggauaaacgccuggugguacuggaugaggagcuugagggcauuucaccagaugaacuuaaagaugaacuaccugaacgacaaccucgauauccuuuucuuacucauuucuucauuguguauaguuauaaauaucaacaugaugauggaagaguuucauauccucugugcuuuauuuucuccaguccuguuggauguaagccugaacaacagaugauguaugcuggaaguaagaauaagcuaguccagacagcugaacuaaccaagguauuugaaauaagaaauaccgaagaccuaacugaagaaugguuacgugagaaacuuggauuuuuucacuaaugugaacuucuguguuucuaaaguauuuauguauuaaccugaccauacuggaaucagacauaaauacuuauuuaugccuaaaaaugcacuguuacuuacaguuuguuuccugcaguaaagaaaaauucuucauuugugcaaaauuugaacaaagaggaaaucaucuucauaguaaugaaacuuuguaaaguguuuccuuauauugguaauuguuagguggacuacuuuucuccagggacuuuuugcacucuugugacuaauuucuauaacuuaugguucggaauuuguuacuauuuacagacaccauuggaaaguggauauauuagauugugagagacaacaguugccuccuuuugacaaauacuggauauuagcaguuuauuuaugaaaauagcguauuaucacuugucaaaucauugaaauucauuuggggucaaagacuugagugacccaguauugagccaugaauaauuuaguguaaccuguauuacaaguacauugaugaauucuguaucuucuuugguuuccuguaucuuuuuaaucaagucuagaaacuauguucaucagucacucauuuuuaaggucgggaguuagauuuuaugauagaauuaugacuguuagcuuuucuccuuauagcaucuuagucuuagaaauugguggguuguaauaaucaagggcuucauuccuuuuaugucauuucuagacaguuuugaaucuagguuaauaacacuuuauuuauaaagcaccucaauguccugugaacacuaauuauuuuaaauguguuaauacugugccuuugauuuguuagcuuuaaaguuaguuuaagacuuuuacacugccaguauuccacauuuggugaaauuaauacuuuuuuaaaggguccaaauaaaauaauuuucuaauguguauaucugaaauuuguaauaaaaucaacuucauauuuuaaaaauuccaacuaucugcuugcauuggugaauauauggcagucgagaguuauaauuuuggguauacuugugguuaguuuugugccauaggaaaaaauuaucuuaaaacuuuggccauaguuaauaacauuaacacuucaauagcaaucacaucuuauauccuaaaugucagaagauauucugaacuggaugccugaauaguuaacuaaaccagucuuguuagaugaugguacucuuggcauaaagcgaggauucugauauuuggcauacuuguaaaaacaaauacauaaguaaccauugaacauuaauuugauaauaggucuagagacucuaaaaacuaaccaaacuuggugaguguauucuuauauuaagaauaucuuagucaucucaaaacuagcaaaauuuaaauuuuggcauguuuuccauucauauguucuuugcauuuuauuuuugagguuucugugagaaguaaagauaguuggaauuuuugcgauauugaauagaacaucuucuguucccaacacuguuuggcuucacuaauuuagaagucaggaagcaauagaaaguuggagaugaggaagugcuagaguagguguuuguuuugguucuuggagggaaaagauucuuuauuccaauuuccagagagaagagaaaacucacccaggaaguuuaaaaauucuuuaaacagguauuuugauauuggagaauaacaugcauauaauucuguaggaaugcacauguaauccaagugaguggagaguguuuuuaauguuuuugaaugaaggaaaugagguuuuguuucaccuguuuugcagcaguaagagaaacuagugcugcaagaauguauuuuuuaaugaaguuccuuauuuugucuugcauguuuuaguuuugcuuauuuuuaaauuuggagguccuccauaaugucagauaauauugaccugccauacguuagcacucuuaguuccgcuacugucuuuaacaggagcaaagagcugugauaaaccaugcuuuuuugagcuugucugacuccuaauuaauaacauguuuuuggcaagacaacagauugagguuagaggaucaguaggacauuuuuauuccaucuguccuauggggaaauuuacaaaucccgugcucuaaaauguucucaaacauuuauauagauuucccuuucaucuuacuaaauuuugcauuguucuuuucaaguauguuucguauuuacugucuuuuuuucugccauuucccaaauaauaacuccagauuucauaauuccaguuuuuacauuccguuaucuuucugguacaaccauucccauucagccuuaaaucugaguccuuuuuagcagcaacuuuuuuccugggauccuccuucguggucuucuaagucaguguuaguuuugaaauuuuuggcccugcauaaguucugcauagcaucuaaugucaaaauagaaccaacugguaaucacaguauuauuuagugugguuuccaugacaacaaaaauacauacgaagaaaacuucucagguuacuaugcugaaauuccaaaaugucugaguuuugaauagugaucacuuuguucugguauugacgcaauuauauuaggaaaaaaguugguugacuguuuuuguuuaauugacuucuaaaauguucaaauugucuaguucuaaaaguuuacuaaaugccuagugcaguuaaacauacucuuguuuaaguguguguugcuaaauuuuuuacugucauuacuaaauaaucuguguggcaaaaugugugucagcacuuuucccuccuuuuuuaucuccuauuuucaggagucaaauguagccauaaacuguauccuugucugacacuuuagcuaaaaauuuccaguuaggggaguuuauugccaaauuaaauuuggcuguuccccccaacccauauagauauuaaggaagguguacuuaaaaaauguuuggacugcuuuuaaaaccugagcaaugucauuaauccauauguggacuagugaugaauagauauuuucauaagaguuuaaaugcugauauuugguggaaguagagaguaacucauauucuaucaauucaaguauucuuacuaugguugcuuucccuauuuguucaauagacugauaauacuggaauuuauagaguuugagccauuacaacuuuugugaggauguguuucaaacauuucuggacaaaucuuauuuuguauuucuggaagaauguaguaaucuucuagaccgcuuaaaaccaaugcucccaagcugaauauucuugagaaauuuguuuuuauuaugccauuugacauuucaaaucagugcucauauacaguaaacuugugauagaaauuguauuuuauugcuuuuuggauuauaauucauauaaauauaauuacuugaauauuguuugagaucauuaacaugccagggcaguucccacugauuuagaugguccaagauaaucucauucaggaggcuugaaacauuaaugguuuagucuugugaauuuuaacaguucucugucaucguuuaacaaaaccaacaacugacacaacuccuuaagcugugguuucagucucugcuaguucauauugcauguuuauuuuggacagucuuuuguuaagcauggugcuuguacugguuuaaauaaaauguuaacauu

SEQ ID NO: 166 - RNA, 2582 nt, Homo Sapiens
ggugcgcgcgccucgacauccgggcaacgccucuguucuguccucccccuucgucgccugugacaaccggaagcggaagugaaaaugggugucccugcugccucuuagcaacaagaggggucaagugacacaaccagcugacucccguagaggaagacacuguggaggccaguucuggagcuauugcagccucgguugcccggccggggacccgagccgaaaaguuaucgucagaaugucgggcaaagaccgaauugaaaucuuucccucgcgaauggcacagaccaucaugaaggcucguuuaaagggagcacagacaggucgaaaccuccugaagaaaaaaucugaugccuuaacucuucgauuucgacagauccuaaagaagauaauagagacuaaaauguugaugggcgaagugaugagagaagcugccuuuucacuagcugaagccaaguucacagcaggugacuucagcacuacaguuauccaaaaugucaauaaagcgcaagugaagauucgagcgaagaaagauaauguagcagguguuacuuugccaguauuugaacauuaccaugaaggaacugacaguuaugaacugacugguuuagccagagguggggaacaguuggcuaaauuaaagaggaauuaugccaaagcaguggaacuacugguggaacuagcuucucugcagacuucuuuuguuacuuuggaugaagcuauuaagauaaccaacaggcguguaaaugccauugaacaugucaucauuccccggauugaacguacucuugcuuauaucaucacagagcuggaugagagagagcgagaagaguucuauagguuaaagaaaauacaagagaagaaaaagauucuaaaggaaaaaucugagaaggacuuggagcaaaggagagcagcuggagagguguuggagccugcuaaucuucuggcugaagagaaggacgaggaucuucuauuugaauaaucuuuccuguucugguucuuugagaaacccuaacacuggcuucauuuuaauucacaguguguagguuugauuuguguggcuauuuauuuuuuggccuaagaauuucacugguuguaaaauuuaccuagaugucuauuuaugggauuacuuuugcagaaucauaauuuagcaaccauuuaucauggaugaaagagaucuguaaaaccugcccaggaacuuacagaauuuacuuugcagaagcguuaucauacuccauuuacaucuguguuacacgugaucugcuuaccaagcauauuaggaaauaccucuuaggaagcauuagcggucucaggccaauuacuguggagcagcuuucauuccuacccacuugcaaaccuuggcgcuguugucugagauugcugcagccauucuuguuaccaugguacuucucaaacuuugugaaaaccugcacuuuuccuugcaugacagguuccugucuugucugucaugggagccauucugccaauuuaaaugcgacugugguauaaacaguaaaaugauuuaaaaguaagucauuccguuuuuauuaauuuacuguuaagucauguucucaugcucagaucaguagugucagccagagcuuucucugcagacauguaggaaguggguagcuauuuuucccacuccauguauuagaguuuuacaaaaaggcuuacuuuugagacaacuguugcauuuugggguacuaauaaaugauugccgaugaguuaccugcugaacuguaaauucuaccaucuccacuuugcagaugaggaaauugagacuuugacaagucaaagagcacagcuggaaugcaagucaaauauguacaaggauauccacaacacuguucgcagcuacaagcugagguacaaggugccucaaaagcuugagagaagcagaaauagaauagaauccugaccugugaaaacaaugacucugcaauaagguaugcaauuuuauaaaagcacuauaauauccuagggccaggcgcaguggcucacgccuguaaucccagcacuuugggaggccgagguggguggaucacgaggucaggagaucaagaccauccuggcuaacacggugaaaccccaucucuacuaaaaguacaaaaaauuagcuggguaugguggcgggcaccuguagccccagcuacuccgaaggcugaggcaggagaauggcgugaacccaggaggcagagcuugcagugagcugagaucgugccacugcacuccagccugggcaacagugcaagacuccaucucaaaaaaaaaaaagcacuauaauaucuaagaaauuugguuuguguuuauuaguaaauaugcuagaucaucaaagauuuaaucuagaccuuaaaauuugagguuuccguaggcuuuauuauuauaugauaccuaauguuuaacugauauuuuaagccauguaaacaaagaauacuucugaauguuucacuaaauuucuugaguuuuuuuuuuuaacuuaaccucacuaggccucaauauucagaaugugaaacaggggaguuggauuggugauugcugauauuuuuuuccagcuguaaaauaaaggcaauggguccauuuaa

SEQ ID NO: 167 - RNA, 2368 nt, Homo Sapiens
gaaagagaaccuguaaacgcucucggaauuauggcggcgguggauauccgagagacaaucugcugggaauuucuuggguugacagcucuuggaucccuauuuugaacagugguaguguccuggauuacuuuucagaaagaaguaauccuuuuuaugacagaacauguaauaaugaaguggucaaaaugcagaggcuaacauuagaacacuugaaucagaugguuggaaucgaguacauccuuuugcaugcucaagagcccauucuuuucaucauucggaagcaacagcggcaguccccugcccaaguuaucccacuagcugauuacuauaucauugcuggagugaucuaucaggcaccagacuugggaucaguuauaaacucuagagugcuuacugcagugcaugguauucagucagcuuuugaugaagcuaugucauacugucgauaucauccuuccaaaggguauugguggcacuucaaagaucaugaagagcaagguaaguagaacauccauacccuccuaaaacacuuuuugauccucugagaaugaagcuguuuucuuuaggaaaauggcuguugaucuuuucuaaguguguuucacuuuuucaugggaugauggcuuuguugcagcugagauucauguaacuagaugugguaauaauagcuuucacauaggaacagaugcaaguucacucuguuaguuaacugguagucuuuguuaaggugauucaagguuuuaaaauauuuggggccaggugugguggcucacuccuguaaucccagcacuuuggaaugccaaggcagguggaucaccugagccuaggaguucaagaucagcuugggcaacauagugaaaccuggucucuacauaaagucagaccuaaagccaaaaggaaagaagaaccaagcucuauuuuucagagacaacguguggaugcuuuacuuuuagaccucagacaaaaauuuccacccaaauuugugcagcuaaagccuggagaaaagccuguuccaguggaucaaacaaagaaagaggcagaaccuauaccagaaacuguaaaaccugaggagaaggagaccacaaagaauguacaacagacagugagugcuaaaggccccccugaaaaacggaugagacuucagugaguacuggacaaaagagaagccuggaagacuccucaugcuaguuaucauaccucaguacuguggcucuugagcuuugaaguacuuuauuguaaccuucuuauuuguauggaaugcgcuuauuuuuugaaaggauauuaggccggaugugguggcucacgccuguaaucccagcacuuugggaggccauggcggguggaucacuugaggucagaaguucaagaccagccugaccaauauggugaaaccccgucucuacuaaaaauacaaaaauuagccgggcgugguggcgggcgcccauagucccagcuacucgggaggcugagacaggagacuugcuugaacccgggagguggagguugcccugagcugauuaucaugcuguugcacuccagcuugggcgacagagcgagacuuugucucaaaaaagaagaaaagauauuauucccaucaugauuucuugugaauauuuguuauaugucuucuguaaccuuuccucucccggacuugagcaaccuacacacucacauguuuacugguagauauguuuaaaagcaaaauaaagguauuuguauauauugcuucaucaugacuuuuuucuucaucauaacugauauuuuucagaugcacuuugaagacauaaaggauguuaaaguaguaacuaagcauauuucuuuuuguucaguuacauaauccucaguauuaaaauaaacaguugcugacauuuuggaagaugaagaaaaggaaaaaccucacucaccaauaccauuacccuauaaauacuguaacaguguugugaauuuuaaucuuauucuguguguagauacuucuuuuuucaauaaagaaaaggaauuuuauuuuuuuuaaaguuauggaggcugagaaguccagcauugauuggcuccaucuggugagggccuucuugcugguaggaagucugcaaagucccuaggcagcacaggguaucucauggcaagggggcugagugugcuugcugcauguagaugcuuuuaaaacuguacuuuaaucauuccuuucguacaauuuuacuuuauuauaucuguuguaagcuuuuccccauguuuauguaguuuuuauagacuguuuuaguguccgaauuucuguaaaugauuguaucucaguuuucuuucugucuuauauuugggauuuuucccaguuuacauuauuuuauauaagacugcugugauuauaucuuuguauaaugcc

SEQ ID NO: 168 - RNA, 8552 nt, Homo Sapiens
aagagcagcggcgaggcggcggugguggcugaguccgugguggcagaggcgaaggcgacagcucuagggguuggcaccggccccgagaggaggaugcggguccggauagggcugacgcugcugcugugugcggugcugcugagcuuggccucggcguccucggaugaagaaggcagccaggaugaauccuuagauuccaagacuacuuugacaucagaugagucaguaaaggaccauacuacugcaggcagaguaguugcuggucaaauauuucuugauucagaagaaucugaauuagaauccucuauucaagaagaggaagacagccucaagagccaagagggggaaagugucacagaagauaucagcuuucuagagucuccaaauccagaaaacaaggacuaugaagagccaaagaaaguacggaaaccagcuuugaccgccauugaaggcacagcacauggggagcccugccacuucccuuuucuuuuccuagauaaggaguaugaugaauguacaucagaugggagggaagauggcagacuguggugugcuacaaccuaugacuacaaagcagaugaaaaguggggcuuuugugaaacugaagaagaggcugcuaagagacggcagaugcaggaagcagaaaugauguaucaaacuggaaugaaaauccuuaauggaagcaauaagaaaagccaaaaaagagaagcauaucgguaucuccaaaaggcagcaagcaugaaccauaccaaagcccuggagagagugucauaugcucuuuuauuuggugauuacuugccacagaauauccaggcagcgagagagauguuugagaagcugacugaggaaggcucucccaagggacagacugcucuuggcuuucuguaugccucuggacuugguguuaauucaagucaggcaaaggcucuuguauauuauacauuuggagcucuugggggcaaucuaauagcccacaugguuuugguaaguagacuuuaguggaaggcuaauaauauuaacaucagaagaauuugugguuuauagcggccacaacuuuuucagcuuucaugauccagauuugcuuguauuaagaccaaauauucaguugaacuuccuucaaauucuuguuaauggauauaacacauggaaucuacauguaaaugaaaguugguggaguccacaauuuuucuuuaaaaugauuaguuuggcugauugccccuaaaaagagagaucugauaaauggcucuuuuuaaauuuucucugaguuggaauugucagaaucauuuuuuacauuagauuaucauaauuuuaaaaauuuuucuuuaguuuuucaaaauuuuguaaaugguggcuauagaaaaacaacaugaaauauuauacaauauuuugcaacaaugcccuaagaauuguuaaaauucauggaguuauuugugcagaaugacuccagagagcucuacuuucuguuuuuuacuuuucaugauuggcugucuucccauuuauucuggucauuuauugcuagugacacugugccugcuuccaguagucucauuuucccuauuuugcuaauuuguuacuuuuucuuugcuaauuuggaagauuaacucauuuuuaauaaaauuaugucuaagauuaaaagguuacagauacugggcuggcaucggcguccuccagaguugugaaucugcccugacucacuaucgucuuguugccaaucauguugcuagugauaucucgcuaacaggaggcucaguaguacagagaauacggcugccugaugaaguggaaaauccaggaaugaacaguggaaugcuagaagaagauuugauucaauauuaccaguuccuagcugaaaaaggugauguacaagcacagguuggucuuggacaacugcaccugcacggagggcguggaguagaacagaaucaucagagagcauuugacuacuucaauuuagcagcaaaugcuggcaauucacaugccauggccuuuuugggaaagauguauucggaaggaagugacauuguaccucagaguaaugagacagcucuccacuacuuuaagaaagcugcugacaugggcaacccaguuggacagagugggcuuggaauggccuaccucuaugggagaggaguucaaguuaauuaugaucuagcccuuaaguauuuccagaaagcugcugaacaaggcuggguggaugggcagcuacagcuugguuccauguacuauaauggcauuggagucaagagagauuauaaacaggccuugaaguauuuuaauuuagcuucucagggaggccauaucuuggcuuucuauaaccuagcucagaugcaugccaguggcaccggcgugaugcgaucaugucacacugcaguggaguuguuuaagaauguaugugaacgaggccguuggucugaaaggcuuaugacugccuauaacagcuauaaagauggcgauuacaaugcugcagugauccaguaccuccuccuggcugaacagggcuaugaaguggcacaaagcaaugcagccuuuauucuugaucagagagaagcaagcauuguaggugagaaugaaacuuaucccagagcuuugcuacauuggaacagggccgccucucaaggcuauacuguggcuagaauuaagcucggagacuaccauuucuauggguuuggcaccgauguagauuaugaaacugcauuuauucauuaccgucuggcuucugagcagcaacacagugcacaagcuauguuuaaucugggauauaugcaugagaaaggacugggcauuaaacaggauauucaccuugcgaaacguuuuuaugacauggcagcugaagccagcccagaugcacaaguuccagucuuccuagcccucugcaaauugggcgucgucuauuucuugcaguacauacgggaaacaaacauucgagauauguucacccaacuugauauggaccagcuuuugggaccugagugggaccuuuaccucaugaccaucauugcgcugcuguugggaacagucauagcuuacaggcaaaggcagcaccaagacaugccugcacccaggccuccagggccacggccagcuccaccccagcaggaggggccaccagagcagcagccaccacaguaauaggcacuggguccagccuugaucagugacagcgaaggaaguuaucugcugggaacacuugcauuugauuuaggaccuuggaucaguggucaccucccagaagaggcacggcacaaggaagcauugaauuccuaaagcugcuuagaaucugaugccuuuauuuucagggauaaguaacucuuaccuaaacugagcugaauguuuguuucagugccauauggaauaacaacuuucaguggcuuuuuuuuuucuuuucuggaaacauaugugagacacucagaguaaugucuacuguauccagcuaucuuucuuggauccuuuuggucauuauuucagugugcauaaguucuuaaugucaaccaucuuuaagguauugugcaucgacacuaaaaacugaucaguguaaaaaggaaaacccaguugcaaguuuaaacguguucgaaagucugaaaauagaacuugccuuuuaaguuaaaaaaaaaaaaagcuaucuugaaaauguuuuggaacugcgauaacugagaaacucuuaccaguccacaugcaauuagacauauucagcauauuuguuauuuuaaaagggaggguugggagguuucuuauuggugauugucacacgguauaccauacuccucuccuucaaagaaugaaaggccuuguuaaggaguuuuuugugagcuuuacuucuuuggaauggaauauacuuaugcaaaaccuugugaacugacuccuugcacuaacgcgaguuugccccaccuacucuguaauuugcuuguuuguuuugaauauacagagccuugauccagaagccagaggauggacuaagugggagaaauuagaaaacaaaacgaacucugguugggguacuacgaucacagacacagacauacuuuuccuaaaguugaagcauuuguucccaggauuuauuuuacuuugcauuucuuuuugcacaaagaacacaucaccuuccugaauucuuuaaauaugaaauaucauugccaggguauggcuuacagugacuacuauuauaauacuaaaacucagagaaucaaagauggauuaaacucagugguugaugaaagccaaaaccuguuuguacuguucuauacuauucagguaucuuuuuauuucugauaguuuuauauuauaauagaaagccagccacugcuuagcuaucauagucaccauuuucucacuguuaacauuaggaaaaucaaggcuacuaugcuucaggauugucugguuaaauaguaugggaaaaaaacugaagaguuucacauaauuacacacgugaaauaauuaaagcuuaaacugaauuuguauuucauuuuauugucagauggugguguucaccagccuguaucuugucugagacugcauucguaucugagcagguuuucuaugccuacugaugucaguauguuuauacuaaccuucaugcuuuuuucccagaaucccucaucugccagaaaacuugaaaaguuuauugcuuguagaguuguacugcuuugauuuuugaaguugggguaguaguuagaacuagauuuaacuagucuauaaugaacaugaaggcuuuuauauaugaaguuguauaccuuuuuguguuuagagaauuaugggaaaccugguaagcaaaacuuuccucccagauaauugcuuccaaauucgaagaguuagucaccaagagagccauauguaugaaagcguaucugugaaagguaggaaacuuacccccccuaaguguaauguugcuuuaggcaacucuuguaaauagugagacuuguuuggucucuuacauguagagauuugagugcaguugguacaguacuuuggugucuccaccacugucccuucuccccgcuucaaaauaaguguaauccacgguagcagccacacuuccuuuagaaggaacuguuauaauuuauuuaaaaguugaaaaaccacccaagaugacuaccaacuuucacuuuuuucuucugccauccacccucauuuuuccuuuagcaagauuuuuauaucuaacuuuccuucccuccauugaguacgugcuuugagaaaacauuucuuaaaacagugugugccaccuaaggcuggaugggaaagugcagucuuguuguucauauaaaaacacacuucuuauuaguuuaccacuugccuuuuucuauuguuaauguucugaauuuccuuuucuuggcuuguuucuacuucauuuuacccugggucacuugcugccagcaguuugugaauggugucuuucaaauaacuuaguucuuauggcuucacuuaaagacugucucaaaaauacuuugcucucuucuucuuuuuuguucaugggacaugguaccuaagcaaauaggaguuggguuugguuuuucuccuaaaauaaugcucaauacuuaccuaaucaaauggcauccauuugaauaaaaugacaauaacuaaagcuaguuaaugucagugacauuaaacuaacuccaggauucaggaguuuuaauguuagaauuuagauuuaacagauagaguguggcuucauuuguccaugguagcccaucucuccuaagaccuuuucuagucugucuuccugccuucgaacuugaugacaguaaaacccuguuuaguauucucuugugcauuugguuuguugguuagccgacugucuugaaacuauucauuuugcuucuaguuuuauuuuacagagguagcauugguggguuuuuuuuuuuuuuucugucucuguguuugaaguuucaguuucuguuuucuagguaaggcuuauuuuugauuagcagucaauggcaaagaaaaaguaaaucaaagaugacuucuuuucaaaauguauuguuuagcacuuaacucagaugaauuuauaaauuauuaaucuugauacuaaggauuuguuacuuuuuugcauauuagguuaauuuuuaccuuacaugugagagucuuaccacuaagccauucugucucuguacuguugggaaguuuuggaaaccccugccagugaucuggugaugaucugaugauuuauuuaaagagccguugaugccuccaggaaacuuaaguauuuuauuaauauauauauaggaauuuuuuuuuauuuugcuuugucuuucucucccuucuuuuauccucauguucauucuucaaaccaguguuuuggaaguaugcaugcaggccuauaaaugaaaaacacaauucuuuauguguauagcauguguauuaaugucuaacuacauacgcaaaaacuuccuuuacagagguucggacuaacauuucacaugcacauuucaaaacaagaugugucaugaaaacagccccuuuaccugccaagacaagcagggcuauauuucagugacagcugauauuuguuuugaaagugaaucucauaauauauauauguauuacacauuauuaugacuagaaguauguaagaaaugaucagaacaaaagaaaauuucuauuuucaugcaaauauuuuucaucagucaucacucucaaauauaaauuaaaauauaacacuccugaaugccugaggcacgaucuggauuuuaaaugugugguauucauugaaaagaagcucuccacccacuugguauuucaagaaaauuuaaaacgaucccaaggaaagaugauuuguauguuaaagugacugcacaaguaaaaguccaauguugugugcaugaaaaggauuccuugguuaugugcagggaaucaucucacaugcuguuuuuccuauuugguuugagaaacaggcugacacuauucucuuugauuagaaaauaaacucauaaaacucauaauguugauauaaucaagauguaaccacuauaaauauguagaagaggaaguuuuaaaagaccuuaagcuggcauugugaaggaacaccaugguagacucuuuuuguaaauguauuuuguauuuaaugaaaugcaguauaaagguuggugaaguguaauauaauuguguaaacaaauccuguuaauagagagauguacagaaucguuuuguacuguaucuugaaacuugugaaauaaagauuccaccucugguuauccuguaugcuguaauauaccacaaccaagcaccuuuccagacagacuuuuuuuaagcugaaugauucaauuuuuuaauguuuuuuggaaauucagaagcuucugaaaacauucacuuguggcaauuugaauuuaucuuucauuuuaaacuccugaaauucagauuuuuacaaguccaauauugcccuagggagaacaugaauuugcuaagaaauguuaucuuuuaaaucucugauaucuuugucuugaagcagccuugauauguaguaagcgugauucacuuuagccugauuauaauauuauuuaucuaaaguuuguuuaugcauugccuugucccaggaauuuuuuaagaggacuugcagagacacguaccacacaguaacauuuagacuaaauaugcucugaguaaaggagaaaugaaaaaauauuaaaucaagagugaacauguacacaaagugcaauuggaagugggcuacaaauuuggcccccagcuucccagcaggcaacucaaagagguaacugagguaaaauguuccagcucagaagcauuggaucuuggauaaaaagccuacaugaugcaaacuguggcaacugagaugucagaucucaagaucucaaauuguacuugugggagcacagucagugaccccagaugaccuugacugaccuaaaaguugugggggaagucggaugucagagccuuaacaccagcaggugaccauccaaccuggggcaaugccugccuguucaccacuuagccucuuucuggcaagucauuagaauguccuccaucuucauuggcugcaacuugaugagcuacagccucuuuccuaacuuccuuuaugaugcuaguuuagguugguuauaccagcuuggaaguaugcuuagauuaaguuacagcagauacacaaauuagaugcaaguaaaaaaaaucagaauuucuguaguagaaacuacgaaaaauaaaaaggaaaguuuuuacuuuuuggguauuuuuuuacgaauaagaaaaagugagcguuaaucaguucaaaaggagguacugcuguguaaugggcuuuguacguuccuucucaugucacuuacgucacuacuucgccaucaaauugaacaagcuuuuaauuagauccugaaaauucacuaugcuaguaguuuauugguaguauuauauuuugaguagaacucugauuuucccuagaggccaaauucuuuuuaucuggguuaauuucuuuuaaacauaacaauguuaaugcugaauuguauauuaaaucccauuucuaaaaaccacacaauuuuuucucauguaaguugaguggaaugugguuaguuaacugaauuuggaauguucauauaaauaauuuguugcugcuc

SEQ ID NO: 169 - RNA, 1641 nt, Homo Sapiens
cugccucggggcggaccgggucccaguggucacuccugucccugggguuuagccacucccgaaaaggaccccauucuucccaaccaaauaucucauguaguuuuucugaaucccugagaccagccgguggauggcggugacggguggggaauggggggcgccgaaugggaaagcgaacagacuggggugaaaacuuuuggcccguuuggaagcggcagccaggacaaccugacuauguacauggauuuaguggacggcaucuuuuugaaccaaauuaugcugcaaauagaucccaggcccacaaaucaacgcaucaauaagcacgucaacaaugaugugaaccuucgcauucagaauuugaccaucuuggugagaaacauuaagaccuacuaccaggauagacccuuuuuccgguaacuaaacuucuugcgggcagacacagcguuugaguuuucgcauuggcuucaaacaaacccaguggaaguggacagugaacaagacacccccgcaggaggcccgggcacgggguguggcugccaggccuggccauggaaggccaucacugugggcucuucugggaguggcacugacagccagcaaggagaaugggugcuggggcggaguggaagaaggugagcuugaggccggaguuccuaccccaggaggcaccgucagcgucccacuucugcucgugugauccccuggaggcaccugaaucaggcaguaaacauggagugagaaacaccggaguagaagaccuugcaacagcacaugugugggcccaguuccuagcugccccggguggccaaggccacauccuguacacacaggucugggagugucugcauuucagcccuugaccgugaacuugacccucuggagguguccaucuugaugugauccucugacugcaaccucauccucugccucucagagcugccucccccuguggcuucuugcccugaggcaugggaggcguuggugccaggagcuugggguuugagucagguuggcucggggauaagacccagccuuuccacacauuaguuugugaugcugggucauagugcgucuguuugcucccugucaagggaccaguaacaugaggggucagagaagggaucagaacucucgugggccuccagugugucgcaaguuuuugcuguucugcuuuuccucagcugcuggugggaaugcaaauugcugugcugacuuuggaaaaacucuccggcaguaaagccuaaaguuccacauccacacaccguacuguggcccagcugauuucucuccuaaggguaucccggaguaacuucugcacauggaugccugggacuuuacagcccuucugcacacaauaacagaaaccuggaagccacccagaugcccaucagugggagaagggaugaauacacgaagacacgaucacacaauggaauauuauacagcuguccaaacacauuaacugcagcauaacuucagugauguagguggauucuggcaauaucauaaauauuaguaaaaauagcauguucccaaugaugacuuacagcacuaugccuuuuaaaaauaaaguuaaaagcaacuacaaugacuguacucucuaggaaaauuuacaggugcaauaaaacuacauaaaaaaga

SEQ ID NO: 170 - RNA, 1838 nt, Homo Sapiens
ggguggugcuggaccucgggcggggccgggccucguggcgggaggaggcagggcagggccucugggacggggcuggacggcuuguugacggaaacgagcccuugacgcuguggcccggaaguggagcggcugucgcagugcggcuccggcaguggcagcggaggccuguguuugcggccuucggcaagcgacugagauggcgagcgcaacugcaccugcagccgcaguccccacccuggcuucgccuuuggagcagcuccggcacuuggcggaggagcugcgguugcuccugccucgagugcgggucggcgaagcccaggagaccaccgaggaguuuaaucgagagauguucuggagaagacucacccccacggaggggacugcucucccccgcugcauccuuucugugagguaccuuacccaccucagcaccugagagggugaaauagaauucuaaccucgacauucgggaaguguuuuugagaagucucggucgguaagggaagucuuccaaguccgugcagcacuaacguauuggcaccugccuccucuucggccaccccccagaugaggcagcugugacugugucaagggaagccacgacucugaccauagucuucucucagcuuccacugccgucuccacaggaaacccagaaguucugugaacaaguccaugcugccaucaaggcauuuauugcaguguacuauuugcuuccaaaggaucaggggaucacccugagaaagcugguacggggcgccacccuggacaucguggauggcauggcucagcucauggaaguacuuuccgucacuccaacucagagcccugagaacaaugaccuuauuuccuacaacagugucuggguugcgugccagcagaugccucagauaccaagagauaacaaagcugcagcucuuuugaugcugaccaagaauguggauuuugugaaggaugcacaugaagaaauggagcaggcuguggaagaaugugacccuuacucuggccucuugaaugauacugaggagaacaacucugacaaccacaaucaugaggaugauguguugggguuucccagcaaucaggacuuguauuggucagaggacgaucaagagcucauaaucccaugccuugcgcuggugagagcauccaaagccugccugaagaaaauucggauguuaguggcagagaaugggaagaaggaucagguggcacagcuggaugacauuguggauauuucugaugaaaucagcccuaguguggaugauuuggcucugagcauauauccaccuaugugucaccugaccgugcgaaucaauucugcgaaacuuguaucuguuuuaaagaaggcacuugaaauuacaaaagcaagucaugugaccccucagccagaagauaguuggaucccuuuacuuauuaaugccauugaucauugcaugaauagaaucaaggagcucacucagagugaacuugaauuaugacuuuucaggcucauuuguacucucuuccccucucaucgucauggucaggcucugauaccugcuuuuaaaauggagcuagaaugcuugcuggauugaaagggagugccuaucuauauuuagcaagagacacuauuaccaaagauuguugguuaggccagauugacaccuauuuauaaaccauaugcguauauuuuucugugcuauauaugaaaaauaauugcaugauuucucauuccugagucauuucucagagauuccuaggaaagcugccuuauucucuuuuugcaguaaaguauguuguuuucauuguaaagauguugauggucucaauaaaaugcuaacuugccagugauuaaa

SEQ ID NO: 171 - RNA, 1934 nt, Homo Sapiens
cggcugaggcgccucgaagggcaagcgccaagggggcgcgggcgccgccggaagcuggggcggggcgcccagcgggaugcggugaagggcgagcggcgcggcggcugcgaugagugccucugcggccaccggggucuucgugcugucccucucggccaucccggucaccuaugucuucaaccaccuggcggcccagcaugauuccuggacuauuguagggguugcugcccucauccuguuccugguagcacugcuggcucguguccucgucaaaagaaaaccaccccgggacccacuguucuauguguaugcaguuuuuggauuuaccagcguggugaaccucaucauaggacuggagcaagauggaaucauugacggguucaugacacacuacuugagagagggugaaccguaucugaacaccgcauaugggcacaugaucugcuacugggauggcucugcucauuaucugauguaccuggugaugguggcagccauagcaugggaauuuuuuuguuguuguuguuacagggaaacuuauagaaccauuggccuauauuggguuggaucuauuauuaugaguguuguuguuuuugugccaggaaacauuguagggaaguauggaacacgaauuugcccugcuuuuuucuuaagcauaccauauacuugucuuccugucugggcugguuucagaaucuauaaucagccaucagaaaauuauaauuaccccucaaaggguuauucaagaagcccaagcgaaagaccugcugagaagaccauuugauuuaauguugguugugugucuccuccuggcaacuggauuuugccuguucagagguuugauugcuuuggauugcccaucugagcucugccgauuauauacgcaauuucaagagcccuaucuaaaggauccugcugcuuauccuaaaauucagaugcuggcauauauguucuauucuguuccuuacuuugugacugcacuguauggcuuagugguuccuggauguuccuggaugccugacaucacauugauacaugcuggaggucuggcucaggcucaguuuucucacauuggugcaucucuucaugcuagaacugcuuaugucuacagagucccugaagaagcaaaaauccuuuuuuuagcauuaaacauagcauauggaguucuuccucagcucuuggccuaucguuguaucuacaaaccagaguucuucauaaaaacaaaggcagaagaaaaaguggaauaaaaauauuacuucauguuccuccuuucuaaauuacuaacuuuuguuauacugguacugauauuuugucccauuucacucucuucucauacgugaguacuuaagaauauguacauucuugcucugcacuguaugugugagcuauaugguauuguguaaauuuuuuuugaaggaaaauggaaauucuugagaaacaguuuguuuaaagaaauauauucaaaaucauuugugaauaaacuugaucauccaucucaauauuguuugacauauaaaauaauuauaaguguaaaaaauuacaauuuagugccaacaguagugagcaugaaaugaaacuauucaaaagagaauauggccugugcauauuaaaaaauucaaaacagugaaugcagacuggaggaguaacuuuugcaaauaagaugaauaugcuucauuauuaaacucaauauaaaaggcaaaucaucagaauauuuuuaaauguuguuugaaaaauguuuucccaaggaaaguuuauuauuugcugcuguuucaagaaaauuacuuuuacuaaauuuuuuugugugaauuuaaacagcuaaauagggaucaguaacuuuaucucuauccuuaaugaacauuuguuuuauugguggcuggaaauauuucuauuguauuucuguguauauuuuuaauaaaauuauuuuuggccucuua

SEQ ID NO: 172 - RNA, 107 nt, Homo Sapiens
gugaucacuucagcagcacauauacuaaaacuggaacgauacagagacgauuagcauggccccucugcaaggaugacacacaaauucaugaagcauuucuuuuuuuu

SEQ ID NO: 173 - RNA, 5437 nt, Homo Sapiens
gccugggggugggcgucuucucucaaccgaagcugggaguuggggagcuggaggguccaggaugagaauucaguggcgcuacuaccccggagcugcuugugguucagagaucagaaagguguccugaggacuggaggcagaaauccaggcguggcguacuggaaggcgcacuaggggagggcagccuggcccagaauuucuuugcauuuuaaaggccacacauucagucuccccggggcgcuacggagguagucaccgccacauccaggacuccuuccacagaggagucauugcaguuuucaguagagguguacuucugagaaguggcuucuugggucuucaugcagccauggaucuggauaaaccaucuguuuggggcucauuaaaacagcggaccaggccauuguugaucaacuugagcaagaagaaggugaaaaagaacccaaguaagcccccagaucuacgggcaaggcaucacuuggaccgccgucucagccucucugugccugaucuccuggaggcugaggccuuggccccagagggccggccuuacuccgggccacagucuuccuacaccucggugcccagcagucuguccacugcagggaucuuucccaagagcagcaguagcuccuugaaacagucugaagaagaauuggauuggagccaggaagaagccagucaccuccaugugguggaaacagacucagaggaggccuaugccucuccugcugagcggagacggguguccagcaacggcaucuuugaucuucagaaaacuucccuuggaggggaugcaccagaagagccagagaagcuauguggaagcagugaccugaaugcuucuaugacaucucaacauuuugaagaacaaucugacagucaaaaguuugaaaugacucaaaaauuuaauugggcucauguaauacauauucaaaaacagacuugaauucuacaauauggccagcaggaguugaugcauuucuggaggaggaagugacugaguugcgggaagguaccgggggaagccagugauggcuugaguaaccuccccagcccuuuugcguaccuccucaccauacaccugaaggaaggccggaaccugguuguccgagaucgcuguggcacaagugauccuuaugugaaauuuaagcugaaugggaagacgcuguacaaaaguaaagucauauauaagaacuugaacccaguaugggaugagauaguuguauugccaauccaaagccuugaucaaaagcuacgugugaagguauaugaucgagauuuaaccacaucugauuucauggguucugcauuugucauucucagugaucuugagcuuaacagaacaacugaacauauuuuaaaacuggaagauccaaacaguuuagaagaugacaugggagugaucguguuaaauuugaaccuagugguaaaacagggugauuucaagagacaccguuggucaaaucggaagcgauuaagugccagcaagcugugacagcagguuugcaaaaccaaugaaaaaaacaguuuuccccaggcagggaggaauuuuuuuuauaauuaaauacugaaaguuggaauuccuaugaucaucaaagucacucucaggaauuagaagcaaguuuacaugucaucuuuauuuuuugcuuuaguccucuuugauacgcaaccuacggcucucugaguccuugaaaaagaaccaacucuggaacgggauuauaaguauaacuuuguuggaagggaagaaugucucaggaggaagcaugacagagauguuuguccaguuaaaacugggagaucagagguauaaaaguaagacacuguguaagagugcaaauccgcaguggcaggaacaguuugacuuucacuacuucucugacaggaugggcauuuuggacauugaaguguggggaaaggacaacaaaaagcaugaggaacgucugggcacguguaaaguggauaucucggcacucccucugaagcaagccaacugccuggagcugccacuggacagcugucugggggcucuccuuauguuggucacacuuacacccugugcgggggucuccgucucugaucugugugucugccccuuagcagaccucagcgaaagaaagcagauuacccagcgauauugcuuacagaacucccugaaagaugugaaagacgucggcauucuacaagugaagguuuuaaaggcagcagaucucuuagcggcagauuucucagggaagagugacccauuuugcuuguuggaguuaggcaaugaccgacuucagacgcauaccgucuacaaaaaccucaacccugaauggaacaaaguuuuuacauuucccauuaaagauauccaugauguuuuggaagugacaguguuugaugaagauggagauaaacccccagauuuucuuggaaaaguugccauucccuugcuguccauuagagauggacaaccgaauuguuauguacuaaagaauaaagauuuagaacaagcuuuuaaaggaguuauuuacuuagagauggaccuuauauauaauccggugaaagcaaguauuaggacuuuuacuccccgggaaaagcgcuuuguugaagacagccgcaagcuguccaaaaagaucuuaucaagagauguggaccgugugaaaagaaucacuauggcaauauggaauacaaugcaguuccuuaaaagcugcuuccagugggaauccacauuaagaaguacaauagcauucgcgcaccgcaaagaggaaccaccccugucuaugaaauguacccuuuucucuggugacauuggcccauccuuaugagcauaauaaaaucgcagaaucaaagcgcugcaagagaucuuaaaaccaccuaagucuaccacugagagcccaagaaucuuggaaggacuucacagcuggccucaugccuucacuuuauaucucagggcauuuucucucauuuguaaagggacuuguccuugaucaaauugguaaugucagccaugggaggagaaaucaagucucccgacugcaaaucuuuguauauuugguaucaugccauucauuucuguccugugcaaagaucacuauaaaaacuaauacgagguaugaguggucuaagagugugaauaucagucaugaucauuggugaaucugauuucugaauguuaugugguucugcuucuguuuucuacugccaauauaugcugaauguucucucuuagccaacaggcauagccucauauaaaaaaugggggaaaaaaaacauuuauuagcccaagaagccaauggguucaaggucacucccaacauuuuuaugccaucaaguauaucagcuccaaaagaggcuuuuccuuugccauugggggguauuuuguuugcugucguuuauuuuaguucuccacugcuucgguguagaggaccuaugcugccuguaggcuugaccuuuccuauacuuuuucugcugucugaaguugcuaaaacauuuggccuuaauaaaaacacuaauaaagguuuuauuaaucuguaguauuuuugaucacugucuggaauuuugaacuauauaugauccccuuggcauuguugcugaucuuugucuacaauuucaucagaccugugaaaggcaaggucagcagcauccaggacagccaggagagcacagacauagaugacgaggaggaugaagaugacaaggaaucugagaaaaagggguugauugaaagaaucuauaugguacaggauauuguuucaacuguucaaaacgucuuggaggaaauagcuucuuuuggagaaaggauuaagaacacauuuaacuggacgguccccuuccuuucaucucuggccuguuugauucuggcagcagccaccaucauuuuguauuucauuccacugcgguacaucauuuuaaucuggggcauaaauaaauuuacuaagaagcuucgaaaucccuauuccaucgacaauaaugagcuacuagacuuccucucuaggguaccgucugauguucaaaaggugcaguaugcagaauugaaacucugcagcagccacagcccccugcggaagaagcgcagcgcucucuagggcacacaccgacuuuggacagcagcacccaauauuguguuugguugaguagaccaauguuauggcuguuucagugguacccaagguguccuucugaaaugcaugcccuguggcacccucuguauacuuccuccuccuucacgugcacagacauacacacaugugcacacacccucaugcauggguguccuaguugcguagagggucagcccagcgaaaagcaacaaccccaagacugugaaagacuaacauccauucugaaauaggagauaacaaggcugccauggaucugaacaccaccuuccuugagaacagccaggagcccacuuggauucaagagugacuuugaacuuguuuucacaccuccaacagacucucauuaagauucaguuauuuccgcuccccagccccacacuccuuucagauuaucguucaugggcguaagucucuucucagaguuaacaagucuuugguagucauccucuguccaaauauuguauauuauuaaaaggcauuuuuaauaauuaccagaauuagcucaaaccuuuagggaucuuucagccaugauuauuaaggauauguaugugaauuuuugggaaaccucucggugcuggaugccagccuacagcaggguccauugcuggcaauggauggcccaggaaggucccuagagaucacucacuugaaaaaugagggucccaugaaaguauuugguugccuucugaugccacuucuucucacuuuacuuuuugcuuauuuucaaaauauuauaaaaugucaacauauaauuucagaaaggcagguggggguaggggagaaaugaaugaauaaauucucuagguauuuagaaagauaagaaacugaagaccgagagacuaauaaggcugcuuaccuaauuauuauaaucauuucauuugccugaauguuuuaagcaggaaguagaaauacuuuggcugcccaaauguaucuuuuguuccucuuagaaguaaaauaagcuacauacaauaaaaauuuauuucagaaccccauuucuagaaaauaccaccccagaguccucauuugauagcaucugucuccugcagaccucaucauuccacaguauuucccugccauguaaaaauccugacuuugugcguauauaaaauguaugcaauuaagucuguuuaaaugauauuuaaguuuuaaagacuguauuuuguugacacauacuuugugcaguuuuuauguauguauguauuauaaaaaaaguuaagguuaaaaagaucucauuuaauagugaguucacuauuuuuuuuuuuuugucucuggguuguaauuuaauaaucuucaaacaaaauguuuacgaaaaaugccaaagauucuaaaucuua

SEQ ID NO: 174 - RNA, 111 nt, Homo Sapiens
ggcuggucugaagguagugcaucaucuuaauugguuguucauacucaguuacagauaauacuccuuguucuacucuuuccccacuucucacuacugcacuugacuagucuu

SEQ ID NO: 175 - RNA, 6049 nt, Homo Sapiens
accgcuuccccggcagccgccauugucgcgcucggagccccucagcucaggcggccgaggcggaggcagcggcggcgggauggcggacgccaacaaggccgaggugcccggggccacugguggcgacagcccgcaccugcagcccgcagagccgccgggcgagccgcggcgagagccgcaccccgcggaggcggagaagcagcagccgcagcacagcagcagcuccaauggcguuaaaauggagaaugaugaaucagcaaaagaagagaaaucugacuuaaaggaaaaaucuacaggaaguaagaaggccaauagauuucauccuuauucaaaagacaagaauucgggcgcuggagaaaagaaggguccaaaucguaacagaguuuucauuagcaacaucccauaugacaugaaauggcaagcuauuaaagaucuaaugagagagaaaguuggugagguuacauacguggagcucuuuaaggaugcggaaggaaaaucaagggguuguggugugguugaauucaaagaugaagaauuuguaaagaaagcccuagaaacuaugaacaaauaugaucuuaguggaagaccccuuaauauuaaagaggauccugauggagaaaaugcucguagggcauugcagcgaacaggaggaucauuuccaggaggacacgucccugauaugggaucaggguugaugaauuuaccaccuuccauacucaauaauccaaacauuccuccugaagucaucaguaauuugcaggccgguagacuugguuccacaauuuuuguugccaauuaaucuugacuucaaaguugguuggaagaagcuaaaggaaguguucagcauagcuggaacugugaagcgggcagauauuaaagaagacaaagauggcaagagcagaggaaugggcacugucacuuuugagcaagcaauugaagcaguucaagcaauuucuauguucaaugggcaguuuuuauuugauagaccuaugcaugugaaaauggaugacaagucuguuccucaugaagaguaccguucacaugaugguaaaacaccacaauuaccacguggucuuggaggcauugggaugggacuugguccggguggacagccuauuagugccagccaguugaacauagguggaguaaugggaaauuuagguccagguggugaguauucuaacuuccucuuuucuuuuuaaaugauacauaugcuagcuaauaaagccuccauugauguggucuguaauaauguuuaaaggacucuaauuaauaguuagauauuuacggugucacuucauucugaaaaaggaaugaaaccuugagcacagcuaacaugaaagagauaggcagaagucaggaggguuucuuuggggccagcuauguuguagcuagccuuuuagcauuuuggauuuugaaaugucuugaaggcagaaggagaauauaucaucuaugaacaguauuuauggaguagcugaaaugcuaccauaucauaggcagcuaaaaucuguuuauccauuugggaagguggcuuuucagguaguuauuuggcugcucaccuggaagaacucacaguucauuuuuagagauugguuuuuaaacuuugguguuaggacccuuuuauauuuuaaaauuuguugagaacccgaaaaugcuuuguuuauguaguuauaauuaccaguauuuacuguauuauaaaugaaaaauuagaaauuaaaaaaauuacauauuaaaaaaugauaaacucauuacauguuaacauacauaaaaguuuuaagaaaauaaacuauuuuucaaugcaaaaaagaaauuggugaggagaguggcauuguuuuaccuuuccacacaucuuuuuaauguuuggcuuaauauugcuguuauaucuguuucugcacuuuaguuuuuugugauauuguacaucauauaguguuuggaaaauuacaccuuaaacucaagagaaugaggguaaaacaucaaauaaugucuuaguaguauuuggugacuuaaauaguuuugaccuauugaacccucaagagucccuggaccauacuuugugaauuacuguuuuaauugauggacuaauaaaugcuaucagauuccuauuuugucaagaugcuguagucacacuuuaaauuaugaggcucauuaucauaaucauucugauccaaacaaguuuucucccuuacccuuagacucucacaccuaccuacccucuccuaaauacauacuauuuauauuuugaaaauuuuuacugcucuuuuaacugcgauguuuagagaguccuuacauucuggccugaucucuaaaucugcuguaaugcuauuucugugucuaugcuggaaaaaaaaaaucauugauaguaguauuucuguguuuauuguggaaaaaaaagugaaugauuaccuaguucaagauauucucuaacugaauguuguggguguuacuagugaauuuugcuuucuugucugauaaauguucaaagaaacccuuuugaagauucaugauuagacagcugcuauggcauagcacuuuaaaccaugccuccuguacccuaccgcuucucuaguguuucauugugguuauaccagugguaucuauuuugcuauaaugcauuauaucaucuuuuagucauaaaaauaaaauauacuuaaaguaguaugggaauggaugguccagguuuuggaggaaugaauagaauuggaggaggaauaggguuugguggucuggaagcaaugaauagcaugggaggauuuggaggaguuggccgaaugggagagcuguaccguggugcgaugacuaguagcauggagcgagauuuuggacguggugauauuggaauaaaucaaggcuuuggagauuccuuugguagacuuggcagugcaaugauuggaggguuugcaggaagaauaggaucuucuaacauggguccaguaggaucuggaauaagugguggaauggguagcaugaacagugugacuggaggaauggggaugggacuggaccggaugaguuccagcuuugauagaaugggaccagguauaggagcuauacuggaaaggagcaucgauauggaucgaggauuuuuaucggguccaaugggaagcggaaugagagagagaauaggcuccaaaggcaaccagauauuugucagaaaucuaccuuuugacuugacuuggcagaaacuaaaagagaaauucagucaguguggucauguaauguuugcagaaauaaaaauggagaauggaaagucaaaaggcuguggaacagucagauuugacuccccagaaucagcugaaaaagccugcagaauaaugaauggcauaaaaaucaguggcagagaaauugauguucgcuuggaucguaaugcauaauuucaagccaugguuggaacauuccuacaucuguuuugcugaaucuccuaguaaaagucauuuuuuuaaaguaauauuguaugcuuacaaaagcuguaaaaaugaacuuuuaaaacucccaccagcuuuuaacaguauaauguuaaaaauauacuguaauuuuuguuaaucucaaguuuggguuuuuaaagacagcaagucuggucauucaguuuaaaugaaugguuauacuguuuuuaaugaaauaagccauuuucuuguuguuuucaguacuacauaguuggauuuguuuguucuaguuucuccaguuuuugucaacuuauuguaugguaaaacauagauuuuuuccccccaaacuucuguuuuauaauauguaauuuuucaugaaaagaaagggcucagaaaaauuaggaugugauuuugguugguuuuaaauuacuguaaguuuuagauucuaagguucaagauuuuuaaaauuugauuuaaaugaagaaauggauuuuucucucugccccucccugccauucauauuuucugcauaacacuauuaauaauaucaaccuccacagccccuuauuuuauuauuuccaauaauuccaaguucauauagaacugauaauguagcaagccccaaguaugauaauaggcagacuauucccaacuuucugucuaguuuccagccauugaagugaacugcuaaaaaaagaaaaauaauugaaauguugagagagaugguuauguaaguuaguccucugcuguuuacuucugcaggagcugauccauuuauaaaugcaguuuuaauaaaccauggaauaccaaggcacaacauaucaaacacauuggaucccacgauguuagacauagccauaucuccuuucccuacaaaagaaaagcauacuguuaaaaugugcuuaccaauacuguguuuuauuaauaaucuucauaagaaaagaaacacuggauacuuuuuuguuguugauucguuuugaaaaauuguuguuagagcaaaagucuuacugaauuuguauuuuuaaauuuuucuuggguuaguauuuaaagucuuaacauuuauuuaauaauuauauuuauuaaaccauuuuucaauaagguauauagcuuauuuguugcuuuucauuguaauuuaacaugguuaaugguuaauuacuauuuaacacacauuucaaaugaauauuauuugggggauuagauugagugaaauuaaccugcuauuaaauaguaaacuuuuccucuggagucacuuuuuucccccuucaaaguauguuacugaggaaguaaacuuuuuuuuuuuuuuuugguuuuuguuuuuugagacacagucucgcucuguugcccaggcugcuggagugccguggcgcaaucucggcucacugcaaccuccgccuccuggauucaaacaauucuccugccucagccuccugaguagcugggauuacaggcacaugccaccacgcccggcuaauuuuuguauuuuuaguagagacuggguuucaccauguuggucaggcuggucucaaacuccugaccucgugauccacccgccucggccucccaaaauccugggauuacaggcgcgagccaccacacccggcuggaaguaaacauuuuuaaagcuacuuuuacucauucuagccuuguagaaugaccauugcagcuugagggaccuaguucuuaccuuuucuugcaaccaacacacuugcaauugugucugguaugcuuguuccugcugcuaauaaaguaaggcccauuacuguaucgggaauuucuaguguuuccccuguaauaaacagauauuucaaguuacaaaucuuaaagauucacuaaccauccuuugcaguuauuuuggauauuuccuucgugaacaaaaauaaaauaggcacauuuagaauucagagccaauaugugcuugcuuauuaguuuuuuagcuagcaacauauuugaaucaggcugguaauucggguaacccagguagcacagauuuuuaaugacauaucuaaagauacguaacagcuaaaauucugccagugagaaauuuuccuguuugauauucuuacaaaagauguuuauguccaccauuaucucaucagggcugugcugaauauuugauaaugagacugaucauuccgcuuuuucuuucuuaaaaauauuagucagaguuaagcaaauuaauuauagcuaucuuuaagcuauaaauguguuaacauguauauauaccauuuauuauguucuacuuuagugauauaccuuaauuuagugggcuuuggcagggcgggggagggggaacguucauuaaucucugaggaaaacaaaaccuguuuucuacuugagucuaacauauggucccaauuuauuaauacuucuguuaaauuugaugucaggucaacauuuuucagaaauguauuuauucucagaaacagaaccagagagaaguuaaacaaaagguuauguaacuguuccuuuaauguuguaauugaaaacuugguuuagcgucuuuuuuuucuuucucuuuuuuuuucuuaaaaugccaacuaaaauaauuagaaaguagcuuauuuauugcaugcuuauacauugauauuggaauuggaauugguuguuaauuucuguuacuggcuuugcuagaauucauaugugcauaaauaacacuaauauuuaucauc

SEQ ID NO: 176 - RNA, 7886 nt, Homo Sapiens
acggcaugcacugcggcgcccagccggucaccgccugccggcugcagacgccugcgagcagguuguuuuuauaagaggcgucauuggcgcccgagcugugaccgccgccacuggggcagccagcacaaucgggcggagguggcgcugccccuucagccgugcgcgagugcacagcuccggaggcccgagccgacccuggggcguccgguccgguggucuugcagccuccaaaccccgagugcuauaccgaacugcgcgccaagggugggagagcugacggccugggccacccuucuuccuucacugggcaggcuuugaggugcuugucggucuggacugaugaaaauccauaugaccugaaagaugucugaaaauuccagugacagugauucaucuugugguuggacugucaucagucaugaggggucagauauagaaauguugaauucugugacccccacugacagcugugagcccgccccagaauguucaucuuuagagcaagaggagcuucaagcauugcagauagagcaaggagaaagcagccaaaauggcacagugcuuauggaagaaacugcuuauccagcuuuggaggaaaccagcucaacaauugaggcagaggaacaaaagauacccgaagacaguaucuauauuggaacugccagugaugauucugauauuguuacccuugagccaccuaaguuagaagaaauuggaaaucaagaaguugucauuguugaagaagcacagaguucagaagacuuuaacaugggcucuuccucuagcagccaguauacuuucugucagccagaaacugauagcuguugugucacuuccucaugcugacauauuuacuagaggguaaaauuaauaaccuucuaguaagaguggcagucgaagggaagggcucaucugacuucuggaaaccuauguuaaaauacagugcuuugaaccuugaucaugggcuaauuagguuggaaaugaaacuagagaccagauacacccaaggaaacuuuugguaguuauuuuacuuuauaagucacaggaaaugcuuguguacuuuccuguguuccuuaaauaguugcacuuaaauuaccucuuugaaacugaaugaagagacagagaguauuuuuuuucuuuccagaaauaauacuuguuuauaccuguaauagcaaugaaauuuuguuucuuuugagacagaguuuugcucugucucccagucuggaguauaguggcaggaucucagcucacugcaaccuccaccucccagguucaagugauucuccugccucagccucccaaguagcugggacuauaggugcacuaccaugcccggcuaauuuuuguauuuuuaguagagaagggguuucgccauguuggccaggcugaucucgaacuccugaccucaggugaucugcccgccucggccucccaaagugcugggauuacaggcgugagccacugcuccuggccagcaaugaaacuugaggcuaugcgaaugaaggauuguucuaagaguguaaacuauaaggcgaggaggauuaaauaaaaaaacagagauaggcucucaaagcaccaaauaguaugauuaacagauucuuguguaucacauuugaaaugcuuuauguuuuggcuuuauguugaugaguugaaaacccguguuuuuguuuauguuguuugguuuuuguuuuuggcuaucuuauguagaaaggcauguaagggauggcauugauuauucuaaauaauuuuuacugggaaagcuuuuccaagauuuugaauagcuaaaugucaacuuuuuucuuaauaguauuuucaucucagccuagugacgaugaaucaaguagugaugaaaccaguaaucagcccaguccugccuuuagacgacgccgugcuaggaagaagaccguuucugcuucagaaucugaagaccggcuaguugcugaacaagaaacugaaccuucuaaggaguugaguaaacgucaguucaguaguggucucaauaaguguguuauacuugcuuuggugauugcaaucagcaugggauuuggccauuucuauggcacaauucagauucagaagcgucaacaguuagucagaaagauacaugaagaugaauugaaugauaugaaggauuaucuuucccagugucaacaggaacaagaaucuuuuauagauuauaagucauugaaagaaaaucuugcaagguguuggacacuuacugaagcagagaagauguccuuugaaacucagaaaacgaaccuugcuacagaaaaucaguauuuaagaguauccuuggagaaggaagaaaaagccuuauccucauuacaggaagaguuaaacaaacuaagagaacagauuagaauauuggaagauaaagggacaaguacugaauuaguuaaagaaaaucagaaacuuaagcagcauuuggaagaggaaaagcagaaaaaacacagcuuucuuagucaaagggagacucuguugacagaagcaaagaugcuaaagagagaacuggagagagaacgacuaguaacuacggcuuuaaggggggaacuccagcaguuaagugguagucaguuacauggcaagucagauucucccaauguauauacugaaaaaaaggaaauagcaaucuuacgggaaagacucacugagcuggaacggaagcuaaccuucgaacagcagcguucugauuugugggaaagauuguauguugaggcaaaagaucaaaauggaaaacaaggaacagauggaaaaaagaaagggggcagaggaagccacagggcuaaaaauaagucaaaggaaacauuuuuggguucaguuaaggaaacauuugaugccaugaagaauucuaccaaggaguuuguaaggcaucauaaagagaaaauuaagcaggcuaaagaagcugugaaggaaaaucugaaaaaauucucagauucaguuaaauccacuuucagacacuuuaaagauaccaccaagaauaucuuugaugaaaaggguaauaaaagauuuggugcuacaaaagaagcagcugaaaaaccaagaacaguuuuuagugacuauuuacauccacaguauaaggcaccuacagaaaaccaucauaauagaggcccuacuaugcaaaaugauggaaggaaagaaaagccaguucacuuuaaagaauucagaaaaaauacaaauucaaagaaaugcaguccugggcaugauuguagagaaaauucucauucuuucagaaaggcuuguucugguguauuugauugugcucaacaagaguccaugagccuuuuuaacacaguggugaauccuauaaggauggaugaauuuagacagauaauucaaagguacauguuaaaagaacuggauacuuuuugucacuggaacgaacuugaucaguucaucaauaaguuuuuccuaaacggugucuuuauacaugaucagaagcucuucacugacuuuguuaaugauguuaaagauuaucuuagaaacaugaaggaauaugaaguagauaaugauggaguauuugagaaguuggaugaauauauauauagacacuucuuuggucacacuuuuuccccuccauauggacccaggucgguuuacauaaaaccgugucauuacaguaguuuguaacauuuguagauuggauagcauuuuuaugauuugaugaguuucuuguaagguuaccguuucuaagaguugugcuuuauggccacugagagaauucagaauaaauugaaagauggagucuaaaaauuauuagcuguuacaaauggaacauuucauuauaacgugaucacuuugacuugagcaaaugguuuaauuuuuaucuuaaaaaucaguuaagaauauauaaaauccuacuuuggccaaguuuguuucuuuucauuauaguuuauaugaaaagaucaccuuaagugaaauuauuuuccuuuaaucuuuuauguauuuauucacuuuuggaagcuaggaaugagcaacacaaauuuuacucugaagucagaagagcucauauauaauaauucuaaugucccaccuauuuucacuuguccauuccauguaccagcuuaguuaugauacuuagucacauaauuaucuuugauaaagguagaggcacaaagaggcaaacuaagcaagucaaauucuaauguguguacuucauaauaauuuuuuauccauuuucaucuuuauauucuguaacaugaaacuuaccuaaucuucaaauguuagcuucauuuuuuaccuuugaaauacuuaaucuuucugaauaaauauaaugugucuauaaaauaaugagacugauucuggugucuuuagucauuaagcugguaucuaguccuauaaugaacaaaggugaagcugccuugaggagacaagugaaaaauuuuugcuucaaaggagcucacaagcuaaguaaauaaaugaaauuaagguauggggcaugguggccucaggcugucuggagguguuuggaaaggcuucuugagugagguggccuuugaacugaacuuaguuuuuaaaguagcuuuuggaagagaaaugaggauuugcuaugcagacagggaagggaauuucacuuaaaaggaaggucauuuggagaugugaagauacacugcuuuaaggaagcaggguagagcuggaggauaagagaugcagaccaugaagggccccauuuuaugcuaaagguuuuguccuguaggacauggagaacuucugaagaauuuucaaggcgggugggauaagauuauauuguauuuuagauuacaguaguccccccuuaucuucaggauauauguuccaagacccccaguggaugcuggaaaccagggauagaacauaauucuauauauacuaugcaugaauuucuuuuuccuucuuuacaaucucacacauagguuuguucuuacuauagaucuuaccaaucucagcauacuuuuauuucucuugagaaccuucacccuuucacuuaaaggaggcgcuuuauagcuucucuuuggcauauccaaaugccagcaucacuguuguauuuuggggucauuauuaaguuacuuaaucauccuuaauccuuaucuuagggauacuugaacacaaacacugugguaggauaacaguauaucugauuaacagacugcuacuaggugauuaauggguggguaguguaaauacacaagaaaaggaugauucacaucccaugugggauggagcagaacugcauuauuucauuacauuacucagaacaggcauauaauugaaaacuuaugaauuauuuuuuuuuaauuauuugagauggaaucuugcuuugucagccaggcuggagugcagugacacgaucucagcucacugcaaccucugucuccuggguucaggugauucuccucccuagucucccaaguagcugggacuauaggcacgugccaccacacccggcuaauuuucauauuuuuaguagagaugggguuucaccauguuggccaggcuguucuugaaauccugaccucaagugauccacacaugucuaccucccaaagugcugggauuacagucgugagccacuguaccccgccuaaaacugaugaauuauuucugaaauuuucuauuuaacauuuucagaccacaguugaccacagguaacggaaaccucaaucacagaaaguaaagccguggauacggugggacuaauguauugguagcagccuagaggauugaugggaaagguaugaagcuagaagguggucaauauaauacagacaugagcugaugaacaucuaaacugggacuauacuaguaggagaggaaaggaaaaaacauuuggaaaauaguaacauugauauuucuugugaaggagaaguagaaaguaacagugacuucuagauuucuggguugggucaucuuguuggauaguaguaccacugagauagggaauucaagguuuggggcaaggguaauuggagaugagaauuguguuuggagguaacuacugacauucaaguggagaggguuaguuggcaguuaguucuauggucaucucuuuugccgagacuguauauuuaucagacuccugggagaacaccaacauccaugggguuguagggaaggcuaaggacaggaguggggagugguaccuugaaaauccaaaagccaucucaaguaaaaggaauaaaugugucaugcuuuuuaaaaaguugaugugcggaaaauguuuucuuggcuuggaaacugggcggccaggggaugacaguauggacuuccagugaaguagugacggaagccugaucauagacauuaaggaaagcgguguagguguugugagcuuuugcuguaagaaaaaguugagacuuuuguuuugcuuuguuugugagagauguguauguauuucugcugagugauaaagccagcggggagggacugauuuuuauaggaaaggaggaaaaauaauggaaacacaucucauuauuuuauugucacauuucuuuucuuuguuaucuuuugaguguuucccuuuuuugccaguagaguuauugucuauuuuuucuuucuauaggacaaaaaaacuaauacagacuccuuuauuuuuauauggauauacuaggauuguaauucagauauuuaauaucuuuuaucaguguucagaucauagauuaauggagaaaacauuuaaaauuguuuuaaauuuaaauacauugaacucuaacauagaugaaaaauguguuuacugcuuucagucgaccugauaaaaagcaacguaugguaaauauugaaaacuccaggcaucgaaaacaagagcagaagcaccuucagccacagccuuauaaaagggaagguaaauggcauaaauauggucgcacuaauggaagacaaauggcaaaucuugaaauagaauuggggcaauuaccuuuugauccucaauacugauucacaauugaguuaaauuagacaacuguaagagaaaaauuuaugcuuuguauaauguuugguauugaaacuaaugaaauuaccaagaugacaaugucuuuucuuuuguuucuaaguaucaguuugauaacuuuauauuauuccucagaagcauuaguuaaaagucuacuaaccugcauuuuccuguaguuuagcuucguugaauuuuuuuugacacuggaaauguucaacuguaguuuuauuaaggaagccaggcaugcaacagauuuugugcaugaaaugagacuuccuuucaguguaagagcuuaaagcaagcucagucauacaugacaaaguguaauuaacacugauguuuguguuaaauuugcagcagagcuugagaaaaguacauuguucuggaauuucaucauuaacauuuuauaaucuuacacucacuucuugucuuuuuguggguucaagagcccucugacuugugaagaauuugcugcccucuuaagagcuugcugacuuguuuucuugugaaauuuuuugcacaucugaauaucguggaagaaacaauaaaacuacaccaugaggaaaacuaaaggucuuuauuuaaaaucuggcauuguauuaacauguaauuuuauacuaugugguauuuuauacauuuccucaguagugauauuugguaaagcaguucauacagcuuuuuucuaaguuccaugaaucuuacccaguguuuaccgaaguauuuaagcagcaucugaauauuuccacccagcaauguuaauuuaucuaggaaaguucagaauuucaucuucauguugaauuucccuuuuaacuuccguucauagacauauaugugacuuccaauucgacccucuggcaagugaguguggaagaaaacagcaguucuuuuauaauugcuugaaauuaggaaagcgcuuauuuccuagaagcaaauaaauguuuaaguaaauaaaggcuacauuuugcug

SEQ ID NO: 177 - RNA, 2406 nt, Homo Sapiens
uucucacuguguccgggucagcugcugccgccgacgccguaccgcugcggccgggggauugggccggggucuccaccgccgaccgaggggagcgggcuccgcucggcccugcuuuuugcgaccuggccgucagccccacgucgccggccuggaggggcgaagaggacgagggggccaaggcuuccuccggggacauuggcucccuggauuaucaagaguuuguaguugacauugaauccaggcugaggauggaagguguggaacuuaaagaagaauggcaagaugaagauuuuccgauaccuuuaccagaagaugauaguauugaagcagauauacuagcuauaacuggaccagaggaccagccuggcucacuagaaguuaauggaaauaaagugagaaagaaacuaauggcuccagacauuagccugacacuggauccuagugauggcucuguauugucagaugauuuggaugaaaguggggagauugacuuagauggcuuagacacaccgucagagaauaguaaugaguuugagugggaagaugaucuuccaaaacccaagacuacugaaguaauuaggaaaggcucaauuacugaauacacagcagcagaggaaaaagaagauggacgacgcuggcguauguucaggauuggagaacaggaccacaggguugauaugaaggcaauugaacccuauaaaaaaguuaucagccaugggggauauuauggggauggauuaaaugccauuguuguguuugcugucuguuucaugccugaaaguagucagccuaacuauagauaccugauggacaaucuuuuuaaauauguuauuggcacuuuggagcuauuaguagcagaaaacuacaugauaguuuauuuaaauggugcaacaacucgaagaaaaaugcccagucugggauggcucaggaaauguuaucagcaaauugauagaagguuacggaaaaaucuaaaaucccuaaucauuguacauccuucuugguuuaucagaacacuucuggcuguuacaagaccauuuauuagcucgaaauucagccaaaaaauuagauacguguuuaauuuggcagaacuagcagaacuuguccccauggaauacguuggcauaccagaaugcauaaaacaaguugaucaagaacuuaauggaaaacaagaugaaccgaaaaaugaacaguaaguuuggcaucuaguccaaacaagacugaagaaugugcugauggagcagugcuguuucugcauucauaaugcauuuauuggcccauauuuuuauguaaccuguuacaaaauagacuugacuuuuucauaauggacuuuuguauuauacaagggacuguucacugcuguacugguuugcaaauuucuugaauuuagcucuuuaauagcuaacuguauuauuaucguuuuauauuuuauauugcuaaauagagaaccacacuuuauauaaaguaguuuuugcauuuguuuauugaaugaugcaucuucuucggugaaauauuuauaugcauaaauggcaaaggaaagaaauaauauauauuuuuaugucauugagcaauauuuuuuaauguguaccugucuuauggaagaaauaugcagguauauaagaccacgauuuucuaaagugcauauuagaauuuuuguuuuuguaaaugguuaaauacauuuccuggguaacuuaggaaauuaaguuuuucauaaggcaacagaugguuaaacugauugucaugaauacccaaagaucauguauauaaucgaaguguauuaguaccaucccaagguuuuuuucucauuuaacauauuuguuucauaauucagcaaguacagaugcaagcgcauugcacacuuuuuccuuucuaaacuuaaagacaagucaaaaagccauucuuagaacuagaggauuuaagaggguaggaauuaggguuuguauauauguauauaugggacauuuuaucuucuggcccaaagucagaacuuuauaaaaaucuugaguuuguucacuaaugugaaauaagcuauguguccaggguauugcuccccugaguguauaugagugcugaguaguauugcagagaaugugaugaguuauucacugucacaacuuuuucuauagaaaacaggggcugcuuuuuaaacucucacuaugggcacuuuaccaaaauacuuccauaucaauuauuugaacucgguaguuguuugaccuaguuagaugugguguuuauucaaguuuguaugaaaucauguuugacaauacuguaaauuagguuaauuuuguaagucuuagcaucaucauauugugcuguuuuggauaacacguuuguuacaagcauuuaaacuguuucauuugguaguaccuuuacauugaaauaaauuguguuugugccuccaaacaaaaa

SEQ ID NO: 178 - RNA, 846 nt, Homo Sapiens
cacagccuacgcacgaaagugacuaggaggaaggauauuauaaagugaugcaaacagaaauuccaccagccuccauguaucaucaugugucauaacucagucaagcucagugagcauucucagcacauugccucaacagcuucaaggugagccagcucaagacuuugcucuccaccaggcagaagaugacagacugugaauuuggauauauuuacaggcuggcucaggacuaucugcagugcguccuacagauaccacaaccuggaucagguccaagcaaaacguccagagugcuacaaaauguugcguucucaguccaaaaagaaguggaaaagaaucugaagucaugcuuggacaauguuaauguuguguccguagacacugccagaacacuauucaaccaagugauggaaaaggaguuugaagacggcaucauuaacuggggaagaauuguaaccauauuugcauuugaagguauucucaucaagaaacuucuacgacagcaaauugccccggauguggauaccuauaaggagauuucauauuuuguugcggaguucauaaugaauaacacaggagaauggauaaggcaaaacggaggcugggggaaauggcacaaucacacaccuaugcugguagagucaguggcccacaagaagagauacuguugaccagaaaggacacuccauauugugaaaccggccuaauuuuucugacugauauggaaacgauugccaacacauacuucuacuuuuaaauaaacaacuuugaugauguaacuugaccuuccagaguuauggaaauuuuguccccauguaaugaauaaauuguauguauuuuucucua

SEQ ID NO: 179 - RNA, 1043 nt, Homo Sapiens
gcgcccgcuccucgcgcucacagcggcccgcgggccgggcgucaugggcggccucuucuggcgcuccgcgcugcgggggcugcgcugcggcccgcgggccccgggcccgagccugcuagugcgccacggcucggggcucccuccaucggcucugaaaagagggcccuccuggacccgggagcggacccugguggcggugaagcccgauggcgugcaacggcggcucguuggggacgugauccagcgcuuugagaggcggggcuucacgcugguggggaugaagaugcugcaggcaccagagagcguccuugccgagcacuaccaggaccugcggaggaagcccuucuacccugcccucauccgcuacaugagcucugggccugugguggccauggucugggaaggguacaaugucguccgcgccucgagggccaugauuggacacaccgacucggcugaggcugccccaggaaccauaaggggugacuucagcguccacaucagcaggaaugucauccacgccagcgacuccguggagggggcccagcgggagauccagcugugguuccagagcagugagcuggugagcugggcagacgggggccagcacagcagcauccacccagccugaggcucaagcugcccuuaccaccccaucccccacgcaggaccaacuaccuccgucagcaagaacccaagcccacauccaaaccugccugucccaaaccacuuacuucccuguucaccucugccccaccccagcccagaggaguuugagccaccaacuucagugccuuucuguaccccaagccagcacaagauuggaccaauccuuuuugcaccaaagugccggacaaccuuuguggugggggggggucuucacauuaucauaaccucuccucuaaaggggaggcauuaaaauucacugugcccagcacaugggugguacacuaauuaugacuucccccagcucugagguagaaaugacgccuuuaugcaaguuguaaggaguugaacaguaaagaggaaguuuugcacaccca

SEQ ID NO: 180 - RNA, 73 nt, Homo Sapiens
gcccagcuagcucagccgguagagcacaagacucuuaaucucagggucguggguuugagcccuguguugagca

SEQ ID NO: 181 - RNA, 71 nt, Homo Sapiens
aucgagaaagucauacagguuaugggauuggcuugaaaucaguuucuggagguucaauuccuuuuucguuu

SEQ ID NO: 182 - RNA, 103 nt, Homo Sapiens
uugcuuuggcagcacauauaccaaaauuggaaugauacagagaagauuagcauggccccugugcaagaauaauacacaaauucgugaagcauuccauauuuuu

SEQ ID NO: 183 - RNA, 2895 nt, Homo Sapiens
auggagucagggcagccggcucgacggauugccauggcgccgcugcuggaguacgagcgacagcuggugcuggaacugcucgacacugacgggcuaguagugugcgcccgcgggcucggcgcggaccggcuccucuaccacuuucuccagcugcacugccacccagccugccuggugcuggugcucaacacgcagccggccgaggaggaguauuuuaucaaucagcugaagauagaaggaguugaacaccucccucgccguguaacaaaugaaaucacaagcaacagucgcuaugaaguuuacacacaaggugguguuauauuugcgacaaguaggauacuugugguugacuucuugacugauagaauaccuucagauuuaauuacuggcaucuugguguauagagcccacagaauaaucgagucuugucaagaagcauucaucuugcgccucuuucgccagaaaaacaaacgugguuuuauuaaagcuuucacagacaaugcuguugccuuugauacugguuuuugucauguggaaagagugaugagaaaucuuuuugugaggaaacuguaucuguggccaagguuccauguagcaguaaacucauuuuuagaacagcacaaaccugaaguuguagaaauccauguuucuaugacaccuaccaugcuugcuauacagacugcuauacuggacauuuuaaaugcaugucuaaaggaacuaaaaugccauaacccaucgcuugaaguggaagauuuaucuuuagaaaaugcuauuggaaaaccuuuugacaagacaauccgccauuaucuggauccuuuguggcaccagcuuggagccaagacuaaauccuuaguucaggauuugaagauauuacgaacuuugcugcaguaucucucucaguaugauugugucacauuucuuaaucuucuggaaucucugagagcaacggaaaaagcuuuuggucagaauucagguuggcuguuucuugacuccagcaccucgauguuuauaaaugcucgagcaaggguuuaucaucuuccagaugccaaaaugaguaaaaaagaaaaaauaucugaaaaaauggaaauuaaagaaggggaagaaacaaaaaaggaacugguccuagaaagcaacccaaagugggaggcacugacugaaguauuaaaagaaauugaggcagaaaauaaggagagugaagcucuuggugguccaggucaaguacugauuugugcaagugaugaccgaacauguucccagcugagagacuauaucacucuuggagcggaggccuucuuauugaggcucuacaggaaaaccuuugagaaggauagcaaagcugaagaagucuggaugaaauuuaggaaggaagacaguucaaagagaauuaggaaaucucacaaaagaccuaaagacccccaaaacaaagaacgggcuucuaccaaagaaagaacccucaaaaagaaaaaacggaaguugaccuuaacucaaaugguaggaaaaccugaagaacuggaagaggaaggagaugucgaggaaggauaucgucgagaaauaagcaguagcccagaaagcugcccggaagaaauuaagcaugaagaauuugauguaaauuugucaucggaugcugcuuucggaauccugaaagaaccccucacuaucauccauccgcuucuggguugcagcgaccccuaugcucugacaaggguacuacaugaaguggagccaagauacgugguucuuuaugacgcagagcuaaccuuuguucggcagcuugaaauuuacagggcgaguaggccugggaaaccucugaggcaaagaaagguuuacuuucuuauauacggagguucaacugaggaacaacgcuaucucacugcuuugcggaaagaaaaggaagcuuuugaaaaacucauaagggaaaaagcaagcaugguugucccugaagaaagagaaggcagagaugaaacaaacuuagaccuaguaagaggcacagcaucugcagauguuuccacugacacucggaaagccgguggccaggaacagaaugguacacagcaaagcauaguuguggauaugcgugaauuucgaagugagcuuccaucucugauccaucgucggggcauugacauugaacccgugacuuuagagguuggagauuacauccucacuccagaaaugugcguggagcgcaagaguaucagugauuuaaucggcucuuuaaauaacggccgccucuacagccagugcaucuccaugucccgcuacuacaagcgucccgugcuucugauugaguuugacccuagcaagccuuucucucucacuucccgaggugccuuguuucaggagaucuccagcaaugacauuaguuccaaacucacucuucuuacacuucacuuccccagacuacggauucucuggugccccucuccucaugcaacggcggaguuguuugaggagcugaaacaaagcaagccacagccugaugcggcgacagcacuggccauuacagcagauucugaaacccuucccgagucagagaaguauaauccugguccccaagacuucuuguuaaaaaugccaggggugaaugccaaaaacugccgcuccuugaugcaccacguuaagaacaucgcagaauuagcagcccugucacaagacgagcucacgaguauucuggggaaugcugcaaaugccaaacagcuuuaugauuucauucacaccucuuuugcagaagucguaucaaaaggaaaagggaaaaagugaacagugauggcuguuuucuuaucccaugccuguacuuuucagcggcuccuugccagacaucauaggucauuauuaauuauugguuugcuauuucauucuuuuccaaugcucuuaaugauuguacgguggaccaga

SEQ ID NO: 184 - RNA, 108 nt, Homo Sapiens
ugugcucgcuuuggcagcacuuacacuaaaauuggaaugauacagagaagauuagcauggccccuacacaaagaugacaugcaaauuugugaagcauuccauaaauuu

SEQ ID NO: 185 - RNA, 2167 nt, Homo Sapiens
gaguuggcgcugcgggccgggcgggggccgcggaagcugcgaugcggacagggcagcggcggugacccgagcugccgcccgacaugaacucgcuggagcaggcggaagccccgcgaguuguaucccugauuccugcggugguuuccgguaacugccaagaucucaaggcuuuugagaggagacuuacugaauauauucauuguuugcaaccugcuacuggacgcuggagaaugcuucuuauagugguaucugucuguacagcuacuggugccuggaacugguuaauagacccugagacacaaaagguguccuucuucacaucauuauggaaucacccauuuuucaccauuagcuguaucacucuaauaggcuuguucuuugcuggaauacacaagagaguaguugcaccaucaauguauccuuuaccaaggauuaaauucuauagcugcucgaugucgaacgguauuagcagaauacaauaugucuugugaugauacaggaaaacuaauuuugaaaccuaggccucauguucaaugacaaucuucacucauuguuaugggacuuaaaauagccuuucuucgaauaagugauacagcaaaaagccauaaaggauuccuuuugcgguuggauauguaaaggucauagcagcaacugacaagaagugugcaauauuuaccuggauuaucuugaugauggugacucauuaucagugcuuugguacuuuugauuaccuguguuucaguauuagugucacuuuaguacuucagauccugcaaauauuuuugcagaugaaguauguauguauguuacuaaguuaaacuuagaaacagaaccucauucaguuuuuauaauguauuuuugcaaacuacuguaaauagcaaaucaaugccaauguuaaacaaagaggaaaacguuguguggacuuuguucucuugcaccaguauuucaggaacaucugcuugccauccccacagcucuuuaaaacuggcuauuaugugugccuuucauucuuacauuucuaaucauacugcaggaaaaacauuggauucagcuuagacugaggaaaacucuccauuauguuguaagaaauuauagauguuuugagagacacuuuuuguuaaaccagauauugaacuccagcaacuauugugguuauauuuuuaguucauuguucucauuuaaugcuaaauauccuuuauauugcuuuaauaauuuucuuuuuuuuuuuuuuuuuuuuagacggagucucgcucuguugccaggcuggagggcaguggcacgaucuuggcuuucugcaaccucugccucccagguucaagcgauucuccugcuucagccuucugaguagcugggacuacaggcgcaugccaccaugcccagcuaauuuuuuuguauuuuuaguagagacgggguuucaccacguuggccaggaugguuucgaucuccugaccucgugauccuccugccucauccucccaaaaugcugggauuacaggcauaagccaccgugccuggccucuuuaauaauuuuuaaaauacccuaaaggcuugugaauauacaagucuacugauaaauuauguauugucugggaauuugauagucauuguuuuagauaacuggauuuuacgcugugguagacaggcugugacacuaguguugcacagguguaauuggucauccuaugccuucaccagaauaacuugggaguggugccagaaacuagagucuacaauucucacuguuuagagaguguuaaugacauacuguguaugcauaauagccgcauguacuauaauagcccuuaaaauuaaacuauugggauugcuguaaauauuuuaaaguacuggaggugccuuuuaccuguuuauuagauuuugaaaagguuuaaauuauuucaugagcaaucuuuuaaauuucauuuaacauaaagcugaaaauucaauaacaggauaaaaaagcuuuuuaacaaggcugccauuuaacuuaaauguguucaucuuagcuuucacuuguauaaaauuugauucuuugaacugcagcaauaaaacccucagcuccuaagaagucuuaagaggguauucuauauauucugcuuuguuuuauuuucuguaaauuuuguagguaaauaugugcauuaaaaauaaauacuuuauauauaacucguga

SEQ ID NO: 186 - RNA, 1016 nt, Homo Sapiens
cacauguaaacuacuugaacuccauuucaucuuuuuucauaccaucucuaagauugcugccgcauuugcuuguuaaacugaaagcauguuucuugcaaaggcucuauuggaaggagcagaucgaggucuuggagaagcucuuggaggccucuuuggaggagguggucagagaagagaaggaggaggaagaaauauuggagggauaguuggaggaauugugaauuuuaucagugaggcugcagcagcucaguauacuccagaaccgccucccacucagcagcauuucaccaguguggaggccucagaaagugaggaaguuaggcgauuucggcaacaauuuacacagcuggcuggaccagacauggaggugggugccacugaucugaugaauauucucaacaaaguccuuucuaagcacaaagaucuuaagacugacgguuuuagucuugacaccugccggagcauugugucugucauggacagugacacgacugguaagcugggcuuugaagaauuuaaguaucuguggaacaacaucaagaaauggcaguguguuuauaagcaguaugacagggaccauucugggucucugggaaguucucagcugcggggagcucugcaggccgcaggcuuccagcuaaaugaacaacuuuaccaaaugauuguccgccgguaugcuaaugaagauggagauauggauuuuaacaauuucaucagcugcuugguccgccuggaugccauguuucgugccuucaagucucuggauagagauagagauggccugauucaagugucuaucaaagaauggcugcaguugaccauguauuccugaagugggaacugagaagucaagauccucccuggaggacaggacugaaaaccuugccaagcuguacacaguugcugauacccugugcaacagcucucauuuccuggcaagcucuuucacaacccuacauauuucugaucaugugcugccuuuuacugcugaauuaaaacagauauuucacgaaaaa

SEQ ID NO: 187 - RNA, 4625 nt, Homo Sapiens
agggccgggaaacacgauaaaggggacaugccgggaguugcaguacccucaggaagguagcgucuugaucugcguggcgugguucugugccuugggaagagaugaaugggaagcggccagcggagcccggcccagcccgggugggaaaaaagggaaagaaggaggugauggcggaguuuucggacgcuguuacggaagaaaccuugaaaaagcagguggcugaggccuggagccgcaggacgccguucagucacgaagucauugucauggacauggacccuuuucuucacugugugaucccaaacuucauccaaagccaagacuucuuagaagggcuucagaaggaacugaugaacuuggacuuccaugagaaguauaaugauuuauauaaguuccagcagucugaugauuugaagaagagaagagagccucacaucuccacuuuaaggaaaauucuguuugaagauuuccgguccuggcuuucugauauuucuaaaauugaccuggaaucaaccauugacauguccugugcuaaauaugaauucacugaugcccugcugugccaugaugaugagcuggaagggcgccggauugccuucauccuguaccugguuccucccugggacaggagcaugggugguacccuggaccuguacagcauugaugaacacuuucagccgaagcagauugucaagucucuuaucccuucguggaacaaacugguuuucuuugaaguaucuccuguguccuuucaccaggugucugaagugcugucugaagaaaagucacguuugucuauaaguggcugguuucaugguccaucauugacucggccucccaacuacuuugaaccccccauaccucggagcccucacaucccacaagaucaugagauuuuguaugauuggaucaacccuacuuaucuggacauggauuaccaaguucaaauucaagaagaguuugaagaaaguucugaaauucuccugaaggaguuucuuaagccugagaaauucacgaaagucugugaggccuuggagcauggacauguggaauggagcagccgaggucccccuaacaaaagguuuuaugagaaagcugaggagaguaagcuuccugagauauugaaggagugcaugaaguuauuucgcucugaggcacuauucuugcugcucuccaacuucacaggccugaagcuucauuucuuggccccuucggaagaagaugagaugaaugauaaaaaagaggcagaaaccacugauaucacugaagaagggacuagccauaguccuccugagccagagaauaaucagauggccaucagcaacaacagccaacagagcaaugagcagacagacccagagccagaggaaaaugaaacaaagaaagaaucaaguguucccaugugccaaggggaacugaggcauuggaagaccggucacuacacuuuaauucaugaccauagcaaggcugaauuugcccuagacuuaauucuguacuguggcugugaaggcugggagccagaauauggcgguuuuacuucuuacauugccaaaggugaagaugaagagcugcuaacagugaauccagaaagcaauucuuuggcauuggucuacagagacagagagacucugaaauuugucaagcauauuaaccaccgaagccuggaacaaaagaaaaccuucccaaacagaacagguuucugggacuuuucauucaucuauuaugaaugacagcacugggcaaagcugaacaaaaaugugacccuucguaauuacugggaagucugaaagagcuaagcauggagucaaggagaacuacaugguagcuugccugacaguguucuuaaaacugguugucuuuuacuaggacucauaaugauuguccucaaccgagaccuugagcuugcagcuaaguacuuaucucuugauuaaaaaaaaaaaguuggcuuuuuuuuuuuuaacauuuaguccuuuuuccauauuggcuucuucagugaauuuuuaaguucaauuuguuuuuauugagguaaaauauuuauaacauaaaacugaccagcuuacccauuuuuaaauaugcaauucaguggauuaaguacauucucauuguuguccagccaucaccaucauccaucuccagaaguuuuccaucuucccaaauucugugcccauugaacaauaacuccccaccuccccuuccccuagcaacagccauaccuuuugucucuaucaucaacuucacuacucauauuucucauguaaguggaaucauacaguauuuguccuuuugugacugguuucacuuagcauaaagucuuuaagaugcauccauguuuccaguguuucgguuuuuuuagaaaaacucauacgugauugcagccgggcaugguggcucacgccuguaaucccagcacuugggaggccaaggcaggcggaucaccugaggucaggaguuaaagaccagccugacaaacauggagaaaccccaucucuacuaaaaauacaaaauuagcugggcgugguggcacaugccuguaaucccagcuacucaggaggcuggggcaggagaauugguugaacccaggaggcggagguugcagugagccgagauugugccacugcacuccagccugggcaacaagagugaaacucugucucaaaaaaaaaaaagaagaaaaaaacauaagugauugcagaauuuuguucuucucauaauuucugguuuagaaaauuauggagccuuacauccugaucaugcugggccuuagaauucugacacagugagucaucacauuuccucccacugccuguggccuuguuccaccaugacucucacaguacaguguaggcuuaguguaguauuauucccuuggaaagggucuggccuaccaucacaugccccaagaaacuucugguugguaaagaagauaggcugcuuauugccauguguagucacuuccaagugcccacugccuuuccauccugcaauuguggccuguguauaauuaaaugauuuuagccucacguguugcuucuguuuuccuaaauacuguagggucaacuauauaacuaauugcuuuuuauuuuaagagacggaaugcuaaaaccacaucagaaugccaagaggcugugcaucuuguuaauuuuuuucuugaacuguuccagggaguuacaucauaauuaccuguguguggguaugcauggguggaugaaagaugcuguucucauuccaucccaauagagucuucuguuuccuuucucuuuuuuacauuuauuuuuagcuuuugcaguaguguuuaguguggguuuuacuaauuaauagaaaaagcacugggccuuuaaacuucuuaacuacucuucucuuucaucuccuaaaacuuuugaguauucauucuuuucugaaguuugcauuuaaaugaaaaugacuuucgcuuuggcuuuuagguuuaguuucaaaaagguuuaauucugcacccuagccaguuaagaaauguuuuagcagguaugcccuugauauggauauuuauauauuuuacacauguaguaauauuauuucuauaacuuacuguuauaaaacacuaauuuuuaaaugaugagauaaaaagaaauaucuagaacuaguucuaacauugucuuccccuaugcauaugguaacgaaccauuuuacaccauacuauuuuggagaccacaauuuuuuuugcguuugagauggagucucacucuguggcccaggcuggaguacaguggcaugauaucggcucacugugaccucugucuccuggguucaagcaauucuccugccucagccuccuaaguagcugggauuacaggcaccugccuccauacccagcuaauuuuuuuauauuuuuaguagagacaggguuucaccauguuggccaggcuggagaccacaauuuuuuaaccacaguguagcaacacucaagugggauugcgaauacuguuacuaaugguuaaugucacagcuugccuuuucuauauuccagcugacuaaaggucaucucacucacuugccuucugauguguuuucaugaguugaggggaaagggugucaguggcauaacuucaggaagacccagggaaaagugcuuggguaggugaaacugucaugugugccaagcuuggaaaauaguuugagacucauggcuguaggcaccauccaaggccaauuuuccaauucuggaaagccaaaucugaaucuuagaauaccucacaaguguuaaaaugugcuuuuuagugucuccuuuaucucaguguguuuaugaucugucaacacauaaucaucuuuuauacacuacaaaaagggacucgggugucugaggggagagaaucccuaggagcccaacucugauguugcugucaguuacaucaucuacagcagcaccucuuagauugugaaggaugguguaacuuaaaagauuguguuucugcacugaagauagauacacagugauagugaaguuuguuuuccuuauaguacuucauuuugcaucuugauugcuuuuuagggccuggggccaaugucaacaacucuuagguagcaaaagaagaauuagaacaugggcaucuuuuuuauaccucuuucagauaaaagcuaugauguucaccugu

SEQ ID NO: 188 - RNA, 437 nt, Homo Sapiens
auggaucccaacugcuccugcgccacucgcuccaccacgccguccgggugggccuagcagucgcuccauuuaucgcuugagaucuccagccuuaccgcggcucgaaauggaccccaacugcuccugcaccacugggugucuccugcgccugcaccggcuccugcacgugcaaagagugcaaaugcaccuccugcaagaagagcugcugcuccugcugccccgugggcugugccaagugugcccacggcugugucugcaaagggacguuggagaacugcagcugcugugccugaugugggaacagcucuucucccagauguuaauagaacaagcugcacaaccuggauuuuuuuucaauacgauacugagccauuugcugcauuucuuuuuauauuaaauaugugagugacaauaaaacaauuuugacuugaaucuua

SEQ ID NO: 189 - RNA, 1052 nt, Homo Sapiens
cggaacacgcugggaggaggguggaaggcaaccucggggaaacugggaaaggcggccuggacuucgggaacaccgcguaccugcgggggcacagccccacccgagcgaacgggcuccaaaggggaggucccgcggugcccaccgcgcagagcucaggggguggugcgcccggcccuucugcggcgcacagcccagcccaggaacgcgggcggugcggacucagcgggccgggugcaggcgcggagcugggccucugcgcccggcccgaccuccgucuauaaauagagcagccaguugcagggcuccauucugcuuuccaacugccugacugcuuguucgucucacuggugugagcuccagcauccccuuugcucgaaauggaccccaacugcucuugcgccacugguggcuccugcacgugcgccggcuccugcaagugcaaagagugcaaaugcaccuccugcaagaagagugagugcggggccaucuccaggaaucuggggcuguggcucagguugggagggaacucaaggcuggcccugagugcauccuucuggggaacugggcuuucuuugcccucauugcccgugucauucccucuccaggcuuucugcccuaaauucagauggggcaggacagcauuuuucucgugggacacaaaccccaacuguacccccuaugguuucagaacagagcugugccagacgaaaaaaagcauccucugggucuggguucugagcucgagccaggcuugcuauuagggcagggaggugcccggucaagucuacugccaccucucacucuccccuucuuccccaggcugcuguuccugcugccccgugggcugugccaagugugcccagggcugcgucugcaaaggggcaucggagaagugcagcugcugugccugaugugggaacagcucuucucccagauguaaauagaacaaccugcacaaccuggauuuuuuuaaaaauacaacacugagccauuugcugcauuucuuuuuauacuaaauaugugacugacaauaaaaacaauuuugacuuuaa

SEQ ID NO: 190 - RNA, 408 nt, Homo Sapiens
cgcuccaccacgccguccacgugcgccuugcggucucuccauuuaucgcuugagaucuccagccuuaccgcggcucgaaauggaccccaacuacuccugcaccacugguggcuccugcacgugcgccggcuccugcaagugcaaagagugcaaaugcaccuccugcaagaagagcugcugcuucugcugccccaugggcugagccaagugugcccacggcugcaucugcaaagggacgucggagaagugcagcugcugugccugaugugggaacagcucuucucccagauguuaauagaacaaccugcacaaccuggauuuuuuuuuuauacaauacugagccauuugcugcauuucuuuuuauauuaaauaugugagugacaauaaaacaauuuugacuugaaucuu

SEQ ID NO: 191 - RNA, 465 nt, Homo Sapiens
caucuuggcuccugugccugugccggcuccugcaaaugcaaagagugcaaaugcaccuccugcaagaagagugagugcagggccuucccugcgaaucugggggaugggccaaguuagagcagggaacccagagcucugcaggcaggggcaggccaaugaccagcuuccccaaaccccuccuucaacaccugauucagaaucagaccucaaauugccuuaaaaaugggcugcugcuccugcugcccugugggcugugccaagugugcccagggcugcaucugcaaagggacgucagacaagugcagcugcugugccugaugccaggacagcugugcucucagauguaaauagagcaaccuauauaaaccuggauuuuuuuuuuuuuuuuuuuuguacaacccugacccguuugcuacaucuuuuuuucuaugaaauaugugaauggcaauaaauucaucuagacua

SEQ ID NO: 192 - RNA, 109 nt, Homo Sapiens
gcuuguccucagagaauuagguaacuuguucaaaauggucagaagcaacagauauaacuccuugcucuacucuuuccccccuucucacuacugcacuugacuagucuuu

SEQ ID NO: 193 - RNA, 1002 nt, Homo Sapiens
cgacagccggaagucccgccugccguguagucgccgccgucgcugccgcugccgcugccgccgucguuguuguugugcucggugcgcugagcuccgcggcuccgcgagccgguuccguccccuucccgccgccgccaugaaguggauguucaaggaggaccacucgcuggaacacagaugcguggaguccgcgaagauucgagcgaaauaucccgacaggguuccggugauuguggaaaaggucucaggcucucagauuguugacauugacaaacggaaguacuugguuccaucugauaucacuguggcucaguucauguggaucaucaggaaaaggauccagcuuccuucugaaaaggcgaucuuccuguuuguggauaagacagucccacaguccagccuaacuaugggacagcuuuacgagaaggaaaaagaugaagauggauucuuauauguggccuacagcggagagaacacuuuuggcuucugagggccauugcugggcuaggugcaccguaacugcuuguguaucuuguaaauagccagccauuuucaguuauuauaccagaaccucuucacauagaccuauuagugcauuuguaacuggauuuauuucuuaauauauuggaagguuuuguuuccuuagacuaguaaauuaucauacagaguuuuauuuugaguuuuucuuuuugugcauuguccucaugccuguauucuccaggaaacuuguccuucuggaaaucauauugaaugauauuucuauaucgaagugagguaggugcgguauuaaagugaaagggaaggugaugcauuuauucuggguuaugcuugaaguguuagauggcuaaguauuaaaauuauccaaauuaaauccuuagcagucagaacacuugcuucacuagaauaugccaacugccaaucauguuggacugagcuaauuuguuccucuuucugaaacuauuaagguaaauaauuaacaauaaaaauucucuuauaaaggca

SEQ ID NO: 194 - RNA, 2665 nt, Homo Sapiens
uggagcgcggcagcaagcgugggaacgcgggcggcgagacggcggcaggacggcggcaggaugugugaccggaaugguggucggcggcuucgacaguggcugaucgagcagauugacaguagcauguauccaggacugauuugggagaaugaggagaagagcauguuccggaucccuuggaaacacgcuggcaagcaagauuauaaucaggaaguggaugccuccauuuuuaaggccugggcaguuuuuaaagggaaguuuaaagaaggggacaaagcugaaccagccacuuggaagacgagguuacgcugugcuuugaauaagagcccagauuuugaggaagugacggaccggucccaacuggacauuuccgagccauacaaaguuuaccgaauuguuccugaggaagagcaaaaaugcaaacuaggcguggcaacugcuggcugcgugaaugaaguuacagagauggagugcggucgcucugaaaucgacgagcugaucaaggagccuucuguggacgauuacauggggaugaucaaaaggagcccuuccccgccggaggccugucggagucagcuccuuccagacuggugggcgcagcagcccagcacaggcgugccgcuggugacgggguacaccaccuacgacgcgcaccauucagcauucucccagauggugaucagcuucuacuaugggggcaagcuggugggccaggccaccaccaccugccccgagggcugccgccugucccugagccagccugggcugcccggcaccaagcuguaugggcccgagggccuggagcuggugcgcuucccgccggccgacgccauccccagcgagcgacagaggcaggugacgcggaagcuguucgggcaccuggagcgcggggugcugcugcacagcagccggcagggcguguucgucaagcggcugugccagggccgcguguucugcagcggcaacgccguggugugcaaaggcaggcccaacaagcuggagcgugaugaggugguccaggucuucgacaccagccaguucuuccgagagcugcagcaguucuauaacagccagggccggcuuccugacggcaggguggugcugugcuuuggggaagaguuuccggauauggcccccuugcgcuccaaacucauucucgugcagauugagcagcuguauguccggcaacuggcagaagaggcugggaagagcuguggagccggcucugugaugcaggcccccgaggagccgccgccagaccaggucuuccggauguuuccagauauuugugccucacaccagagaucauuuuucagagaaaaccaacagaucaccgucuaagugcgucgcuugggcgccccaccccgucugcguccugcauccaucucccuguuacaguggcccgcaucaugauuaaagaauguggaucccucugucuggggugggaugccuuacuuugcacuuaauuuaauaagggcauucucggaggaguagacguuuaauacgaaguggcggcauagcccugccgagaugucggugauggccuggaugcuguaaccacaaccuguggcuaaaaauuuuauuuucuauccuuuacccgucauuaucauuaguugcuaugauucuuucugcauuuucgguuaacuaucauuuccaaagacuugucauucaguaauauuagcagauagcugcuucgauaaaggaauuuggaguuuaaaaaucaacuugugaaaacaagguuguuuuugucuuuaucguuuguuagaguuauagauuuaugauuucauaggcuugauucuaugugaaauaucuuuuuacuuuuaugcauuuuaauaagauuuaaaaauauuuagauuaaagcccccuuuaaugaguacaagaaaaacucuuggcuuguuagaagaaaguauauucuuucuagaauuuggugcaggaauauguguucauauccaggcaaacggguguguuuuuaucuucagacaaugaaaccuucuccucuggggcuuuguugccaggaagauuagaacuaaauuuauuuuuuucauuucugucaugaaaucauuccagauaccucuuuucuucuuuccaaaugguuuucacauguguuugaaauauuuguacuucgaauugucggauuuuccauguccuccuuucuccuuugugcccagccugagucagcaccaaucccgcauucagaaccucccagugaaagggcagccuucauuuugagaagguggaagguguuaggguuugggagacagcucauccaaucucccaagucucaugguggauuugugacugugagaguuuccgguuuaaaaucugaaaagccagauaugccuguuuccuuuucccagcaccaugccuguggaggggacagucagacccagagguccuuuacguguggauggaguucacaggcgaauagaggagaggaccaggggacguggcuugucccuuuuguccaacaaagcauuauauuuuuaagaauggcagaccuguuugcugaaguguucauaagauaacaauaggcuugaaucuccaauucaaaugaaugucaaagcacauaucuuuaauaugcugaaugaauauuuauuuuuguauccauuaaaacaguauauugaucucuuuuauucuuuauuaaaauaaaaugcucuuuuuuaaa

SEQ ID NO: 195 - RNA, 4134 nt, Homo Sapiens
guacgugcgcgucucccugccgccgccgccgcccgccgcgggccgccccggggccgccgucgccgacgacgcgcgggaggaggaggaggaggccgccccgccgccgccgccgccgccgccgccccggcucgccgccgcccgcccgccgggcucgcagccccggcccccggccgcaggcgaggcccaggccgcggccgacaugaaccaccagcagcagcagcagcagcagaaagcgggcgagcagcaguugagcgagcccgaggacauggagauggaagaugcagucacucugaugugggugagagaaccucccccaucccccagcagaggccacugcagagccaugcagagauggcugggaaccacaggcuugggcuggaagcgggagauacagaugacccaccaagaauuacucagaacccugugaucaaugggaauguggcccugagugauggacacaacaccgcggaggaggacauggaggaugacaccaguuggcgcuccgaggcaaccuuucaguucacuguggagcgcuucagcagacugagugagucgguccuuagcccuccguguuuugugcgaaaucugccauggaagauuauggugaugccacgcuuuuauccagacagaccacaccaaaaaagcguaggauucuuucuccagugcaaugcugaaucugauuccacgucauggucuugccaugcacaagcagugcugaagauaauaaauuacagagaugaugaaaagucguucagucgucguauuagucauuuguucuuccauaaagaaaaugauuggggauuuuccaauuuuauggccuggagugaagugaccgauccugagaaaggauuuauagaugaugacaaaguuaccuuugaagucuuuguacaggcggaugcuccccauggaguugcgugggauucaaagaagcacacaggcuacgucggcuuaaagaaucagggagcgacuuguuacaugaacagccugcuacagacguuauuuuucacgaaucagcuacgaaaggcuguguacaugaugccaaccgagggggaugauucgucuaaaagcgucccuuuagcauuacaaagaguguucuaugaauuacagcauagugauaaaccuguaggaacaaaaaaguuaacaaagucauuugggugggaaacuuuagauagcuucaugcaacaugauguucaggagcuuugucgaguguugcucgauaauguggaaaauaagaugaaaggcaccuguguagagggcaccauacccaaauuauuccgcggcaaaaugguguccuauauccaguguaaagaaguagacuaucggucugauagaagagaagauuauuaugauauccagcuaaguaucaaaggaaagaaaaauauauuugaaucauuuguggauuauguggcaguagaacagcucgauggggacaauaaauacgacgcuggggaacauggcuuacaggaagcagagaaaggugugaaauuccuaacauugccaccaguguuacaucuacaacugaugagauuuauguaugacccucagacggaccaaaauaucaagaucaaugauagguuugaauucccagagcaguuaccacuugaugaauuuuugcaaaaaacagauccuaaggacccugcaaauuauauucuucaugcaguccugguucauaguggagauaaucaugguggacauuaugugguuuaucuaaaccccaaaggggauggcaaaugguguaaauuugaugacgacguggugucaagguguacuaaagaggaagcaauugagcacaauuaugggggucacgaugacgaccugucuguucgacacugcacuaaugcuuacauguuagucuacaucagggaaucaaaacugagugaaguuuuacaggcggucaccgaccaugauauuccucagcaguugguggagcgauuacaagaagagaaaaggaucgaggcucagaagcggaaggagcggcaggaagcccaucucuauaugcaagugcagauagucgcagaggaccaguuuuguggccaccaagggaaugacauguacgaugaagaaaaagugaaauacacuguguucaaaguauugaagaacuccucgcuugcugaguuuguucagagccucucucagaccaugggauuuccacaagaucaaauucgauuguggcccaugcaagcaaggaguaauggaacaaaacgaccagcaauguuagauaaugaagccgacggcaauaaaacaaugauugagcucagugauaaugaaaacccuuggacaauauuccuggaaacaguugaucccgagcuggcugcuaguggagcgaccuuacccaaguuugauaaagaucaugauguaauguuauuuuugaagauguaugaucccaaaacgcggagcuugaauuacugugggcauaucuacacaccaauauccuguaaaauacgugacuugcucccaguuaugugugacagagcaggauuuauucaagauacuagccuuauccucuaugaggaaguuaaaccgaauuuaacagagagaauucaggacuaugacgugucucuugauaaagcccuugaugaacuaauggauggugacaucauaguauuucagaaggaugacccugaaaaugauaacagugaauuacccaccgcaaaggaguauuuccgagaucucuaccaccgcguugaugucauuuucugugauaaaacaaucccuaaugauccuggauuugugguuacguuaucaaauagaaugaauuauuuucagguugcaaagacaguugcacagaggcucaacacagauccaauguugcugcaguuuuucaagucucaagguuauagggauggcccagguaauccucuuagacauaauuaugaagguacuuuaagagaucuucuacaguucuucaagccuagacaaccuaagaaacuuuacuaucagcagcuuaagaugaaaaucacagacuuugagaacaggcgaaguuuuaaauguauaugguuaaacagccaauuuagggaagaggaaauaacacuauauccagacaagcauggguguguccgggaccuguuagaagaauguaaaaaggccguggagcuuggggagaaagcaucagggaaacuuaggcaauugcgcugcuagaaauuguaagcuacaaaaucauugguguucaucaagaagaugaacuauuagaauguuuaucuccugcaacgagccggacguuucgaauagaggaaaucccuuuggaccagguggacauagacaaagagaaugagaugcuugucacaguggcgcauuuccacaaagaggucuucggaacguucggaaucccguuuuugcugaggauacaccagggcgagcauuuucgagaagugaugaagcgaauccagagccugcuggacauccaggagaaggaguuugagaaguuuaaauuugcaauuguaaugaugggccgacaccaguacauaaaugaagacgaguaugaaguaaauuugaaagacuuugagccacagcccgguaauaugucucauccucggccuuggcuagggcucgaccacuucaacaaagccccaaagaggagucgcuacacuuaccuugaaaaggccauuaaaauccauaacugauuuccaagcugguguguucaaggcgaggacgguguguggguggccccuuaacagccuagaacuuuggugcacgugcccucuagccgaagucuucagcaagaggauucgcugcugguguuaauuuuauuuuauugaggcuguucaguuuggcuucucuguaucuauugacugcccuuuuugagcaaaaugaagauguuuuuauaaagcuuggaugccaaugagaguuauuuuaugguaaccacagugcaaggcaacugucagcgcaaugggggagaagagguuaguggaucgggggucccuggcucaaggucucugggcugucccuagugggcacgaguggcucggcugccuuccuggggucccgugcaccagcccugcagcuagcaagucuuguguuuaggcucgucugaccuauuuccuucaguuauacuuucaaugaccuuuugugcaucuguuaaggcaaaacagagaaacucacaaccuaauaaauagcgcucuucccuucaaaaaaaaa

SEQ ID NO: 196 - RNA, 4623 nt, Homo Sapiens
aggaacagguaccaagguuggguggaagaagcuauauggcuggagccagcuucaagggcuugaggagccaccgacaccacuuccagaauggcugcuaugcugccucuacuggauucagguugcagucgggaggcggggcaggaggcggggcuugggcggguaucacuccaccccuuucacgauugcagaccggccuuaggaccuggcgcagcacggaaugaggcuucgaggccggcuaggggaggccgucgcucauauccgacgucaccaguucgcgccggcgauagacgaggacgccaacagcagcggagaaacguuucucuuuccucucaguuugcgcacaccauggcggccccugcccagcagacuacucagccuggcggcgggaagcgcaaaggcaaggcucaguaugugcuggccaagcgcgcucggcgcugcgacgcuggcgggccccgucagcuagagcccgggcuacagggcauccucaucaccugcaauaugaacgagcgcaagugcguggaggaggccuacagccuccucaacgaauacggcgacgacauguaugggccagaaaaguuuacagacaaggaucagcagcccucuggaagugagggagaggaugaugaugcggaggcugccuugaagaaagaaguuggugacauuaaggcaucuacagagaugagguuaagaagauuccagucaguggaaaguggagcaaauaacguugucuucaucaggacacuugggauagagccugagaaauuggugcaucauauucuccaggauauguacaaaaccaagaaaaagaagacucgaguuauuuugcgaauguuacccaucucaggcacaugcaaggcuuuuuuagaagauaugaaaaaauaugcagaaacauuuuuggaacccugguuuaaagcuccaaacaaagggacauuucagauuguguacaaaucucgaaauaacagucaugugaauagagaagaaguuaucagagaauuggcaggaauagugugcacccucaauucagaaaauaaaguggaucucaccaauccacaguacacagugguaguagaaaucaucaaagcugucuguugccugaguguugugaaagauuacauguuguuuagaaaauacaaucuccaggagguggugaagagcccuaaggauccgucacagcuuaacucaaagcagggaaaugggaaagaagcuaaacuggaaucugcggacaaaucagaccaaaacaacacagcagaaggaaaaaauaaccagcagguaccagagaauacugaggagcuggggcagacaaaaccaacgucuaauccacaggugguaaaugagggaggagccaaaccugaacuugcaagucaagccacagaaggauccaagucaaaugaaaaugacuucucauaggaagucauuugguguuggagguggguuucucaccuggggcucuacgagauguugcuggggcuccaccuuaaauugugacuaaaaacaguuuuuuauuugugugcugcauuaugcuguucucacaguagugagcaaugauugcgcagcccuguuaacaguuuuuuuagggaucuuucagccuuuaugguauuacguagaggcagacccaugugcugcuguugcaaagaggggaggauaggagggggauguuggccucucccaggcuccucuucugcagugccagcugacuuaagggagugaacuaccugugaaguagaaaaucagagggaaguuuucauucuaaggaaggaguuuuuacaugccacagcucagcugucugccugccacuuuguuguaaacauugcaaaaauguggaucauguagguuagaagugaauuguuuagugaaguuuuuguacuuuugugauuuucuuguuuaugucuguuuuuuuuuuuuuuuuuuaacauuuguguguaauauagcugacaguccagugucgcaauuuuggaaggcaagaugugagagagacgagaaccauuuuaggcauagaacuacagacauuucugaaaagguuggugaugaagaacuucagucuucugaguauacuucaguauacuagugcaacaagggacacaaagaaauucugucuuaauaaagaaagcuacuucucaaggguauuauguggacucaguccaagcucuccugucccauugugcauugucugugacaugcaacuuacaaaacuagcaauuguaacaauaaaucacagccacuugacaagaaaggauauucauuauuuucaaauggcuuuuggacuaucaaaaacaguaaggcuuuuguucagaaaucaccuuuagucaaaagguuuaagaagcaaauuauuuaguagcagaacuuaucucaggaaaggaaaauaugcaugguuggugagaaucuaauaacauuaaaaugcuggggcaagaugcaguacaaaguugaagagacuuuauucucaauaaguugauuuacugaugauaugucauaugaugcaaaaaagguuuugugucauuaacugaaaaguagcagcuucucuauccaggaugaugagucaacagguuucacuaauauuugucaugcuguagcauuuguaagauuuguaaaugaugaaauucaaagaaaacuuuuucuauugcuaggagccugccagaacaaaggccaauauauaauguugugacaucauaucugauaaccagaggucugguaucuacacuccuggugccccaucagugguugucuccauaagucauuuugcguuauuaaaaaaaaaaaaagaaauccugauguugacauuauagcacacugcuuucuccacagagaugcugauaucaaaaacuugaagauacagugaaguucugaauaauguuacaaaacugguuaccuguaucaaagacccauuuaugcaaaaauguuaaaaaaaaaaaaaaacacccaaaacaaaaaccuggacagacagcacauaaaccuccugcaccauacagacauccaguggcuucucagaggaagcguucucuacaggauauuugaauugaaaggugaauugccagaguacuuacaauaaaacagccagcuuuugcugagugcuuuggaaaugaaaaaugacuacagaaaguagccuauuuugcagacguuuuucaucacaugaacaaauggacaagucucugaaagguucuggggaaaaaaauuuuucuuaaagcgacaagacucuuagaucuaaaaggaaacugacuugccaccuugccagaggaauucuugaaauguuucugcagccacuuggccuugaaaauaaagggugcaacucucaaaucuuguucuaacccggcuggaggaaccacaagacccaaugaaauagcauuuucucuccuuuucccagcacuaguauauaaccuaugaggaacccuugucucugaaucugcucagcuugaaauuuugucucugaaggaagagaaugaacucagcccuagucugacaguccuagauuucugugaaauaagaguauucuucaacuuagugcucacacucacauaccaugaggguucucugcagggguuuagggguuuccugaauuugaaaguuuuuucaaggccucuuuuuggguaaaacaauugaaaaggcagacaccaacaaagucugcaaaauuaacuguccagauuaagaauauuaaggagcuguaaaauuagcuuguagaaauggacuuauccuuaaguuuuaaaaaguuaggaaauccuaaaaauguuaggcuuccugcacaaguggcuauguucauuuaauggcuagugaacaugggaauguauuuuuauccuccuagcuggugguucuguuugguaaaccagacuagaaugauuugagaggggcaaagagaauaggcaggaccuuccuucuauagcuuuacauauuuagaauguuaauacuuaaugacauugaaguuaccuugcaaugauugauaagaggauuauuaauaucaguuaggggaauagggaggauaggauuuuggugccuucuucagcagacuugcuccaagacaaagauucuauuuugauagugcaagacaaaaggacucggaagaaaauuggccauaugccuacagagcauacaacucuguggaacuaaauuguuuuuacuuugugaaagcugcuauuuuacggaaagauuuugauuauacaguuuguuuuuaaauugucuuuuauauuuauuuguauuugguaagaaucgguuguuacacaagcuguucuuucccaguuacaaaauccuguguucgguuguaaccugaacucauuaaaagacuuguuuucagguuuaucaacuguuuauuuucacugacauuugagcauguuauuuuauaaaugacgggauuccaggguaggaagugcuuuuuauuccccuuuuguuuuuucuuuuaaaaaauuacgucaguuaaaaaaauaaaaaaacugcagucuuaugguuuagaaaacuuguuuagcuccauagaggaaagaauguuaaacuuuguauuuuaaaacaugauucucugagguuaaacuugguuuucaaauguuauuuuuacuuguauuuugcuuuugguacggccagaaaucgagcuuguuuuuucauaguuccugauauuuucagaaaaaucaaaauaaauuuguucccuaaaaa

SEQ ID NO: 197 - RNA, 2351 nt, Homo Sapiens
guaccccuccaggugccuccuugagggcagugaccccaagcgccagacgcuugagaagcuugggaggaugacguaggguggagccugcgaccuaauccucccaucacaaggggcacgcgaaaagcaacccaucugcagggcgcucuggagccucucuagccgccuagagccugcgagagcaaaggcggcuggagacuuagggggcggggaguaaagugaggacugcaccaaaucuccuggccucuuggggacgcaaagacucaggaggaggaauuuuaucgccuuaucuuugccuccaggaagucauacccuccacaaaaggaaagcagagauuuuuauucggucuucucuuuuacccuuuccuuuuccguuucuaacuuugcuugacguuaaugguuccuuccucccucuccuccucugcgcuuugguacgagccaagggagaggggcggagggaggaaaagggaaaggaagccgacaggccuuaaaggggccgcaacuauuuuuuuaagccacuuuuuccucucuccaauuuugcaacgacgggcgcggaggaggagguucccggaagccacgcgcagcuggagcagcggcgaccgcagcuggaggcccggagcgccugcggggcuggcagaggcgagggagguugcggguaggaagggcggacugcgcgcgcccccugcgucccgcgcaccucggggccgguccaugcucccgacggcugcgggcuucagcaucuggggccagguuggggcggcgggguccagggcgcagguggugcggccgaugcgccgggccggaggcugaggccgcgcugcggggcugggacagcacuggcaucuccagagcaggcccggggcagcaagggaggcgccgcgaugccagacgaaaauaucuuccuguucgugcccaaccucaucgguuaugcccggauugucuucgccaucauuucuuucuacuucaugcccugcugcccccucacggccuccuccuucuaccugcucagcggccugcuggacgcuuucgauggacacgcugcucgcgcucuuaaucaaggaacccgguuuggggccaugcuggacaugcugacggaccgcugcuccaccaugugccuguuggucaaccuggcccugcuguacccuggagccacgcuguucuuccaaaucagcaugaguuuggauguggccagucacuggcugcaccuccacaguucugugguccgaggcagugagagucacaagaugaucgacuuguccgggaauccggugcuucggaucuacuacaccucgaggccugcucuguucaccuugugugcugggaaugagcucuucuacugccuccucuaccuguuccauuucucugagggaccuuuaguuggcucugugggacuguuccggaugggccucugggucacugcccccaucgccuugcugaagucgcucaucagcgucauccaccugaucacggccgcccgcaacauggcugcccuggacgcagcagaccgcgccaagaagaagugacgcuggagccccggguccuggcugcccaccugcccugggagucuugcugugccacacagcuccccacccccugcuaggaggucccagucucacgccuuccucauguguuguucuaccugcugggaugggggucagccucucuuuggugacgucacguucucugggauccugaggacccgggccucaaaucagggaggauacgcgggaggcccccuccauccaggcggugcuccuggggugccgggaccgggcagugucacacccugccugcucaguccugggguccgagaugcuagggacgcuugagugagggagguggugugagggccagguuuccugaaaggcgggagucagaccuccgcccccagccagagcaagcuuggggcaccaugcccaggagggaagaagccauccacagccuucccugucaccggcuccucuguccugccuacccugguccuggcgggacuucacuauuugacuugguuuccuuucagauauucuuggcucagggccuggguugagggagcuuagggaaggacguccgucugggugcuuuuccuccaguuugcuggcuggcuucuccgucuacccacagugaccucacagagaggcccuccugccacccaugcucaugugguguccccaccgcccacuuguuugaugucacugacugucuacauguauuuauauucuugauauuuucuacccucacuagaauguaaacuccaugaaggcacagacuuuucuuguucucuucucuaucccuagaguaagaccaacuugaaccuggcauauaguagcugcuuaauaaauacucgucugucaauga

SEQ ID NO: 198 - RNA, 4607 nt, Homo Sapiens
gacgcagcugcgggcggcgggcggcgcgcacacugcucgcugggccgcggcucccgggugucccaggcccggccggugcgcagagcauggcgggugcgggcccgaagcggcgcgcgcuagcggcgccggcggccgaggagaaggaagaggcgcgggagaagaugcuggccgccaagagcgcggacggcucggcgccggcaggcgagggcgagggcgugacccugcagcggaacaucacgcugcucaacggcguggccaucaucguggggaccauuaucggcucgggcaucuucgugacgcccacgggcgugcucaaggaggcaggcucgccggggcuggcgcugguggugugggccgcgugcggcgucuucuccaucgugggcgcgcucugcuacgcggagcucggcaccaccaucuccaaaucgggcggcgacuacgccuacaugcuggaggucuacggcucgcugcccgccuuccucaagcucuggaucgagcugcucaucauccggccuucaucgcaguacaucguggcccuggucuucgccaccuaccugcucaagccgcucuuccccaccugcccggugcccgaggaggcagccaagcucguggccugccucugcgugcguccuuucacgcgugucuucguguuggugcgcuuuucacuggucauaaagugcugcucacggccgugaacugcuacagcgugaaggccgccacccggguccaggaugccuuugccgccgccaagcuccuggcccuggcccugaucauccugcugggcuucguccagaucgggaagggugauguguccaaucuagaucccaacuucucauuugaaggcaccaaacuggauguggggaacauugugcuggcauuauacagcggccucuuugccuauggaggauggaauuacuugaauuucgucacagaggaaaugaucaaccccuacagaaaccugccccuggccaucaucaucucccugcccaucgugacgcugguguacgugcugaccaaccuggccuacuucaccacccuguccaccgagcagaugcugucguccgaggccguggccguggacuucgggaacuaucaccugggcgucauguccuggaucauccccgucuucgugggccuguccugcuucggcuccgucaaugggucccuguucacauccuccaggcucuucuucguggggucccgggaaggccaccugcccuccauccucuccaugauccacccacagcuccucacccccgugccgucccucguguucacgugugugaugacgcugcucuacgccuucuccaaggacaucuucuccgucaucaacuucuucagcuucuucaacuggcucugcguggcccuggccaucaucggcaugaucuggcugcgccacagaaagccugagcuugagcggcccaucaaggugaaccuggcccugccuguguucuucauccuggccugccucuuccugaucgccgucuccuucuggaagacacccguggaguguggcaucggcuucaccaucauccucagcgggcugcccgucuacuucuucggggucugguggaaaaacaagcccaaguggcuccuccagggcaucuucuccacgaccguccugugucagaagcucaugcagguggucccccaggagacauagccaggaggccgaguggcugccggaggagcaugcgcagaggccaguuaaaguagaucaccuccucgaacccacuccgguuccccgcaacccacagcucagcugcccaucccagucccucgccgucccucccaggucgggcaguggaggcugcugugaaaacucugguacgaaucucaucccucaacugagggccagggacccaggugugccugugcuccugcccaggagcagcuuuuggucuccuugggcccuuuuucccuucccuccuuuguuuacuuauauauauauuuuuuuuaaacuuaaauuuugggucaacuugacaccacuaagaugauuuuuuaaggagcugggggaaggcaggagccuuccuuucuccugccccaagggcccagacccugggcaaacagagcuacugagacuuggaaccucauugcuaccacagacuugcacugaagccggacagcugcccagacacaugggcuugugacauucgugaaaaccaacccugugggcuuaugucucugccuuaggguuugcagaguggaaacucagccguaggguggcacugggagggggugggggaucugggcaaggugggugauuccucccaggaggugcuugaggccccgauggacuccugaccauaauccuagccccgagacaccauccugagccagggaacagccccaggguuggggggugccggcaucuccccuagcucaccaggccuggccucugggcaguguggccucuuggcuauuucuguguccaguuuuggaggcugaguucugguucaugcagacaaagcccuguccuucagucuucuagaaacagagacaagaaaggcagacacaccgcggccaggcacccaugugggcgcccacccugggcuccacacagcaguguccccugccccagaggucgcagcuacccucagccuccaaugcauuggccucuguaccgcccggcagccccuucuggccggugcuggguucccacucccggccuaggcaccuccccgcucucccugucacgcucauguccuguccugguccugaugcccguugucuaggagacagagccaagcacugcucacgucucugccgccugcguuuggaggccccugggcucucacccaguccccacccgccugcagagagggaacuagggcaccccuuguuucuguuguucccgugaauuuuuuucgcuaugggaggcagccgaggccuggccaaugcggcccacuuuccugagcugucgcugccuccauggcagcagccagggacccccagaacaagaagaccccgcaggaucccuccugagcucggggggcucugccuucucaggccccgggcuucccuucuccccagccagagguggagccaagugguccagcgucacuccagugcucagcuguggcuggaggagcuggccuguggcacagcccugagugucccaagccgggagccaacgaagccggacacggcuucacugaccagcggcugcucaagccgcaagcucucagcaagugcccaguggagccugccgcccccgccugggcaccgggacccccucaccauccagugggcccggagaaaccugaugaacaguuuggggacucaggaccagauguccgucucucuugcuugaggaaugaagaccuuuauucaccccugccccguugcuucccgcugcacauggacagacuucacagcgucugcucauaggaccugcauccuuccuggggacgaauuccacucguccaagggacagcccacggucuggaggccgaggaccaccagcaggcagguggacugacuguguugggcaagaccucuucccucugggccuguucucuuggcugcaaauaaggacagcagcuggugccccaccugccuggugcauugcugugugaauccaggaggcaguggacaucguaggcagccacggccccggguccaggagaagugcucccuggaggcacgcaccacugcuucccacuggggccggcggggcccacgcacgacgucagccucuuaccuucccgccucggcuagggguccucgggaugccguucuguuccaaccuccugcucugggacguggacaugccucaaggauacagggagccggcggccucucgacggcacgcacuugccuguuggcugcugcggcugugggcgagcaugggggcugccagcgucuguuguggaaaguagcugcuagugaaauggcuggggccgcugggguccgucuucacacugcgcaggucucuucugggcgucugagcuggggugggagcuccuccgcagaagguuggugggggguccagucugugauccuuggugcugugugccccacuccagccuggggaccccacuucagaagguaggggccgugucccgcggugcugacugaggccugcuucccccucccccuccugcugugcuggaauuccacagggaccagggccaccgcaggggacugucucagaagacuugauuuuuccgucccuuuuucuccacacuccacugacaaacguccccagcgguuuccacuugugggcuucagguguuuucaagcacaacccaccacaacaagcaagugcauuuucagucguugugcuuuuuuguuuugugcuaacgucuuacuaauuuaaagaugcugucggcaccauguuuauuuauuuccaguggucaugcucagccuugcugcucugcguggcgcaggugccaugccugcucccugucugugucccagccacgcagggccauccacugugacgucggccgaccaggcuggacacccucugccgaguaaugacguguguggcugggaccuucuuuauucuguguuaauggcuaaccuguuacacugggcuggguuggguaggguguucuggcuuuuuugugggguuuuuauuuuuaaagaaacacucaaucauccua

SEQ ID NO: 199 - RNA, 5602 nt, Homo Sapiens
agcuccugugacagacggagcuggagcggcggggcggcggcggaguccggcggccgggagagcgagugagcgagcggaggagcagcgacacgggagucuagggagcgagaaggagaaggaggggagcgcucgggcgcgagcgagagaaaccgcgagcgccgagcuuggacucgagccccggaacggcugaggagcccgcccgcuccccuccccucccccuccccgggcccgggcccagcgcgccauccuccccccuccuucccucccucccuccuuccucccuccccucucccucccccucccccgccgguggaugggagugaaggacggaagaggcccugcggaggcggcggugcagcgcuccggguggaaugaaucuuacuuguugaauaucuucugguuacuaguuggauucauuugugaaagaaucauuuuccccuguguggaagacacuuaguggcauauuuaaauuauaaguccacggaucaaaaagcuuuuugauuucccaaaggagggacauaccacuauaucagauaagcuugacauuacagccaagauggugcugucccagagacaacgagaugaacuaaaucgagcuauagcagauuaucuucguucaaauggcuaugaagaggcauauucaguuuuuaaaaaggaagcugaauuagaugugaaugaagaauuagauaaaaaguaugcuggucuuuuggaaaaaaaauggacaucuguuauuagauuacaaaagaagguuauggaauuagaaucaaagcuaaaugaagcaaaagaagaauuuacgucagguggaccucuuggucagaaacgagacccaaaagaauggauuccccguccgccagaaaaauaugcauugaguggucacaggaguccagucacucgagucauuuuccauccuguguucaguguuauggucucugcuucagaggaugcuacaauuaaggugugggauuaugagacuggagauuuugaacgaacucuuaaaggacauacagacucuguacaggacauuucauucgaccacagcggcaagcuucuggcuuccuguucugcagauaugaccauuaaacuaugggauuuucagggcuuugaaugcaucagaaccaugcacggccaugaccacaauguuucuucaguagccaucaugcccaauggagaucauauagugucugccucaagggauaaaacuauaaaaaugugggaagugcaaacuggcuacugugugaagacauucacaggacacagagaauggguacguaugguacggccaaaucaagauggcacucugauagccagcuguuccaaugaccagacugugcguguaugggucguagcaacaaaggaaugcaaggcugagcuccgagagcaugagcaugugguagaaugcauuuccugggcuccagaaagcucauauuccuccaucucugaagcaacaggaucugagacuaaaaaaagugguaaaccugggccauucuugcugucuggauccagagacaagacuauuaagaugugggaugucaguacuggcaugugccuuaugacccucgugggucaugauaacuggguacguggaguucuguuccauucuggggggaaguuuauuuugaguugugcugaugacaagacccuacgcguaugggauuacaagaacaagcgaugcaugaagacccucaaugcgcaugaacacuuuguuaccuccuuggauuuccacaagacggcacccuaugucgucacuggcagcguagaucaaacaguaaaagugugggagugccguugauugugucuccuucggccccuccucccucuuuuccucuggaugcacucugaugauaccaugguuaccccauugagcucuguuuaaauaaauauuguccuuucauguaaauuauucuggauguagauugagcuuauuaaauguuacacacaaaguauucaugcauggugaauccaaauuguauacuguaaauuuacauacguugucuagaaguaccauaggguuuaaaaaccugggcuggcauuggucacaccaggccuaagaaggcagaaguugaaucaauugaacuagggcacuaaacugaauaguugacagugucauuuuauguuggauuauuaauuccuguuuuucuuucugcuaucuguuggugccugacuugauggccucauuuggggaaaaguggugguuauuagggcuuuuucugaaauguguaucuauguaacaucacuuaagugugcuuaauaaaucuucuguaaggauuuuagaugauaaggcuacaauucagaaucuucugaaccaucuauguaaugaauggggauuauacauuggaauuuuugucaugacacauuugccaaaucaguaggauauauuuguuuuggcagccuaucacgcagaggcuagugguauauuuauguaagaaaaugacuguaaaucucaagaaaaaucucagcagcuaauagcaacucauuuauuucauuuuggucuuaaugcuuuguaaacaggucaaaaaauacugucauacucuaagcuucuauuuuccacacuggacauacuucuaguuguauucuccauacuauuagacuguguagugaugugacuuccaaguagaauuuaaucuccccauugagugugucaugguacaaaucacuauucguuuuugguguuuuuuagggaugugcaaugugcauuacauaaugacagaaauacugagaagguucugugugcccauuugaaaggagugggaggaauacagcaguuuguuuuucaacaugaaucugauauugauuuaaacuguguuucacuuacaaguuuuaaaaaaaugacaggguuuaauggagcgugcauaaaaauguacuguuuucaccuuuuguuuauauguaaauguuuguaaguauaugggccuaucuguaaguggauaagucuguauguguguaucauacacaucaaccuccauguccuuaguccuggguuuuugaaaaagugcuaaaacggacaaguagaauaaauguugcuguggaaugccaugcuuuagaacaaacccuuuuugaucuuaaugcuucugaaaacuaggucugacucuggggauuuuuuuccagccgaaggaaaaucacuuccguuaugucccccucuaauuuagccgcucgacauuuuacacaacccggauauguuguauauuuugacccaaaguuacagguagguuuaagagaauuuuuagccaugacuuuuggagcacuauuccauugucaguuauuaauaaagaauuccauugcuuagcuaaccaacagguuuuuuuuguuuccaagagaguuauuugaaaaguuaacagaacaaugagauaacagugacaguuuaacaaagauaaaauucugaacugcguuuuauucauuuguguacuaugugauuuuuuaaauguccccuuuaguauuuaauggaaaauugguuccugcaaaagacaaagggugagaguuagcguccuguagauacacacagagacuaggccguauauuaacuagaagcagcuuuaugucuagcuugugucuuuuuguuuguuugcuuguuuguuuuuagauuccugagagaugucucuggaagggaaaguuuugagaacuaauggcuauuuuugaggacaaaaauuacaucuuaagcuaauuccuuaaauacauacaguaggugaauuuucaggacaauauugccucacaacccugcuuacauugaaaagucuuuuucccuuagcucuucugacuggauuuuucuacaaaaacuauggaaaauaucuuuguucuuguuugcugcuauuuucuguccuauuuugagaaauauaaauacauagaaauggugcaucuuaacauuuguuuguacauguauaaaugucuuguauuuuaauucauuuuuagcaugaauuguuuaaggguaagccacaacaucuagaaaucacucauagauauugaacaauaaaggagaaugguaccgaugcaggaggaagcaagcgugucuuccccugcagcacacagcgacuugcguugacaaaggaggaggaaacgauuacucuguaaacaaaguuauccuuacuugggagauugccacagccugcugcugaguugaguuaccagacauccuccaugugagaagcagcgaacauugaaucucagggauggcccacaacuggguccacauguaaugagcccuguuuaauaacgaaggggugggggagagcaguccgucuacaaccuggaaucagauuugcaaaauuuccugcacugcugucugacacuguccuguugaugcccuuucugacuguguucucuguuuucucugucugcugucuaacccugugccuugccugggauaaggacaaugaugagguuacugguuuggauuguaaguagaggacuuuuauuaauugguuuagagguucacugcugcuuugucacuuucucaaucaaauuggccacuuaagaaauaaagagcugguagaauugcauccucagaugauuauugacugugugugugugugaaaacagacauuccagugccacccaaauauauaucuguaacgugcccaagaaauccuagcugcgcucuugagagugcaugccauggagacugguuuagacaccgcguggagccuaguugccuguugucacggcaucuugcacuuuaggagacuaagaccguccugguucgucuguguguggugugaccaauggugugcccagagcacuacucucaaaaucacuaguguuagcaagucgucccgggcuggggagcguucgccguagucuuuggaagcuuuggcuuuagauuuaccaagccccgccuccccgcugccagugcccugcucucccguucgccucuuucuguuucugugugaacuuucccgguaauaucacucguuaaauagguuuucuuuaaacuuaauuaaagaaaaacuauuuaaagguaaaggauauuuuguugacaucgguggcucgaucauccuuaagcaacugaaguuaaaauuguugaaggaaaaggcacuuaaauugguuacuuucauguccagcuguauauaaguccaguguguucaucuagaugacgcaaagaaucuccugguagagaagcgacauguaaaaaacugguggaaaaagguuuuggauuuuuuuuccagugggguggggggagggcaagcuggauuuacaggucacggcuggacugaaugggccuuuuuaucuucccacuguaucauggaaguagcugcuugcuuguacuguccauccuucaggcaucccuaaagcucacucugaagauguuagagacaaacacaaacucuucgaguuaaaguugauccugacacugacaugaaggcaagccuugauuucguaugaacguugcugaagugguaauugaggaaaacaguuccccagauuguuaagaguucacugaagauauugacacaauuuuaaaaaaucaguaaaggaauguauauaauauugcucucguguuuuacaguaagauuuguugcucucagacuguguaaaacaaaauuuauucauguuuucugcauauuaaaaaaucuuauuguaccaacugguaaacuauuaaaugccuauaaaacua

SEQ ID NO: 200 - RNA, 882 nt, Homo Sapiens
cgggauccaggcgggccauggcggauguccccggggcacagcgagcgguuccuggugacggcccagagccccgggacccccuggacuguugggccugcgcuguucuuguaacagcccagaaucugcugguggcugccuucaaucuucuccugcuggugcuggugcuagggaccaucuugcuacccgcugucaccaugcugggcuucggcuuccucugccacucucaguuccugcgcucccaggcacccccuugcaccgcgcaccugcgggaccccgguuucacggcccuacuggucaccggauuccugcuccucgugccgcugcucgugcuugcucuggccagcuaccgccgccucugccugcgccuccgccuagccgauugccucgugcccuacagccgagcccuuuaucggcgucggcgcgccccgcagccgcggcaaauccgggccucaccagggucccaggccguucccacaucaggaaaggucugggucuaaugacccucgagucaagaacaacccugacggcugcccucccucuuauucggcccaaggacuugaagcccggcaucuuccgaccugcccugcccccaccccugccugagcggaguccuagcauccccuugggagcagcagcgucaguggacccagugcugagaaaagcccccacaucccggaaaacccacuuuccuuucacgacccacaucucaauccugaacaucuaggcuggaaccugcacaccucccccucagcuccgucgugaaugggacaacaaucucgugcccucguuuuauggugcagcuucucuaguauuucuggggcuggggggcggggcuggaggggaaggaguguccacgcaucaauaaagauuuaacgaacugaa

SEQ ID NO: 201 - RNA, 375 nt, Homo Sapiens
aauggcuacagcaauggucagcuuggaaaccacagugaagaagacagcacugaugaccaaagagaagacacucauauuaagccuauuuauaaucuauaugcaauuucaugccauucaggaauucugagugggggccguuacgucacuuaugcgaaaaacccaaacugcaagugguacugcuacaauggcagcaucugugaggaacgucacccugaugaaauugacaccgacucugccuacauucuuuucuaugagcagcagaggauagacuacgcacaauuucugccaaagauugauggcaaaaagauggcagacacaagcaguauggaugaagacuuugagucugauuacaaaaaguacuguguguuacaguaa

SEQ ID NO: 202 - RNA, 3475 nt, Homo Sapiens
gccgccgccgccgccgccgccgccgccgccgccgccgccgccgccgccacagcccgcugggccggaggaggcggagcuggcgcugucccggcucucuugcggggaagcaacugagggggcggcgcggcgggccccggcggccgaagaggcuggcagguggcgccguggggugggugcuccuggugagaggaguccacuccgugcgugcgggcggaggccggcccccgagagccgccgacaugaagaaagacgugcggauccugcuggugggagaaccuagaguugggaagacaucacugauuaugucucuggucagugaagaauuuccagaagagauuguuguggauuuaaauaccuccucauuugcagaguaucuucagccuucaacaaaauagaaugaaaacaacauauuuaaaaaaucuaacaccgaaacaccaaauuaauccaagaauccacugaguuccuccccgggcagaagaaaucaccauuccagcugaugucaccccagagagaguuccaacacacauuguagauuacucagaagcagaacagagugaugaacaacuucaucaagaaauaucucaggugcuaaugucaucuguauaguguaugccguuaacaacaagcauucuauugauaagguaacaagucgauggauuccucucauaaaugaaagaacagacaaagacagcaggcugccuuuaauauugguugggaacaaaucugaucugguggaauauaguaguauggagaccauccuuccuauuaugaaccaguauacagaaauagaaaccuguguggaguguucagcgaaaaaccugaagaacauaucagagcucuuuuauuacgcacagaaagcuguucuucauccuacagggccccuguacugcccagaggagaaggagaugaaaccagcuuguauaaaagcccuuacucguauauuuaaaauaucugaucaagauaaugaugguacucucaaugaugcugaacucaacuucuuucagaggauuuguuucaacacuccauuagcuccucaagcucuggaggaugucaagaauguagucagaaaacauauaagugaugguguggcugacaguggguugacccugaaagguuuucucuuuuuacacacacuuuuuauccagagagggagacacgaaacuacuuggacugugcuucgacgauuugguuaugaugaugaccuggauuugacaccugaauauuuguucccccugcugaaaauaccuccugauugcacuacugaauuaaaucaucaugcauauuuauuucuccaaagcaccuuugacaagcaugauuuggauagagacugugcuuugucaccugaugagcuuaaagauuuauuuaaaguuuucccuuacauaccuugggggccagaugugaauaacacaguuuguaccaaugaaagaggcuggauaaccuaccagggauuccuuucccaguggacgcucacgacuuauuuagauguacagcggugccuggaauauuugggcuaucuaggcuauucaauauugacugagcaagagucucaagcuucagcuguuacagugacaagagauaaaaagauagaccugcagaaaaaacaaacucaaagaaauguguucagauguaauguaauuggagugaaaaacugugggaaaaguggaguucuucaggcucuucuuggaagaaacuuaaugaggcagaagaaaauucgugaagaucauaaauccuacuaugcgauuaacacuguuuauguauauggacaagagaaauacuuguuguugcaugauaucucagaaucggaauuucuaacugaagcugaaaucauuugugauguuguaugccugguauaugaugucagcaaucccaaauccuuugaauacugugccaggauuuuuaagcaacacuuuauggacagcagaauaccuugcuuaaucguagcugcaaagucagaccugcaugaaguuaaacaagaauacaguauuucaccuacugauuucugcaggaaacacaaaaugccuccaccacaagccuucacuugcaauacugcugaugcccccaguaaggauaucuuuguuaaauugacaacaauggccauguauccagaggaucauuacagagacagacucucccgagacaugggccacacugauagaauagagaauuugagaaaaaucugggucuuucuaaaaacugcuuuccaugcccgguuacgcuguaugugcaccugcaacagguguacauuuugcaucugucagaacuuccucaacucagacuugcugcaaucuguaaagaacaaaaucuucacugcaguucuuaacaggcacgugacacaagcugaccucaagagcuccacguuuuggcuucgagcaaguuuuggugcuacuguuuuugcaguuuugggcuuugcuauguacaaagcauuauugaaacagcgaugauauaaaaagaaauacugucccuaccaaaaacaaauacuuuuauguacauucugaaugcuuuaaguucugcuagaauuauugagauauuuauacaugcagaguuacuuuauuaauauuuguaauucaugcauaagaguauuuuaaugauaguuauaacugcaguauuggcuagcauauggaaagaaaacagcuaacagccaaacuaaaauggcuaaauuccagaggccaaaagggaauauuuuguaaauauauguacauauucaggcaagauauggucucccaagcugaguucuagaaaugauguuucuagacauuucuaagugguauuguuagugcucacuuggcucacucuucuagguuuaaguuagcccagagauuguauuuacucauggaucacuuuauuuauuucacauuuacucagaaugauccuuuggguucuauaaggacauaagguacaauuugccauugucucuccauuuuuaaaaacauacaagucagugucagcuuaccaacaugacauuuuuucagucaguugugguaggccagccuugaagccaucgcacagucuagaaacuuguguagcugagugugcagcucaccuuuaagggugaaguuagguaaaagcaauuagcagaggcguuaucuaugugauuauguugcuuccuugucaguauguugaauuuuauagcccuuucaaugaaauaaaaaaaaaauuuguauauuaccaauguuuuuaguuuaaauaaagagucacccuuacuacuguugaauuucaucccaaguguaaaucauucuauaauggcugugucuguuauaguauauuacaguaacugcaugugucaccaaguguucuauaucaggcuaggauaaccuagaggcaguaauuuuuuaaaugauaaaauaaaucuaaugaauauaaacucucaugauaaaccuauuuuuuccaucaucagccuuuucaaguauuuaaauaaauaacugcuguguacugugaucuugaguucuuuugucaucuaaaguaaauauuucuguac

SEQ ID NO: 203 - RNA, 1592 nt, Homo Sapiens
uguguuuccggcgucggcggccgcggccggggacggugugagagcgguaagauggcggcggcggcggugguggaguuccagagagcccagucucuacucagcaccgaccgggaggccuccaucgacauccuccacuccaucgugaagcgugacauucaggaaaacgaugaagaggcagugcaagucaaagagcagagcauccuggaacugggaucucuccuggcaaagacuggacaagcugcagagcuuggaggacuccugaaguauguacgacccuucuugaauuccaucagcaaggcuaaagcagcucgccugguccgaucucuucuugaucuguuucuugauauggaagcagcuacagggcaggaggucgagcuguguuuagagugcaucgaaugggccaagucagagaaaagaacuuucuuacgccaagcuuuggaggcaagacuggugucuuuguacuuugauaccaagagguaccaggaagcauugcauuuggguucucagcugcugcgggaguugaaaaagauggacgacaaagcucuuuugguggaaguacagcuuuuagaaagcaaaacauaccaugcccugagcaaccugccgaaagcccgagcugccuuaacuucugcucgaaccacagcaaaugccaucuacugccccccuaaauugcaggccaccuuggacaugcagucggguauuauccaugcagcagaagagaaggacuggaaaacugcguacucauacuucuaugaggcauuugaggguuaugacuccaucgacagccccaaggccaucacaucucugaaguacauguugcugugcaaaaucaugcucaacaccccagaagauguccaggcuuuggugagcgggaagcuugcacuucgguaugcagggaggcagacagaagcauuaaaaugcguggcucaggcuagcaagaacagaucacuggcagauuuugaaaaggcucugacagauuaccgggcagagcuccgggaugacccaaucaucagcacacacuuggccaaguuguaugauaacuuacuagaacagaaucugauccgagucauugagccuuuuuccagaguacagauugaacacauaucuagucucaucaaacucuccaaggccgacguggaaaggaaauuaucacagaugauucuugacaagaaauuucaugggauuuuggaccagggggaggguguccugauuauuuucgaugaacccccaguagauaaaacuuacgaagcugcucuggaaacaauucagaacaugagcaaaguaguggauucccucuacaacaaagccaagaaacugacauagaguuggaucuguagcgguccuuuggagaguguguguggcgggagagugaaaccuugggggaaaaugcuaggagauucuuuuuucuuuuuguucuacuuuucgcucggaaaguuuuuaaauccucauuuggugcaucuguauuccagccaauaggugugccaguuuucauguaaucuuuacuggcccaacuugggaguggggaaauugcuuaaaaaaaaagaaaaagaaaaaaaaaaagauuauucuaaauaaaaggaaaaaggcuuacacua

SEQ ID NO: 204 - RNA, 4777 nt, Homo Sapiens
ggaaacgacauucggagcugcgcucccgcccaggccggcccugacgcgggccucgucagccaguaacagggagcagaggugggaguuagcgaggcgaccacgaaaacggugaaggucggaaccgacagccuccuccgagaagggcaggagcugggaggaggcggcagcggcggcggcagaaacagcagcggcggcggcggcggcagcugggaggagguggugacgguggcaacggcagcgucggggacgauggcgcgacucguggcagugugcagggacggggaggaggaguuccccuucgagaggaggcagauuccccucuacauagacgacacccugacgauggugauggaauuuccugauaauguguuaaaucucgauggacaucagaauaauggugcacagcuaaagcaguucauucagcgacaugguaugcuuaagcaacaggaucuaaguauugccaugguggugacaucacgcgaaguccugagugcacuuucucagcuugucccauguguugguugucgucgcaguguggagcgucucuuuucccagcuuguagagucuggaaauccugcucuugaaccccuaacaguagggcccaagggaguccugucuguaacuagaagcugcaugacugaugcaaagaagcuuuauacauuauuuuauguacauggguccaaacuaaaugacaugauagaugcuauuccaaaaaguaagaagaauaagagaugucaguugcacuccuuagauacgcacaagccaaaaccuuugggagguuguuggauggauguaugggaacuaaugucgcaggaaugcagggaugaaguaguuuuaauugacucgaguugucuuuuagaaacacuagaaacauaucugcgaaaacacagguuuugcacugauugcaaaaauaaaguccuccgagcauacaauauccuuauuggugaacuugacugcagcaaagaaaagggcuacugugcugcacuuuaugaaggcuugcggugcuguccacaugaacgacacauacauguuugcugugaaacagacuucauugcacaucuuuugggucgugcugagccagaguucgcaggaggguaugaguauguaauuugcuagaaugggcuaucuagcgcuuugcuucauuuuauuacugaaaguuuauuuucaucaccuucugccucaguacauaugauauauguauaaauuaaaguaugccuguaaagauuuugcuucucuuuaaaguaugcauuucuuaauugacugaaaauagggaaaaacuguucucugguguuugguucaguccucugcuaguucuugcuugaagggaggcaggcuuuuuuggcuuucauuguuacagacuaucauuuucauuugaaaaugauuagaagggauuuuucucccucuauccaugcauuaucauguguaaauuuuauucacaauaaugguuuuugcauaagucagaucuuugcaguaggggauuaagaaaugccuuauugaauguaauucacgaacuguguauauuauauuauuauuacuacacagaaaccuaaaguaguaucucuggcuuuguuguaaaaauaaaaucagaugaugauguuaauagaauaaaucaaaugcauuuccuuuuguauuuaggguaucaacccucauuugagugccuacuuucugcuagaauacaaagggcuuuuuuaucgccaaaguucugugaacacuuguaaagacuggccugguggaggacucuugcccaugaugaaucacuuuggcauugccuuucucaauuccuccucaaaacaaaaaaccuaaagaaggaaaaaauguuuugcuauaauuggaaaguaaaaggaacuguugugucuacuaugagcuggacacuucuaugugauugcuuugugcccuaaaacccaucuuuuuagagccaguuccugaauuacuuuauuuuuagcaauacgaggacuaaauucuacuugcauguguauuucucauugguuguggacaugcaugcuuguauagcaacauauacguugaguguaaauguauaacugucuuguuacuagguaagcacauuguguuuaaaaccugaacuugcagcuguguuauccaucuuuuacuguuucaguuaaagguauuagugugugauuauucccuuuuauaggcgaagagaaaggcaugcaaagacaauagauauagcucaagaagaaguucugaccugcuugggaauucaucuuuaugaaagacugcaucgaaucuggcagaagcuacgggcagaagagcagacauggcagaugcuuuucuaucuugguguugaugcuuuacgcaagaguuuugagaugaccguggaaaaaguacaggguauuagcagauuggaacaacuuugugaggaauuuucagaagaggaacgaguaagagaacucaagcaagaaaagaaacgccaaaaacggaagaauagacgaaaaaauaagugugugugugauauuccuacucccuuacaaacagcagaugaaaaggaaguaagccaagagaagguaauauuucuuaauaucaacucuuaaguguguauguauugcuuguagauagaaguacaggccaggugugguggcucacgccugugaucccagcacuuugggaggcccaggguggagguaucacuugagccuaggaguuugggaccagccugggcaagauagugagaucucuaucucuauuuauuuuauuuuauuuuuuuaauaaaaauaaaaaguacagucgucccuugguaucugugggguuugauuccaggacuuccuguagauaccaaaaucugcagaugugcaagucccugauguaaaaugguguaauauuugcauauagucuaugcacauccuccuuauacuuuuauuucugagacagggucucacucugucacccggacuggagugcaguggcacaaucauggcucacugcagcguucaucucccaggcucaugucaucuucccaccucagcuucccaaguggcuggaacuacaggcuuaccccaccaggcccagcuaauuuuuuguauuuauuguagagauggcguuuuaccauguuguucaggcuggucuccagcuugugggcucaagcaauucucccaccucagccucccaaaaugcuacaauuacaggcaugaaccaccgugccuggccucuuguauucuuaaauuaucucuaaauuauaauaccuaaugcaauguaaaagcuauguaaggcugggcaugguggcucacgccuguaaucccagcuacuugggaggcugaggcaugagaauuucuugaacccaggaggcaaagguugcagugagccaagaucgcuccacugcaguccagccugggcgacagagugaaacucucucaaaauaaauaaaaacuguuuaaauaguuguuauacuguauuguuuagaaaauaaggacaagaaaaaagucuguacauguucaguacagaugcaggaaacagacuucauagaaaauagcagcugcaaagccuguggcagcacugaagaugguaauacuuguguagaaguaauuguuaccaaugaaaauacaucauguaccuguccuagcaguggcaaucuuuugggguccccuaaaauaaagaaaggcuuaucuccacacuguaaugguagugauuguggauauucaucuagcauggaagggagugaaacagguucucgggaggguucggauguugccugcacugaaggcauuuguaaucaugaugaacacggugaugacucuuguguucaucacugugaagacaaagaggaugauggugauaguuguguugaauguugggcaaauucugaagagaacgacacaaaaggaaaaaauaaaaagaagaagaagaaaagcaagauacugaaaugugaugaacauauccagaagcuuggaagcuguauuacagauccagguaaucgagagaccucaggaaauaccaugcacacaguguuucaccgugacaagaccaaagauacacauccugaaagcuguugcagcucugaaaagggugggcagccauugccuugguuugagcauaggaaaaauguaccacaguuugcagaaccuacagaaacguuguuuggucccgauuccggaaaaggugccaagagcuuaguugaacuccuugaugagucugaauguacuucagaugaggaaaucuuuaucucacaagaugaaauacagucauuuauggcuaauaaccagucuuucuacagcaauagagaacaauaccgacagcaucugaaggagaaauuuaauaaauacugccgguuaaaugaucacaagaggcccauuuguaguggcugguugacaacggcuggagcaaauuaaauaaauaaaauagcucugucuuucaaugaaacacucacgaugacuacugcgccuucucuuucgaaaaacucuuaauuuagugacuuauggcaaaauuuuaucuuaaaucaaugugauucuuucuuguuuugggagacgguggagguauccucauuaguucuuucuucaggcuugugucuuuaguugcguggcugcgcaggccugccauaugauuuaagccaucucuuuucauuaaauguuucucuuccugugagacuuacuaaagcaacuuaguggcaaaaaguaauguuguacuuauaauucuguacagaaaugacaaugagcugaauauaugguuuuacaaaguagacauccacuugcaaaauguuuggauguaauguuaaagcgcaaugugcaaaauuuaaaauaaagaauauuuauuaauacgcacaguaaaa

SEQ ID NO: 205 - RNA, 68 nt, Homo Sapiens
aauaugcuaaaaaauuggaaagauacagagaagauuagcauggccacugugcaaggaugacacacaaa

SEQ ID NO: 206 - RNA, 3957 nt, Homo Sapiens
gcgggggcgggcuuugccgagcgcagagcugcagccgccgagccggacguguccgcgaagauggcgggccggaaaggaaggagcaugcaagcggcaagauguccuacagaugaauuaucuuuaaccaauugugcaguugugaaugaaaaggauuuccagucuggccagcaugugauugugaggaccucucccaaucacagguacacauuuacacugaagacacauccaucggugguuccagggagcauugcauucaguuuaccucagagaaaaugggcugggcuuucuauugggcaagaaauagaagucuccuuauauacauuugacaaagccaaacaguguauuggcacaaugaccaucgagauugauuuccugcagaaaaaaagcauugacuccaacccuuaugacaccgacaagauggcagcagaauuuauucagcaauucaacaaccaggccuucucagugggacaacagcuugucuuuagcuucaaugaaaagcuuuuuggcuuacuggugaaggacauugaagccauggauccuagcauccugaagggagagccugcgacagggaaaaggcagaagauugaaguaggacugguuguuggaaacagucaaguugcauuugaaaaagcagaaaauucgucacuuaaucuuauuggcaaagcuaaaaccaaggaaaaucgccaaucaauuaucaauccugacuggaacuuugaaaaaaugggaauaggaggucuagacaaggaauuuucagauauuuuccgacgagcauuugcuucccgaguauuuccuccagagauuguggagcagauggguuguaaacauguuaaaggcauccuguuauauggacccccagguugugguaagacucucuuggcucgacagauuggcaagauguugaaugcaagagagcccaaaguggucaaugggccagaaauccuuaacaaauaugugggagaaucagaggcuaacauucgcaaacuuuuugcugaugcugaagaggagcaaaggaggcuuggugcuaacagugguuugcacaucaucaucuuugaugaaauugaugccaucugcaagcagagagggagcauggcugguagcacgggaguucaugacacuguugucaaccaguugcuguccaaaauugauggcguggagcagcuaaacaacauccuagucauuggaaugaccaauagaccagaucugauagaugaggcucuucuuagaccuggaagacuggaaguuaaaauggagauaggcuugccagaugagaaaggccgacuacagauucuucacauccacacagcaagaaugagagggcaucaguuacucucugcugauguagacauuaaagaacuggccguggagaccaagaauuucaguggugcugaauuggagggucuggugcgagcagcccaguccacugcuaugaauagacacauaaaggccaguacuaaaguggaaguggacauggagaaagcagaaagccugcaagugacgagaggagacuuccuugcuucuuuggagaaugauaucaaaccagccuuuggcacaaaccaagaagauuaugcaaguuacauuaugaacgguaucaucaaauggggugacccaguuacucgaguucuagaugauggggagcugcuggugcagcagacuaagaacagugaccgcacaccauuggucagcgugcuucuggaaggcccuccucacagugggaagacugcuuuagcugcaaaaauugcagaggaauccaacuucccguucaucaagaucuguucuccugauaaaaugauuggcuuuucugaaacagccaaaugucaggccaugaagaagaucuuugaugaugcguacaaaucccagcucaguugugugguuguggaugacauugagagauugcuugauuacgucccuauuggcccucgauuuucaaaucuuguauuacaggcucuucucguuuuacugaaaaaggcaccuccucagggccgcaagcuucuuaucauugggaccacuagccgcaaagauguccuucaggagauggaaaugcuuaacgcuuucagcaccaccauccacgugcccaacauugccacaggagagcagcuguuggaagcuuuggagcuuuugggcaacuucaaggauaaggaacgcaccacaauugcacagcaagucaaagggaagaaggucuggauaggaaucaagaaguuacuaaugcugaucgagaugucccuacagauggauccugaauaccgugugagaaaauucuuggcccucuuaagagaagaaggagcuagcccccuugauuuugauugaaaaugaacuauuugaaacacacagugaccaagggaagugaccaaggugaagauggccuaggaucuucacugucuuacucaagauacuggacuaaguggaacguucucuaccuucaacaugugcucgcucugcaugauuagugcaauaaaacucccuuccuuaugcauacugagauagcuuagugucucguggaaggugucaauuugguuuagaaugcugcgcuuaccuucccaugcaggcuaaagugauuccuucuugcucagucccucugggugggaaccauccaguacuuguggacacuacacguuucaaccucucuacuagcaccaucacccuugaaaacucucagucagugucaugaauguugcaugacaacaguuggccgauuagaaggcagacuuucuacaugcaaaucuggcuuaguaaaucgaggugugggccagagauccucugacagcuguccugagcuaacacuaaaagucacuggguauuugguuaaaggucucccacaagacugguauucucuuugccugaagaaacaaggcauugaaucucuaaaaugcuguucucaaucauugucagagauguuuucaaguugcagucagaagaucuuucuuaauagaaagucagaugacuaccguguugguugugacuuccccuuaaguauaacuaauuugcucugugguaagagauaugcucauuauuaccacuuagaagauguuguuaaaaacaugugaaagauagguauggaaaaagcauacacccccaaacagaaaggaguuauuaaaguaauuuacaaaccucucagcacuaauuaguguccaacuccaagugggucaauuccuuaguauaauauuaaggcuuacuaguaucacugcuuuuuccuuagcuuaaugacuuacuuagaauuuauccuuuauuuuaaaugaucuguacuaucuagugucuaaaacacuauucuccagaaaaaucaaucauuuucuagcccucucccucaguccuuuauuguccauuccaauacauugaacacauuuccuuuacccuccacacacuucuuccaaaaggaagcacccguugaguccuuuugagggugauuugucuuacaacugacugacuuagcaggaauuuaauuaggucauauuuggugaugagacuuauggagugugccucucucucccaacugcugcuuaaaaugcaaggacaagcaauuagaagccauccuaaggugcuuaccucacacgccacccaugaggcuuguggccacaguggcacuuggguguggcuccucuguuauuuguccucaugugagaaagcagaucaucuccaaaucuugccauuuguauacuuuugguggagacuuggaugucauaucuucuuuguuuuggguuuucuucccuagcuuauuuuguggcuuuuaaagaaguggauuguauugugagauccugugauuccugguggccaguauccuggauuccucuaagaucuugccucuuuccuccucaugaaagcagcacacauuguguuaacuuaugucucuuguuaaaugagcuuaaugucuuuguguuuuguccaaaacuguauugaaaaaauauuguuuaaugcaaaugaaggaaugcaauaaagaguaaauauacuugaaaaaaaaaaaaaaaa

SEQ ID NO: 207 - RNA, 66 nt, Homo Sapiens
gggcuggucugaugguauuggguuaucaggacuuauuagcauuagugucacuaaaguugagagaca

SEQ ID NO: 208 - RNA, 1157 nt, Homo Sapiens
ggcuccgcuauaaaacccaggccggcaggaucgcugcacccgcggcggccuccucggugcgcgacccccggcucagaggacucuuugcugucccgcaagaugcggaugcugcuggcgcuccuggcccucuccgcggcgcggccaucggccagugcagagucacacuggugcuacgagguucaagccgaguccuccaacuaccccugcuuggugccagucaagugggguggaaacugccagaaggaccgccagucccccaucaacaucgucaccaccaaggcaaagguggacaaaaaacugggacgcuucuucuucucuggcuacgauaagaagcaaacguggacuguccaaaauaacgggcacucagugaugauguugcuggagaacaaggccagcauuucuggaggaggacugccugccccauaccaggccaaacaguugcaccugcacugguccgacuugccauauaagggcucggagcacagccucgauggggagcacuuugccauggagaugcacauaguacaugagaaagagaaggggacaucgaggaaugugaaagaggcccaggacccugaagacgaaauugcggugcuggccuuucugguggaggcuggaacccaggugaacgagggcuuccagccacugguggaggcacugucuaauauccccaaaccugagaugagcacuacgauggcagagagcagccuguuggaccugcuccccaaggaggagaaacugaggcacuacuuccgcuaccugggcucacucaccacaccgaccugcgaugagaaggucgucuggacuguguuccgggagcccauucagcuucacagagaacagauccuggcauucucucagaagcuguacuacgacaaggaacagacagugagcaugaaggacaaugucaggccccugcagcagcuggggcagcgcacggugauaaaguccggggccccgggucggccgcugcccugggcccugccugcccugcugggccccaugcuggccugccugcuggccggcuuccugcgaugauggcucacuucugcacgcagccucucuguugccucagcucuccaaguuccaggcuuccgguccuuagccuucccaggugggacuuuaggcaugauuaaaauauggacauauuuuuggag

SEQ ID NO: 209 - RNA, 295 nt, Homo Sapiens
gcugggcaugguggcuugugccuguaguuccagcuacuugggaggcagagguaggaagauugcuugaguucaggagcucugggcuguagugcacuaugccaaucaggugucugcacuaaguucagcaucaauauggugaccucauaggaguaggggaccaccagguugccuaaggaggggugaaccagcccagguuggaaauagagcaggucaaaauucccaugcugaucaguagugggauugcaccuaugaauauugcacuccagccugugcaacauagugagacgcugucucu

SEQ ID NO: 210 - RNA, 3999 nt, Homo Sapiens
uggcggugguggcgguggcggcggcggugguggugguggcggcggcggcggcgaagggggcggagaggaaggagcgcggcgggaccgggccgggacagcgcguacuuugggcuccgggauucgcuccgcgcccgcgguuguagcagcugccgcugcagccauagcagcaggacuuccucaagcgcagggacuaugucuuaaggcgcuuugcagagccaagcucauuucuggcacauaagaggucagucauuggcaccaugaacuggaauaaaggugguccuggcacuaagcgaggauuuggcuuuggagguuuugccaucagugcugggaaaaaggaggaacccaaacucccacagcagucccacagugccuuuggggcaaccagcucuucuucuggauuuggaaagucagcuccaccacagcuuccuucuuucuacaaaauuggaucuaagcgggccaacuuugaugaagaaaaugccuauuuugaagaugaggaagaagauucuagcaacguugauuuaccuuacauuccugcugaaaacucaccaacucgccagcaauuccauuccaagccaguagauucugacagcgaugaugaucccuuggaggcauucauggcugaaguggaggaggaggaucaggcagcuagagacaugaagaggcuugaagaaaaggacaaggaaagaaaaaacguaaaggguauucgagaugacauugaagaggaagaugaccaagaagcuuauuuucgauacauggcagaaaacccaacugcuggugugguucaggaggaagaggaagacaaucuagaauaugauagugacggaaauccaauugcaccuaccaaaaaaaucauugauccucuuccccccauugaucauucagagauugacuauccaccauuugaaaaaaacuuuuacaaugagcaugaagagauaaccaaccucacuccacagcaguuaauagaucuccggcauaagcucaaucuucgggucucuggugcugcaccuccuagaccaggaaguagcuuugcucauuuuggguuugacgaacaacuuaugcaccagauucggaaaucugaauacacacagcccacuccaauacagugccagggugugccuguggcauuaagugguagagacaugauugguauugccaaaacagguagugggaaaacugcagccuucauuuggcccauguugauucauauaauggaccagaaggaguuggaaccaggugauggaccaauugcagugauuguguguccuaccagggagcuuugccagcagauccaugcagaauguaagcgguuuggaaaagcauauaaucuucgaucaguggccguauauggaggagggaguaugugggagcaggccaaggcccuucaggagggggcagagauuguuguguguaccccaggucgacugauagaucaugugaaaaagaaagcuaccaaucuucaaagagucucuuaccuuguguuugaugaagcagaucgaauguuugacaugggauuugaguaccaaguucgauccauagcaagucauguucguccugacaggcagacucucuuauuuagugcaacuuuucggaagaagauugaaaaguuggccagagacauccugaucgacccuauucgaguggugcagggagauauuggagaggcaaaugaagaugugacacagauuguggagauucuccauucuggaccuaguaaauggaacuggcuuacccggcgucugguagaauuuaccucuucagggaguguccuccucuuuguuacuaaaaaagccaaugcugaagagcuagcgaauaaccuuaaacaggagggucauaaucuugggcugcuccauggggauauggaucagagugagagaaacaaggucauuucagacuuuaagaaaaaggacaucccaguccugguggccacagauguugcagcccguggucuggacauuccuucaauuaagacugucauuaacuaugauguggcacgagacauugauacccacacgcauaggauuggccgcacaggaagagcgggugagaaagguguggccuauacccuacucacucccaaggacagcaauuuugcuggugaccugguccggaacuuggaaggagccaaucaacacguuucuaaggaacuccuagaucuggcaaugcagaaugccugguuucggaaaucucgauucaaaggagggaaaggaaaaaagcugaacauugguggaggaggccuaggcuacagggagcggccuggccugggcucugagaacauggaucgaggaaauaacaauguaaugagcaauuaugaggccuacaagccuuccacaggagcuaugggagaucgacuaacggcaaugaaagcagcuuuccagucacaguacaagagucacuuuguugcagccaguuuaaguaaucagaaggcuggaaguucugcugcuggggcaaguggguggacuagugcagggagcuugaauucuguuccaacuaacucagcacaacagggccauaacaguccugacagccccgucaccagugccgccaagggcaucccaggcuuuggcaauacuggcaacaucaguggugccccugugaccuacccgucugccggagcccaaggagucaacaacacagcuucagggaauaacagccgagaagggacugggggcagcaacgggaaaagagagagauauacugagaaccggggcagcagccgucacagucacggagagacuggcaaucggcauagcgauaguccacgucacggagaugguggucgccauggagauggauaccgccauccagaaagcagcagccgucauacugauggccaucggcacggggagaacagacauggaggaagcgcaggccggcauggggagaaccggggugcaaaugauggucggaauggggaaagcaggaaagaagcuuuuaaucgugagagcaagauggagcccaagauggaacccaaaguggacagcagcaagauggacaagguggacagcaagacagauaagacagcugacggcuuugcugucccagagccgccuaaacgcaagaaaagucgaugggacaguuagaggggaugugcuaaagcgugaaaucaguuguccuuaauuuuuagaaagauuuugguaacuaggugucucagggcuggguugggguccaaaguguaaggacccccugcccuuaguggagagcuggagcuuggagacauuaccccuucaucagaaggaauuuucggauguuuucuugggaagcuguuuugguccuuggaagcagugagagcugggaagcuucuuuuggcucuaggugaguugucauguggguaaguugagguuaucuugggauaaagggucuucuagggcacaaaacucacucuagguuuauauuguauguagcuuauauuuuuuacuaaggugucaccuuauaagcaucuauaaauugacuucuuuuucuuaguuguauggccaggcaguccccauuuuaggaguuggcuucugcaaauucaauccauugagcuaacuguuggggagcaauuugguaguuguagacauuugcagggaagggagaugucugauucuaaaugggaguugaugcucagguccccagccagguuugcauccagcccugagacauguaggaaacaccuuucagacccaggcucugaagauucccagaagccacaaggauugaagggaaaaggugauccugguaacuguuccaggauugcuccagguuugagaugguauugcuaaauuuaaaauuaaacaagaaacccaacaacagcuuuuaaagugucuucuaucucauuguauuuuuuuuaacuugccccaaugauagaaaagucuuuugcugaaaugauuuugaugauuuuuguuuaucguuuauaaaaaggaaaagaaauauacaaacuuugacuuuugugacuuugugaagguuucuuuaagaugugcauuccuuucugcuugcucucuaguaaauguuuuacuaccggga

SEQ ID NO: 211 - RNA, 630 nt, Homo Sapiens
gaaaagcuaugagaaauaaugugcccagggaccguggagacacagccauggaaguuggaaucuaugcaaauauccuugaaaaacaagcaaaggaggaaucugugccagaagugggauccaggccguguguuuccacagcccaagaugaggccaaacacucccaggagcuacaguaugccacccccguguuccaggagguggcaccaagagagcaagaagccugugauucuuauaaaucuggauaugucuauucugaacucaacuucugaaauuuacagaaacaaacuacaucucaggauggagucucacucuguugcccaggcuggaguucaguagcgcgaucuuggcucacuucaaucuccaucuucccaguucaagcgauucucaugccucgaccucccgaguagcugggauuacaggugcccgcuaccacgcccagcuaauuuuuguauuuuuaguagagaugggguuucacuaugguggccaggcuggucuugaacuccugaccucagaugaucugccugccucggccucccaaagugcuggaacuacaagccugagccaccgugcccggcccugaaucgcuuuaguaaauaaagggucuccaagaauaaauucauccgaacaugc

SEQ ID NO: 212 - RNA, 3831 nt, Homo Sapiens
agggaggggguggaaaggagggagaaaaggcagaggcgucaagggaggccggagggagagugggguggacagaggagcggagggacgagagggaagcgcacgauagcugcgcggagagagagcgaagagcaggcggaggaacaaaggcgacccaagacacccagagagggacaggauuggcugcggccaggccguuuccgguggagcugucgccuagccgcuaucgcagaguggagcggggcugggagcaaagcgcugagggagcucgguacgccgccgccucgcacccgcagccucgcgcccgccgccgcccguccccaggugaguggggucggccgggggcucaggcgagagaaccauggagucuggcaguaccgccgccagugaggaggcacgcagccuucgagaaugugagcucuacguccagaagcauaacauucaagcgcugcucaaagauucuauugugcaguugugcacugcucgaccugagagacccauggcauuccucagggaauacuuugagagguuggagaaggaggaggcaaaacagauucagaaucugcagaaagcaggcacucguacagacucaagggaggaugagauuucuccuccuccacccaacccagugguuaaagguaggaggcgacgaggugcuaucagcgcugaggucuacacggaggaagaugcggcauccuauguuagaaagguuauaccaaaagauuacaagacaauggccgcuuuagccaaagccauugaaaagaaugugcuguuuucacaucuugaugauaaugagagaagugauauuuuugaugccauguuuucggucuccuuuaucgcaggagagacugugauucagcaaggugaugaaggggauaacuucuaugugauugaucaaggagagacggaugucuauguuaacaaugaaugggcaaccaguguuggggaaggagggagcuuuggagaacuugcuuugauuuauggaacaccgagagcagccacugucaaagcaaagacaaaugugaaauuguggggcaucgaccgagacagcuauagaagaauccucaugggaagcacacugagaaagcggaagauguaugaggaauuccuuaguaaagucucuauuuuagagucucuggacaagugggaacgucuuacgguagcugaugcauuggaaccagugcaguuugaagaugggcagaagauuguggugcagggagaaccaggggaugaguucuucauuauuuuagaggggucagcugcugugcuacaacgucggucagaaaaugaagaguuuguugaagugggaagauuggggccuucugauuauuuuggugaaauugcacuacugaugaaucguccucgugcugccacaguuguugcucguggccccuugaagugcguuaagcuggaccgaccuagauuugaacguguucuuggcccaugcucagacauccucaaacgaaacauccagcaguacaacaguuuugugucacugucugucugaaaucugccuccugugccucccuuuucuccucuccccaauccaugcuucacucaugcaaacugcuuuauuuucccuacuugcagcgccaaguggccacuggcaucgcagcuuccugucuguuuauauauugaaaguugcuuuuauugcaccauuuucaauuuggagcauuaacuaaaugcucauacacaguuaaauaaauagaaagaguucuauggagacuuugcuguuacugcuucucuuugugcaguguuaguauucacccugggcagugagugccaugcuuuuuggugagggcagaucccagcaccuauugaauuaccauagaguaaugauguaacagugcaagauuuuuuuuuuaagugacauaauuguccaguuauaagcguauuuagacuguggccauauaugcuguauuucuuuguagaauaaaugguuucucauuaaacucuaaagauuagggaaaauggauauagaaaaucuuaguauaguagaaagacaucugccuguaauuaaacuaguuuaaggguggaaaaaugcccauuuuugcuaauuaucaaugggauaugauugguucaguuuuuuuuuuuccagaguuguuguuugccaagcuaaucugccugguuuuauuuauaucuuguuauuaauguuucuucuccaauucugaaauacuuuugaguauggcuaucuauaccugccuuuuaaguuugaaacuaacucauagauugcaaauauugguuaguauuuaacuacaucugccucggcucacaaauuccgauuagaccuuuauccagcuagugccaaauaauugaucagaugcugaauugagaauaagaauuugaggucuacauucuugguuguuaauuuagagcguuugguuaaaguauguccuucagcugacuccaguauaaucuccucugcucauuaaacugauuccaggagauuggauuugcugugacuagauacagauggagcaaauguccuaacagagaaauagaggugaugcugcuaaagggagaaaugccaggcggacaaaguucagugucgggaauuuuccccgugacauucacuggggcaugagauuuuggaagaaguuuuuuacuuugguuuagucuuuuuuuccuuccuuuuuauucagcuagaauuucugguggguugaugguaggguauaaugugucuguguugcuucaaauuggucugaaaggcuauccugcugaaaguccugcuuuccuaucuagcauuuauuucucuggcaaacuuuucuuucuuuucuuuuuuaaaguaaacuuguguauugagucuuaacuguauuucaguauuuuccagccuuauguguuacauuauuccaaugauacccaacaguuuauuuuuauuauuuuuuuaaacaaaauuucacaguucuguaauguaggcacuuuuauuuucauugugauuuauauauaagguaauguaggguuauauuugggagugacugcaagcauuuuuccaucugugugcaacuaacugacucuguuauugaucccuucuccugcccuuucccagguaauuuaaauuggucaugguagauuuuuuucauagauuugaaaaacuuuuagguuguuaccaaguaugaaguauaaaucuggggaagagguuuuauuuacauuuuaggguggguaagaaagccaccuuguuacaaauuuuuuaauuuccaaaauaaucuauauuaaaugaggguuucugaucuguacuuuguguuuagcuaccuuuuuauauuuaaaaaauuaaaaaugaaaauuacguucuuacaagcuuaaagcuugauuugaucuuuguuuaaaugccaaaauguacuuaaaugaguuacuuagaaugccauaaaauugcaguuucauguauguauauaaucaugcucauguauauuuaguuacguauaaugcuuucugagugaguuuuacucuuaaaucauuugguuaaaucauuuggcuugcuguuuacucccuucuguaguuuuuaauuaaaaacuuuaaagauaagucuacauuaaacaaugaucacaucuaaagcuuuaucuuuguguaaucuaaguauaugugagaaaucagaauuggcauaauuugucuuaguugauauucaaggcuuuaaaagucauuauuccugggcuugguaagugaauuuaugagauuuacugcucuagaaaguauagauggccaaaggaccguuuuguauugcuuccugauuaccagucugauuauaccaugugugcuaauauacuuuuuuuguuauagauugucuuaaugguaggucaaguaauaaaaagagaugaaauaauuuaaauucuuaaaaaaaaa

SEQ ID NO: 213 - RNA, 3123 nt, Homo Sapiens
aguuccaaguuuggagcuuuuagcugccagcccuggcccaucauguagcugcagcacagccuucccuaacguugcaacugggggaaaaaucacuuuccagucuguuuugcaaggugugcauuuccaucuugauucccugaaaguccaucugcugcaucggucaagagaaacuccacuugcaugaagauugcacgccugcagcuugcaucuuuguugcaaaacuagcuacagaagagaagcaaggcaaagucuuuugugcuccccucccccaucaaaggaaaggggaaaaugucucagucgaaaggcagaguguugcugugugugcuugugauuuguauuuuauuugauguaaacgugaaggcagaguauuuucuaacacuguaauucaacuagguuuugugucuccuggaucuauuuuuuuuucuuguuguucugaggagcugauauacuuggaaauauuagguuuaagauaugcagauguccaacuuauauacauagucaaggguuuagagucuggagacaggaggcuggcaauuucaacuaggaggcaggucaggcaagaagcgaaacccuggccuuaaaauuccaaaagaagcauuugaacaaccucagaccaguuccacaccaccucgagauuuagacuccaaggcuugcauuucuauuggaaaucagaacuuugaggugaaggcagaugaccuggagccuauaauggaacugggacgaggugcguacggggugguggagaagaugcggcacgugcccagcgggcagaucauggcagugaagcggauccgagccacaguaaauagccaggaacagaaacggcuacugauggauuuggauauuuccaugaggacgguggacuguccauucacugucaccuuuuauggcgcacuguuucgggagggugauguguggaucugcauggagcucauggauacaucacuagauaaauucuacaaacaaguuauugauaaaggccagacaauuccagaggacaucuuagggaaaauagcaguuucuauuguaaaagcauuagaacauuuacauaguaagcugucugucauucacagagacgucaagccuucuaauguacucaucaaugcucucggucaagugaagaugugcgauuuuggaaucaguggcuacuugguggacucuguugcuaaaacaauugaugcagguugcaaaccauacauggccccugaaagaauaaacccagagcucaaccagaagggauacagugugaagucugacauuuggagucugggcaucacgaugauugaguuggccauccuucgauuucccuaugauucauggggaacuccauuucagcagcucaaacaggugguagaggagccaucgccacaacucccagcagacaaguucucugcagaguuuguugacuuuaccucacagugcuuaaagaagaauuccaaagaacggccuacauacccagagcuaaugcaacauccauuuuucacccuacaugaauccaaaggaacagauguggcaucuuuuguaaaacugauucuuggagacuaaaaagcaguggacuuaaucgguugacccuacuguggauugguggguuucggggugaagcaaguucacuacagcaucaauagaaagucaucuuugagauaauuuaacccugccucucagaggguuuucucucccaauuuucuuuuuacucccccucuuaagggggccuuggaaucuauaguauagaaugaacugucuagauggaugaauuaugauaaaggcuuaggacuucaaaaggugauuaaauauuuaaugaugugucauaugaguccucaagcuucucagacuucucuuauucuuuacaaaaugaaugcauuggcccugacaaaaaggugcuacgguagugaugaaauuauaaguagauuuguaguuugucccauuuauuauuuuaauauuuauguuuaagugcuugguugaaaagauuccauuuuauacaagaagggagauucaaaaaaaaaauauaagguuggguuagcaauauuuauagggcuuuuauuuuuuaaguucaauugugucugugguccagaagaaauuauuuaauaugcaucuuugagaauauuauaaaaauaucaaaaaggagcucuucuugugaaaugucuguuccagcuguugugacugcugccauuuuugcaaacaucugcccaauccugggugaucaccacaucuuuuaggggaagugacaagaugcucuggucauacucuuuuucccaacuuuggaaaacauaaaaaucacucauauaacagcucaaagaguaaaacauuugguucuucugacacuugugguauaguauuaguggaaagugauuuguaauaugauuuuauauccaccuaccuauucaucuaccuguguguauguguguguuugugugucuauuuggcaauucacaaguccugccaagugguuucuaugagcaucucuguuugguaaggaggacaauugucaguuuugagggggacauguguuaaaucacagaaaaaaauggugccuucuucugcguuugucccuccugccauguguaaguuguaaggauugccuuuguaguuaauguacucuuuggcuuuguuuguuuguuuucuucuucagugaagcagccuuacuauucauagaagggcuagaauaggagaaaaugaaagguagugaguaauucuuugauaagaugaggaaauaaugggaaagguugaauuaauuccugggcauggacuaccagaugaccacaaguugcguugaggccgcaucuuucuucagcagcgugcaauagcuggcuccucuauaggagaugagcuucauugggaguuccuagcaaguugacuaaacagcaaaaguucuuucucguggguaaauauacccacagguucuaugauuuguagcucuagguuucuugaugaucaaggagugaaguaauugacagggaaaauauagaccuaugauaaauaaccaggaagcauugcuuuuggacaaggaaggacagaggguuuugauuuuaaaaagaagaaaaaaaaaccuuauuuuuucuuucuuggccucaaguucaauauggagaggauugcuucccugaauccucucuuccuuccccuuuuaga

SEQ ID NO: 214 - RNA, 459 nt, Homo Sapiens
augaugugugacuucaccgaggaccagaccacagaguucaaggaggccuuccagcuguuugaccgaacaggugauggcaagauccuguacaaccaauguggggaugugaugaggccccuaggucagaaucccacuaacacugagguggucaagguucugaggaaccccaagaguaaugagaugaaugugaaguugcuggacuuugagcacuuucugcccaugcugcagaugguggccaagaacaaggaccaaggcaccuaugaagauuacguagaaggacuucagguguuugacaaggaaggaaauggcaccaucauggguguugaauucuggcacguucuugucacacugggugagaagauaacagaggaagaaguagagguguugguggcagggaacgagggcagcaaugguuguaucgacuaugaagcauuugugaggcauauccugucgggauga

SEQ ID NO: 215 - RNA, 86 nt, Homo Sapiens
agcugaguccaugaugauuucaaguuaucccugucugaaggcaaagaaaggccuuucuguguggaauuugaauaucugaaacucag

SEQ ID NO: 216 - RNA, 3404 nt, Homo Sapiens
aagauggcggcgcgcugggagcguaucaucugcguuucuaggagcuucgcuaugcggcugcuuuaagauucuaggguuguacaggcccacgccagacacgacgucuggcaggaaccucggccucagagauggcucugaguaaaucaaugcaugcaagaaauagauacaaggacaaaccuccugacuuugcauaucuggcauccaaauauccagauuuuaagcagcauguucagauaaaucugaauggaagagugagccuuaauuuuaaagaccccgaagcagucagagcucugacguguacucuccuaagggaagauuuuggacuuucuauugauauuccauuggagagacuaauucccacaguucccuugagacucaacuauauucacuggguagaagaucugaucggucaccaggauucugacaaaaguacucuccgaagaggaauugacauaggcacgggggcaucuugcaucuaccccuuacuuggagcaaccuugaauggcugguauuuccucgcaacagaaguggaugauauguguuucaacuaugcaaagaaaaauguggaacagaauaacuuaucugaucucauaaaaguggugaaagugccacagaagacacuccugauggaugcucuuaaagaagaaucugagauaaucuaugacuuuugcaugugcaacccucccuuuuuugccaaucaauuggaagccaagggaguaaacucacgaaauccucgaagaccuccgccuaguucuguuaauacaggaggcaucacagagaucauggcagaaggaggugaauuagaguuuguuaaaaggaucauccaugacagucuacaacuuaaaaaaagauuaagaugguauagcugcaugcugggaaagaaaugcagccuggcgccucugaaggaggagcuucgcauacaagggguucccaaaguaacguacacugaauucugucaaggucggacaaugagaugggccuuagcuuggaguuuuuaugaugaugucacaguaccaucaccaccaaguaagcgaagaaaauuagagaaaccgagaaaacccauaacauucguggugcuggcguccgugaugaaggaauuaucccucaaagcaucaccucugcgcucggagacggcggaaggcauagucguugucacgacauggauugaaaaaauucucacugauuugaagguccagcauaaacgaguucccuguggaaaagaggaagucagccuuuuccuaacggccauagaaaacuccuggauucauuuaaggagaaagaaaagagagcgugugagacagcugagagaaguuccccgagcuccugaggacgucauucaggccuuggaagagaaaaagcccacccccaaagagucuggcaauagccaagaacuggccaggggcccccaggagaggacccccugugggccugcucugcgggaaggcgaggcugccgcuguggagggcccgugcccgagccaggagucccugucccaggaggaaaacccggaacccacggaggaugaaaggagugaggaaaagggagggguggagguuuuggaaaguugucaaggcucuagcaacggagcccaggaccaagaggcuucugagcaguucggcagcccaguggcugaaagggggaaacgucucccaggaguggccggacaguaccuguuuaaguguuugauaaacguuaagaaggagguggacgaugccuuaguggagaugcacuggguugagggccagaacagggaucugaugaaccagcuuugcaccuacauacguaaccaaauuuucaggcuuguugcaguuaacuagaaaccuccugcacaguuggaaacguguugauaguaacuugcuuuggaguggccugugggguggcaagaggaauccuaccagcggcccauuaguagcacgauguggaauuaucuucgaaaacaaaaaccuaugaaucugucccccaccuccccccgccuccuucccgcuuuuugaguuacagggagucguaguguggucauuuacaaggaggaauuguggucaucaguaacaacagaaagcccucaguaaacucccgagggauugcaagcuggcucaagcuggccccucagcucuggacugccucugcaaggucagaaggguuguuuguggagucugggcugggcagcacugccuagaauaucaugcugucucugucacccaaggguguuucuugaggagggguggcucucucugccuccagcuggaggcccugguacccuguucuaggucacucuucaagauggggccuaccuugcaucaaucccacaaagggagcuguauggugggugguggggaaucugggagagaaaccuuaguaaugcugggaaggagcagcagagucuggggaccacccgguaaauggcacauuccugacaccuggcuguuuugauguugcuuauuucagaagcagaauuagguaagcaaaacuccccggugugacugaggcacacagaaggcacccauacccccaccuccagccuguugacaguaccauuuuguagcaguuuuacuacugugugauuuuuguuuggacaucugaaguagagcuuguuuuguuuuuaaauaagaauauucacaaauuaaaaaccagcgguccuauuugaauccugggguuagcugagugagcggcugaugauagaaaugagaaauagaacaaaauaguaugugccguagguagcuuaagaaagucucagauauuuuguugcugaucaaauacuguuuuuuuguggcuucacuuguaauccccccuguacuuaccuacucacauuggagaguucugaggccggaguaacuguguccuugaaacacguuucuaauuggaaugccaggguucaguagccguccccccggaaaggggugaccuuuugcugugcuugauguugcaucagcagccuaggguucuguuuagacuaaaaucuuggccagagcuccuugccaucugcuaagaagacuggggcugaguaguuaagccagccuucugagagguggcuguuggucaggacgggaagcuggugaccuuggcaugucuuggcagcagcuagaucaggcccucggcagagacacaggaagcggaacugcugugccuuaacuuggcuguggagcuggagcuggagaaggcagcauacugaccaguggcuuuuugauugauuguuuguuaugagguggaguuuuacucuuguugucuaggcuggagugccguggugcgaucuuagcucacugcaacccccgccucccggguucaagcgauucuccugcaggagacucgcuugaaccugggagguggagguugcagugagccgagaaugccacugcacuacagccugggcgacaaagugggacugucucaaaaaaaaaaaaaaaaaaaaa

SEQ ID NO: 217 - RNA, 460 nt, Homo Sapiens
ugguccggugcguccuguucuacagcuauggccgggccagcugcagcuuuccgccgcuugggcgccuuguccggagcugcggccuuaggcuucgcuuccuacggggcgcacggcgcccaauucccagaugccuacgggaaggagcuguuugacaaggccaacaaacaccacuucuuacacagccuggcccuguuaggggugccccauugcagaaagccacucugggcuggguuauugcuagcuuccggaacgaccuuauucugcaccagcuuuuacuaccaggcucugaguggagaccccagcauccagacuuuggccccugcgggagggacccugcuacucuugggcuggcuugccuuggcucuuugagcucccuuuugcuuaauuacuggguuuucugggcaguuuuuuuuuuaaagaguuggaguaagaagaggauuaaaaaggaaaggcaaauaaa

SEQ ID NO: 218 - RNA, 129 nt, Homo Sapiens
ugcacuuauguauguuuuuguuuaacuuguggacaaagacuuauggauaggugcaacaaauaaauccucuuuugcaacccagaacucauuguucagcaugaguuuugauacauacaggaagggauauuu

SEQ ID NO: 219 - RNA, 3447 nt, Homo Sapiens
auuccugccugggagguuguggaagaaggaagauggccagagcuuuguguccacugcaagcccucuggcuucuggagugggugcugcugcucuugggaccuugugcugccccuccagccugggccuugaaccuggacccagugcagcucaccuucuaugcaggccccaauggcagccaguuuggauuuucacuggacuuccacaaggacagccaugggagaguggccaucguggugggcgccccgcggacccugggccccagccaggaggagacgggcggcguguuccugugccccuggagggccgagggcggccagugccccucgcugcucuuugaccuccgugaugagacccgaaauguaggcucccaaacuuuacaaaccuucaaggcccgccaaggacugggggcgucggucgucagcuggagcgacgucauuguggccugcgcccccuggcagcacuggaacguccuagaaaagacugaggaggcugagaagacgcccguagguagcugcuuuuuggcucagccagagagcggccgccgcgccgaguacucccccugucgcgggaacacccugagccgcauuuacguggaaaaugauuuuagcugggacaagcguuacugugaagcgggcuucagcuccguggucacucaggcgagccggagagcuggugcuuggggcuccuggcggcuauuauuucuuaggucuccuggcccaggcuccaguugcggauauuuucucgaguuaccgcccaggcauccuuuuguggcacguguccucccagagccucuccuuugacuccagcaacccagaguacuucgacggcuacuggggguacucgguggccgugggcgaguucgacggggaucucaacacuacagaacggggagcgggaaguggguagaauaugucgucggugcccccacuuggagcuggacccugggagcgguggaaauuuuggauuccuacuaccagaggcugcaucggcugcgcggagagcagauggcgucguauuuugggcauucaguggcugucacugacgucaacggggaugggaggcaugaucugcuggugggcgcuccacuguauauggagagccgggcagaccgaaaacuggccgaaguggggcguguguauuuguuccugcagccgcgaggcccccacgcgcugggugcccccagccuccugcugacuggcacacagcucuaugggcgauucggcucugccaucgcaccccugggcgaccucgaccgggauggcuacaauguggcucacaccuguaaucccagcacuuugggagcccaaggugggcagaucacuugaggucaggaguucgagaucagccuggccaauacauugcaguggcugcccccuacgggggucccaguggccggggccaagugcugguguuccugggucagagugaggggcugaggucacgucccucccagguccuggacagccccuuccccacaggcucugccuuuggcuucucccuucgaggugccguagacaucgaugacaacggauacccagaccugaucgugggagcuuacggggccaaccagguggcuguguacagagcucagccaguggugaaggccucuguccagcuacuggugcaagauucacugaauccugcugugaagagcuguguccuaccucagaccaagacacccgugagcugcuucaacauccagauguguguuggagccacugggcacaacauuccucagaagcuaucccuaaaugccgagcugcagcuggaccggcagaagccccgccagggccggcgggugcugcugcugggcucucaacaggcaggcaccacccugaaccuggaucugggcggaaagcacagccccaucugccacaccaccauggccuuccuucgagaugaggcagacuuccgggacaagcugagccccauugugcucagccucaaugugucccuaccgcccacggaggcuggaauggccccugcugucgugcugcauggagacacccaugugcaggagcagacacgaaucguccuggacuguggggaagaugacguaugugugccccagcuucagcucacugccagcgugacgggcuccccgcuccuaguuggggcagauaauguccuggagcugcagauggacgcagccaacgagggcgagggggccuaugaagcagagcuggccgugcaccugccccagggcgcccacuacaugcgggcccuaagcaaugucgagggcuuugagagacucaucuguaaucagaagaaggagaaugagaccaggguggugcugugugagcugggcaaccccaugaagaagaacgcccagauaggaaucgcgauguuggugagcguggggaaucuggaagaggcuggggagucuguguccuuccagcugcagauacggagcaagaacagccagaauccaaacagcaagauugugcugcuggacgugccgguccgggcagaggcccaaguggagcugcgagggaacuccuuuccagccucccuggugguggcagcagaagaaggugagagggagcagaacagcuuggacagcuggggacccaaaguggagcacaccuaugagcuccacaacaauggcccugggacugugaauggucuucaccucagcauccaccuuccgggacagucccagcccuccgaccugcucuacauccuggauauacagccccaggggggccuucagugcuucccacagccuccugucaacccucucaagguggacugggggcugcccauccccagccccucccccauucacccggcccaucacaagcgggaucgcagacagaucuuccugccagagcccgagcagcccucgaggcuucaggauccaguucucguaagcugcgacucggcgcccuguacuguggugcagugugaccugcaggagauggcgcgcgggcagcgggccauggucacggugcuggccuuccuguggcugcccagccucuaccagaggccucuggaucaguuugugcugcagucgcacgcaugguucaacguguccucccuccccuaugcggugcccccgcucagccugccccgaggggaagcucagguguggacacagcugcuccgggccuuggaggagagggccauuccaaucuggugggugcuggugggugugcuggguggccugcugcugcucaccauccugguccuggccauguggaaggucggcuucuucaagcggaaccggccaccccuggaagaagaugaugaagagggggagugauggugcagccuacacuauucuagcaggaggguugggcgugcuaccugcaccgccccuucuccaacaaguugccuccaagcuuuggguuggagcuguuccauuggguccucuuggugucguuucccucccaacagagcugggcuacccccccuccugcugccuaauaaagagacugagcccug

SEQ ID NO: 220 - RNA, 5786 nt, Homo Sapiens
gcgcggccucagagggucgggcggacgccgccugggugagaagcaggcagccaguacccuugccacgguagaaugggugaggaggggccccccagccuggaguacauccaagccaaggaucuguucccccccaaggaacuagugaaggaggaagagaaucuucagguccccuucacagugcugcagggugagggaguagaguuccugggccgggcagccgaugcccucauugccaucucuaacuaccggcugcauaucaaauucaaggacucugucaucaacgucccccuccggaugauugacaguguggagagccgugauauguuccaguugcacauuuccugcaaggacuccaaaguggugaggugccacuucuccacuuuuaagcagugccaagaguggcucucacggcuaagccgagccacagcaagaccugccaagccugaagaccucuuugccuuugccuaccaugccuggugccuggggcugaccgaggaggaccagcacacucaccuaugucagccaggugagcacauacguugucgacaggaggcggagcuugcaaggaugggcuuugaccugcagaacgucuggagagucucacacaucaacagcaacuacaaauugugccccaguuacccccagaagcugcugguuccuguguggaucacugacaaagagcuggagaacguggcuuccuuccgcuccuggaagcggauucccgugguuguguauagacacuugcgcaauggggcugccaucgcccgcugcagccagccagagaucagcugguggggcuggcgcaaugcugaugaugaguaccuggucacguccauugcuaaagccugugcccuggacccggggacaagggccacugggggcucccucagcaccgggaauaaugauaccagcgaggcgugugaugcugacuuugauucuucucugacugcgugcucuggaguggagagcacagcagcuccucaaaagcugcugauccuggaugcgcgauccuacacggcagcaguggccaaccgggccaaggguggaggcugugaaugugaagaguacuaucccaacugugaggucguguucaugggaauggccaacauccaugccauccggaacagcuuucaguaccuccgggcuguguguagccagaugccggauccuagcaacugguugucggcacuggagaguaccaaauggcugcagcacuugucggugaugcuaaaagcagcugugcugguggcuaauacaguagaccgggaaggccggccugugcugguacacugcucagauggcugggaccgcacaccgcagaucguagcccuggccaaaauauuacuggacccauauuacaggacguuggagggcuuccaaguguuaguggagucugacuggcuggauuuugggcacaaguuuggagaucgcuguggccaccaagagaauguggaggaccaaaacgaacaaugcccuguguuccuccaguggcuugauucuguucaucaguugcuuaagcaguuccccugccuguuugaauuuaaugaagcauuccugguaaaacuggugcaacacacauacuccugccucuacggcaccuuccuggccaacaaccccugugagcgagagaagcgcaacaucuacaagcggaccugcucugugugggcgcuccuucgagcuggcaauaaaaacuuucauaacuuccucuacacacccagcucagacaugguccugcauccuguuugucauguccgggcccugcaccucuggacagcuguuuaucugccagcaucaucuccaugcacacuuggggaagaaaacauggaucuuuaccuuuccccaguggcccagagccaggaguucucuggccgcucucuggacagauuaccuaaaaccagauccauggaugaucuucuuucugccugugacacaagcagcccccugacucguacauccagugacccuaaccugaauaaccacugucaggaggucaggguaggccuggagcccuggcacagcaauccugagggaucagagacaagcuuuguggacucugggguaggagggccucagcaaacuguaggagaagugggucuuccuccuccucugcccagcagccagaaagacuacuugagcaauaaaccuuucaagagucacaaaagcuguucuccaaguuacaaacugcuuaauaccgcagugccucgggaaaugaagagcaacaccucugauccugagaucaaaguccuagaagagacuaagggaccagcuccagacccuucugcccaggaugagcuggguaggacuuuagauggcauaggggagccaccugaacauuguccugaaacagaagcugucagugcacucuccaaggucauuucuaacaagugugauggaguuuguaauuuuccugagucuucccagaacucuccuacagguacgccccaacaggcccagccagacuccaugcuaggugugcccuccaaguguguucuugaucacagccucagcaccguuugcaacccaccgagugcugccugccaaacuccucuagacccaagcacugacuuccucaaccaagaucccucagggucuguggcaaguaucucccaccaggaacaacugaguucugugccggaucugacccauggggaggaagacauugguaaaagaggaaauaauaggaaugggcaguuauuggaaaauccucgcuuugggaaaaugccauuggaauugguccggaagccaauuucucagagccagaucagugaguucucuuuucuaggguccaacugggacagcuuccaagggauggugacuucauucccaaguggggaggccaccccucggcggcugcuuuccuauggcuguuguagcaagaggccaaacaguaagcagaugcgggccacagggcccugcuuugggggccagugggcucagagagaaggugugaagucaccugucuguucuagucauuccaauggacauuguacuggcccaggaggaaagaaccagaugugguuguccagucauccaaagcaagucucuagcacaaagcccguuccacugaacugcccuucuccagugccuccucuguauuuggaugaugauggacuccccuuucccacggaugugauccagcauagguuacggcaaaucgaagcaggguacaaacaagagguggagcagcuacgucgacaggugcgugagcuucagaugaggcuggacauccgucacugcugugccccuccagcagagccccccauggacuaugaggaugauuuuacauguuugaaggagucagauggcagugauacugaggauuuuggcucugaucacagugaagacugccuuucagaagcaagcugggaaccuguugauaagaaagagacugaggugacucgcuggguuccagaccauauggcaucacacugcuauaacugugacugugaauucugguuggccaaacgaagacaccauugcagaaauugugggaauguauuuugugcuggaugcugccaccugaagcugcccauuccugaucagcaacucuaugacccaguucucgucuguaacucauguuacgaacacauucaagucucucgugccagggaacucaugagccaacagcugaagaaacccauugcuacagcuuccaguugaaugccggggagaaaccuguccaauuuuagcagguuugaagggaggaucuucuucaguuguaguuuggaagguuccuugguguggcucaugaaaucacagagcucagagauaccaucuugagaaauccuccuugguaucaugaaacuggagcagaggaauugcaauuuagcaggagguccucuacuggugauacccucaccuugggguaaugguccuaacccagacccagggucuggaagcuuaauguugaguuggugacuccagccucuuucuccuggaggucacaagaugaugauugcguagauguugccuggugcaaagugccccaaacagcaauagaaaggcauauguauaaccaaacuccaagugauaaccagacccaucucuccuccaccuugacaaaagcagauuauaguauacaagguaggaauuccuguccuauuugagaugaacuauauccuguaccucugugcucugugucugcaugaaggcucagccuuuagaggcacuccuucuaguugcauuaguacugucuuucuguggaguuugguuugaagacuggcucagcaaguggagguuucaauguauuuuucaguuggcucaucagccagcauuggugaauauucaguuuaggggaacaguucuagggagugagacauuuuugggagcagaggaaaacucugcugauguucgguccuggcaaacauugaguuauuuugagcugugaaggcagucgucucuguuacacaguggcagcucuugaguuaugcacugugaagaaugagaagggaaaagcaaaaauuauccuugugaaauaucugcugauugugcccuacucuuugcaccugacuuuuccuaguuguccuggugcuaacacaggagcuacaccuugauccucuccuggcaugaaaauaaaacaaagguuuucguuguuguuguuccauugcccauuucccccauguugucuuucccuuggcugaugccuccucugggucacauugcuucuuauccugaacacuugacaccuugaggguagaauuuagcguuugguuuuuaccuccuagcauaugcuguuugguaugugaggguuucaguacaaaugcugcugucuauuucugugcacuuaacaauggaacccaaacagaagagaauaaagccuugauaccaaaauugggaaagaacauguguccauuuggaccaaacguuguugguuuuuaaaaaauuuuauuuuguuuuuuuguuuuuguuuuuguuuuuuuucaucuuaauauguaccaguggcacuuaaccaaaagauacagugauauagccauguacugugggugggacagauacagucuccuuggccuauaaugaaaccacuaggacuuuauacaguuuuccuuaauuuguugacauauaaaugguaaauuauauuuaggcuuauccuguuuugaaaugaugguagucaucuuucuuacugcuacuuucauguugcuuucuagaaaacagcauuucauuccaaaauaacuaggaucugcauuuagaacaagaaucauuauuuguccugaccuuuucaguccuacagagacgcaucugugguucuuuuguacuugccauagauguaaccuaaaaaguuuuggcauauuuaggucagccuagcggaacuuuuuuuuucauuuaaauggagcugaauaauggagauuuugugucugcaaaauuccugagaucauugaaaaaguaacaagcuguuccuuguuucugauacauaaaauuauuuuaagcauuuuaucaaucauuaaaauuuacugccaguugugaguggcuuuuuaauuaacuugucuuucauugcacuucacucugccuguuuucaaggggaguaagauugguaacauuuggggagacuguaucugucuacuuagcguggcuguuuugagggacugucccaucagugaacaaacugcauggccuuggagagagacucugggcucuuggcucagauguguucaucaaauacuccuuucagagcuguuguggguguaagugacaugauguggccaaaaauccaaacugugcaguugcguugugacaaacaugcaaugugcuguaaaaauucaauacaguuuaaauaaaaucucuauauuagu

SEQ ID NO: 221 - RNA, 103 nt, Homo Sapiens
gugcuugcuuuggcagcacauacaccaaaauuggaacaauauacagaagauuagcauggccccugcacaagaaugacacucaaauuuguguucuguauuaaaa

SEQ ID NO: 222 - RNA, 2290 nt, Homo Sapiens
uggcccgaaggcagaacuaacugugccugcagucuucacucucaggaugcagccgaggugggcccaaggggccacgauguggcuuggaguccugcugacccuucugcucuguucaagccuugagggucaagaaaacuguaagucugauguuuccacuguaacagauguuucuaccuggcuuccuccuuucucuucugugaugccuaaaacgcacauuaaauugcugggguuugauacuucuaacaauuaaggaaaagaauccaauugagaacuaaaguuuaucccaugugggcauuuuuagaaaggcuuagaucuaagccaaguucuggucaguguguuuuagaaguagcacacguuuccuuggcuggucugaaaguaguggguuaucuugaugaauuguuuagucaguuacagaucaaacuccauguucuuuucucuguucucacgacuacucuugacuagucuaaaaauauauuagguuguugaaaaguaauugugguuuuugccauuacuuuuuuaaaagauggcaaaaaacacaauuauaaguagcacacauuuucuuuuuuuuuuccuuuuuuuuuugagacagagucucuguuacccaggcuggagugcaguggugcaaucccggcucucugcaaacuccgccuccuggguucaagggauucuccugucucagccuccuaaguagcuggaauuagaggcgcaugccaccaggcccggcuaauuuuuguauuuuuaguagagacaggguuucaccauguuggccaggcuggucucaaacuccugaccucaggugauccgcuggccuccaccucccaaagugcugggauuacaggugugagccaccacgcccggccucacauuuucuagauuucagugcauugcuguuuuuugggauggggaagugauuuuuuuauuuuaaugagcaauuccauaauuaguuuuuuguuguuuuaccauaauggcuuauuugaauauuguaaccuauccccaacuguuuuuauuugcaaaugagauauaauugauuuguuagacauaugaagacagauccuaguuuaaauuguugcuacuuuuuuuacuccuaaaugauaaaaaucacacacuggagcucauuuuccauucaccugugaggcuacaaguauaucuguaauauuuugugcuuguacaaagggaaguggggugcugccuaucuuugaagccugguuuaucuuccacuuuacagcuaauuuugaaccuuugucuugagaugagaggguuuuguucugcuucuucugggaccacaugaaugagggggcucaguagugucccggggcugugaauagagggagagcccacagaacacuauuuccuugucagaagucacugcaaucagcaaagaauggaggugacuggguugcaggcaaauugcacagcucuuuggaggugaaguccaugggcaaggcuagcuggugagucaagccucggagcaguggccccaggcuggggagggcuaguuggccacuggcaaagccccucugccaggcuucucugcucaacuguaggugcuuccuugggcauuugauccccauggcaacccacggaggcaggauauccauaaucuucauaauuauccugcuggacugauggugucaccaagccucagaaauaaccgauuuuaccagccguguuggcucacaccuguaaucccagcacuuugggaggccaagguggucgaaucacuugaagccaggaguucaaaaccagccuggccaaaacagugaaaccccgucucuacuaaaaauacaaaaaauuagcuggacaugguggcacaugccuguaaucccagcuacucgggaggcaggggcaugagaauugcuugaacccgggaggcagagguucggugagccaggauugcgccacugcacuccagccugggcaacggagcaggacuuugucucagaaaaaaagaaagaaagaaagaaagaaccgauuuguccacgagagaggcaguuggcugggcacugggacuggaacuuccacucucugaagcugcaccauuugucuggagccauaggccugacucaagucuuuuagaccaguuuuacuuaagcucuuugauuuguuuucccaaucuguaacauggggaugauaagagaacuucgugggcaugaagugggugugagguugagacuggauaaaaggaggugauuaauuggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 223 - RNA, 2321 nt, Homo Sapiens
ggcaccucauucauuucuaccggucucuaguagugcagcuucggcuggugucaucgguguccuuccuccgcugccgcccccgcaaggcuucgccgucaucgaggccauuuccagcgacuugucgcacgcuuuucuauauacuucguuccccgccaaccgcaaccauugacgccaugucggguuauucgagugaccgagaccgcggccgggaccgaggguuuggugcaccucgauuuggaggaaguagggcagggcccuuaucuggaaagaaguuuggaaacccuggggagaaauuaguuaaaaagaaguggaaucuugaugagcugccuaaauuugagaagaauuuuuaucaagagcacccugauuuggcuaggcgcacagcacaagagguggaaacauacagaagaagcaaggaaauuacaguuagaggucacaacugcccgaagccaguucuaaauuuuuaugaagccaauuucccugcaaaugucauggauguuauugcaagacagaauuucacugaacccacugcuauucaagcucagggauggccaguugcucuaaguggauuggauaugguuggaguggcacagacuggaucugggaaaacauugucuuauuugcuuccugccauuguccacaucaaucaucagccauuccuagagagaggcgaugggccuauuuguuuggugcuggcaccaacucgggaacuggcccaacaggugcagcaaguagcugcugaauauuguagagcaugucgcuugaagucuacuuguaucuacgguggugcuccuaagggaccacaaauacgugauuuggagagagguguggaaaucuguauugcaacaccuggaagacugauugacuuuuuagaguguggaaaaaccaaucugagaagaacaaccuaccuuguccuugaugaagcagauagaaugcuugauaugggcuuugaaccccaaauaaggaagauuguggaucaaauaagaccugauaggcaaacucuaauguggagugcgacuuggccaaaagaaguaagacagcuugcugaagauuuccugaaagacuauauucauauaaacauuggugcacuugaacugagugcaaaccacaacauucuucagauuguggaugugugucaugacguagaaaaggaugaaaaacuuauucgucuaauggaagagaucaugagugagaaggagaauaaaaccauuguuuuuguggaaaccaaaagaagaugugaugagcuuaccagaaaaaugaggagagauggguggccugccauggguauccauggugacaagagucaacaagagcgugacuggguucuaaaugaauucaaacauggaaaagcuccuauucugauugcuacagauguggccuccagagggcuagauguggaagaugugaaauuugucaucaauuaugacuacccuaacuccucagaggauuauauucaucgaauuggaagaacugcucgcaguaccaaaacaggcacagcauacacuuucuuuacaccuaauaacauaaagcaagugagcgaccuuaucucugugcuucgugaagcuaaucaagcaauuaaucccaaguugcuucaguuggucgaagacagagguucaggucguuccagggguagaggaggcaugaaggaugaccgucgggacagauacucugcgggcaaaagggguggauuuaauaccuuuagagacagggaaaauuaugacagagguuacucuagccugcuuaaaagagauuuuggggcaaaaacucagaaugguguuuacagugcugcaaauuacaccaaugggagcuuuggaaguaauuuugugucugcugguauacagaccaguuuuaggacugguaauccaacagggacuuaccagaaugguuaugauagcacucagcaauacggaaguaauguuccaaauaugcacaaugguaugaaccaacaggcauaugcauauccugcuacugcagcugcaccuaugauugguuauccaaugccaacaggauauucccaauaagacuuuagaaguauauguaaaugucuguuuuucauaauugcucuuuauauuguguguuaucugacaagauaguuauuuaagaaacaugggaauugcagaaaugacugcagugcagcaguaauuauggugcacuuuuucgcuauuuaaguuggauauuucucuacauuccugaaacaauuuuuagguuuuuuuuguacuagaaaaugcaggcaguguuuucacaaaaguaaauguacagugauuugaaauacaauaaaugaaggcaaugcauggccuuccaauaaaaaauauuugaagacugaa

SEQ ID NO: 224 - RNA, 2523 nt, Homo Sapiens
cccuaucccgucuugcucugcggcgcaggggcaagauggcugcugagaagcaggucccaggcggcggcggcggcggcggcaguggcggcggcgguggcaguggcggcggcgguagcggcgguggacguggugccggaggggaagaaaauaaagaaaacgaacgcccuucggccggaucgaaggcaaacaaagaauuuggggauagccugaguuuggagauucuucagauuauuaaggaaucccagcagcagcaugguuuacggcauggagauuuucagagguacaggggcuacuguucccguagacaaagacgucuucgaaaaacacucaacuucaagauggguaacagacacaaauucacagggaagaaagugacugaagagcuucugaccgauaauagauacuugcuucugguucugauggaugcugaaagagccuggagcuacgccaugcagcugaaacaggaagccaacacugaaccccgaaaacgguuucacuuguuaucucgccuacgcaaagccgugaagcaugcagaggaauuggaacgcuugugugagagcaaucgcguggaugccaagaccaaauuagaggcucaggcuuacacagcuuaccucucaggaaugcuacguuuugaacaucaagaauggaaagcugccauugaggcuuuuaacaaaugcaaaacuaucuaugagaagcuagccagugcuuucacagaggagcaggcugugcuguauaaccaacguguggaagagauuucacccaacauccgcuauugugcauauaauauuguugaugggaccagucagccaucaaugaacucaugcagaugagauugaggucugggggcacugagggucucuuggcugaaaaauuggaggcuuugaucacucagacucgagccaaacaggcagcuaccaugagugaaguggaguggagagggagaacgguuccagugaagauugacaaagugcgcauuuucuuauuaggacuggcugauaacgaagcagcuauuguccaggcugaaagcgaagaaacuaaggagcgccuguuugaaucaaugcucagcgagugucgggacgccauccaggugguucgggaggagcucaagccagaucagaaacagagagauuauauccuugaaggagagccagggaaggugucuaaucuucaauacuugcauagcuaccugacuuacaucaagcuaucaacggcaaucaagcguaaugagaacauggccaaaggucugcagagggcucugcugcagcagcagccagaggaugacagcaagcgcucaccccggccccaggaccugauccgacucuaugacaucaucuuacagaaucugguggaauugcuccagcuuccugguuuagaggaagacaaagccuuccagaaagagauaggccucaagacucugguguucaaagcuuacagguguuuuuucauugcucaguccuaugugcuggugaagaaguggagcgaagcccuuguccuguaugacagaguccugaaauaugcaaaugaaguaaauucugaugcuggcgccuucaagaacagccuaaaggaccugccugaugugcaagagcucaucacucaagugcggucagagaagugcucccugcaggccgcagccauccuugaguaugcaaacgacgcucaucaaacagagaccuccuccucccaagucaaggacaauaagccucugguugaacgguuugagacauucugccuggacccuucccuugucaccaagcaagccaaccuugugcacuucccaccaggcuuccagcccauucccugcaagccuuuguucuuugaccuggcccucaaccauguggcuuucccaccccuugaggacaaguuggaacagaagaccaagaguggccucacuggauacaucaagggcaucuuuggauucaggagcuaaccaggcucuuccucgggggcgggggagauucugacucuuaaucuguauugugagaaaaucccagcaaguuccaugauauuaaauccaggucugcauuggcccggggcaagaguuuaacaucuucggcccugcauuccuacaucuugugucuguacacguucuuaagcagcgugucaggagagcacccuguugucuucugguaaaugugugcagggucauccugucuccuguaccuccugggaaaggggccgcugcugucuggugcccugugagcugugauugauugccuuuggucaguaaugcguucaggaguccacaccaggcacagauggggccuugaaacgcuuugucaugcuucuucaguaccauggauuugaaaugaacucauccuugcugugagcauccaggagcccuugagaaguuuaucuaugacuaugaaacuggcaacgucaccccagaauuacggucagccuuauuccccuucaccucccagugaacgcuaagaaguuucagacaagcagagagcucuauuuuuagaagaaauauguuacacucagaaaugaugaaaccaaaucuuauauuaaaaggcaaagaug

SEQ ID NO: 225 - RNA, 88 nt, Homo Sapiens
ggucauugauuacaacggggaacgcacgcuggaugguuuuaagaaauuccuggagagcgguggccaggauggggcaggggaugaugac

SEQ ID NO: 226 - RNA, 6231 nt, Homo Sapiens
guggcgcgggccgccguuuccgcaaacagaaucgcguuuggcugugcugggaugugugaaccuauuggguacuguacaacuucaagccucgaaaucagauaggcaccaccaaccucauuuccuguuucaccuugauuuucugugauaccaaaaucucagcuucacaaagucauugaaagaguguugguucaugaaguuuuaccaucaauucaaguaaucauaaauggcaaauucugcaaaagcagaagaauaugaaaagaugucucuugaacaggcaaaagcgucagugaauucugaaacagagucuucauucaauauuaaugaaaacacaacagcuucugggacugggcuuucugaaaagacuucugucuguaggcaaguagacauagcaagaaagagaaaagaguuugaagaugaucuuguaaaggaaaguucuaguugugggaaagacacuccauccaagaagagaaaacuugauccugaaauugucccagaggaaaaagauuguggugaugcugaaggcaauucaaagaaaagaaaaagagaaacugaggauguuccaaaagauaaaucuucuacuggagauggcacucaaaauaagagaaaaauagcacuugaggauguuccugaaaagcagaaaaaucuggaagaaggacacagcucaacaguggcugcccauuacaaugaacuucaggaaguugguuuggagaagcguagucaaagucguauuuuuuaccuaagaaacuuuaauaauuggaugaaaaguguucucauuggagaauuuuuggaaaagguacgacagaagaaaaaacgugauaucacuguuuuggaccugggaugugguaaagguggagauuugcugaaauggaaaaaaggaagaauuaacaagcuaguuuguacugauauugccgauguuucugucaaacagugucagcagcgguaugaggacaugaaaaaucgucgugauagugaauauauuuucagugcagaauuuauaacugcugacagcucaaaggaacuucugauugacaaauuucgugacccacaaauguguuuugacaucugcaguugucaguuugucugucauuacucauuugagucuuaugagcaggcugacaugaugcugagaaaugcgugugagagacuuagcccugggggcuauuuuauugguacuacucccaauagcuuugaauugauaagacgccuugaagcuucagaaacagaaucauuuggaaaugaaauauauacugugaaauuucagaagaaaggagauuauccuuuauuuggcugcaaauaugacuucaacuuggaagguguuguggauguuccugaauucuuggucuauuuuccauugcuaaaugaaauggcaaagaaguacaauaugaaacuagucuacaaaaaaacauuucuggaauucuacgaagaaaagauuaagaacaaugaaaauaaaaugcucuuaaaacgaaugcaggccuuggagccauauccugcaaaugagaguucuaaacuugucucugagaagguggaugacuaugaacaugcagcaaaguacaugaagaacagucaaguaagguuaccuuugggaaccuuaaguaaaucagaaugggaagcuacaaguauuuacuugguguuugccuuugagaaacagcagugagcacauaggcaguagucccagaggggccguguucuguccugcacaaauuugaacaacucaucucgauauauuugauauuucucugucuguugauuuuaauucuaaaugugcaggaugcugccagaaacuccaauguagaaauucaacauuugcugucugugacagaugaacuuuugcauguguauauaagaaugaguugggaccucugucuuuaaaaaucuauuuuuagguaauguucuaagaauuccauuugccucuaugaucuuagcucauaaaaauauaauaugacuugauaaagcaacuaaacucuuuccacaguguucagauuuguccuguguguguuuacaguauucaauuuauugcaguuauagaauuggucagagagcauuuucauagugugcucauuucuaugguuuuguuauauagcauuuuucaacauuuaauggucuguacaguugaauguaaguguucaauauguauugcugaaguuauaaguuuaaaacucaauuucagaugcucauaaaaguuacuuagcuaaaauuuuagcaauuuauugcauuuugaaauaaucauuaacaugcugcaauucaggagcugguuagaacauuuuaaguggcagcauagaauuuuggaauuuuggggcuuucuuuucagaaauugcuaccauaguaauuaauguuuccaguuaucaagauugugauuagacacauuuaccuuucuucauugaacaaauggugccauaguuauuuuucucaaaauuuagugaaaaucccucccauguagacauguugcacauuuuuuccaaauuuauacauggaacugcaguaggaauauucucaccaucugaugccauguacccacuucagaaauaagcaauacuuguuccucuguuacaaccucagcacuuugcaccguaggagccauuguuaaaguugucacuuguguaacugacugcuuuuccaaaacugguacuuaugugaacuguuguccuugcuuuacaccaccauuuggaaaacuuaccaguuuuuagauguagauguagugaaaaacuucaagaaugaagcagagcaauugaguauucuuuuuuaaauuauuaagccaugauuuacaaaaacauuacuuucuguaauucacaauacuuguuuuaaaaacauagugucuucauuagugugcaucuauuaacuguucaugguguuagaguugcaaacuuuuuagcaagaaaauauggauuuccucauuucaguuccuucugcagccugugaaucuccacaaaguguuaccaguuuacaaaaauaagucuuuuugccuuaagucauuuuggaaauaaguaauacugcaucugacucugguggcuguauuagcuaggaaagguuuguaaauggugucagugagguggggaaaggaagucuuccugucacauaugcagguucguuuucauucuagggcagugccaggaaguauauugauagcuuuguagguacaggaaaaacaucaucauuauuuccucuguucacauuuacuggucuuaauuaacagguaauaauaauacauguacuuuuagccugaaaccucuuccacgccauggguaacuugggggagagaagaauccuccaaacgauggaguagccagugguaauacaaagcagggagaacagaaagguagaguuacuaaggccuucagugaacagaaaggagcagagagcaagauuagaucugagaagaugcucuggggacugagcccacuguuguuggugucagggaggcuuacuggagccacaccugcaggcgcuguguucaggcaccaccuuccuccuugagcuuugccugucucuugccuuaucaguucuuccuccaccacccuacaccccccuccccccggccccaagccccugugucuccuuguuacaauuaaguuucuggauauugacuuaagaacuguuaggaagaggacuagaaaaggcuuccccugccuauccucuccgaucaccaagguggaagggagcuaguaggacucuuccuugacacaccuugucgucuaaauguucgguauucuauucaggacuuacgguaacuauuaugagggaggcauggcuuuccaccgucgggccaggaagagcaccuguugcugcaagcucagugaaguggggcacucccagaccugccaugcaguuuauccucugagaauggaauuggaaaugaagaccuaaccagcuauuggugggaaugacggaacuggggauugcgaugauugaucugggaacauggcuggauugugauuuaaccaagaaugcugauguugaauucuuugggccuagaauauacuugagaaagcacuaguggcuuguguucagggagaggagcuggcaguuuuuaaccacuucugugggagccguguucuaaccuguggaaaguauugcaauucugugagagugacucugcagagucacugcaccaucaggcuuggcccugcugugccuucaguacccagccagguucucuggguccagggugacucuccaaagaaauuggccuucagcuggagaaaacauuggguggagacucucacuuauguuaaugcaaucuugaaaugacugaaagguagauugccagcacagugaguuucccagccugcucccccauccacacuuggaaauugagggagcaugaccgcucucugacuucacauguuaauagaggaucagagcagaguugggaguauauuggucaggaucauagaaaagaagacaaagcuugcucagccaugagauggccagguauccaguuuuguuaacucucuuugggaauuucuuuuucagccuguuuuuuagcuuagugccauuaugucauuuugauuuguauucaaguacucuucaaguaucuuuguaaugaagguuuggcuacuuguauaggucugccugcagggugaaaaugccagugugaauauucuagcuaccaaacauuguuuuuuguugaaaaacugacuuucuguugucuaccucaggccuugugcauuuggguuaucucaagccagucaccacagagggucucuagggucugcaaaauagaggccaaauccagggaccaggcccuaauaauagaaguuguaccaaaaugccugugguacuugauggccuguuggucaaauaggaaguacaagugugugauguuagaaccucccuaguugcugcuauaucaaacacugcacacuugacaaguguuuucauuccccgcccucugacagaacaacauuccuaauucuuugaaggcaaccagugcaaaggcuacuacacuuguguaaugauauuuagcagaugcauacaggacuggaucccagggcacugucaguucuucccucccucucgugcugcucaguuuguccucugcucccauguaggccuaaagucaccccacuccuuagugccugcaccucaccacgauauugaggaagcacaggacauccaaggguacucuccaguuuggcuguggagacuugagcaagcccuaaaguccccugcucccuggacuucuccuggguugugcuuuuuugggggcaacauaccuuggacaaagcugagcugacagcuaauguuuauuagccuccuaccuaagucagucacuuugcuaaauucuucaccugugguaacucauuuugauuguuauaacaucucagcaccguuauucccauuuuaaugaugaggaaacugagucauagaggauacagacuugcccaaaggagagccaggauuuucacacccccuccucaagcugggccugcccuccaagugcuuguuauauaccuccacgggugucagcccagaugacuccucacccauccaccaccugcagcuugagauguuaacuauuagagcuccauucuuuugguucaaaacguugauacuuacuuagauguucccugagaggaguguuuauuucugaguaaggggcuuuguugaaagaggggguuagagagagcaagacagcacuugagugcacuggcaggaagcagagauaagacuugaauuucaguuugguagaccaccuucuuuagcagcccaaccuguagcaaaucuaguuuagccugcauggcagggagagggauucucuucccacccucaccauuugcaaguggcaggagcugagaaugccaguacgagaguguagccaaagugagaggcugagagcaaaggagacauuuuuuucaguuuugagucgaguauccagacagaggcaaaucauuuuguuuaacuuuuuauuaaaguguaacuauagaaacacaucaaugauuuuucacaaguggagcacgugcauacaaucggcaccccagaagccccccgucagauucccuuccaguuaacuaccucuccaagggaaaccacuauccugaguucuaagcgcauagauuaguucugucugguuuggggagauauauaaauggaauuaugcauucuucguaucugguuucuuuucaccaauauuauguuugugagauuuuuguugcauguauuuguacauggauuuucauucucaugguuguauaauauuucauugugugaauaaaccacauacuguuuaucuga

SEQ ID NO: 227 - RNA, 3590 nt, Homo Sapiens
cggacgcggccgccgccgucgccgccaucugucaccuccacuccggcaucagcagccagucgcccgugucccgccugucuccucggcggagccugcugcccguccugccaccucucugcucuguucuugucucugccuucauucccgaauggaucugguaggaguggcaucgccugagcccgggacggcagcggccuggggacccagcaaguguccaugggcuauuccucaaaauacaauaucuuguucuuuggcugauguaaugagugaacagcuggccaaagaauugcaguuagaagaagaagcugccguuuuuccugaaguugcuguugcugaaggaccauuuauuacuggagaaaacauugauacuuccagugaccuuaugcuggcucagaugcuacagauggaauaugacagagaauaugaugcacagcuuaggcgugaagaaaaaaaauucaauggagauagcaaaguuuccauuuccuuugaaaauuaucgaaaagugcauccuuaugaagacagcgauagcucugaagaugagguugacuggcaggauacucgugaugaucccuacagaccagcaaaaccgguucccacuccuaaaaagggcuuuauuggaaaaggaaaagauaucaccaccaaacaugaugaaguaguaugugggagaaagaacacagcaagaauggaaaauuuugcaccugaguuucagguaggagauggaauuggaauggauuuaaaacuaucaaaccauguuuucaaugcuuuaaaacaacaugccuacucagaagaacgucgaagugcccgccuacaugagaaaaaggagcauucuacagcagaaaaagcaguugauccuaagacacguuuacuuauguauaaaauggucaacucuggaauguuggagacaaucacuggcuguauuaguacaggaaaggagucuguugucuuucaugcauauggagggagcauggaggaugaaaaggaagauaguaaaguuauaccuacagaaugugccaucaagguauuuaaaacaacccuuaaugaauuuaagaaucgugacaaauauauuaaagaugauuucagguuuaaagaucgcuucaguaaacuaaauccacguaagaucauccgcaugugggcagaaaaagaaaugcacaaucucgcaagaaugcagagagcuggaauuccuuguccaacaguuguacuacugaagaaacacauuuuaguuaugucuuuuauuggccaugaucaaguuccagccccuaaauuaaaagaaguaaagcucaauagugaagaaaugaaagaagccuacuaucaaacucuucauuugaugcggcaguuauaucaugaauguacgcuuguccaugcugaccucagugaguauaacaugcuguggcaugcuggaaaggugaggagcacauuuuguuaacauucagauuuaauuacuguaaguaaaauuuaaaauguaaauacaucaguucauguucuguauugaaauaggucugguugaucgaugucagucagucaguagaaccuacccacccucacggccuggaguucuuguuccgggacugcaggaaugucucgcaguuuuuccagaaaggaggagucaaggaagcccuuagugaacgagaacucuucaaugcuguuucaggcuuaaacaucacagcagauaaugaagcugauuuuuuagcugagauagaagcuuuggagaaaaugaaugaagaucacguucagaagaauggaaggaaagcugcuucauuuuugaaagaugauggagacccaccacuacuauaugaugaauagcacuaauacccacugcuucaguguuaacacagcagugauugucagcugccaauagcaaaugaaguuaugggugacuugaaauaccaaaaccugaggagugggcaauggugcuucugugcuuuucccccuuguaacccaugugccagauguguggaauuuuuagcucagcauugagagaauaaaaugucacuaccucucaucuuaugaacaggauaauauaauucuuuaacagcuauagguuaucuggcugaaguagaccuaauuuuaugugacuugugguguaaaaugucuugaugauaauuuuuaaaacuuggguaacacuuccaaauaugggaggaaaggacagauguguuuacaagggaggauuuuacaacauacuugcuuuauucaccucccuguuuuguguugcgucuuuccuugaauauuuuauuggcccagaguuagccuuucucaauuauguuuccagacuguggccgugauucuaaaggaaaaugugugcucuuuaguggguagaacaaauggaaauuugguuucagaauggcugacagaaaucgacauaagucauguaauuuuuguugauauaucaugaaaaugaacagaauucuuuuuccauacuuauaucuaagaaaaggcaucauagguuucugaaagagauaacuauauaacagcuuuuuaacuauccagucaacuuucagcuuuucuacauuuagguaaaaugguuaggauauaacucaugguguggcuaaucuacauuuaucaauaaaauguaaauuaucugaaaggacagaauauaagauuuaaccauguuugacguauuuuaauuuaguuaaugaagcaaaauucaguuuauauuucacuagaacuguguacuugauugauuuucagagaaauaucacaaauuagaaauauuaaaucuaaggaugaaagguauauauaaaacaauuugggggccaggcacgauggcucaaaccuguaaucccagcacuuugggagaccaaggcggguggaucacuugaggucaggaguucaagaccagccugggcaacauggcgaaacccugucucuacuaaaaauacaaaaauuagccgggugugguggcacuucucuguaaucucagcuucucaggaggcugagacaggagaaucgcuugaacccgggaggcagagguugcagugagcugagaucaugccacugcacuccggccuaggugacagagggaaacuccaucuccaggaaaaaaaaaaaaaaacccaauuuggauaccaaauuaaucaacuaauuugagcuaucuggccuuacucuuaguaguuuuuaguacgugcuggacaccacuuuuaaaaagcaaucacugugcuagaaaaguauauuggcuuuguuaggauuaaaguucauuaacuucaauguaaucaugccuccuauuacugaagucagauuggaaccacuaaagauccaaacuuucugucugguaauagaaaguaaaaaucuagacaucauuuacauuugagaaagcuguuuuuaacauuauuuuaaaaugccaaauauguucuuucuagaaaaauauuuauuuuuguuuuuguuggauagcuuuuaauuacauuucagagagguguaauuuuggguagaugcucauuacauuuuugaaagguuuaugauuccaaaauaaagauuuauaugacuggugauacuggcuuuacagaaauuucagagaacuaauuuuuaaaaucuuuagcauuuaaaacuuuuuuuguuuuguuuucugacauauucugacaaagagcagcaaaccacug

SEQ ID NO: 228 - RNA, 102 nt, Homo Sapiens
gauccuuuugcgguucauagugugaugauugaguguucacaggcaugugugagauaugccauccucaaaccuuguuacagggucagcacauuacccaucuga

SEQ ID NO: 229 - RNA, 72 nt, Homo Sapiens
guguugaugguauaguggugagcauagcugccuuccaagcaauugacccgacuucgauucccagccaaugca

SEQ ID NO: 230 - RNA, 1869 nt, Homo Sapiens
guaacaacucucagaggagcauugcccagauugaaacaauggaggaucuuuguguggcaaacacacucuuugcccucaauuuauucaagcaucuggcaaaagcaagccccacccagaaccucuuccucuccccauggagcaucucguccaccauggccauggucuacaugggcuccaggggcagcaccgaagaccagauggccaaggugcuucaguuuaaugaagugggagccaaugcaguuacccccaugacuccagagaacuuuaccagcuguggguucaugcagcagauccagaaggguaguuauccugaugcgauuuugcaggcacaagcugcagauaaaauccauucauccuuccgcucucucagcucugcaaucaaugcauccacagggaauuauuuacuggaaagugucaauaagcuguuuggugagaagucugcgagcuuccgggaagaauauauucgacucugucagaaauauuacuccucagaaccccaggcaguagacuuccuagaaugugcagaagaagcuagaaaaaagauuaauuccugggucaagacucaaaccaaaggcaaaaucccaaacuuguuaccugaagguucuguagauggggauaccaggaugguccuggugaaugcugucuacuucaaaggaaaguggaaaacuccauuugagaagaaacuaaaugggcuuuauccuuuccguguaaacucggcucagcgcacaccuguacagaugauguacuugcgugaaaagcuaaacauuggauacauagaagaccuaaaggcucagauucuagaacucccauaugcuggagauguuagcauguucuuguugcuuccagaugaaauugccgauguguccacuggcuuggagcugcuggaaagugaaauaaccuaugacaaacucaacaaguggaccagcaaagacaaaauggcugaagaugaaguugagguauacauaccccaguucaaauuagaagagcauuaugaacucagauccauucugagaagcaugggcauggaggacgccuucaacaagggacgggccaauuucucagggaugucggagaggaaugaccuguuucuuucugaaguguuccaccaagccaugguggaugugaaugaggagggcacugaagcagccgcuggcacaggagguguuaugacagggagaacuggacauggaggcccacaguuuguggcagaucauccuuuucuuuuucuuauuaugcauaagauaaccaacugcauuuuauuuuucggcagauuuuccucacccuaaaacuaagcgugcugcuucugcaaaagauuuuuguagaugagcugugugccucagaauugcuauuucaaauugccaaaaauuuagagauguuuucuacauauuucugcucuucugaacaacuucugcuacccacuaaauaaaaacacagaaauaauuagacaauugucuauuauaacaugacaacccuauuaaucauuuggucuucuaaaaugggaucaugcccauuuagauuuuccuuacuaucaguuuauuuuuauaacauuaacuuuuacuuuguuauuuauuauuuuauauaauggugaguuuuuaaauuauugcucacugccuauuuaauguagcuaauaaaguuauagaagcagaugaucuguuaauuuccuaucuaauaaaugccuuuaauuguucucauaaugaagaauaaguagguaucccuccaugcccuucuguaauaaauaucuggaaaaaacauuaaacaauaggcaaauauauguuaugugcauuucuagaaauacauaacacauauauaugucuguaucuuauauucaauugcaaguauauaauaaauaaaccugcuuccaaacaacaa

SEQ ID NO: 231 - RNA, 954 nt, Homo Sapiens
auggagccgcccggacgccggcggggccgcgcgcagccgccgcugcugcugccgcucucgcuguuagcgcugcucgcgcugcugggaggcugcggcggcggcggcggcggcgccgcggcacugcccgccugcugcaagcacgaugggcguccccgaggggcuggcagggcggcgggcgccgccgagggcaagguggugugcagcauccuggagcucgcgcagguccugcccccagauacucugcccaaccgcacggucacccugauucugaguaacaauaagauauccgagcugcagaauggcucauuuucuggguuaacucuccuugaaagauuggaccuccgaaacaaucuuauuagucguauagauccaggugccuuuuggggacugucaucucuaaaaagguuggaucugacaaacaaucgaauaggaugucugaaugcaaacauauuucgaggacucaccaaucuggcucggcuaaaccuuucggggaauuuguuuucuucauuaccucaaggaacuuuugauuaucuuuccucauuacggucuuuggaauuccagacugaguaucuuuugugugacuguaaccuacuguggaugcaucgcuggguaaaggagaggaacaucacgguacaggauaccagguguguuuauccuaagucacugcaggcccaaccagucacaggcgugaagcaggagcuguugacaugcgacccuccgcuugaauugccgucuuucuacaugacuccaucucaucgccaaguuguguuugaaggagacagccuuccuuuccagugcauggcuucauauauugaucaggacaugcaaguguugugguaucaggaugggagaauaguugaaaccgaugaaucgcaagguauuuuuguugaaaagaacgugauucacaacugcuccuugauugcaagugcccuaaccguuucuaauaaucaggcu

SEQ ID NO: 232 - RNA, 112 nt, Homo Sapiens
gccugcugccauaguacucugaaagcacccaauccugucugaucucaaaagcuaagcaggguugggucuggcuaauauuuggaagggagaaaguuggguaggaauacguggu

SEQ ID NO: 233 - RNA, 107 nt, Homo Sapiens
augcuugcuucagcaacacauauacuaaaauuggaaggauacagagaagauuagcauggccccagcgcaagaaugacacccaaauucgugaagccuuccauaguuaa

SEQ ID NO: 234 - RNA, 104 nt, Homo Sapiens
ggcugguccuaagguaguguguuaucaauugaucaaagucaguuacagaucgaacuccuugaucuacucuuuccuccugcucacuacugcacuugacuagucca

SEQ ID NO: 235 - RNA, 2712 nt, Homo Sapiens
cguuggagucauaagacggcgucgguguugcagucuguguccuuggaggugaccagggccacugcaggcauggugcuagcagagcuguacgucucugaccgagagggaagcgaugccacgggagauggaaccaaggagaaaccauuuaaaacaggucuaaaggcuuugaugacaguagggaaagaaccauuuccuaccauuuacguagauucacaaaaagaaaaugagagguggaauguuauuucuaaaucacaguugaagaacauuaaaaagauguggcauagggaacaaaugaagagugaaucccgggaaaagaaagaggcagaagauaguuuacgaagagaaaagaaccuggaagaagcaaagaagauuaccauuaaaaaugauccaagucucccagagccaaaaugugugaagauuggugcguuagaaggauauagaggccaaagaguaaagguguuuggcuggguccacaggcugcgcaggcaaggaaagaauuuaauguuucugguguugcgagaugguacagguuaucuucagugugucuuggcggaugaguugugucagugcuacaauggaguucucuuguccacggagagcaguguugcaguguauggaaugcuaaaucuuaccccaaagggcaagcaggcuccagguggccaugagcugaguugugacuucugggaacuaauuggguuggccccugcuggaggagcugacaaccugaucaaugaggagucugacguugauguccagcucaacaacagacacaugaugauccgaggagaaaacauguccaaaauccuaaaagcacgauccauggucaccaggugcuuuagagaucacuucuuugauaggggguacuaugaaguuacuccuccaacauuagugcaaacacaaguagaagguggugccacacucuucaagcuugacuauuuuggggaagaggcauuuuugacucaauccucucaguuguacuuggagaccugccucccagcccugggagauguuuuuuguauugcucagucauaccgggcagagcaguccagaacacgaaggcaccuggcugaguacacucacguggaagcugaguguccuuuccugacuuuugacgaccuccugaaccgguuggaggacuugguuugugaugugguagaucgaauauugaagucaccugcagggagcauagugcaugagcucaacccgaacuuucagccccccaaacggccuuucaaacggaugaacuauucagaugcuaucguuuggcuaaaagaacaugauguaaagaaagaagauggaacuuucuaugaauuuggagaagauaucccagaagcuccugagagacugaugacagacaccauuaaugaaccaaucuugcugugucgauuuccuguggagaucaaguccuucuacaugcagcgauguccugaggauucccgucuuacugaaucugucgacguguugaugcccaauguuggugagauugugggaggcucaaugcguaucuuugauagugaagaaauacuggcagguuauaaaagggaagggauugaccccacucccuauuacugguauacggaucagagaaaauacgguacauguccccauggaggauauggcuugggcuuggaacgauucuuaacguggauucugaauagguaucacauccgagacgugugcuuauacccucgauuuguccagcguugcacgccauaaccauuuucuccagaagcguggaggaaagauuaugaaaggaacaggcucuuuaaaaaagaaaacaaaaagccagaaucuuccuuuuuuuguuucauugggguuucucuuucuguuuuucuuucuacuaccauaaaaacuaucucaaaucaccugaacaucaagugauauuaagguugucaucuuaagaaaaaauauccauuuuuuucuuaaguucgggaaacaaaguucggggaaaauaccuggcaugaaacuguaguuagggauacauuucagcauuuuacucacuuuauccaaguuauucauuuuauucaaguuauauguauguauaauucaacaauuuuagauuaugguguaagauacuccaguaacuuaucuuucuguccuuuuaaguguaccuugaauucuuugauuuauuuuauugcaucaaugaauuaaaacaaaaaucuugggggaagaaauuggcaauaucguauaaaaaucugcucauauuagaacacaguauaauucagcaguaaacacuagaaucaaaugaauagccuuuuguaucaguuauuaaucuuuucuaacucugcuuagcugcuaauaauccugaggcauagaaauugaagaauuuguaaaaauagaauugccuuaaaggauuugaaguaagaacauaauuuuggggagaguuuuuuagugauucacaguaucccucuuagcauuaauuuaagguaaagaggcagauugauuuucccucuuuccugguaauuccuaaguaauuaagaauaaauaaguuccaaaagaaauuguagcuggaaucuuaauaacaauugugaguggcuguuugaguugcccccaccauguccuuagaucuaaucugugcuaccuuauuaacucacagcaggcuuacugaauggcuucauuucagauuuaguugauuucuccaccaaaugcaugucauguauucucaauaggcuguauucccagcagucaauaaaugaacacccguaaaaacuc

SEQ ID NO: 236 - RNA, 2765 nt, Homo Sapiens
guuccagaauccaagauggcgggauccaggcaaaggggucuccgggccagaguucggccgcuguucugcgccuugcugcugucacucggucgcuucguccggggcgacggcgugggaggagaccccgcggucgcguugccacaucgccguuucgaguacaaauacagcuucaaggggccgcaccuggugcagagcgacgggaccgugcccuucugggcccacgcggggaaugcuauuccaaguucagaucaaauucgaguagcaccaucuuuaaaaagccaaagaggcucaguguggacaaagacaaaagcggccuuugagaacugggaaguugaggugacauuucgagugacuggaagaggucgaauuggagcugauggccuagcaauuugguaugcagaaaaucaaggcuuggagggcccuguguuuggaucagcugaucuguggaaugguguuggaauauuuuuugauucuuuugacaaugauggaaagaaaaauaauccugcuauaguaauuauaggcaacaauggacaaauccauuaugaccaucaaaaugacggggcuagucaagcuuuggcaaguugccagagggacuuccgcaacaaacccuauccuguccgagcaaagauuaccuauuaccagaacacacugacaguaaugaucaauaauggcuuuacaccagauaaaaaugauuaugaauuuugugccaaaguggaaaauaugauuaucccugcacaagggcauuuuggaauaucugcugcaacuggaggucuugcagaugaccaugauguccuuucuuuucugacuuuccaguugacugaaccuggaaaagagccgcccacaccagauaaagaaauuucggaaaaggaaaaagaaaaguaucaggaggaauuugagcacuuucaacaagaauuggauaaaaaaaaagaggaauuccagaagggccaccccgaccuccaagggcagccugcggaggaaauauuugagaguguaggagaucgagagcuaagacaagucuuugaaggacagaaucguauucaucuugaaaucaagcagcugaaccggcaguuagauaugauucuugaugaacagagaagauaugucucuuccuuaacagaggaaaucucuaaaagaggagcaggaaugccugggcagcaugggcagauuacucaacaagaacuggauacuguugugaaaacucagcaugagauucugagacaaguaaaugaaaugaaaaauuccaugagugaaaccgucagacuggucaguggaaugcagcacccuggcucugcuggaggcgucuaugagacaacacagcacuucauugacaucaaagagcaccugcacauaguaaagagggacauagauaacuuagugcagcgaaauaugccaucaaaugaaaagccgaaaugcccagaacuaccaccauuuccaucauguuugucuacgguccacuucauuauauuuguuguggugcaaacuguauuauucauugguuauaucauguauaggucucagcaagaagcagcugccaaaaaauucuuuugacuaccauuuuccuguguacuucaucuauuuguguacaaaaugaugucguuuugagggaauuuaaguauuuaaauugcuucauagucuaaauuauuaauuuucuuaauaaaauaacuguuuaaacauugauuugcaguuaagaauaaaccuuaaagcaaagacaaccacauuuuaauuuguucacaguauguaaaucugucuaaauuucagugaauuucuggucaguaugaugcagccucugagcagaauauugaccaguaagaggguaaauaaagugggggcaaccccuggauaugaauguuacccccuaagucuccaauauugcagguuucccuguauaacguaaacacacuugcccucaugccucccagaauaugaggucuaauuaagaagucccaucagguuuauuuuguaaccaaagucuuuuuuagaggucagacuuccuaaucaaaggccugggccugcaguccuuucaucuuaaugcaacuuccuuugaaaucaaagaauauuuugucugagagcuuuaaggaucugguaauagacuucaaaauguuaagugaaauuuuuuuuuccucuauuuaucaaugauauauuucacuuuuaaaggaaauuuuagaggaaaauuaauagcugcuuuuugccuaaaaaaccuuguggguggaaacauuccucugagaauggcuuuuauagguauuuugccugguaauguauucauucaugauugcccauauucuugaaugucuucauuccaauggggucaggucaauauuaugaaaauaauuuuuauauuuauauuuguaacuuaaggaauuuauuucucccuuuacuacagcauguaaauucagcucaaauugcaugaucugaggauuuaaauucacaaaaccugccacuacauucugguuuacauuaguuacuucaugcuggcugggguuagugaccauuugcauacucuuuuaaaucaaggaggcuguaguagaagcaguuuuaagauucuugaaggcaaaauuugaaaaacagugaauacuucuaauuguuuccuuuuagugccagaacuaaggacauugugaagcacuuguuaguaaacuuaaccuugaaaugucagacuggaaggaguuuuuauagucuuugugcauacuucuagguauuacagaaacagucuguaaaugacauuuuaagaugcaaauuuaauucuguucacagcugauuuauacugauuu

SEQ ID NO: 237 - RNA, 2315 nt, Homo Sapiens
gccccggcccgcaaacccaaacacuccaggcgcccgcccgccgcgcgugauucucgccucgccgcagcccagcccugcgcgccuugcccggcggcccccgcccggccgcuccgggccccuggccccgcggagcgaugcugcugcuggcugccgccuuccucguggccuucgugcugcugcuguacauggugucuccgcucaucagccccaagccccucgcccugcccggggcgcauguggugguuacaggagguuccaguggcaucgggaagugcauugcuaucgagugcuauaaacaaggagcuuuuauaacucugguugcacgaaaugaggauaagcugcugcaggcaaagaaagaaauugaaaugcacucuauuaaugacaaacagguggugcuuugcauaucaguugauguaucucaagacuauaaccaaguagagaaugucauaaaacaagcacaggagaaacuggguccaguggacaugcugguaaauugugcaggaauggcagugucaggaaaauuugaagaucuugaaguuaguaccuuugaaagguuaaugagcaucaauuaccugggcagcguguaccccagccgggccgugaucaccaccaugaaggagcgccgggugggcaggaucguguuuguguccucccaggcaggacaguugggauuauucgguuucacagccuacucugcauccaaguuugccauaaggggauuggcagaagcuuugcagauggaggugaagccauauaaugucuacaucacaguugcuuacccaccagacacagacacaccuggcuuugccgaagaaaacagaacaaagccuuuggagacucgacuuauuucagagaccacaucugugugcaaaccagaacagguggccaaacaaauuguuaaagaugccauacaaggaaauuucaacaguucccuuggcucagauggguacaugcucucggcccugaccugugggauggcuccaguaacuucuauuacugaggggcuccagcagguggucaccaugggccuuuuccgcacuauugcuuuguuuuaccuuggaaguuuugacagcauaguucgucgcugcaugaugcagagagaaaaaucugaaaaugcagacaaaacugccuaaucuucuuaccccuuggaagaagacuguuuccaaauaauuugaacagcuugcugcuaaaugggacccaauuuuuggccuauagacacuuauguauuguuuucgaauacgucagauuggaccagugcucuucaggaauguggcugcaagcaaggggcuagaaguucaccuccugacaguauuauuaauacuaugcaaauauggaauaggagaccauuugauuuucuaggcuuugugguagagaggugaagguaugagaauuaauagcgugugaacaaaguaaagaacaggauuccagaaugaucauuaaauuuguuucuauuuauucuuuuuugccccccuagagauuaaguccagaaauguacuuucuggcacauaaagaaaucuugaggacuuuguuuaaaccuuccauaaaaaaacaauuuucgguuucucggguucucucucucucucucucugucucucugucucucugucucucugucucucugucucucugucucucucucucucucucuuucuuucuuuguguauuuuauucaagaugaguuggacccauugccagugagucugaaugucacugacagcccuguguugugcucaggacucacucugcugcugguggaaacucauggcuucucucucucuuugaucccauaaagcuacgagggggacgggagagggcagugcaaugggaaguaaagagauauuuuccaguaggaaaagcaaugcuuucuugucuuuagacucaaaugcuuagggaacguuucauuucucauucauggggaaaggcagccuccuuaaauguuuucugaagagcgguaaaaucuagaagcuuaagaauuuacaguuccuucaauaaccaugaugaccugaaguucaccuaucccauuuuagcaucuacuuguuuuucccaucucuuccuuuccaauuuugcuuauacugcuguaauauuuuuguaaaaaaaaaaaaaaaggaaaaaaaagaccagcuaaaauuuucgacuugacuuuuuaacuuaacucaugaauuaauuaaagcaaaugaaaaaauuaaaaagugugacuuuuucucggagcauauauguagcuuuuaggaaaggcugaugaugguauaaaguuugcucauuaagaaaaaaagacaaggcugauuuugaagagaguugcuuuugaaauaaaaugauca

SEQ ID NO: 238 - RNA, 1737 nt, Homo Sapiens
gggguggagcugagggguggagcugaggcuggagggaggaagguguggggggacccagggguccugucuccaagccugguugcucuuacgcgaaaaguugggacacugaggugucacagcuucucuuuugaaauggagaggagguaggagggugagguccauccagguagacacagacacacacagagaccacagcuuccuguaacauuuccgagugucgaauuccaucucccggucuagagguuuuucuucuugguccuuccugagaccucuuggcucccaagagccucuugaucggggcaggaaugagggugccccagggugcgagagucguggaucccugaaaagaggaggcugcucccccucuuucuuccccccaccuccagauuuccucaucugcccacaccuuccggugggcggggacguguauggacaaauuugcgggcuggggaccauggaaguggaggaaaucuacaagcaccaggaagucaagaugcaagcaccagccuucagggacaagaaacagggggucucagccaagaaucaaggugcccaugacccagacuaugagaauaucaccuuggccuucaaaaaucaggaccaugcaaaggguggucauucacgacccacgagccaagucccagcccagugcaggccgcccucagacuccacccagguccccugcugguuguacagagccauccugagccuguacauccuccuggcccuggccuuuguccucugcaucauccugucagccuucaucauggugaagaaugcugagauguccaaggagcugcugggcuuuaaaagggagcuuuggaaugucucaaacuccguacaagcaugcgaagagagacagaagagaggcugggauuccguucagcagagcaucaccauggucaggagcaagauugauagauuagagacgacauuagcaggcauaaaaaacauugacacaaagguacagaaaaucuuggaggugcugcagaaaaugccacaguccucaccucaauaaaugagaggacauuguggcagccaaagccacaacuuggaagauggggcugcaccugccaacgaagacgggaaaugaccccccccccccagccuagugugaaccugccccucgucccacguauagaaaaaccucgagucauggugaaugagugucucggaguugcucguguguguguacaccugcgugcgugugugugcgugugugcgcguguguucguguaugugcgugugugcgugcgcgugugugugcauuuugcaaaggguggacauuucaguguaucucccagaaaggugaugaaugaauaggacugagagucacagugaauguggcaugcaugccugugucaugugacauaugugagucucggcaugucacgguggguggcugugucugagcaccuccagcagaugucacucugaguguggguguuggugacaugcauugcacgggccugucucccuguuuguguaaacauacuagaguauacugcggcguguuuucugucuacccaugucauggugggggagauuuaucuccguacaugugggugucgccaugugugcccugucacuaucuguggcugggugaacggcugugucauuaugagugugccgaguuaugccacccugugugcucagggcacaugcacacagacauuuaucucugcacucacauuuugugacuuaugaagauaaauaaagucaagggaaaacagcguc

SEQ ID NO: 239 - RNA, 1794 nt, Homo Sapiens
ccggaaguggucggcgcgcggcgcggcgcgccugggcgcuaagauggcggcggcgugaguugcauguugugugaggaucccggggccgccgcgucgcucgggccccgccauggccgucaccaucacgcucaaaacgcugcagcagcagaccuucaagauccgcauggagccugacgagacggugaaggugcuaaaggagaagauagaagcugagaagggucgugaugccuuccccguggcuggacagaaacucaucuaugccggcaagaucuugagugacgaugucccuaucagggacuaucgcaucgaugagaagaacuuuguggucgucauggugaccaagaccaaagccggccaggguaccucagcacccccagaggccucacccacagcugccccagaguccucuacauccuucccgccugcccccaccucaggcaugucccaucccccaccugccgccagagaggacaagagcccaucagaggaauccgcccccacgacguccccagagucugugucaggcucuguucccucuucagguagcagcgggcgagaggaagacgcggccuccacgcuagugacgggcucugaguaugagacgaugcugacggagaucauguccaugggcuaugagcgagagcgggucguggccgcccugagagccagcuacaacaacccccaccgagccguggaguaucugcucacgggaauuccugggagccccgagccggaacacgguucuguccaggagagccagguaucggagcagccggccacggaagcagcaggagagaacccccuggaguuccugcgggaccagccccaguuccagaacaugcggcaggugauucagcagaacccugcgcugcugcccgcccugcuccagcagcugggccaggagaacccucagcuuuuacagcaaaucagccggcaccaggagcaguucauccagaugcugaacgagcccccuggggagcuggcggacaucucagauguggagggggaggugggcgccauaggagaggaggccccgcagaugaacuacauccaggugacgccgcaggagaaagaagcuauagagagguugaaggcccugggcuucccagagagccuggucauccaggccuauuucgcgugugaaaaaaaugagaacuuggcugccaacuuccuccugagucagaacuuugaugacgagugaugccaggaagccaggccaccgaagcccccacccuacccuuauuccaugaaaguuuuauaaaagaaaaaauauauauauauucauguuuauuuaagaaauggaaaaaaaaaucaaaaaucuuaaaaaaacaagcaaacaguccagcuuccuguccuccuaaaguggccccuguucccaucucccgggccagacagcuguccccccguccuccuccccagcccagccugcucagagaagcuggcaggacugggaggcgacagaugggccccucuuggccucugucccagcucucugcagccagacggaaaggcggcugcuugccucuccauccuccgaaaaaccccugaggacccccccccauccucuucuaggaugaggggaagcuggagccccaacuuugauccuccauuggaguggcccaaaucuuuccaucuagggcaaguccugaaaggcccaaggcccccuccccagucuggccuuggccuccagccuggagaagggcuaacaucagcucauugucaaggccacccccaccccagaacagaaccgugucucugauaaagguuuugaagugaauaaaguuuuaaaaacua

SEQ ID NO: 240 - RNA, 5929 nt, Homo Sapiens
gcggccgccgccugccgggccuccccucgccgcggccggccgccgcgcucccgcccgggcgcccagcuauguacuccccguacugccucacccagcucagaaucgggcguugggcuuugccgggugcuucagaucaaugcagacggacacugugccggggcgagcugacaggaguucacggcugcgauagaacauggagaugucaugggcgcgacagagccuggcggggauaccagcagcccgucuuccccuccucccguccucccucgccccgcaugcucccggcuugccgccugcaggaugaguuccacccguucaucgaggcacugcugccucacguccgcgcuuucuccuacaccugguucaaccugcaggcgcggaagcgcaaguacuucaagaagcaugaaaagcggaugucgaaggacgaggagcgggcggugaaggacgagcugcugggcgagaagcccgagaucaagcagaagugggcaucccggcugcuggccaagcugcgcaaggacauccggcccgaguuccgcgaggacuucgugcugaccaucacgggcaagaagccccccugcugcgugcucuccaaccccgaccagaagggcaagauccggcggauugacugccugcgccaggcugacaagguguggcggcuggaccuggucauggugauuuuguuuaaggggaucccccuggaaaguacugauggggagcggcucuacaagucgccucagugcucgaaccccggccugugcguccagccacaucacauuggagucacaaucaaagaacuggaucuuuaucuggcuuacuuuguccacacuccggaauccggacaaucagauaguucaaaccagcaaggagaugcggacaucaaaccacugcccaacggggcacuuaaguuuccaggacuguuuugugacuuccggggucuggaaugugacggagcuggugagaguaucacagacuccuguugcaacagcaucagggcccaacuucucccuggcggaccuggagagucccagcuacuacaacaucaaccaggugacccuggggcggcgguccaucaccuccccuccuuccaccagcaccaccaagcgccccaaguccaucgaugacagugagauggagagcccuguugaugacguguucuaucccgggacaggccguuccccagcagcuggcagcagccaguccagcggguggcccaacgauguggaugcaggcccggcuucucuaaagaagucaggaaagcuggacuucugcagugcccucuccucucagggcagcuccccgcgcauggcuuucacccaccacccgcugccugugcuugcuggagucagaccagggagcccccgggccacagcaucagcccugcacuuccccuccacguccaucauccagcagucgagcccguauuucacgcacccgaccauccgcuaccaccaccaccacgggcaggacucacugaaggaguuugugcaguuugugugcucggauggcucgggccaggccaccggacagcccaacgguagcggccagggcaaagucccggggucauuuuugcuaccgccgccgccuccaguggccagaccugugccccuuccuaugccugauuccaaauccaccagcacugccccagacggcgccgccuugacuccuccaucaccuucauucgcaacgacaggcgccuccucugccaaccgguuugucagcaucggaccccgggacggcaacuuucugaacaucccacagcagucucaguccugguuccucugauaagaucgacaaaagaaacaacaaaaugagaagaagagguuccucgaaaggggggagaagaaauuuugagaauggaaaaaucccccagcccagcccagccccaccgaaaagcaaaaauuacacgucgucagccacucagcccuucucuccuccagcccggggacccccgcgggccccagaagcagcccaguucucagagagcccuuggaaggggucucgguggagcugugcaccagcagccaagcagaaagaaacacgcgacauggacucugucaaguagaggacagaaagcaagaaaggaugcagaacugccuuccucccccugaccccgccccggccuucuggggaaggaacaaaguccccaaacaaagcaaccagcacaauucugaaggggccuggccuccacccucaccccuuccuaggggaaccccacccuccacacagccggagcugcccuagggagccuggagggccagcuuguaaagaugaugggguuuagaucccucaggcucuccccuccagacuccgcccuucccucccucccucccucccucccucucugccaaggcuccagcuucuucccccagcugcucccgaccaggagggggagagcagccuccacuuaccccaccccacccuugggcuaaaagcccccaggcgggcagggggugaccccuggagcuaguugcgugucccagaauggaggguguucugacaccccacccugagccgcaagagcaguccuggggcccuggaccccucuguacaguccguaggaaaaagucggaaugcucucgacggccucgucccagccugggacaggcccccuuuccccucucucugcaggccaggagggccuccuuccugccacgagggaggggagucgggccccaggucgcccccgcccccagcccugcaugcaggugcccucgcuccgccccaucaguuccugccccugccccucaugcagacugcccugcuggggccgggccggaggguggagcagaaaggggaccccggagccgagcgaggaggaccaggcagccgccgcugccgcgcuaagccaccaccugcgcuuagguaggcguccugcucgccgacuuucaguuccuugggaggguguugggugucguccuuuucaaaaguguuuuggagcuuucugugccccccgacuuucccccgccuccccgccccccacguggccacuuuucucuggauuuuagcuguaaugucuuuacucuuuauuuagggguggggcauucauuguuugggucuuuugcuguuggaaugggaacuccuccuccauuugagcaacuugggaacaauuugguaacacaccacaggaaguagcucucccccccagcccccuccucccucaagggaggguuggggggccuguccagagggucuucagaagccccccugggagggaggggaggaugagcacgcccagcuccccuccagggugugacuuggccccucuggcuugucuuucugugccuuacuccuccuccugcgucucccguuccuggccccuucuugaguccuugugccucucucuuucucucucuuucuuaauuguaugaaaacacaaagcacaggucaggauccucugagagaaaaucaacauugcaccacguaggggugggcuaugggcuguauuuauugugaaucuaguuugugaggcuguggccccgagcuggcggagggagggaagaggagggagugacgggaggggaggaggucagcgaccuggggccguagcggcaggcgaacggugccugcuacccagcuggaagccacaagguggcuggcuccaggggcggcuuuuguuggaaguugagugaagcccucccccuguccucagcgugcagcccuagaggaccccagggcugaggggcaguggauccugcgggagucucccggggcguggggaguaaggccccggggguggggggccgggugggccgggcgugacgcgcggucaaagugcaaugauuuuucaguucgguuggcuaaacagggucagagcugagagcgaagcagaaggggcucccuguccggcccacgugcccuuucccucgacgacagucgagggcucgggcucugugggacugugggagcuagggucugcggggcgccugcccgggcgaggucggaagcugcaggccagcugggcccgggccggagcgugcccggcggggcugcccgggcgggcagggggugggggcugcuccuuucccaagugguguugugaggggcaaugagggcaacaggagauguggggacguguuaggagagaaaaaaaaaaaaacaaaaauauauaugggggaaauuaacuuuuuuuuuucauugaaccaagugcaaugcaucagagaguuuuccuaucuuuguauguuaagagauuaagaaaaaaaaauucuauuuuuguuguaauguccucgcggcucuggggacgcuaaaagaaccgggccugccccgcccugcgcggggauaacgaaagcugaguguuuuucccuuuuuuuuguucguuuuuaguuuuuuuuuuuuuaagucguuuuccugcguugacgaggaugaucugggguuuuuauuuguuucgucguucguucuguuucggugggagggcugaaggaaacguucacauuuuagaguuuaaaaaaaacaccucgacauuuaaaaaaucaaccaacacaagaucaaaaaggaaaaggacgagagaaaaauuauuuuuaagauaauuaaacauaaaacccuggugcuucuuacauuauaaaguacguuuuaaagaacccacaaacuauuauacauaaguuuaugaaucaauuaaauauccugcacuuguuaggaauacgcauaucccuucuuuguugaguuuaacggaacgggacagcggcgugcccccggcggcuggacugcuccggccgcgggucuccccgggcgccccucccuggggcccagcaccccuccucgccccauccccguccggguacgggggcgcggcagggguccccggccccucccccgcagaggucaaugccaacgaacaaacguccccucccucccucccucuccgccccgagcgcccuucuuugagccagacgccaacuugacccucaccagcauuaucaggagcgcgcucagcaaguugguaguuuccuccccccuuucccggcgccccucccgcccccauucaacaucucucauccuauccccgacccccuccggggaacaccgggaaggcucgacgcuccaggacaggaccagccacgcagacaggucgauuugcccaggcccgcgcccgcacgcacgcacgcacacggccccgcacacagccccgccccaccccgcaaccagcccugucgacugccuuauacacccgcccccgcgcuggccggccgaccuagugccuuguucucacccccgugcuggcggagcggacgccgcgcucugggucccagaggggccggguggcucagacgacccaccacucccccacccugaccgugcugaacagacccccccacacgagagaaaauaaaggagcaauaaagucacgagaacuuucgucccccaaucgagagcccgaggggcaccccagccccgccucugcucccccccaccccacccacccucggggcgccccccuccccccgcaagccagccugggccagccccgcuucggccccucccgggagauccgugcgcccgaccagcaccagcaucgcggaccgcaaaggccgcccgucccgucaaacaaguuucuucuuaggcuaagaaacgcaguauauacgaguaucucuauauauaguacuaauggauuuggugugcuucccccuuagcgucccccucccucugcuccuccuccuucagccuggucucccccucuucucugcccuccacccccgucucugcacugagauacauaagaaacaaggguaguuuacugucuguuuuguuuucuggguuuucaguguccuagcggaaugcaaguaggcagccagcccgucuguucccucuccgccccgccccgccccgcccccgucacugcgcuucuguuauaccaucuuugccugacucucuccggcuucuccauugaauggcuaauguguaugugaaauaaagaaauaaagaaaaacaaacgcga

SEQ ID NO: 241 - RNA, 674 nt, Homo Sapiens
guggcaucgccggccucgcuaugucugccauuuucaauauucagagucuauugacuguaaucuugcugcuuauauguaccugugcuuauauucgauccuuggcacccagccuccuggacagaaauaaaacuggauuguuggguauauuuuggaagugugccagaauuggugaacggaagaguccuuauguugaaguaugcuguauaguaauggccuucagcauccucuucauacaguagcuggggaaaaugccagaauuuaauugccaucagauuucauugugaacaaggacuuacugcagaaaauaauggaaaggauguuuaacucuuuuaucuccgaacauugaaugagauaaauuuccagaugcuguucucuauuuuaauguuauuggaccaauauucuguauaaauaauuaagauguaaccauuuaauagucuguaacaaugaaccucaguacugucacuacaauauuacauucugcaaauguuauucuguuguaucagauacgaaauuuuagugagguaucucuaaggcauauaguagaaaacaaaauugguuaauuaaguucguuucacugugauuuggaaaugauuuaaucuuuauagaaugagacccuuuuuuggacuagcuuuuuuuauuaaaauggcucaauauguguaaaaaaaaaaaaaaaa

SEQ ID NO: 242 - RNA, 1040 nt, Homo Sapiens
gagacggacucuugcuauguugcccaggcuggucuugaacuccuggccucaagcaauccuccugccucagccucccaaagcacggggauuacaaacagccugcugagggaugcccaagaaguuccagggugagaacaccaagucggcagcggcccgggcacguagggcagaggccaaggcggccgcugaugccaagaagcagaaggagcuggaggaugccuacuggaaggacgacgacaaacacgucaugaggaaggagcagcgcaaggaggagaaggagaagcggcgccucgaccagcuggaacguaagaaggagacgcagcgccuacuggaggaggaggacuccaagcucaagggcggcaaggcgccgcggguggccacguccagcaaggucacccgggcccagaucgaggacacgcugcgccgagaccaucagcucagggaggccccggacacagccgagaaagccaagagccaucuggaggugccgcuggaggagaacgugaaccgccgcgugcuggaggagggcagcguggaggcgcgcaccaucgaggacgccauugcagugcucagcguggcggaggaggcggccgaccggcacccagaaagacgcaugcgggcagccuucacagccuuugaggaagcccagcugccgcggcucaaacaagagaaccccaacaugcggcugucgcagcugaaacagcugcucaagaaggaguggcuccgcucuccugacaaccccaugaaccagcgggccgugcccuucaaugcccccaagugagcccagaacuuggggagccaguucacccacgggugguccaggucacgacucugcacgcccuuaggccaggucagcugcgagggucacagagcguuccgggggccaaggcgccgggccccggggccaugcucuuaucaccagccacccguccucccgccagagggucccugccccgagugacaccccauccccucccaucccccggcgcguguguguagagccucagggcugagugcccaauaaagguggcggcaaggcu

SEQ ID NO: 243 - RNA, 4125 nt, Homo Sapiens
agcgggggauauggcggggccuuugucucucgcugucgccggagucccaggucugucuucacugcucuguguccucugcuccuagaggcccagccucuguggcgcuguuaccagcagguauuggagauccacagcuaagaugccaggacccccuagaagccuagaaaugggacuguugacauuuagggauguggccauagaauucucucuggaggaguggcaacaccuggacauugcacagcagaauuuauauagaaaugugauguuagagaacuacagaaaccuggccuuccuggguauugcugucucuaagccagaccugaucaccugucuggaacaagggaaagagcccuggaauaugaagcgacaugagaugguggaugaacccccaggauuggauuuuucauuacugugaagaaaaacacuggaauuuugauaaggaguucuuuaaaucuacaggucacuuuggauaauauggcaguuucauaauacuuauucuuucaauagaaauaaaacauuuuaaaauguauguguccucauuuugcucaagaccuuuggccagagcagggcauggaagauucuuuucaaaaagcaauacugagaagauauggaaaauauggacaugagaauuuacaguuaagaaaaggcuguaaaaguguggaugaguauaaggugaacaaagaagguuauaauggacuuaaccaguguuucacaacugcccagagcaaaguauuucaaugugauaaauauuugaaagucuucuauaaauuuuuaaauucaaacagaccuaagauaagacauacugaaaagaaaucuuucaaauguaaaaaacgugucaaauuauuuugcaugcuuucacauaaaacccaacacaaaagcauuuaucauagagagaaguccuacaaauguaaagaauguggaaaaaccuuuaauugguccucaacccuuacuaaucauaggaaaauuuauacugaagagaaaccuuacaaaugugaagaauauaacaaaucuccuaagcaacucucaacccuuacuacacaugaaauaauucaugcuggagagaaacucuacaaaugugaagaauguggugaagcuuuuaaucgauccucaaaucuuacuacacauaagauaauucauacuggagagaaaccuuacaagugugaagaauguggcaaagcauuuaucugguccucaacccuuacugagcauaagaaaauucauacuagaaagaaacccuacaagugugaagaauguggcaaagcauuuauaugguccucaacacuaacuagacauaagaggaugcacacuggagagaaacccuacaaaugugaagaauguggcaaagcuuuuagccaguccucaacccuuacuacacauaagauaauucauacuggagagaaacgcuacaaaugcuuagaauguggcaaagcuuuuaagcaacucucaacucuuacuacacauaaaauaauucauguuggagagaaacucuacaaaugugaagaaugcggcaaagguuuuaaucgaucuucaaaucuuacuacacauaagauaauucauacuggagagaaaccuuacaagugugaagaauguggcaaagcauuuaucugguccucaacccuuacuaaacauaagagaauucauacuagagagaaacccuacaaaugugaagaauguggcaaggcauuuauaugguccucaacccuaacuagacauaagaggaugcacacuggagagaaacccuacaaaugugaagaauguggcaaaucuuuuagccaauccucaacccuuacuacacauaagauaauucauacuggagagaaacccuacaaaugugaagaauguggcaaagccuuuaacugguccucaacucuuacuaaacauaagauaauucauacugaagagaaacccuacaaaugugaaaaauguggcaaagccuuuaagcagucuucaauccuuacuaaccauaagagaauucauacuggagagaaacccuauaaaugugaagaauguggcaaaucuuuuaaccggucuucaacuuuuacuaaacauaagguaauucauacuggaguaaaacccuacaaaugugaagaauguggcaaagcauuuuucugguccucaacccuaacuaaacauaagagaauucauacuggagagcaacccuacaaaugggaaaaauuuggcaaagccuuuaaucgguccucgcaccucaccacagauaagauaacucauuggagagaaaucuuacaaguaugaauaaugugccaaagccuaagaaaacccucaauucuuaauagauauaagauuauuccuacuggagagaaacuacaaaccugagagaggcgcuaaugcuuuugacaguaccuaaaacuuuaaagaaaaucauucugcugaaaaauccuagaaaugugaagaaugugaaaaagccuuuaaaugauugucacacuugauuguagguaagauaauucauacuggagaaaacuaccagugugaacaacguggccaagcuucgacaaugcucacacccuauugcacaggaaagcauuuauacuugagaagaaauguacaaauauuggcaaaguaaaaaauccauuaacaccugcucacaucuuacucaaaauuguagaguucauaguaaauaaaagcauuaaaauucuaauuacucucagaagaucugucagaaaguaugucuuuaaaguauagaagagcauuuauuuugaaaaaaacauuacacauaugaagaggauuguaauaucuuuacuuguaccacagaucuuauuguacacauuuuauacuagagaaaaacccucaggcaguuguuaaaauuuuguugaacaucagggaguuuaagaaaacccugcaaguauaaugaauuuggaaaaacauuuuuucaaaaacuacaaauuauaaaacaccaaaguguucauacuaaaauauauuuuugcagauacauuaaauaugaaagauauucaauccaaaauuaagucuauguaaauaucagggaauaauucacaguagaaauaucuagggcauucaagcuuuagacauuacacuaaaucagagugcugaguauagaaaauaauacaaacagauuugucuaaacauuuguauauaacuuuaaaaauagaauauuuuuuggaggguuauaauuacauucaaaguacuuuuuuuugaaaauacagauuuuuuuuaaaagugaauaauguguucaacucuuaaauucaugcuguuucaucauugcugguguauucauaugugaaagcaugugacuaauuguugcugcauaaaagauaugagauucuuuuuuauuaggcauuauuuaugaccuuuucuaugaaaagauaaggacauuaaaauguaagaugcgugaggaaaauuuagguagagaggcucuuugugguuaacuuauaauauugagugaugcaugagguagguguucagaauaauauuccucugcauuauuaugaaugaaaagcauucuuaauuuuaguuaaaauuaaguuagucauauguuauuuuauuaauuguacuucuaugaaauaauaugcagucuauuuuuaaauuauaaauuaugugugaacuuagcuuuucaauucaacauuuuuaacauauuaaauacuauugugaauucaaugaaguguucuuaugccacuaacuuuaaccuauucccuuacucaaggauguagguaaaagaugguaacaauacacuauuugguaagauaauguacugacaucucuagcaaucuuuuuugccaguggcuuuaaauugccaauaaguuaaagaauauuguuccuauggguuaaauuuuuauucuuauuuucacauuuaaauuuauuuuucuuaauuuuuguggauacauaauauguguauauauguaugccauauaugguauauuuugaugcaggcauacucuauauaauaaucacauuagaggaaaugagauauccauuaccucuagcauuuauucuuuuuauuacaagcaauucaauuguacacuuuuaguuauuuuuaaauuuacaauguuauugauuacagggucauuuuuauggucauaauaaaaaauuuuauacaaacguguaaaaucuauacauuucugaguucugaauaaauauuuuuaaaaauuuuaa

SEQ ID NO: 244 - RNA, 4137 nt, Homo Sapiens
cggggagacgcucuguggagacgcgagcacuuccggugugugagccugcgguugcuacauaaccgcguaguuugagccauuucugcgucuggcggguccuucugaacuugucaccuucgcuuggggucgcaacgacccgaugaucgaugauccaagcaagggaaaagaagccuuggcggagagcggaggcacaauuccaccuuccuuugugcuccauuacucaagacacugaagacuccaaaaaguaguaggaaaaaugaccacauucaaggaggcagugaccuucaaggauguggcuguguucuucacugaggaggaacuggggcuacuggacccugcccagaggaagcuguaccaagacgugaugcuugagaacuucacgaaccugcugucaguggggcaucaaccauuccacccuuuccacuuccuaagggaagaaaaguuuuggaugauggagacagcaacccaaagagaaggaaauucaggcggcaagacuauugcggaagcaggaccacaugaagacugcccuugccagcaaaucugggaacaaacugcaagugacuuaacccagucucaagacuccaucauaaauaauucucacuucuuugaacaaggugauguccccucccagguugaggcaggacuaucuauaauucauacaggacagaaaccuucacagaaugggaaguguaaacaguccuucagugauguugccaucuuugauccuccucagcaguuccacucaggagagaagucucauacaugcaaugaguguggaaaaagcuucuguuacaucucagcucuucguauucaccagagaguucacuugagagagaaacucucuaagugugacaugcgugguaaggaauucagucagagcucaugucugcaaacucgugagagaguccacacuggagagaaaccauucaaaugugagcaaugugggaaaggcuucagauguagagcgauacuucaaguucacugcaaauuacacacaggagagaaaccuuauauuugugagaaaugugggagggccuucauucacgauuuccagcuucagaaacaucagauaauucauacuggggagaagccguucaaaugugaaauaugugguaagagcuucugccuuaggucaagucuuaauaggcauugcaugguccacacagcagagaaacuguacaaaucugaggaguguggaaaaggcuucacugauagccuagauuugcauaagcaucagauaauucacacaggacagaaaccguacaauuguaaagaaugugggaagagcuucagaugguccucauaucuuuugauccaucagcgaauccacaguggagaaaaaccauacagaugugaggagugugggaagggcuacauuaguaagucaggucuuaacuugcaccagaggguccauacuggagagagaccuuauaauuguaaggaaugugggaagagcuuuagccgggcuucaaguauuuugaaucauaagaaacuccacugccggaaaaaacccuucaaaugugaggauuguggaaagaggcuuguacaccggucuuucuguaaagaccaacaaggagaccacaauggagaaaacucauccaaaugugaggacugugggaagcgcuacaagaggcgcuugaaucuggauauaauuuuaucauuauuuuuaaaugauauguaaguuguacauauauaugggauaugguaugaaauuuuaauauguguauauaauacguaaugaucaaauugauguaauuaguguauuaccuuaaacaauuaacauuucuuuguuuugggaaaauucaaaauccauuguucuagcgauuugaaaagaaacaauaaauuauuguugauuauagucaccuuuggugcuuuagaacacuagaauguauuucuccuaucuagcaguacuuauguaucuuguuacccaaucuuuggcuaucucaccuaaccccuacacuucccugcuucuagaaccacuguuuuacucacuaauucuaugaaaucaacuuuuuuagcuuccauaugugugugaggacaguuaguauuuaucuuaccuugcuuagcuuauauuguuuaacauguccuccaaagcucaucuauguugccacaaaugacacaauuuuguuuucuuuuuaugcccaaagaguauucuauuguguauauaugccaccuuuucuucauuuaucuauugauggacacauagguggguuccauaucuuaacuauugugaagaauagugcuccaaugaacaugguaguguagauaucugauccacauacugauuuccuuugcuuuggauauacucaauagugggauugcuagaucacucgaaucuuaugccucagaggcuugacacaagagcaaaacuauggaaguguggcuagggugauauggcuucauaccaccucaggccucaaguccucaacugcaccagaguguccacguuggacagaauccuuaguaaugaggugugugauaaagucucugcucaguugucuauaaucucauuugagaguucacaaaggggcaaaacauuaaaaagaggcauaugguaagcacuucaguguguguuuauaucauaauuuaucacaguccauacugauaauauauuucauccaggcuuguaggacagaaaacauuuguuuaaguuaaauucaguguuucaccauagcucagcauucucccaucauccuaggaccaucguaguagagaacucuuguaaauugugcaguaggguugcaaacagaacuuacgcuugucauucaggagacaggccuuagaauaagaguuuguucacacauuuacaaaacccuaaugaugaacaugucaaaaguggugaccacuagaaugucaacuacagguaccuuguuuucugcauccucaggaccuuaacacugauuagcacuuacauguuuaguauguguuaaaugacucaaaaggagaaaauaugauauuuuaaaauugcaucuaggagagaaaaucuacaaaaaauaauucagggacacgaguuaaaaugcagaauacacucaguucugcaauccaaagcauuauuuuggguaaucuuacccuguugcacuuggcugcuggcuuccccucauccucuguucugaaguuuacuacuaguggcuuugucuaaugcuccauugguugcauacaauauaaauucaacaaucauuuguaacucuucucacacuacaggcugaaaaugguuuguuaacuugucaauaacaguccacugcauauaucacaauuacauuuuuuucaacaguguuaaggcaaaauuuauaguaauacuuuuuacguggcagauguaguuacguuggaaaaaacuuccuuaguucugaauucucaugauugcuucuguauuuccaugcaggccuugauauaauggccuucuaauugugguagcauuuauuuuaucaaacaacucagguagaagcuaugccaauuugacaauuuuuggaaaccuaaccuaauauucucuuccuaucucuaugaaauaccaagagaaaccuaucggaguuugguaauuucaugaaauguauccaugauugggguaggagugacauuuacaugcucuucuuuauuguuggcaguaaaaauaagucuuuuguaagcaguguauaucagaauguauaagguacaaguguuuuaccuggaaaugaugggauaggaaauuaugauuaugauguuaaaacugugaaaaguagaaaaccacauggaugauaucaccccauuuuaaaauggaauaaguauucaacaagaauuugugugaaaugcauuuauuccuauaacauaagaccaauaaaaugagggaaccagacauacaguaaaaggagaaaaacauaaugugagcuuugugaaaucugacuguaaccuucauaacauaaucaaauaucuuuguguguuucugggacuuuuuaauguguauauacguaauuugugaacaacuauucuuuccucuggcaaugaauauuugcugguauuuuuccauuuuauaauuuuaugcauuuuuucucagugaacaucaguuuuaucaaagcaguaaauuuagugcaauaaauuugcaaacuuauuaacguuaaucacuuaccuaccaggacucagaaucucagaauaaaauugcucuauauu

SEQ ID NO: 245 - RNA, 2864 nt, Homo Sapiens
acacauccgcgcagaccaggaagcggaucccguggagugaaggucgcaccgcggcggauugacuucuaaagacuugguacgugaggaaaaaacacggaagaggaagaggaaagcaaaggagucagggauggcucuucuucagggucuacugacauucagggauguggccauagaauucucucaggaggaguggaaaugccuggacccugcucagaggacucuauacagagacgugaugcuggagaauuauaggaaccuggucucccuggauaccucuuccaaaugcaugaugaagauguucucaucaacaggacaaggcaauacagaagugguccacacagggacauugcaaauacaugcaagucaucacauuggagauacuugcuuccaggaaauugagaaagauauucaugacuuuguguuucaguggcaagaaaaugaaacaaauggccaugaagcacucaugacaaaaaccaaaaaguugaugaguaguacagagcgacaugaucaaaggcaugcuggaaacaaaccuauuaaaaaugagcuuggaucaagcuuucauucgcaucugccugaagugcacauauuucaccccgaagggaaaauugguaaucaaguugagaaggcuaucaacgaugcuuucucaguuucagcaucccaacgaauuuccuguaggccaaaaacucguauuucuaauaaguauaggaauaauuuccuccagucuucauuacucacacaaaaacgggaaguacacacaagagaaaaaucuuuccaacguaaugagaguggcaaagccuuuaaugguagcucacucuuaaaaaaacaucagauaauccauuuaggagacaaacaguauaaaugugauguaugcggcaaggacuuucaucagaagcgauaccuugcaugccauagaugucacacuggugagaauccuuacacguguaaugaguguggcaagacauucagucacaauucagcccuguuaguucacaaggcaauucauacuggagagaaaccuuacaaguguaaugaauguggcaagguuuuuaaucaacaaucaaaccuugcacgucaucauagaguucauacuggagagaaaccuuacaaaugugaagaaugugacaaaguuuucagucgcaaaucacaccuugaaagacauaggagaauucacacuggagagaaaccauacaaauguaagguuugugacaaggcuuucagacgugauucacaccuggcacaacauacuguaauucacacuggagagaaaccuuacaaguguaaugaguguggcaagaccuuuguucaaaauucaucucuuguaaugcauaaggucauucauacuggagagaaacguuacaaguguaaugaauguggcaagguuuuuaaucacaaaucaaaccuugcaugucaucguagacuucauacuggagagaaaccuuacaaguguaaugaauguggcaagguuuuuaaucgaaaaucaaaccuugaacgucaucauagacuucauacuggaaagaaaucuuagaaguguaaauuugcaagguuuuuaggcaacagucaaaccuugcaugucaucauagacuuuauacuggagagaaaccuuacaaaugugaagaaugugacaaaaguuuucaauuucaaaucacuccuugaaauacauaggagaguucauacuggagagaaaccauacaaauguaagguuugugacaaggauuucgggugugauucacaccuggcccaacauacuggaauucacacuggaaaggaacuguacaaguguaaugaguguggcagagccuuugguggucagucaacacuuacucaccaucaagcaauccaugguauagggaaacuugacuaauguaaugauugucacaaagucuucaguaauauuacagccauugcaaaacauuggagaauccauaaugaaggaggucuuacaaguguaauaaauguggcaaguuuuucagacaucauucauaacuugcaguucauuggcgaucuuauacaggagagaaaucuuacaaaugugaugauuguggcaaggucuucagucaagcuucaucuuuugcaaaacgggagaauucauacaggagagaaaccucacaagugugaugauugugagcaaagccuuuacuucacguucacaccacauuagauaucagaggauccauacuggacagaaaucuuacaaacguccuauguguggcaaggucuucaguccgagguuacuccuugcagaauaucauaacguucauuuuugagguaauaguuacaaaugcggugagcacagcaaaccaucaaggauugacaguagagucaauucagaauugacuugaguuugaguugacuuaaaacauucaguugaagcauuaauugacauuaaaguguuuauguuaagaggauugggccaggcguguggcucacgccuguaaauccagcacuuuaggagcccaagguggauagaucacuugaggucaugaguuugagaucagccuggccaacagacgugagucacuuuucccagccugcuuuuuguuucuuuaacaaaaaccaauagggguuuuuauagguauuguguugaaucugaaucacauuggcuuauauaauaacaauauugauuuuuccaaaccaucaauguggguuguauauauauguuuuuaaucauuuugguuaauguuuguagauuucaaggugugaaauucucaguuuuuuuauguuuauuccuaaguauuucuuacuuuaagaucucuagcaaauggaaguguuuuuuaauuuucguuuaaauuuuuuauuguuuauggaaauucaauuaauuuuuggugcugcuauugcauugugcaaauccacugaauguguugauu

SEQ ID NO: 246 - RNA, 3138 nt, Homo Sapiens
aagccuauuaaagaucagcuuggaucaagcuuucauucgcaucugccugaacuccacauguuucagacccaagggaaaauugguaaucaaguggagaagucuaucaaugaugcuuccucagcuucaacaucccaaauaauuuguaggcucaaaacccauauuucuauuaaguaugggaagaauuuccucuauucuucauuauucacacaaauacaagaaguacacaugagggaaaaaccuuuccaauguaaugaguguggcaaagccuuuaaucauagcucauguuuaaggagacaucacguaacccauucaggagagaaacaguauaaaugugauguauguggcaaagucuuucaucagaagcaauaccuugcauggcaccauaguguucauacuggagaaaaaccuuacaaguguaaugaguguuccaagaccuucaaucagaagucaucccuucagugucaucauagacuucauacuguacagaaacauuacaaaugugaagaaugcaacaaagcuuuuaguagaaaagcaaaccuugcacaucauggacuucauacuggagggaaaucuuacaaauguaaggguugugacaagguuuuccaccaugauuuaugccuugcacaacaucagagaguucauacuggagagaaccuuacacauuucacgaguauggaaagaccuuugcucaaaauucagcccuuguaaugcauaaggcaauucauacuggaaagaaaccuuacacauguaaugaauguggcaagguuuuuaguagaaaagcacaccuugcaugucaucauagacuucauacugucuaagguuucuaaucaacaaucaaaccuugcacaacaucagagaguuuauacuggagagaaaccuuacaaguguaaugaguggggcaaagccuuaagugggaagucgucacuuuuuuaucaucaagcaauccaugguguagggaaacuuugcaaauguaaugauugucacaaagucuucaguaaugcuacaaccauugcaaaucacuggagaauccauaaugaagacagaucuuacaaguguaauaaaugugguaaaauuuucagacaucgaucauaucuugcaguuuaucagcgaacucauacuggagagaaaccuuacaaauaucaugacuguggcaaggucuucagucaagcuucauccuaugcaaaacauaggagaauucauacaggagagaaaccucacaagugugaugauuguggcaaagucuugacuucacguucacaccucauuagacaucagagaauccauacuggacagaaaucuuacaaaugucuuaaguguggcaaggucuucagucugugggcacuccaugcagaacaucagaaaauucauuuuugagauaacuguuccaaauacagugacuauagaagaucauaaagcuuuaauugacauuagagccaaauaggcauugacuugagauugaguugacuuaaccuugaguuuaagaauuaauuuacauuaaaguguuuauguuaagaagauugggccagguggggauuacaggcgcgagccaccgcgcccggccccuaaguuaauauuucaaacaaucgaagguaaaacaacauauuguguugggccaccuguacugaacgcugaaucguuuuuccucuuaaguugaaaaugguuuuaaugcaaagcgccuuuuuugagcagguagagucacgcauccggcaggcggggcgagcuccccucugucuggggcagggugggggagaggggcagggaccucgguaaagggguggaguggcgcgcugguugccgcgggcacuggcaauuagaagggauuauuaaacuaagcaagguccuggguuguuugaguggauaauggaaacugaaaggugacgugcaaaacugccuauuacucccaggaguggaggauaauuucauauuucauggaaauaaacucagggcccggagcgguggcucacaccuguaaucccagcacuuugagaggccaaggagggaggaucgcuuaagcccaggaauucgaaaucagccuaggcaacauaguaagaccucaucucuacuaaaaauaaaaaaaaacagccagguguguuaguccacaccuguggucccagcugcuugggcugccucagcuucccgaguagcugggauuacagguaugaaccacuaugcccggcuaacuuuguuuuuuuuuuuuagaaauuaaaccuuuuuucagcuuaaugacccagggguguauuuuugaaggacuugggagcucucuuugaaaggcaaacaacaagggaaacaguaccuuuaucucaguaggaaauuaaauaauucaaacaucaaauaacuucaauuuaaggcuauggacuuugagauaauucugagccuugagaggaauguggucaggcaaccugaguccaguggaaugcaggugcaacuucuaagaguuuuccuguaaguaauuaagaagacuaaguagccccagagauaagaccuccucggaucauugucccuucuuauguagugauaaaguaaccuuccuugaaguguaucuauccguaaucaaucaaguugcugcagccuaugcacuggcccagaauaaaaaacguggugauucugcuaaagcuucucugucuuucccugugugugaaaucuuaacgucucuacuugggaacgcugaucccauucauuuagaguugauguuuccacguggcuauuuccaagcuuugccuucaaauaaauucuguacuuaaucauauauucuaaauuuuauuauuuacugcugacaucaguuucugucggauuguaggagccucaccagagagggccccugucgccauguuguaaaacucacacuugccaaaaguuguggguuaggguuucucccccucccucaggaugacgcuaguuagcugacacagauggucaccuccauuaccaaguagagucaggaugaacuaugugugacuguucaacuauguguccucuucccugaggacugauuaguguuuaucuugaaaacauguccuuaauggguuguauagaacacugaagcaucugauuucaaacucuuagcucuuuuccucuauuucccaucacauucuggucuaaggcuuauuuauuaauaaaaugauuuuuauuucuuuauua

SEQ ID NO: 247 - RNA, 4839 nt, Homo Sapiens
acgcgccgcgugcccggccgcgcccagcaggguuuccaggccugaggugcccgcccuggccccaggagaaugaaccagccgcagaggauggcgccugugggcacagacaaggagcucagugaccuccuggacuucagcaugauguucccgcugccugucaccaacgggaagggccggcccgccucccuggccggggcgcaguucggagguucaggucuugaggaccggcccagcucaggcuccuggggcagcggcgaccagagcagcuccuccuuugaccccagccggaccuucagcgagggcacccacuucacugagucgcacagcagccucucuucauccacauuccugggaccgggacucggaggcaagagcggugagcggggcgccuaugccuccuucgggagagacgcaggcgugggcggccugacucaggcuggcuuccugucaggcgagcuggcccucaacagccccgggccccuguccccuucgggcaugaaggggaccucccaguacuaccccuccuacuccggcagcucccggcggagagcggcagacggcagccuagacacgcagcccaagaagguccggaaggucccgccgggucuuccauccucgguguacccacccagcucaggugaggacuacggcagggaugccaccgccuacccguccgccaagacccccagcagcaccuaucccgcccccuucuacguggcagauggcagccugcaccccucagccgagcucuggagucccccgggccaggcgggcuucgggcccaugcugggugggggcucauccccgcugccccucccgcccgguagcggcccggugggcagcaguggaagcagcagcacguuugguggccugcaccagcacgagcguaugggcuaccagcugcauggagcagaggugaacggugggcucccaucugcauccuccuucuccucagcccccggagccacguacggcggcgucuccagccacacgccgccugucagcggggccgacagccuccugggcucccgagggaccacagcuggcagcuccggggaugcccucggcaaagcacuggccucgaucuacuccccggaucacucaagcaauaacuucucguccagcccuucuacccccgugggcuccccccagggccuggcaggaacgucacaguggccucgagcaggagcccccggugccuuaucgcccagcuacgacgggggucuccacggccugcagaguaagauagaagaccaccuggacgaggccauccacgugcuccgcagccacgccgugggcacagccggcgacaugcacacgcugcugccuggccacggggcgcuggccucagguuucaccggccccaugucacugggcgggcggcacgcaggccugguuggaggcagccaccccgaggacggccucgcaggcagcaccagccucaugcacaaccacgcggcccuccccagccagccaggcacccucccugaccugucucggccucccgacuccuacagugggcuagggcgagcaggugccacggcggccgccagcgagaucaagcgggaggagaaggaggacgaggagaacacgucagcggcugaccacucggaggaggagaagaaggagcugaaggccccccgggcccggaccaggugccaacccaccccucggcacuccccacccucaccccaucaggacgcacaugugcacaggccacacgcacaccgcacccacacugggaggccgucggcgggccccacgcucuucccccaaccucacugucucccucuggcccccucccggcgcccuccccauagcccagacgaggacgaggacgaccuucuccccccagagcagaaggccgagcgggagaaggagcgccggguggccaauaacgcccgggagcggcugcggguccgugacaucaacgaggccuuuaaggagcuggggcgcaugugccaacugcaccucaacagcgagaagccccagaccaaacugcucauccugcaccaggcugucucggucauccugaacuuggagcagcaagugcgagcaguacggacgaggugcugucccuggaggagaaagaccugagggaccgggagaggcgcauggccaauaacgcgcgggagcgggugcgcgugcgggauauuaacgaggccuuccgggagcuggggcgcaugugccagaugcaccucaagucggacaaagcgcagaccaagcugcucauccugcagcaggccgugcaggucauccuggggcuggagcagcaggugcgagagcggaaccugaaucccaaagcagccuguuugaaacggcgagaagaggaaaaggugucaggugugguuggagacccccagauggugcuuucagcuccccacccaggccugagcgaagcccacaaccccgccgggcacaugugaaagguaugccuccgugggacgagccacccgcuuucagcccugugcucuggccccagaacggccacucgagaccccgggcuucauccacauccacaccucacacaccuguugucagcaucgagccaacaccaaccugacaagguucggagugaugggggcggccaaggugacacuggguccaggagcucccuggggcccuggccuaccacucacuggccucgcucccccuguccccgaaucucagccaccgugucacucugugaccugucccauggauccugaaacugcaucuuggcccuguugccugggcugacaggagcauuuuuuuuuuuuccaguaaacaaaaccugaaagcaagcaacaaaacauacacuuugucagagaagaaaaaaaugccuuaacuauaaaaagcggagaaauggaaacauaucacucaagggggaugcuguggaaaccuggcuuauucuucuaaagccaccagcaaauugugccuaagcgaaauauuuuuuuuaaggaaaauaaaaacauuaguuacaagauuuuuuuuuucuuaauguagaugaaaauuagcaaggaugcugccuuuggucucugguuuuuuuaagcuuuuuuugcauauguuuuguaagcaacaaauuuuuuuguauaaaagucccgugucucucgcuauuucugcugcuguuccuagacugagcauugcauuucuugaucaaccagaugauuaaacguuguauuaaaaagaccccguguaaaccugagcccccccguccccccccccccccggaagccacugcacacagacagaacggggacaggcggcgggucuuuuguuuuuuugauguuggggguucucuugguuuugucauguggaaagugaugcgugggcguucccugaugaaggcaccuuggggcuucccugccgcauccucuccccucaggaaggggacugaccugggcuugggggaagggacgucagcaagguggcucugacccucccaggugacucugccaagcagcuguggcccccagggcuacccuacacaacgcccuccccaggccccccuaagcugcucucccuuggaaccugcacagcucucugaaauggggcauuuuguugggaccagugaccccuggcauggggaccacacccuggagcccggugcuggggaccuccuggacacccuguccuucacuccuuugccccagggacccaggcucaugcucugaacucuggcugagaggaugcugcucaggagccagcacaggacaccccccaccccaccccaccauguccccauuacaccagagggccaucgugacguagacaggaugccaggggccuggccagccucccccaaugcuggggagcaucccugggccuggggccacaccugcugcccucccucugugugguccaagggcaagaguggcuggagccgggggacugugcuggucugagccccacgaaggccuugggcugugcguccgacccugcugcagaaccagcaggguguccccucgggcccaucugugucccaugucccagcacccaggccucucuccaggucuccuuuucuggucuuuugccaugaggguaaccagcucuucccagcuggcuggggacugucuuggguuuaaaacugcaagucuccuacccugggaucccauccaguuccacacgaacuagggcaguggucacuguggcacccaggugugggccuggcuagcugggggccuucaugugcccuucaugccccucccugcauugaggccuuguggaccccugggcuggcuguguucauccccgcugcaggucgggcgucuccccccgugccacuccugagacucccaccguuacccccaggagauccuggacugccugacuccccuccccagacuggcuugggagccugggccccaugguagaugcaagggaaaccucaaggccagcucaaugccugguaucugcccccaguccaggccaggcggaggggaggggcuguccggcugccucucccuucucgguggcuuccccuacgcccugggaguuugaucucuuaagggaacuugccucucccucuuguuuugcuccuggcccugccccuaggucugggugggcaguggccccauagccucuggaacugugcguucugcauagaauucaaacgagauucacccagcgcgaggaggaagaaacagcaguuccugggaaccacaauuaugggggguggggggugugaucugagugccucaagaugguuuucaaaaaaauuuuuuuaaagaaaauaauuguauacgugucaacacagcuggcuggaugauugggacuuuaaaacgacccucuuucagguggauucagagaccuguccuguauauaacagcacuguagcaauaaacgugacauuuuauaacg

SEQ ID NO: 248 - RNA, 720 nt, Homo Sapiens
ccgggcgcuccuagcggucucccggacccugccgcccugccacuaugucccgccgcucuaugcugcuugccugggcucuccccagccuccuucgacucggagcggcucaggagacagaagacccggccugcugcagccccauagugccccggaacgaguggaaggcccuggcaucagagugcgcccagcaccugagccugcccuuacgcuauguggugguaucgcacacggcgggcagcagcugcaacacccccgccucgugccagcagcaggcccggaaugugcagcacuaccacaugaagacacugggcuggugcgacgugggcuacaacuuccugauuggagaagacgggcucguauacgagggccguggcuggaacuucacgggugcccacucaggucacuuauggaaccccauguccauuggcaucagcuucaugggcaacuacauggaucgggugcccacaccccaggccauccgggcagcccagggucuacuggccugcgguguggcucagggagcccugagguccaacuaugugcucaaaggacaccgggaugugcagcguacacucucuccaggcaaccagcucuaccaccucauccagaauuggccacacuaccgcucccccugaggcccugcugauccgcaccccauuccuccccucccauggccaaaaaccccacugucuccuucuccaauaaagauguagcucaaaa

SEQ ID NO: 249 - RNA, 1048 nt, Homo Sapiens
uccaugcaggaccucccagcccugaagacaaacaucagugacagacaucaguggcagaauggccucccgguauguggcagugggaaugaucuuaucacagaccguggugggaguccuggggagcuucucuguucuucuccauuaucucuccuuuuacugcacugggugcagguuaagguccacagauuugauuguuaagcaccugauuguagccaacuucuuagcucuccgcuguaaaggagucccccagacaauggcagcuuuugggguuagauauuuucucaaugcucuugggugcaaacuuguuuucuaucuccauagagugggcaggggaguguccauuggcaccaccugccucuugagugucuuccaggugaucacggucagcuccaggaaauccaggugggcaaaacuuaaagagaaagcccccaagcauguuggcuuuucuguucuccugugcuggaucgugugcauguugguaaacaucaucuuucccauguaugugacuggcaaauggaacuacacaaacaucacagugaacgaggauuugggauacuguucugggggaggcaacaacaaaaucgcacagacacugcgugcaauguuguuaucauucccugauguguugugucuggggcucaugcucugggucagcagcuccaugguuugcauacugcacaggcacaagcagcggguccagcacauugauaggagcaaucucucccccagagccuccccagagaacagagcuacgcagagcauccucauccuggugagcaccuuugugucuucuuacacucucuccugccuuuuccaaguuuguauggcucuuuuggauaaucccaauaguuuacuggugaacacuucagccuuaaugaguguauguuucccaacucucagccccuuuguucucaugagcugugaccccaguguauacagguuuuguuuugccuggaaaagaugacaagaucuccuaaccucaucauaaacauguacauuguauauauuugcucaugguucaauugaugacuuacucuucugugccgca

SEQ ID NO: 250 - RNA, 5119 nt, Homo Sapiens
auuggugaguggggcagggcaggagggaacugaagagugagaaagcauuauuucagcaaaaggucuuuccucccuugcucucuccuccaaccacuggcucagccucuccgcccgcugccugugaaugaugcaauggaaggugugcuggggucgcccugugucccgugcauaggagcaucucagccuccagguccucuccuuuggggcucacggcacccccaugcuacgaaccgcaggcagggacggccucugucgccuguccaccuacuuggaagaacucgaggcuguggaacugaagaaguucaaguuauaccuggggaccgcgacagagcugggagaaggcaagauccccuggggaagcauggagaaggccgguccccuggaaauggcccagcugcucaucacccacuucgggccagaggaggccuggagguuggcucucagcaccuuugagcggauaaacaggaaggaccugugggagagaggacagagagaggaccuggugagggauaccccaccugguggcccguccucacuugggaaccagucaacaugccuucuggaagucucucuugucacuccaagaaaagauccccaggaaaccuacagggacuauguccgcaggaaauuccggcucauggaagaccgcaaugcgcgccuaggggaaugugucaaccucagccaccgguacacccggcuccugcuggugaaggagcacucaaaccccaugcagguccagcagcagcuucuggacacaggccggggacacgcgaggaccgugggacaccaggcuagccccaucaagauagagacccucuuugagccagacgaggagcgccccgagccaccgcgcaccguggucaugcaaggcgcggcagggauaggcaaguccaugcuggcacacaaggugaugcuggacugggcggacgggaagcucuuccaaggcagauuugauuaucucuucuacaucaacugcagggagaugaaccagagugccacggaaugcagcaugcaagaccucaucuucagcugcuggccugagcccagcgcgccucuccaggagcucauccgaguucccgagcgccuccuuuucaucaucgacggcuucgaugagcucaagccuucuuuccacgauccucagggacccuggugccucugcugggaggagaaacggcccacggagcugcuucuuaacagcuuaauucggaagaagcugcucccugagcuaucuuugcucaucaccacacggcccacggcuuuggagaagcuccaccgucugcuggagcaccccaggcauguggagauccugggcuucucugaggcagaaaggaaggaauacuucuacaaguauuuccacaaugcagagcaggcgggccaagucuucaauuacgugagggacaacgagccucucuucaccaugugcuucgucccccuggugugcugggugguguguaccugccuccagcagcagcuggaggguggggggcuguugagacagacguccaggaccaccacugcaguguacaugcucuaccugcugagucugaugcaacccaagccgggggccccgcgccuccagcccccacccaaccagagaggguugugcuccuuggcggcagaugggcucuggaaucagaaaauccuauuugaggagcaggaccuccggaagcacggccuagacggggaagacgucucugccuuccucaacaugaacaucuuccagaaggacaucaacugugagagguacuacagcuucauccacuugaguuuccaggaauucuuugcagcuauguacuauauccuggacgagggggagggcggggcaggcccagaccaggacgugaccaggcuguugaccgaguacgcguuuucugaaaggagcuuccuggcacucaccagccgcuuccuguuuggacuccugaacgaggagaccaggagccaccuggagaagagucucugcuggaaggucucgccgcacaucaagauggaccuguugcaguggauccaaagcaaagcucagagcgacggcuccacccugcagcagggcuccuuggaguucuucagcugcuuguacgagauccaggaggaggaguuuauccagcaggcccugagccacuuccaggugaucguggucagcaacauugccuccaagauggagcacauggucuccucguucugucugaagcgcugcaggagcgcccaggugcugcacuuguauggcgccaccuacagcgcggacggggaagaccgcgcgaggugcuccgcaggagcgcacacgcuguuggugcagcuagucccuuuuucuugagagaguguggcucugucaccaaggcuggagugcaggggcacaaucucagcucacugcaaccuccaccuugcgugucucagccuccugagcagcugggaccacaggagugugccaccacacccagcuaauuuuuguauuuuuuuaguagagauggggugucaccauguuggccaggcuggucucaaacucucggccucagccucccaaagugcugggauuauaggugugagccaccacacccagccucuauaucccuuuuaucgguggacccaacaaucuucuguagacagaagacugugugaauaagccaauggucccaagagagcacgcauccuaaugagaacggagacagauaauaaagagggaaacaaguaaaccaacuaucaaugauuaggagcgucagauagagccaggugcagccuggacaacaugaugagauccccaucucuaaaaauauaaaauaaauuagcuggucaugauggugcacaccuguagccccagcuucucaguaggcugaggugggaggauugcuuaagccugggaggucaagccuacagugagccaugaucucaccaugcacuccagccuagacaacagggcaaggcccucuaaaaaaaaaaaugaaaagauagcaugcuuuggccggaugugguggcucacgccuguaaucccagcacuucaggagguugaggcgggcagaucaccugaggucaggaguacgagaucagccuggccaacacggugaaaccccaucucuacuaaaaauacaaaauuaacugggcgugguggcucaugccuguaaucccagcuacucuggaggcugaggcaggagaaucgcuugaacccaggaggcggagguuguggugagcugagauugcgccauugcacuccagccugggcaacaagagcgaaacuccgucucaaaaaaggauagcaugcuucauaaacggugaaaugacaugcaaaggccauaguugucaagcaccaguaacaccagagaguggccugucuuuccuucaagcagaccagagaggaccguucugcuggacgccuacagugaacaucuggcagcggcccugugcaccaauccaaaccugauagagcugucucuguaccgaaaugcccugggcagccggggggugaagcugcucugucaaggacucagacaccccaacugcaaacuucagaaccugagcacuuugggaggcccagauggggaggaucacuugacccaggaguucaagaccagccuggccaacauggugaaaccccaucucuacuaaaaauaccaaaaugagccaggcaugguggcacacgucuguaagcccagcuacucaggaggccaaggcaggaggauugcuucaacccaggaggcagagguuguggcugaagaggugccgcaucuccagcucagccugcgaggaccucucugcagcucucauagccaauaagaauuugacaaggauggaucucaguggcaacggcguuggauucccaggcaugaugcugcuuugcgagggccugcggcauccccagugcaggcugcagaugauucaguugaggaagugucagcuggaguccggggcuugucaggagauggcuucugugcucggcaccaacccacaucugguugaguuggaccugacaggaaaugcacuggaggauuugggccugagguuacuaugccagggacugaggcacccagucugcagacuacggacuuuguggugcuggaugcugaagaucugccgccucacugcugcugccugugacgagcuggccucaacucucagugugaaccagagccugagagagcuggaccugagccugaaugagcugggggaccucggggugcugcugcugugugagggccucaggcaucccacgugcaagcuccagacccugcgguugggcaucugccggcugggcucugccgccugugagggucuuucuguggugcuccaggccaaccacaaccuccgggagcuggacuugaguuucaacgaccugggagacuggggccugugguugcuggcugaggggcugcaacaucccgccugcagacuccagaaacuguggugguugcagcuggauagcuguggccucacagccaaggcuugugagaaucuuuacuucacccuggggaucaaccagaccuugaccgaccuuuaccugaccaacaacgcccuaggggacacagguguccgacugcuuugcaagcggcugagccauccuggcugcaaacuccgaguccucugguuauuugggauggaccugaauaaaaugacccacaguagguuggcagcgcuucgaguaacaaaaccuuauuuggacauuggcugcugaaugguccuaucugcuggcucuccccugagaucuggacagaggaagaugggagggugcucaucacccccccagcauaaugaucagccuccuuccuagagacagacucaugcagauugagaucaaaagucccucugcuugggaucaaauuaauguuugacagagcuggccaggcgugguggcucauguauguaauccuagcacuucgagaggccgaggcagguggaucacgaggucaggaguuugagauuagccuggccaagauggugaaacccugucucuacuaaaaauaaaaaaaaauuagccaggcaugguggcgggcaccuguagucccagcuacucaggaggcugaggcaggagaaucgcuugaacccgggagguggagguugcagugagccgagaucgcgccacugcacuccagccugggcgacagagugggacuccaucucaaaaaaaaaaaaaaaaaaa

SEQ ID NO: 251 - RNA, 830 nt, Homo Sapiens
ccuggucacccauugaagcaguguuugugguggagccccugagggcuuggugggguugagcagaaugaggaaagguuucauggagcagggagggagacggcuagggcagcaagugaaggacagacucgccuucccaucccuccaggggcacuccugccagccagccccucucccgcuucccaugaugggguggcuguuggaauucugcaccccaucucuucugauuguuggggcccaggacaaggggacaggcauuugugggccuaaccuccccaggcagauaggaggaggaagccaugucccagcaggcuagggcagagggacccccagugccaacagugcuuuaucagcgggcgccaggcagggccauccccagggugaggacaacaucucccugggcccuguuaucagucacagaguccacaggacgcuccuuggguuaacguguaaccaugagcccuccccuccacccccugaagccacucgcucccagauuaggucgcucuggggcuaucaggccagcauggacgcuggcaaagcggggcagacccugaagacucacugcucagcccagcgcccagaugucugcagguggcugagccccuucauccucuccugcugcguguacuucugccucuggauucccgaggaccagcuguccugguucgcugcccuggucaagugccugcccguccucugccuggcuggguuccugugggucauguccccaagcgggggcuacacccagcuccuccagggagcccuugugugcucggcugugggggacgcuugccucaucuggccggcagccuucgucccugagaagguuc

SEQ ID NO: 252 - RNA, 2825 nt, Homo Sapiens
ggcucagaucccacgcugccauucgguagauaugugucuuuagauaagugacuuaacuuucccgaauuuuagaguccucaucuaaagauucuaauaccuuccugacagacucuguagcugugacccugauaccgcguggugugcuccgaacacauggugcccagaacgaaggcggcguccagaagcccuaggucccagagguccgcucagcggcaggcgcauaaggcggggccggcgcgggccuuuccuuccaucggaaccguucucccggggcugagucccugcccggacuccgaacgccgaagaccaggggccggaagcgcgcgccgccacugccacgccgugucagucgggagggagggagcgagcaggcgaagccgcggaggacggggugaagauggcggccuucuccgagauggguguaaugccugagauugcacaagcuguggaagagauggauuggcuccucccaacugauauccaggcugaaucuaucccauugaucuuaggaggaggugauguacuuauggcugcagaaacaggaaguggcaaaacuggugcuuuuaguauuccaguuauccagauaguuuaugaaacucugaaagaccaacaggaaggcaaaaaaggaaaaacaacaauuaaaacuggugcuucagugcugaacaaauggcagaugaacccauaugacagaggaucugcuuuugcaauugggucagauggucuuuguugucaaagcagagaaguaaaggaauggcauggguguagagcuacuaaaggauuaaugaaagggaaacacuacuaugaaguauccugucaugaccaaggguuaugcagggucggguggucuaccaugcaggccucuuuggaccuagguacugacaaguuuggauuuggcuuugguggaacaggaaagaaaucccauaacaaacaauuugauaauuauggagaggaauucacuaugcaugauaccauuggauguuaccuggauauagauaagggacaugucaaguucuccaaaaauggaaaagaucuuggucuggcauuugaaauaccaccacauaugaaaaaccaagcccucuuuccugccuguguuuugaagaaugcugaacugaaauuuaacuucggugaagaggaauuuaaguuuccaccaaaagauggcuuuguugcucuuuccaaggcaccggaugguuacauugucaaaucacagcacucagguaaugcacaggugacacaaacaaaguuucuccccaaugcuccgaaagcucucauuguugaaccuucccgggaguuagcugaacaaacuuugaacaacaucaagcaguuuaagaaauacauugauaauccuaaauuaagggagcuucugauaauuggagguguugcagcccgggaucagcucucuguuuuggaaaauggaguagauauaguuguagguacuccgggaagacuagaugacuuggugucaacuggaaagcugaacuuaucucaaguuagauuccugguccuggaugaagcugaugggcuucuuucucaagguuauucugauuuuauaaauaggaugcacaaucagauuccucagguuaccucugauggaaaaagacuucaggugauuguuugcucugccacuuugcauucuuucgauguaaagaaacuguccgagaagauaaugcauuuuccuacauggguugacuuaaaaggagaagacucuguuccagauacuguacaccauguuguugucccaguaaaucccaaaacugacagacucugggaaaggcuuggaaagagccacauuagaacugaugauguacaugcaaaagauaacacaagaccuggugcuaauaguccagagauguggucugaagcuauuaaaauccugaaaggggaguaugcuguccgggcaaucaaggaacauaagauggaucaagcaauuaucuucuguagaaccaaaauugacugugauaacuuggagcaguacuuuauacaacaaggaggaggaccugauaaaaaaggacaccaguucucauguguuugucuucauggugacagaaagccucaugagagaaagcaaaacuuggaaagauuuaagaaaggagauguaagauucuugauuugcacagauguagcugcuagaggaauugauauccacgguguuccuuauguuauaaaugucacucugcccgaugaaaagcaaaacuacguacaucgaauuggcagaguaggaagagcugaaaggaugggucuggcaauuucccugguggcaacagaaaaagaaaagguuugguaccauguauguagcagccguggaaaaggguguuauaacacaagacucaaggaagauggaggcuguaccauaugguacaacgagaugcaguuacuaucugagauagaagaacaccugaacuguaccauuucucagguugagccggauauaaagguaccaguggaugaauuugaugggaaaguuaccuacggucagaaaagggcugcuggugguggaagcuauaaaggccauguggauauuuuggcaccuacuguucaagaguuggcugcccuugaaaaggaggcgcagacaucuuuccugcaucuuggcuaccuuccuaaccagcuguucagaaccuucugauuuuuacauuuacugaauaagauuugaguaaugaaagucuguagucuuaaaacucuaaaacaguuguacugcuuccaagcagcaguauuuauaguaacguaagcuauuaaugcuaacucuugcaugucaagaaacauuagucuuaggaauucuucaaaaaauggcaucccaaugaaaauaaauuugaugacuauauuuucaugaa

SEQ ID NO: 253 - RNA, 7221 nt, Homo Sapiens
auggggcugcggccaggcauuuuccuccuggagcugcugcugcuucuggggcaagggaccccucagauccauaccucuccuagaaagaguacauuggaagggcagcuauggccagagacccugaagaauucuccauucccaugcaacccaaauaaauuaggagugaauaugccuucuaaaucaguucacucucugaagccuucugauauuaaauuuguggcagccauuggcaaucuggaaauuccuccagacccagggacgggcgaucuggagaagcaagacuggacugaaaggccacagcaggugugcaugggagugaugacaguccuuucagacaucaucagauauuucaguccuucuguuccaaugccugugugccacacuggaaagagagucauaccccacgauggugcugaagacuuguggauucaggcucaagaacuggugagaaacaugaaagagaaccugcaacuugacuuucaauuugacuggaagcucaucaauguguucuucaguaaugcaagccaguguuaccugugccccucugcucaacagaaugggcuugcggcgggcggcguggaugagcugaugggggugcuggacuaccugcagcaggagguccccagagcauuuguaaaccugguggaccucucugagguugcagaggucucucgucaguaucacggcacuuggcucagcccugcaccagagcccuguaauugcucagaggagaccacccggcuggccaagguggugaugcaguggucuuaucaggaagccuggaacagccuccuggccuccagcagguacagugagcaggaguccuucaccgugguuuuccagccuuucuucuaugagaccaccccaucucuacacucggaggacccccgacuccaggauucuaccacgcuggccuggcaucucuggaauaggaugcagcucuguccuggcuggcugggccccaccucaaccucugcugugcagcuuuuccuucuaggagagauggagccagcaggagagaaagaugagccauugaguguaaaacacgggaggccaaugaagugucccucucaggagagccccuaucuguucagcuacagaaacagcaacuaccugaccagacugcagaaaccccaagacaagcuugagguaagagaaggagcggaaaucagauguccugacaaagaccccuccgauacgguucccaccucaguucauaggcugaagccggcugacaucaacguaauuggagcccugggugacucucucacggcaggcaauggggccggguccacaccugggaacgucuuggacgucuugacucaguaccgaggccuguccuggagcgucggcggagaugagaacaucggcaccguuaccacccuggcgaacauccuccgggaauucaacccuucccugaagggcuucucuguuggcacugggaaagaaaccaguccuaaugccuucuuaaaccaggcuguggcaggaggccgagcugaggaucuaccuguccaggccaggaggcugguggaccugaugaagaaugacacgaggauacacuuucaggaagacuggaagauaauaacccuguuuauaggcggcaaugaccucugugauuucugcaaugaucugguccacuauucuccccagaacuucacagacaacauuggaaaggcccuggacauccuccaugcugagguuccucgggcauuugugaaccuggugacggugcuugagaucgucaaccugagggagcuguaccaggagaaaaaagucuacugcccaaggaugauccucaggucucugugucccuguguccugaaguuugaugauaacucaacagaacuugcuacccucaucgaauucaacaagaaguuucaggagaagacccaccaacugauugagagugggcgauaugacacaagggaagauuuuacugugguugugcagccguucuuugaaaacguggacaugccaaagaccucggaaggauugccugacaacucuuucuucgcuccugacuguuuccacuucagcagcaagucucacucccgagcagccagugcucucuggaacaauaugcuggagccuguuggccagaagacgacucgucauaaguuugaaaacaagaucaauaucacauguccgaaccagguccagccguuucugaggaccuacaagaacagcaugcagggucaugggaccuggcugccaugcagggacagagccccuucugccuugcacccuaccucagugcaugcccugagaccugcagacauccaaguuguggcugcucugggggauucucugaccgcuggcaauggaauuggcuccaaaccagacgaccuccccgaugucaccacacaguaucggggacugucauacagagaaaguaaaccaggguucuuaucagacuccugggucagcaaauccaacaggaaaugcaccagaaaagcaccaaaucccugaaucuucaccuccccgcuugcauguauacguguacacgugguguuccuacgucucuguuuacugucuuuauguguuuauucauguugucuuguagucacacagcugccuuuacauauauguacacaucugcacagaaaaccucugaaacccaucgcacacuucgagaggccauaaccaagacacaaucacaaucagccaugucuugaaagauuagcaauucgacaagaggaaagggugagaaagggcaucccgaacacggaaguggagaagcucagggugugucaggcgagcgguugcguguagauauucucaaguuucuuucucuccuaauaaaguucucauuccuguaggcuucaaaguaaguggcgaguagcucagaauuuaccugggaaaacaacuagaacgaagcuggccacaagggggcagcgugcuaaugaguggcggagccaggacagcaccuuugcugccgccucccuuuucuucugagucaguuugcuuccuggggaagugacagggagcagggagggggugaucaagacugugaagguucucuggccagaccugagcagagucccagagaggauggguuuccagggcgagagggaggcgccaucacucggccuguaccacccacaacgaggaccuagguuguccuuagcaugaggacaucaaccucucaagaacagaggucagugccuuccugcgccaaggucccugcguuuccacaaguccuuggucagguaccugguccuaacaggcugccauggaacaaaucagagccucacugacucaccauucugcuccuaaugaggcuacaagaaaaaaaaccagaggagagaaagcagagcuuauuacaaucaggaaagagcaugagguucuggcagcugcacuuggucucagcuaaagaaggcaaugaccucauacgauagcaugggaaacaaaaaucaagcagacgaaccacauugcaggugauagauacgcgacgugcaccugguggggcagccuggggaagugaggugaugugcccuacuuuaaaacagaucgaccagcugggcuccugggauucagauaugaaccagcaguccucuacuaaaaguuucuuucugcagcgaugggaaaauucagccauugcucuguuucuuccaacaagugaaguccauuacagccuaaugucucaaucuuuuaguucuagcucuaaggccucagguucaauggcugcugucccuuuaaacccuucauuuguccuaaauguuucaaauagcugcccccaaaugcacguguguuaaagauggaagcucuaggucggggucugagagacagcuugacacuugguagaauacauagacuacugugucucaaaguguguuccauggaacauuaacuccagaccuguuccuggagaagagaaaauccuuuguaucugagggggaaacauuaccauaaccuuccuuuggggaauucauguguguauuagcauauuaaaggcucucauaaggccugcaaugcagaaaucuauuuaaguuuuaucuguuuaacccaauguuucccuuaauuccagaacauuuucuuuguucauaacaccuguuaacaccuccugaaaguguucacguaguagacuuaucugagaaaagcaauuuuugagccguuaaagcuucuagauuggacaaacuaggcaauuaaugauacuagaucaauucagaaugcaauuugagccucuucccccugggaaacaaagugaaaagaguggaucucauggaauuaggggagaaguagacccagaauucaugggggguggguggcugugaacaggaccugcagaagaggcucggcugugaauauuuccaaggccccuugaccugugagauucuguagugaacgguuccagcuuuggccagcuuaacaaugugcugggccccaaggucuugagagcauugccuuuucuuccauugaaauaaguucgcuuguuugggaccauucaaaggaucaaaauaaaauuuacuuaccaaaaaaugcaggaggggacggcucccuggagaaugugaccaccuuaccuaauauccuucgggaguuuaacagaaaccucacaggcuacgccgugggcacgggugaugccaaugacacgaaugcauuccucaaucaagcuguucccggagcaaaggcugaggaucuuaugagccaaguccaaacucugaugcagaagaugaaagaugaucauagaguaaauuuccaugaagacuggaaggucaucacagugcugaucggaggcagcgauuuaugugacuacugcacagauucgaaucuguauucugcagccaacuuuguucaccaucuccgcaaugccuuggacguccugcauagagaggugcccagaguccuggucaaccucguggacuuccugaaccccacuaucaugcggcagguguuccugggaaacccagacaagugcccagugcagcaggccagcguuuuguguaacugcguucugacccugcgggagaacucccaagagcuagccaggcuggaggccuucagccgagccuaccggagcagcaugcgcgagcugguggggucaggccgcuaugacacgcaggaggacuucucuguggugcugcagcccuucuuccagaacauccagcucccuguccuggcggaugggcucccagauacguccuucuuugccccagacugcauccacccaaaucagaaauuccacucccagcuggccagagcccuuuggaccaauaugcuugaaccacuuggaagcaaaacagagacccuggaccugagagcagagaugcccaucaccugucccacucagaaugagcccuuccugagaaccccucggaauaguaacuacacguaccccaucaagccagccauugagaacuggggcagugacuuccuguguacagaguggaaggcuuccaauaguguuccaaccucuguccaccagcuccgaccagcagacaucaaagugguggccgcccugggugacucucugacuacagcagugggagcucgaccaaacaacuccagugaccuacccacaucuuggaggggacucucuuggagcauuggaggggaugggaacuuggagacucacaccacacugcccaacauucugaagaaguucaacccuuaccuccuuggcuucucuaccagcaccugggaggggacagcaggacuaaauguggcagcggaaggggccagagcuagggacaugccagcccaggccugggaccugguagagcgaaugaaaaacagccccgacaucaaccuggagaaagacuggaagcuggucacacucuucauuggggucaacgacuugugucauuacugugagaauccggaggcccacuuggccacggaauauguucagcacauccaacaggcccuggacauccucucugaggagcucccaagggcuuucgucaacgugguggaggucauggagcuggcuagccuguaccagggccaaggcgggaaaugugccaugcuggcagcucagaacaacugcacuugccucagacacucgcaaagcucccuggagaagcaagaacugaagaaagugaacuggaaccuccagcauggcaucuccaguuucuccuacuggcaccaauacacacagcgugaggacuuugcgguuguggugcagccuuucuuccaaaacacacucaccccacugaacgagagaggggacacugaccucaccuucuucuccgaggacuguuuucacuucucagaccgcgggcaugccgagauggccaucgcacucuggaacaacaugcuggaaccagugggccgcaagacuaccuccaacaacuucacccacagccgagccaaacucaagugccccucuccugagagcccuuaccucuacacccugcggaacagccgauugcucccagaccaggcugaagaagcccccgaggugcucuacugggcugucccaguggcagcgggagucggccuuguggugggcaucaucgggacaguggucuggaggugcaggagagguggccggagggaagauccuccaaugagccugcgcacuguggcccucuaggcccggggguggguccucacccuaaacucccuauagccacucucuucaccgcccucugccccagccacucccggccaccaggacaugcuucaaugccuggugccauaggaagcccaggggacagucacaacuucuuggggccugggcuucuuccaggccuaugcuccuggaauggauacauuuaaauaaaguccaaagcuauuuuauuccuggguuugccugcgugaagcacucaccuuccaucucuugugcagcccaggugugggagcugccacuuuuuguggccugccuccagcagggcugcccaagccacgaccaaccagagcccaaacugccugccaccacgagcauauccucaagucaccaaacccacuauuucaaaggcagaaaaaaugcuggucaccaggugguggcuggaauuuuggagcuggcugguugccauucaguccaauccaacacauaccuauuaagcaacuguuuuguauccaggacaaugcgaagcacugaggugccuccuaggcugugcaugucgcagccuggcagagaggucaaacuccuucaauaaccaagaagccacgugaugauguguaacuacuagggcaucaguagguaaaugugucugauuguuuuaaagaauagaaaggguucuucggggaaaguuucuugggggagagcaaccuucacau

SEQ ID NO: 254 - RNA, 2862 nt, Homo Sapiens
ggcgcagcggcagcggcagcagcggcaacaagugccggaggcuagcagagccaagccggagcagucccugccgccgacaccgccgggccgcccguccggggcgccgcgcauggagcgugagcugcggcggucgccgggcugagccgcgcggagcggccgggacguggauguggccgcgaucucccgcccuugcccccgccccgccgagcuggagcugcucccggacaagagagccauuuagcugcaaacugucucugucucuguuuauccgagcagaaccuggaaggggcuggcaaggacuaggcaacagaugggacagccagagagauuguaagcaaggaaauaugagaaaugaguguuggacgucgaagaauaaaguuguuggguauccugaugauggcaaaugucuucauuuauuuuauuauggaagucuccaaaagcaguagccaagaaaaaaauggaaaaggggaaguaauaauacccaaagagaaguucuggaagauaucuaccccucccgaggcauacuggaaccgagagcaagagaagcugaaccggcaguacaaccccauccugagcaugcugaccaaccagacgggggaggcgggcaggcucuccaauauaagccaucugaacuacugcgaaccugaccugagggucacgucggugguuacggguuuuaacaacuugccggacagauuuaaagacuuucugcuguauuugagaugccgcaauuauucacugcuuauagaucagccggauaagugugcaaagaaaccuuucuuguugcuggcgauuaagucccucacuccacauuuugccagaaggcaagcaauccgggaauccuggggccaagaaagcaacgcagggaaccaaacgguggugcgagucuuccugcugggccagacacccccagaggacaaccaccccgaccuuucagauaugcugaaauuugagagugagaagcaccaagacauucuuauguggaacuacagagacacuuucuucaacuugucucugaaggaagugcuguuucucagguggguaaguacuuccugcccagacacugaguuuguuuucaagggcgaugacgauguuuuugugaacacccaucacauccugaauuacuugaauaguuuauccaagaccaaagccaaagaucucuucauaggugaugugauccacaaugcuggaccucaucgggauaagaagcugaaguacuacaucccagaaguuguuuacucuggccucuacccacccuaugcagggggagggggguuccucuacuccggccaccuggcccugaggcuguaccauaucacugaccagguccaucucuaccccauugaugacguuuauacuggaaugugccuucagaaacucggccucguuccagagaaacacaaaggcuucaggacauuugauaucgaggagaaaaacaaaaauaacaucugcuccuauguagaucugauguuaguacauaguagaaaaccucaagagaugauugauauuuggucucaguugcagagugcucauuuaaaaugcuaaaauagauacaaacucaauuuugcauagaaagguguauuuugaauaguucccauguuguguucucacauuagaguaauuucuauauuaaaccaugaaaauugccuuuaugagugauacccauuugagggccucuaaacccuucaauuugguacucacgugaagagggaaagcggaagaugguaauuuuuuuuuauggaugauauggcaggaugauugguucugaucuuaccggcuaguggucauuuuuaaaaaacuuguacccucuuaucugaaauccuguuucuggaauuuggccauuuuaagugauuuuguuugcccucuucuauaauauuccuacuucccauaauaaugacugauuuauuuguaauucagguauuuauaaaccuauuggcuacaaagacuuuguuaaacauuauccagugguuuucgugaaauggaauuauguuuauuuuuaugggauuuggguaaauuuuaaauugucuagaaaacugaaauuucaguugucaguuguggaauucaguuuuucaauuguggaaauuuccugccaccccaacaguauuuuuguguguuaauuaauuuugcaaaaugagaaucauggugugacacucaucuaauuuaucuuguugugauguuauggucauaauaaggagaaagaggguuuaauuuuucuuguauuugguuuccuggugguaucauaguguaauuuuaguauuugaaaaucagugugauuccuuaauggccaacugaagauugaauugccgcuaacaaccauaucguguuagugaauuuucaauauggaccaggaaggcauauguauuuugaacuugagugaaaagguugaaguuacagacuuuugcauagaugguuugucaauuuaaaauuccagaauuuauuauugccauauuuucacaugcugcuuauacaagauuauuauugaguaguaacugcuucccugucuauguagaagugccuguguuuuuauuuauuguucagaucaaagaccaaaacauuuucuuaaauauauuuuauguaauauuuuauuuguauacaguguuguugaugaaauauuuaacuagagcaugauauuuuaaauguuaagguguaacauauguuaaauaaaacuguuauuuuugaauuuuaaaauuuguuuuuuggggguaugaacuacuagaguuuaaaauucugccaaacuauuacuuauauguacuauuguguaacauacuuucuugaaauauuuuuguuuauagaauugaagguucuuaucagaugggauacuggggacuauaaacaauggaaauaaagccacuguauuuuuaa

SEQ ID NO: 255 - RNA, 2723 nt, Homo Sapiens
cucucuggauaggaagaaauauaguagaacccuuugaaaauggauauuuucacauauuuucguucagauacaaaagcuggcaguuacugaaauaaggacuugaaguuccuuccucuuuuuuuuaugucuuaagagcaggaaauaaagagacagcugaagguguagccuugaccaacugaaagggaaaucuucauccucugaaaaaacauaugugauucucaaaaaacgcaucuggaaaauugauaaagaagcgauucuguagauucucccagcgcuguugggcucucaauuccuucugugaaggacaacauauggugauggggaaaucagaagcuuugagacccucuacaccuggauaugaaucccccuucuaauacuuaccagaaaugaaggggauacucagggcagaguucugaaucucaaaacacucuacucuggcaaaggaaugaaguuauuggagugaugacaggaacacgggagaacaaugcucuguuugggcuggauauuucuuuggcuuguugcaggagagcgaauuaaaggauuuaauauuucagguuguuccacaaaaaaacuccuuuggacauauucuacaaggagugaagaggaauuugucuuauuuugugauuuaccagagccacagaaaucacauuucugccacagaaaucgacucucaccaaaacaagucccugagcaccugcccuucauggguaguaacgaccuaucugauguccaaugguaccaacaaccuucgaauggagauccauuagaggacauuaggaaaagcuauccucacaucauucaggacaaauguacccuucacuuuuugaccccaggggugaauaauucugggucauauauuuguagacccaagaugauuaaguaugauccaaauacauuucuaucugaaaacauuuccaaauccucuauuaucuaggagccccuaugauguagccuguugugucaagaugauuuuagaaguuaagccccagacaaaugcauccugugaguauuccgcaucacauaagcaagaccuacuucuugggagcacuggcucuauuucuugccccagucucagcugccaaagugaugcacaaaguccagcgguaaccugguacaagaauggaaaacuccucucuguggaaaggagcaaccgaaucguaguggaugaaguuuaugacuaucaccagggcacauauguaugugauuacacucagucggauacugugaguucguggacagucagagcuguuguucaagugagaaccauugugggagacacuaaacucaaaccagauauucuggauccugucgaggacacacuggaaguagaacuuggaaagccuuuaacuauuagcugcaaagcacgauuuggcuuugaaagggucuuuaacccugucauaaaaugguacaucaaagauucugaccuagagugggaagucucaguaccugaggcgaaaaguauuaaauccacuuuaaaggaugaaaucauugagcguaauaucaucuuggaaaaagucacucagcgugaucuucgcaggaaguuuguuugcuuuguccagaacuccauuggaaacacaacccaguccguccaacugaaagaaaagagaggaguggugcuccuguacauccugcuuggcaccaucgggacccugguggccgugcuggcggcgagugcccuccucuacaggcacuggauugaaauagugcugcuguaccggaccuaccagagcaaggaucagacgcuuggggauaaaaaggauuuugaugcuuucguauccuaugcaaaauggagcucuuuuccaagugaggccacuucaucucugagugaagaacacuuggcccugagccuauuuccugauguuuuagaaaacaaauauggauauagccuguguuugcuugaaagagauguggcuccaggaggaguguaugcagaagacauugugagcauuauuaagagaagcagaagaggaauauuuaucuugagccccaacuaugucaauggacccaguaucuuugaacuacaagcagcagugaaucuugccuuggaugaucaaacacugaaacucauuuuaauuaaguucuguuacuuccaagagccagagucucuaccucaucucgugaaaaaagcucucaggguuuugcccacaguuacuuggagaggcuuaaaaucaguuccucccaauucuagguucugggccaaaaugcgcuaccacaugccugugaaaaacucucagggauucacguggaaccagcucagaauuaccucuaggauuuuucaguggaaaggacucaguagaacagaaaccacugggaggagcucccagccuaaggaauggugaaaugagcccuggagcccccuccaguccagucccugggauagagauguugcuggacagaacucacagcucuguguguguguguucaggcugauaggaaauucaaagagucuccugccagcaccaagcaagcuugauggacaauggagugggauugagacugugguuuagagccuuugauuuccuggacuggacugacggcgagugaauucucuagaccuuggguacuuucaguacacaacaccccuaagauuucccagugguccgagcagaaucagaaaauacagcuacuucugccuuauggcuagggaacugucaugucuaccauguauuguacauaugacuuuauguauacuugcaaucaaauaaauauuauuuuauuagaaa

SEQ ID NO: 256 - RNA, 10695 nt, Homo Sapiens
cacagugguccuccgccggcuacggcgcugcgucacugguuugcaggcgcuuuccucuuggaaguggcgacugcugcgggccugagcgcuggucucacgcgccucgggagccagguuggcggcgcgaugaggcgcagcaaggcugacguggagcgguacaucgccucggugcagggcuccaccccgucgccucgacagaagucaaugaaaggauucuauuuugcaaagcuguauuaugaagcuaaagaauaugaucuugcuaaaaaauacauauguacuuacauuaaugugcaagagagggaucccaaagcucacagauuucugggucuucuuuaugaauuggaagaaaacacagacaaagccguugaauguuacaggcguucaguggaauuaaacccaacacaaaaagaucuuguguugaagauugcagaauugcuuuguaaaaaugauguuacugauggaagagcaaaauacuggcuugaaagagcagccaaacuuuucccaggaaguccugcaauuuauaaacuaaaggaacagcuucuagauugugaaggugaagauggauggaauaaacuuuuugacuugauucagucagaacuuuauguaagaccugaugacguccaugugaacauccggcuaguggagguguaucgcucaacuaaaagauugaaggaugcuguggcccacugccaugaggcagagaggaacauagcuuugcguucaaguuuagaauggaauucguguguuguacagacccuuaaggaauaucuggagucuuuacaguguuuggagucugauaaaagugacuggcgagcaaccaauacagacuuacugcuggccuaugcuaaucuuaugcuucuuacgcuuuccacuagagaugugcaggaaaguagagaauuacugcaaaguuuugauagugcucuucagucugugaaaucuuuggguggaaaugaugaacugucagcuacuuucuuagaaaugaaaggacauuucuacaugcaugcugguucucugcuuuugaagaugggucagcauaguaguaauguucaauggcgagcucuuucugagcuggcugcauugugcuaucucauagcauuucagguuccaagaccaaagauuaaauuaauaaaaggugaagcuggacaaaaucugcuggaaaugauggccugugaccgacugagccaaucagggcacauguugcuaaacuuaagucguggcaagcaagauuuuuuaaaagagauuguugaaacuuuugccaacaaaagcgggcagucugcauuauaugaugcucuguuuucuagucagucaccuaaggauacaucuuuucuugguagcgaugauauuggaaacauugauguacgagaaccagagcuugaagauuugacuagauacgauguuggugcuauucgagcacauaaugguagucuucagcaccuuacuuggcuuggcuuacaguggaauucauugccugcuuuaccuggaauccgaaaauggcuaaaacagcuuuuccaucauuugccccaugaaaccucaaggcuugaaacaaaugcaccugaaucaauauguauuuuagaucuugaaguauuucuccuuggaguaguauauaccagccacuuacaauuaaaggagaaauguaauucucaccacagcuccuaucagccguuaugccugccccuuccuguguguaaacagcuuuguacagaaagacaaaaaucuuggugggaugcgguuuguacucugauucacagaaaagcaguaccuggaaacguagcaaaauugagacuucuaguucagcaugaaauaaacacucuaagagcccaggaaaaacauggccuucaaccugcucugcuuguacauugggcagaaugccuucagaaaacgggcagcggucuuaauucuuuuuaugaucaacgagaauacauagggagaaguguucauuauuggaagaaaguuuugccauuguugaagauaauaaaaaagaagaacaguauuccugaaccuauugauccucuguuuaaacauuuucauaguguagacauucaggcaucagaaauuguugaauaugaagaagacgcacacauaacuuuugcuauauuggaugcaguaaauggaaauauagaagaugcugugacugcuuuugaaucuauaaaaaguguuguuucuuauuggaaucuugcacugauuuuucacaggaaggcagaagacauugaaaaugaugcccuuucuccugaagaacaagaagaaugcaaaaauuaucugagaaagaccagggacuaccuaauaaagauuauagaugacagugauucaaaucuuucaguggucaagaaauugccugugccccuggagucuguaaaagagaugcuuaauucagucaugcaggaacucgaagacuauagugaaggagguccucucuauaaaaaugguucuuugcgaaaugcagauucagaaauaaaacauucuacaccgucuccuaccagauauucacuaucaccaaguaaaaguuacaaguauucucccaaaacaccaccucgaugggcagaagaucagaauucuuuacugaaaaugauuugccaacaaguagaggccauuaagaaagaaaugcaggaguugaaacuaaauagcaguaacucagcauccccucaucguuggcccacagagaauuauggaccagacucagugccugauggauaucaggggucacagacauuucauggggcuccacuaacaguugcaacuacuggcccuucaguauauuauagucagucaccagcauauaauucccaguaucuucucagaccagcagcuaauguuacucccacaaagggcccagucuauggcaugaauaggcuuccaccccaacagcauauuuaugccuauccgcaacagaugcacacaccgccagugcaaagcucaucugcuuguauguucucucaggagauguaugguccuccugcauugcguuuugagucuccugcaacgggaauucuaucgcccaggggugaugauuacuuuaauuacaauguucaacagacaagcacaaauccaccuuugccagaaccaggauauuucacaaaaccuccgauugcagcucaugcuucaagaucugcagaaucuaagacuauagaauuugggaaaacuaauuuuguucagcccaugccgggugaaggauuaaggccaucuuugccaacacaagcacacacaacacagccaacuccuuuuaaauuuaacucaaauuucaaaucaaaugauggugacuucacguuuuccucaccacagguugugacacagcccccuccugcagcuuacaguaacagugaaagccuuuuaggucuccugacuucagauaaacccuugcaaggagauggcuauaguggagccaaaccaauuccugguggucaaaccauugggccucgaaauacauucaauuuuggaagcaaaaaugugucuggaauuucauuuacagaaaacauggggucgagucagcaaaagaauucugguuuucggcgaagugaugauauguuuacuuuccaugguccagggaaaucaguauuuggaacacccacuuuagagacagcaaacaagaaucaugagacagauggaggaagugcccauggggaugaugaugaugacgguccucacuuugagccuguaguaccucuuccugauaagauugaaguaaaaacuggugaggaagaugaagaagaauucuuuugcaaccgcgcgaaauuguuucguuucgauguagaauccaaagaauggaaagaacgugggauuggcaauguaaaaauacugaggcauaaaacaucugguaaaauucgccuucuaaugagacgagagcaaguauugaaaaucugugcaaaucauuacaucaguccagauaugaaauugacaccaaaugcuggaucagacagaucuuuuguauggcaugcccuugauuaugcagaugaguugccaaaaccagaacaacuugcuauuagguucaaaacuccugaggaagcagcacuuuuuaaaugcaaguuugaagaagcccagagcauuuuaaaagccccaggaacaaauguagccauggcgucaaaucaggcugucagaauuguaaaagaacccacaagucaugauaacaaggauauuugcaaaucugaugcuggaaaccugaauuuugaauuucagguugcaaagaaagaagggucuugguggcauuguaacagcugcucauuaaagaaugcuucaacugcuaagaaauguguaucaugccaaaaucuaaacccaagcaauaaagagcucguuggcccaccauuagcugaaacuguuuuuacuccuaaaaccagcccagagaauguucaagaucgauuugcauuggugacuccaaagaaagaaggucacugggauuguaguauuuguuuaguaagaaaugaaccuacuguaucuaggugcauugcgugucagaauacaaaaucugcuaacaaaaguggaucuucauuuguucaucaagcuucauuuaaauuuggccagggagaucuuccuaaaccuauuaacagugauuucagaucuguuuuuucuacaaaggaaggacagugggauugcagugcauguuugguacaaaaugaggggagcucuacaaaaugugcugcuugucagaauccgagaaaacagagucuaccugcuacuucuauuccaacaccugccucuuuuaaguuugguacuucagagacaaguaaaacucuaaaaaguggauuugaagacauguuugcuaagaaggaaggacagugggauugcaguucaugcuuagugcgaaaugaagcaaaugcuacaagauguguugcuugucagaauccggauaaaccaaguccaucuacuucuguuccagcuccugccucuuuuaaguuugguacuucagagacaagcaaggcuccaaagagcggauuugagggaauguucacuaagaaggagggacagugggauugcagugugugcuuaguaagaaaugaagccagugcuaccaaauguauugcuugucagaauccagguaaacaaaaucaaacuacuucugcaguuucaacaccugccucuucagagacaagcaaggcuccaaagagcggauuugagggaauguucacuaagaaggagggacagugggauugcagugugugcuuaguaagaaaugaagccagugcuaccaaauguauugcuugucagaauccagguaaacaaaaucaaacuacuucugcaguuucaacaccugccucuucagagacaagcaaggcuccaaagagcggauuugagggaauguucacuaagaaggaaggacagugggauugcagugugugcuuaguaagaaaugaagccagugcuaccaaauguauugcuugucaguguccaaguaaacaaaaucaaacaacugcaauuucaacaccugccucuucggagauaagcaaggcuccaaagaguggauuugaaggaauguucaucaggaaaggacagugggauuguaguguuugcuguguacaaaaugagaguucuuccuuaaaauguguggcuugugaugccucuaaaccaacucauaaaccuauugcagaagcuccuucagcuuucacacugggcucagaaaugaaguugcaugacucuucuggaagucaggugggaacaggauuuaaaaguaauuucucagaaaaagcuucuaaguuuggcaauacagagcaaggauucaaauuugggcauguggaucaagaaaauucaccuucauuuauguuucaggguucuucuaauacagaauuuaagucaaccaaagaaggauuuuccaucccugugucugcugauggauuuaaauuuggcauuucggaaccaggaaaucaagaaaagaaaagugaaaagccucuugaaaaugguacuggcuuccaggcucaggauauuaguggccagaagaauggccguggugugauuuuuggccaaacaaguagcacuuuuacauuugcagaucuugcaaaaucaacuucaggagaaggauuucaguuuggcaaaaaagaccccaauuucaagggauuuucaggugcuggagaaaaauuauucucaucacaauacgguaaaauggccaauaaagcaaacacuuccggugacuuugagaaagaugaugaugccuauaagacugaggacagcgaugacauccauuuugaaccaguaguucaaaugcccgaaaaaguagaacuuguaacaggagaagaagaugaaaaaguucuguauucacagcggguaaaacuauuuagauuugaugcugagguaagucaguggaaagaaaggggcuuggggaacuuaaaaauucucaaaaacgaggucaauggcaaacuaagaaugcugaugcgaagagaacaaguacuaaaagugugugcuaaucauuggauaacgacuacgaugaaccugaagccucucucuggaucagauagagcauggaugugguuagccagugauuucucugauggugaugccaaacuagagcaguuggcagcaaaauuuaaaacaccagagcuggcugaagaauucaagcagaaauuugaggaaugccagcggcuucuguuagacauaccacuucaaacuccccauaaacuuguagauacuggcagagcugccaaguuaauacagagagcugaagaaaugaagaguggacugaaagauuucaaaacauuuuugacaaaugaucaaacaaaagucacugaggaagaaaauaaggguucagguacaggugcggccggugccucagacacaacaauaaaacccaauccugaaaacacugggcccacauuagaaugggauaacuaugauuuaagggaagaugcuuuggaugauagugucaguaguagcucaguacaugcuucuccauuggcaaguagcccugugagaaaaaaucuuuuccguuuuggugagucaacaacaggauuuaacuucaguuuuaaaucugcuuugaguccaucuaagucuccugccaaguugaaucagagugggacuucaguuggcacugaugaagaaucugauguuacucaagaagaagagagagauggacaguacuuugaaccuguuguuccuuuaccugaucuaguugaaguauccaguggugaggaaaaugaacaaguuguuuuuagucacagggcaaaacucuacagauaugauaaagauguuggucaauggaaagaaaggggcauuggugauauaaagauuuuacagaauuaugauaauaagcaaguucguauagugaugagaagggaccaaguauuaaaacuuugugccaaucacagaauaacuccagacaugacuuugcaaaauaugaaagggacagaaagaguaugguuguggacugcaugugauuuugcagauggagaaagaaaaguagagcauuuagcuguucguuuuaaacuacaggauguugcagacucguuuaagaaaauuuuugaugaagcaaaaacagcccaggaaaaagauucuuugauaacaccucauguuucucggucaagcacucccagagagucaccauguggcaaaauugcuguagcuguauuagaagaaaccacaagagagaggacagauguuauucagggugaugauguagcagaugcaacuucagaaguugaagugucuagcacaucugaaacaacaccaaaagcagugguuucuccuccaaaguuuguauuugguucagagucuguuaaaagcauuuuuaguagugaaaaaucaaaaccauuugcauucggcaacaguucagccacugggucuuuguuuggauuuaguuuuaaugcaccuuugaaaaguaacaauagugaaacuaguucaguagcccagaguggaucugaaagcaaaguggaaccuaaaaaaugugaacugucaaagaacucugauaucgaacagucuucagauagcaaagucaaaaaucucuuugcuuccuuuccaacggaagaaucuucaaucaacuacacauuuaaaacaccagaaaaggcaaaagagaagaaaaaaccugaagauucucccucagaugaugauguucucauuguauaugaacuaacuccaaccgcugagcagaaagcccuugcaaccaaacuuaaacuuccuccaacuuucuucugcuacaagaauagaccagauuauguuagugaagaagaggaggaugaugaagauuucgaaacagcugucaagaaacuuaauggaaaacuauauuuggauggcucagaaaaauguagacccuuggaagaaaauacagcagauaaugagaaagaauguauuauuguuugggaaaagaaaccaacaguugaagagaaggcaaaagcagauacguuaaaacuuccaccuacauuuuuuuguggagucuguagugauacugaugaagacaauggaaauggggaggacuuucaaucagagcuucaaaaaguucaggaagcucaaaaaucucagacagaagaaauaacuagcacaacugacaguguauauacaggugggacugaagugaugguaccuucuuucuguaaaucugaagaaccugauucuauuaccaaauccauuaguucaccaucuguuuccucugaaacuauggacaaaccuguagauuugucaacuagaaaggaaauugauacagauucuacaagccaaggggaaagcaagauaguuucauuuggauuuggaaguagcacagggcucucauuugcagacuuggcuuccaguaauucuggagauuuugcuuuugguucuaaagauaaaaauuuccaaugggcaaauacuggagcagcuguguuuggaacacagucagucggaacccagucagccgguaaaguuggugaagaugaagaugguagugaugaagaaguaguucauaaugaagauauccauuuugaaccaauagugucacuaccagagguagaaguaaaaucuggagaagaagaugaagaaauuuuguuuaaagagagagccaaacuuuauagaugggaucgggaugucagucaguggaaggagcgcgguguuggagauauaaagauucuuuggcauacaaugaagaauuauuaccggauccuaaugagaagagaccagguuuuuaaagugugugcaaaccacguuauuacuaaaacaauggaauuaaagcccuuaaauguuucaaauaaugcuuuaguuuggacugccucagauuaugcugauggagaagcaaaaguagaacagcuugcagugagauuuaaaacuaaagaaguagcugauuguuucaagaaaacauuugaagaaugucagcagaauuuaaugaaacuccagaaaggacauguaucacuggcagcagaauuaucaaaggagaccaauccugugguguuuuuugauguuugugcggacggugaaccucuagggcggauaacuauggaauuauuuucaaacauuguuccucggacugcugagaacuucagagcacuaugcacuggagagaaaggcuuugguuucaagaauuccauuuuucacagaguaauuccagauuuuguuugccaaggaggagauaucaccaaacaugauggaacaggcggacaguccauuuauggagacaaauuugaagaugaaaauuuugaugugaaacauacugguccugguuuacuauccauggccaaucaaggccagaauaccaauaauucucaauuuguuauaacacugaagaaagcagaacauuuggacuuuaagcauguaguauuuggguuuguuaaggauggcauggauacugugaaaaagauugaaucauuugguucucccaaagggucuguuugucgaagaauaacuaucacagaauguggacagauauaaaaucauuguuguucauagaaaauuucaucuguauaagcaguuggauugaagcuuagcuauuacaauuugauaguuauguucagcuuuugaaaauggacguuuccgauuuacaaauguaaaauugcagcuuauagcuguugucacuuuuuaauguguuauaauugaccuugcauggugugaaauaaaaguuuaaacacugguguauuucagguguacuuguguuuauguacuccugacguauuaaaauggaauaauacuaaucuuguuaaaagcaauagaccucaaacuauugaaggaauaugauauaugcaauuuaauuuuaauuccuuuuaagauauuuggacuuccugcauggauauacuuaccauuugaauaaagggaccacaacuuggauaauuuaauuuuagguuugaaauauauuugguaaucuuaacuauugguguacucauuuaugcauagagacucguuuaugaauggguagagccacagaacguauagaguuaaccaaagugcucuucucuagaaucuuuacaccuccugugugguuacaaguuaacuuuguaaguagcguaccuuccuuccuuaaaauaucuagcuuccugugcccuuucauagauauucgauuaauuuuuacauuuuaaacaaguugacuauuuccuuuagggguuuuguuucaaacuuuucugucaucugucucuacuaccucagaaacugcagcuugguucugaugauagaaauugaauuuuuccuuguaguuauugugauaaaguaugaauauuuuuagaaagucuauaccauguucuuucguuaaagauuugcuuuauacaagauuguugcaguaccuuuuucugguaaauuuuguagcagaaauaaaaugacaauuccuaagagcca

SEQ ID NO: 257 - RNA, 2334 nt, Homo Sapiens
cgcucggggggugggaaagcgagcccggcagcucaaugacaaaucgguggaggacggcugggguccggccccgggagggggcggggcgcguuuaagagcugcgggccgggugcggacggcggaggcggcgggacuggucccugcucuucagugggucaucugugugucacagccucagaagaccagcgagauggcugccaacaagaguaagggccagagcuccuuggcccuccacaaggugaucaugguuggcagcggaggcguuggcaagucagcccugacgcuucaguucauguaugacgaggaauguuucaaaaucauuggcauaugacaagaaaaaguauacagcaaacaaaaaaguagaagguauucuagaguuuguagaagacuaugaaccuaccaaagcugacaguuauagaaagaaagugguucuugauggggaagaaguucagauagauauucuggacaccgcugggcaagaggacuacgcagccauucgagauaacuacuuucggaguggggaaggguuucuucuuguguucucaaucacagaacaugaauccuuuacagcaacugccgaauucagggaacagauucuccgugugaaggcugaagaagauaaaauuccacugcucgucgugggaaacaagucugaccuagaggagcggaggcaggugccuguggaggaggccaggaguaaagccgaagaguggggcgugcaguacguggagacgucagcgaagacccgggccaacguggacaagguguucuuugaccuaaugagagaaaucagaacaaagaagaugucagaaaacaaagacaagaauggcaagaaaagcagcaagaacaagaaaaguuuuaaagaaagauguugcuuacuaugagugucaaggugacggaugaagccagcugcuccuaaggacacagggcuggguugguaaagagaaggcuaugguugacuucuugcuugugcuucccacucuccccgacuucauucacucaaacuucuuuaaauggggaaaaauauuugugacucuguggcuggcagaagaaauaagcccaugcaaguggaagggcugcuuugucaggagguuguggaauuucuuucuucuccccuucuucccucccaaaagcuuagcuauguauaaagugccacagauaggaaacagcuguuaauuacaaagagaaagaauugucauagcaucuuauuuuguuccuaguuuuauaacauuaccauccuucguuuugaacuacagauguuguaguggguuuuggaggagggaguggaguaagaugcccucccacuuuuaucaguuuaguaguaguacugagaaaaaucccuucagcucuaagaacacugaaaaauccaccgauuuuuuggguaagcuucuuggcaauacccuguggaucugaaacagcuaaaaaaaugaauuugaauugcgccagauaggucaauaccaagcuucugauuccuccucacauaugaaaagugaaaguugugaguuguuuuccucuuauuuaaacauuggccuauuauaaucuguguugguuauuuuucuccuguaagcauccugauuuuucuguaggaacuuuucuuuggcagaccaagugaagacucaggaauggugugcauuauaaaugacacacauugccacuuguguagauauuuuuaaguucuuuggcuaaguccucuccuaacugccuguccucugguuaggccccucccucuccacuaguggugaaugcaugugucugucugaucagcaucacugcacacggaggucuagugagccucuugcuaagugucacacacacucuucccaaagacgugaugaguuaaaguuguauucugaaaucaugaagccagagccugugccagaccuucugcuaccucucauagaauugcucuguaauucuaaauuuaaaauuagaaguagagagagauaagccaucgccccuuugccucugagaauuggcugcuguuucuaauauaauuauuuucuaagauagccagauaguuagaaaaagauuuucauugaugacauaucuuuaaacuuucuugcaucaguauucuaaauugagcaaacugaaagauuuucaucaggaaaggagcacugugggaagagcccaguauucacauuuuuuccccauuuuucagaagcgacauuucauauauaggugccaaaagugaaucggggugcggagagugggaaccuuuugaauuuaugauugucacagagaugguagaaauuaugaucugacuggaaaacaauccuguauccccucccaaagaaucaugggcuuuuuuuuugaauaaaaaagcagacaaauaga

SEQ ID NO: 258 - RNA, 2959 nt, Homo Sapiens
auacuuuagguuauaacuuaaugcaauguacuuuauauugcugcucaaauugucccaggcgcggcccccggaagcucucuggguagaucccugcgcccuuggacgcccgguccuucaguuuuuugagcaccucaagcuucuggccuacaaaacgcucccggcucagcuggagcuuucugcgcccggguccuagagucgcccauuucucuaaggcgccuuggcccuauuuuuagagagcgguauuuagaaaccaagauuagggugcuaacaauuuuuuuuuaaauuuuuauauuuuuaagacaggaucucacuuuguaacacuuccuuuuaguggaagcgccgaccuccugggagacccacgcccccugccgccuuccgucccguuucucagaaaaccacccagacaccccgccccaccggccggggcccgccgcgcaugcgcgccgaggcgugacgucagaacggcggccaggacgccggacgugcggcaguugcaggcgagcaggcgaggaaucgccguggcgucuugguguucuccacgcugguucgcaggugaagagauggcguuugugaagaguggcugguugcugcgacagaguacuauuuugaagcgcuggaagaagaacugguuugaucuguggucggauggucaccugaucuauuaugaugaccagacucggcagaauaucgaggauaagguccacaugccaauggacugcaucaacauccgcacggggcaggaaugucgggauacucagcccccggauggaaagucaaaagacugcaugcuccagauuguuugucgagaugggaaaacaauuagucuuugugcagaaagcacagaugauugcuuggccuggaaauuuacacuccaagauucuaggacaaacacagcguaugugggcucugcagucaugaccgaugagacauccgugguuuccucaccuccaccauacacggccuaugcugcaccggccccugagcaggcuuauggcuaugggccauacgguggugcguacccgccaggaacucaaguugucuacgcugcgaaugggcaggcguaugccgugcccuaccaguacccauaugcaggacuuuauggacagcagccugcuaaccaagucaucauucgagagcgcuaucgagacaacgacagcgaccuggcacugggcaugcuggcaggagcagccacgggcauggccuuagggucucuauuuugggucuucuaggggccucaaggucuugaugugcauagcuucugauaacccugugugcaauaauaugauuugcagggcauuucuguuugugacaaaaguuuuuaauaauaguuuuaaucauuccuuugaaaguagugaugucauaauuguacuaauccacauaaguaccacagagaaggguuugaacugugcuauuuuguucaaauguugacucuccgggggcacuggcucauuccaagacuguucuugugcaacucucagaauaccuuauuugagcauaccuguuuugaaaggcauuuucuuuuuagaguuagguguagugcuuaaggguuaauuuauuuucauguuaugccaguaauauaguguuguaugccuauugagugauuguggcaagaaaagcuacagcuucuuugcguuuaacuuuuucaaaccacagaccagaacugguugcauguuacuuuaggaguuguggguugguaagcucccagguacuucccgaggcuauggugugagagcccccguccugcccucuggggcuccacaggccccuggcaaggccgauggcucaggaugauggggcacagcccgccuuugaacaaucaugcuucagaaaucugccugacccuagcugcugcugcugcucacuuuauucuuguauggcuuugguaggcauacuuggagaacauaucccacauuaggaauugauuuaagccugagaguuugagggcuuuaauccuuuaaaacuuggagaagcuggcugggcgcgguggcucacgccuguaaucccagcacuuugagagaccgaggcgggcggaucacgaggucaggagaucgagaccauccuggcuaacacggugaaaccccaucucuacuaaaaauacaaaaaauuagcugggcgugguggcaggcgccuguggucccagcuacucgggaggcugaggcaggagaauagugugaacccaggaggcggagcuugcagugagccaagauagugccacugcacuucagccugggugacagagugagacucugucucaaaaaaaaaaaaaaaagagcugcacaguaaaggucccaaaauacacaccaccacgagugcaaaaacccaggcgguucucccaacgcgauguuuuuuucccagcgaaucuccgauaagaaggucugugcagauuucugugcuccuaccugcaguaaauauucguagacguauaaagcuaacuuuuccccagccugcccguccgagggcaccaaggagccuuugccuuuggcaaacaugguuugcagggaagagggcgcccagccuccccacagccgccaccgcuccggcucucccgagcugccccucgcccccggcccccucccaggcgcucccucccucucucgcuggcuggcgcucuccuagcagcgcuccccucccucccgagcaggcgcuggcuccgcgcucuuuccagcugucaaagcaucaggcccggccgcggccccaucgcccuggaacuccucccgugccggcuuggccuggggugccgccgccgccucccgcaaggccgcccgcucuccgguagcucgcgugcucgcccgguuccgcuugcgcggcccucugcgcccccagcaccgcugccgccgccgccggcgcuggccucaugugucacauuuucuuaauccagucuauggcugauggauauuuggguugguuccaacuuuuugcuauugugaauagugccgcaauaaacauacgugugcaugug

SEQ ID NO: 259 - RNA, 5709 nt, Homo Sapiens
agucguaacucggaagccggagcccagacgggcccgcggcgggggggugggggcugcgcgggggcgggaguggcggagguggccgccccuggcggcggguuuguuuaucccggggaagaaguuuaggagcgggagauagggaaggagggcgggucggggaggagggaugcgguucggcggaggcggccgccacagggacuugccgccaucaccccugcugccaccaccgcagccucgggcucccagggcggacacggccaccgccucagcgggagaggagucuccaccaggacugaccgcugccgcccagcacguccagguaagguacucaacugugugggguacuacauaaauccugaaagacuacaauaaaguggugaugucucgggaacccaccccaccucuaccuggagauaugucuacuggucccauagcagaaagcugguguuacacacagguuaaaguaguaaaauuuuccuauauguggaccauuaauaacuucaguuuuugucgagaggaaaugggugaaguguuaaaaaguucaacauuuucaucuggcccaagugacaaaaugaaauggugccugaggguaaacccaaagggauuagaugaugaaaguaaagacuacuuguccuuauauuugcuuuuagucagcugccccaaaagugaaguucgagcaaaauucaaauuuucccuucugaaugcuaaaagggaagaaacaaaagcaauggaaagccaaagagcauaucgauuugugcaagggaaggacugggguuuuaaaaaauucauuagaagggacuuuuugcuugaugaagcuaauggucuuuuaccagaugacaagcuuacauuauuuugugaggugagugugguccaagauucaguaaacauaucaggacauacuaauacaaauacuuugaaggugccugagugucgucuagcagaagauuuagguaaucucugggaaaacacaagauuuacagacugcaguuuuuucgugagaggacaagaauuuaaagcucauaaaucugugcuugcagcucgaucuccaguuuuuaacgccauguuugaacaugaaauggaagaaagcaaaaagaaucgaguggaaauaaaugauuuagacccugaaguuuuuaaagaaaugaugagauucauuuacacagggagagcaccaaaccuugacaaaauggcugacaacuuguuggcagcugcagacaaauaugcacuggaacggcugaaggucaugugcgaagaagcuuuguguaguaaccucucaguagagaauguugcagauacccuuguccuugcagauuugcacagugcagaacaguugaaagcacaagccauagacuuuauuaauaggugcaguguacuucgacaacuuggguguaaagaugggaaaaacuggaacagcaaccaagcaaccgacauaauggaaacaucaggguggaaguccaugauucagucucacccucauuuaguagcagaagccuuucgagcacuagcaucugcacaguguccacaguuuggcauuccacgcaaacggcuaaaacaguccugaaaucuuccaugaacaguugaaaaauggaauugacuuucacuccuccagguccagaaggauucuaauacacaaaccauaagcaagaguuguuucuguuauuuuguccacagaacagaagcugaaaaagcauauugcuugcauuucagguggauaauuuaugguuuauucuucagcuuuaaauuagacugauuaauucacuucaaggccuuaaauuaucuucaaugacuugucuuguucauauaauacuuuaauuuuuuuuuauugugccuugucauuuugaccaaggcuaugcaggauugcacuagcuccauaaugcaguaauauugauaacugaagauacuaaguuucaaaaggaucuuccauuauuuugcaaaaagaaaaaugaauuuuauaggguuuguccuaugcuaucucaaaguuuaaguucucuuuaaaagcacuuguauuggagauuaccaguaauaucuccaaucuaaguucuauaaauaugggagaacccucuuaccuucaagguaaguuauggcaauacacugcuucaauucuaauuuauuuuucauuucagggggcaaauaugcaaugaguuggccuagauuuuuagugacauuuaugauguuugucuuguauguuaacuguccaacaaacuguggguuuauucuaaguuuacaauuauugagaacugauugagguuaagauuucaugaagaaagcauguauuguguggaaguaauuuuuuuuuaauuuauacugaccuacauuuauacgaagaauucuguacauguuaaaaguaaggaugaccaaaugcaaauuuaaugagugggccaauuaagaaagauacauaugcacuuuuacuguguaacuuuuguaugcugaaugguacauauauuuuuuugcuuuugagggaauuaauaagguauaauuaauugugucuuaacuuuucaaagaaauuuuuagauggaggcaacugggauguuugugauaauagaugagaaagacauccuugauuguaguuaaauugguuuggauuacagauauucauuauugaauugacuccuauuuucucacacuuuggaaaagacaccugaacaauaaaugaauccuggauagucuacucuccuucaaacaauuaacugauacuugccuuugggagaugcauacaaaaggagagaacccuuagacuaugucaggucacacuaggaaccuccccucacuccccguuuuucuucauuguguuucaguuacuguacuaacauuguggaugauacugaaauucugcauaaugugaacaggauaaacuauuuauaaacugcuuuucaugggccaguucuuuauuauaaaugaauuuuagcuuuaaaugcauauacacguucaguguuugauaguuguguucuuaagggagguuuguucuggugcauuguccuggagaagcagaagcagucaguguugggguaccacaucugacuuacugugguggugaccagugugcuucuuaagggcaagauuuauauuugaccacaagggaaaaagugugucacuggaaaaaaacgcauauaccuauguuugcaaacauaacuauucuucagauuaaaauuuguauaauuuguuuauuuaauguuugaauucaggacaaaagaaaaaaugaagcuugagguguuuucaaauagaccuuauuuuugcuaucucuuuguuagguguuaacugaagcaauucgaauauguccagauucauuuggauucauauuuacauugaaaaaacucaacuaagcauuuguuauccacaacaaccuagaguuuaaaaagaucguauuuucaccugucuucauuacuuucuauguaguuucauucuuugucgugguaacuuaaauuugaaauuggaagaaucucuugggauagaagaaagauucuuaccuggugauggaacuucauacuucauccuguguaagaguauuaugggaaguagaaauucacuuccuuaaauccaucguaagauugagccucaaguuugcaauauacaauuuuaaaaauacacauacauacauacauauguauacauuuccaguuuuaagauuuugcgagggucuuauaagaaaacaaaaauucccucaggcuauagaauuauguugucauauaucagaaaaguacugauguauccauuuauauccaaugcgcaccacaccggcacauugugauuuaauucaccgcuugaaucuauauuucuaaccacagugacuucaguaaaaauaccguauaaugaacauuucagcuucuucuuacuuacucgagaguuuauugcaaaucuuaaggauuuuauuauaaagauuuuuuuuuuaguuugguagcacauuuuguaccaaaaaugucaaacacugugcuguaagaauauccauguuuguagaaauguccacuuuucagauaauauaaugccuaccauuauacuaacagaaucauaugguaguugauuuauuuuuuuauuuauuauguauauuuuugguauuguggguucuugaggcaaugauaaaaacacuuaauguauucugacaugagugcucuaauagccuccuucuccucauuuuuaaacugcauacauuacuuucaaaauagguauagauacucugucccgccuuuugagcuauuagccuguuccuguuucccuuugucaccuaagcaaggcuuuuucugagaagguagugaaugguuucaaauguugcauacuauaagaauaaucauuggguaacuguuguuuagaccaacacuuagaaauacuauauuugugccuuuucauuuuuaauuuuaauguguguugauauuuggagcacaaauaaugaaggugccauaauauggcuugccaauguuaccuccuugaauagucaugugucauugucuugaauugguaauuggagaaccuugcaugaaauaugugaucguguguguguguguguaugcgcgugugugucuguguguuuguguacauaccuguauuugcuuggggcuugugugugguauguuacaaagagugaauuucuggaaauagaaaucaguuaaauguugaaaguucagguuagcagaaauauuucauuuaaauaugcuuuacuuuggaggacaauugauuaacagaggaaaugauaauuuucaaaaaugugaucaauuuacugcaugaugaaaugugaaaacagugccuuuuuaggacaucaauuauaauaaaauuguuuuaaaauauuaacaaagaucucaaaaaguugucaugaacauuauucauuuauuuuuaaacuggaucuaaauaagagcuuagauggccaaaauuagaauuaauaauauacccauuuaaauuuuguucauaaauuuaaaaucuuaaucagaauucuuuauaaaaugugggucauagauaugacccaguguuacuaaaauagaacagggauugugaaaauccagcucaacauacuuaaguauacuuggcuuagagccaaguauacuugaagaggugaauuauucugacuuggacaugcaugcucuuugauggauaaaauaaaaauauucaauuuauucuuacaaaagaaggugggugggugaguggguucguuuuaguguucucagauuauaaagacagcuauaaagacagcacuuuccgcacacaaaguguauuuuacaaaccuuuuuuauacaaauuaaugagcucuacuuuauuuaaguguucauggaaugauguaaauuuuagguccaguugaacaaauauugagugccuaucauaugcaagacuaacuccuuacuaggaaugaaaucacacagugucuucuguuugcaguaugugaacuuuauguuugaaaagaaauuauuauauuuaaauuuuuuuguugucagaguuuaucauuguauacuguaacccaguaaauuuugcauucaguuuuaaaaaaugaagauguaacuuaccugagucucauuuuugaaaaugaaauucugcaaaaauuauuuaaaaauuaguucuuggggaaauugauuuucaagauucaaguguauaaaaacuuauauugaacuuuucagccucguuuuuaauuagcugauguuaaugauaagauacauaauacauguaucuuguugcugaaaauauuuuuugcauuucaacacauugaguuaaaauaaaguuguuacuacuuauucaaga

SEQ ID NO: 260 - RNA, 73 nt, Homo Sapiens
uagauugaagccacuugauuaggguauuuagcuguuaacuaaauuuuuguggguuuaagucccguuaaucuag

SEQ ID NO: 261 - RNA, 1643 nt, Homo Sapiens
cgccuuucagccucaccugcagcugcgccuccuugcaccugcgccugugcuuuuucucccagcacugcggacgcgacucgagggugacgcucgcuccgcucgucccgcucgucauggccuacccgggauacggaggaggguuuggaaauuuuagcauucaggugccaggaaugcagaugggacagccagugccagaaacaggcccagcuauacuccucgauggauacucugggccagcauauucagacacuuauuccucagcuggugacuccguguauacuuacuucagugcuguugcuggacaggauggugaaguggaugcugaagaacuucagagauguuugacacagucuggaauuaauggaacuuacucucccuucaguuuggaaaccugcagaauuaugauugccauguuggauagagaucacacaggaaaaaugggauuuaaugcauucaaagagcuaugggcagcucuuaaugccuggaaggaaaacuucaugacuguugaucaagauggaaguggcacaguagaacaucaugaguugcgucaagccauuggucuuauggguuauagguugaguccucaaacauuaacuacuauuguuaaacguuauagcaagaauggcagaauuuucuuugaugauuauguugcuugcugugugaagcuucgagcauugacagauuucuuuaggaaaagagaccacuugcaacaagggucugcgaauuucauauaugacgauuuuuugcagggcacuauggcaauuugaaugcuuagaauuuuaaaccugaagagacacugugaauucuuuuguuuggaagaagugaacuggacuacuuuaaaacuuuuaaggguuuucuauguucuuccuaccuguuaaaccucuucccuuucuguguguuuuuauuuuagcagauaguucaaagcaauaaaagauuucuuuuuuaauuugagguauuacugcuuuuggaaaaguuauuuuauaaauaugugcauauugucauaaaauauuguaugauuaauugauuuaaauaaugcuuagccuuaauuuuagauaauguaaauuuagaggaauguacuuuacaagauagauuguauaagaagccaaauaaugaaagccuagaaaaaacuaauuuauacuuaucugaagguuacaaauuagacuuuuaaauuuucuuuguaguuggugguguuugaggguuggcuagaaaugaaagccuggauuuugugccauguuuguaauauaguuuguuccuugaucaaauaaucagagaaaagaaacuuaaagaucuuugucugugaagaagaaaauuaucucccuaguucaaucuguagugaaauaagacuacagaaggcauuguuuuuuccuuuuuuauuuuuuguauuauauauuuuucuuaaauauguuuuauugucuucucuaagcaaaaaguucuuaauaaacauaguauuucucucugcguccuauuucauuagugaagacauaguucaccuaaaauggcauccugcucugaaucuagacuuuuuagaaauggcauauguuuuugaugauaugucaacauucaaaauuguccuaauuaaauuguuguuuaaauguaaugucaacucuuuauaaacuuaaaaauaaacaaguaauuaaccacuc

SEQ ID NO: 262 - RNA, 3252 nt, Homo Sapiens
agcgguuccgggcggcagcacaaggcgguagccauggcggaggcggcggcugcagcgggugggacuggcuugggcgcgggcgcgagcuacgggucugcagcggaccgggaccgggacccggacccggaccgcgccgggcggaggcugcggguucucucuggccaucugcugggccggccccgggaggcucugaguaccaaugagugcaaagcgcggagagccgcgucggcggccacggcagcgcccacggccacucccgccgcgcaggagucgggcaccaucccaaagaagcggcaagaaguuaugaaauggaauggauggggauauaaugauucuaaauucaucuucaauaagaagggccaaauugaauugacugggaaaagguacccucuuaguggcauggguuuaccaacauuuaaagaauggauccaaaauacccuuggaguaaauguggagcauaaaacuaccucuaaagcauccuuaaauccuagugauacaccuccuucuguuguaaaugaagauuuucuucaugaccuuaaagaaacuaauauuucauauucacaagaggcagaugaucgaguauuuagagcucauggucauugucuucaugagauauuuuugcucagggaaggaauguuugagcgaauuccugauauaguuuuauggccaacaugccaugaugauguaguuaagauugugaaucuagcuugcaaauauaaucuuuguaucauaccaauugguggaggaacaaguguuucauauggccugauguguccugcagaugagacaagaacaauuauuucuuuggacacuucacaaaugaaucgaauucucuggguugaugagaacaauuugacagcucauguagaggcuggcauaacaggacaagaguuggaaagacagcuuaaagaaagugguuauuguacaggucaugaaccagauucccuggaguucaguacuguaggaggauggguaucuacucgcgcaucaggcaugaagaagaauaucuauggcaauaucgaggaccuggugguucauauaaaaaugguaacaccuagagguauaauagaaaaaagcugucaaggaccucguaugucaacaggcccugauauccaucacuucaucaugggaucugaaggaacucuugguguaauaacagaagcuacaauaaaaaucagaccagucccugaauaccaaaaguauggcucaguagcuuucccuaauuuugaacaaggaguagccuguuuaagagaaauugcaaaacagagaugugcuccggcaucuauucgccucauggacaacaagcaguuucaguuuggucaugcucuuaaaccucagguuuccucuauuuuuacaucauuuuuggacggauuaaaaaaguuuuauauuacaaaguuuaaaggauuugacccaaaucagcuaaguguagccacauuacuguuugagggggaucgugagaagguucuucaacaugaaaaacaaguguaugauauugcugcaaaauuugguggguuggcagcuggagaagauaauggacagagagguuauuugcugaccuauguuauugcauacauucgagacuuggcuuuggaauacuauguauuaggagaaucuuuugagacuucugcuccuugggacagggugguagaucucuguagaaauguaaaagaaagaauaacaagggaaugcaaagagaaggguguucaguuugcuccuuuuucuacaugcagggugacgcagacuuacgaugcaggugcuuguaucuacuucuauuuugccuuuaacuacaggggaauuagugacccacugaccguauuugaacaaacugaggcagcugcuagagaagaaauccuugcuaauggagggagccugucacaucaccauggagugggcaaguuacggaagcaauggcuaaaggaaaguaucucugaugucggcuuugggaugcugaagucugucaaggaauauguggaccccaauaacaucuuuggaaacagaaaccuuuuauaaauccauuaguaccauuacaaaaaaaugucaauuuuuuuuuuaaguuuucaacugugguuauacuaguaaucaaauauaucauggacuauauuuuggauacauuuguuucuuugguuuaaaauaaguuuguuuucauucuguaguuuguuuuguuucuacaucuauggauugacagauaguauuccuaaaucucucucauuguagguacaucauuuuacauucagcgguugucauuucaaauuuuagucaggcagcacaaagcugucaauuauuccagaggaagcugcugccagcuguuuuguauuguugcuuccucuuggggaacaaagacagauuugguaucauugauugcucagcuagccucuuuuuaaaagaacguuucugggaaucagaugucuagggaaggauuccacugaggagugauacacguguacauuguuuaagagcauagucuagugugaguaggccauuaaggggaaggauauucaugaaagaauuuaggcaaccuguuauuuagaaagccuucacgucuguaaggugcuuggccuacuuuuuuuuuuaaauuaguauacaugcauaaaaccuuguaucaucaauauacaaauuauucuguuaggggacauguuuuuguucuccauguuucuguuucuauugugguaugaguuguauuuguaucacugagauaaccuauuguuauauucuaauucauugauaauauguuuuguaagaaaagcugacauccuucauugcaagugaagaacagguuuaccaugaaaugaaugccuuuauucaacuuagaguccuaauguuucugauuucacauucuuguugcugaaaugcagaagaaacagcuacagcaagagcagaaggaaaacucuuagacuuaaugucuccaauugcaagaauuguuucacuaaagaaacagucaucauucaacuacugaauuugaaagccucagcaguuucaaugacaaaaaucauuuuugauuuuuuaaaauuaaucccaauggcaugauaaauuuucauauaaaaaguaaaguuucaauuuaguuuuuaauaaugguuuaaugccuuuuuugaauaacugguuuaaccuaauuuuuuuuaaauguaauguauuaaugcauauaccauaaucaaaaguuugaaauauccuguuucuuaaauaaugagaacauuaaucacauuuagcaagcauuuguacauucaaaccuggauauuaaagugaaaugauuacuuugaa

SEQ ID NO: 263 - RNA, 10470 nt, Homo Sapiens
caaccauguaagcagcuucgcuuccugccgcaaccguccgcggccugaggagcccaccgccgcucucgggggccgacuuccgggggcugagccguugaagcggaggcuggggcggggggcagccggcgcggccggggcaggaggcgcagacucaugaaauggccacagaugauaagacguccccaacacuggacucugcuaaugauuugccucgaucuccuacuaguccuucucaucucacacacuuuaaaccuuugacuccugaucaagaugagcccccuuuuaaaucagcuuauaguucuuuuguaaaucucuuucguuuuaacaaagagagagcagaaggaggccagggagaacagcagccuuugaguggaaguuggaccagcccucagcucccuucgaggacacagucuguuaggucacccacaccuuauaaaaagcagcuuaaugaggaacuccagcggcgcucuucagcauuagacaacaguuugcaacauccccaggagaacacagacacaagaaggaaagcagaaccuaccuuuggaggucaugacccucguacagcuguucagcuucgaagccucagcacaguauuaaaacgccucaaggaaaucauggaggggaaaagccaggauagugaccugaaacaauacuggaugccagauagccaauguaaagagugcuaugacuguagugagaaauuuacaaccuuuaggcgcagacaccauugccgacuaugugggcagauuuucugcagucguugcuguaaucaagaaaucccuggaaaauuuaugggcuauacaggagaccuccgagcuugcacauauuguagaaaaauagccuuaaguuaugcucauuccacagacaguaauucuauuggggaagacuugaaugcucuuucagauucugcuugcucugugucugugcuugauccaagugaaccccgaacaccuguugggaguaggaaagccagccguaacauauuuuuagaggaugauuuggccuggcaaaguuugauucauccagauuccucaaauacuccucuuucaacaagacuuguaucugugcaagaggaugcugggaaaucuccugcucgaaauagaucagccagcauuacuaaccugucacuggauagaucugguucuccuaugguaccuucauaugagacaucugucaguccccaggcuaaccgaacauauguuaggacagagaccacugaggaugaacgcaaaauucuucuggacagugugcaguuaaaagaccuguggaaaaaaaucugccaucacagcaguggaauggaguuucaggaucaccgcuacugguugagaacgcaucccaacugcauuguaggaaaggaauuagucaacuggcuaauccgaaaugggcauauugccacaagggcacaagcuauagcaauuggacaagcaaugguugauggacguuggcuggauuguguuagucaucacgaccagcuuuucagagaugaguaugcgcuguauagaccacugcagaguacagaauuuucugagacgccuucucccgacagugacucagugaacuccguggaaggacacucugagccauccugguuuaaagacauaaaguuugaugacagugacacagaacagauagcugaagaaggugacgauaauuuggcuaauucugccaguccuagcaagcgcacaucagucagcaguuuccaguccacaguggacagugacucagccgcuucuaucagccugaacguggagcuggacaacgugaacuuccauaucaagaagcccuccaaguacccacaugugcccccucacccugcugaccaaaaagguaggagguagucaccaucuggaauccaaacacaggcuggacagcugggccauaggaucucaugccagccuguccuucuggcuuccucugucccacguggcugaggguauuugguguggguuuuguucuacccuuucucauuucucccacaccuccuccccauaccuuuuuugguugauuccuuuuauuucuuguuuucucccucagcaccaccaugcccaguguaaagcuuguagucuuuaaaaggaacuacaucugacugcucuucccauaaugugcaacuuccaagguggcauuucuuugcauuuauaacauggauguucugcucuauucuuuucucuuucuucauuuaacauuuuaaagccuauuugccuuugccguuacccaguaacauaauauuucacuaaacccauuaagaugcuugaacuagauugggggaaaaucauucacacauuccaaaauaucuccauaauaauucauaaugcuuauuauguauauucuauauuuauuaaaacaauuucuucucuaauguaaaaaguauuugauuucugacacuggaggacaacagcucucaauaagugacgcuuucaucaaagaauccuuauuuaaucgccgaguagaggaaaaauccaaagagcugccuuucacaccuuugggcuggcaucauaacaaccuggagcuccugagggaggagaauggggagaaacaagccauggagagguugcuuucagcuaaucauaaccacaugauggcacuacuccagcaguugcuccauagugacucacugucaucaucuuggagggacaucaucgugucauuggucugccagguuguucagacaguccgaccugaugucaagaaccaggaugaugacauggauauccgucaguuuguccacaucaaaaaaaucccagguggaaagaaguuugauucugugguugucaauggcuuuguuuguaccaagaacauugcacauaaaaagaugaguucuuguauuaaaaaccccaaaauucuucuguugaaguguuccauugaguaucucuacagagaagaaacuaaguuuacuugcauugauccuauugugcuucaggaaagggaauucuugaagaauuauguccagcgaauaguugauguucgacccaccuugguucuuguugagaaaacagugucucggauugcccaggacauguuauuggaacauggcauuacuuuggucauuaauguaaagucacaaguuuuggaacgaaucagucgaaugacccaaggugauuuagugaugucaauggaccagcugcuuacgaaaccacaccugggcacuugucacaaauuuuauaugcagauauuucaguugccuaaugaacaaaccaagacacugauguuuuuugaagguuguccacagcaccuaggcuguacaaucaagcuaagaggaggcucugauuaugagcuggcucgaguuaaggagauccuaauauuuaugaucuguguugcuuaucauucucaacuagaaauauccuuucucauggaugaauuugcuaugccucccacauuaaugcaaaacccuucauuccauucccugauugagggacgagggcaugagggggcuguccaagagcaguacgguggagguuccauccccugggauccugacaucccuccugagucucugcccugugaugauagcaguuugcuggaauugaggauuguguuugagaagggugagcaggaaaauaaaaaucuuccgcaggcuguugccucugugaagcaucaagaacauagcacaacagcuugcccggcgggucucccuugugcuuucuuugcaccuguaccggaaucauuguugccacucccuguggaugaccaacaagaugcuuuaggcagcgagcagccagagacuuugcagcaaacaguugugcugcaggaucccaaaagccagauaagagccuuuagagacccucuacaggaugacacuggauuauauguuacugaggaagucaccuccucugaagauaaacgaaagacuuauucuuuggccuuuaagcaggaauuaaaagaugugauccucuguaucuccccaguaaucacauuccgagaacccuuucuuuuaacugaaaaggggaugagaugcucuacccgagauuauuuugcagagcagguuuacuggucuccucuccucaauaaagaauucaaagaaauggagaacaggaggaagaaacagcugcucagggaucucucuggacuucagggcaugaauggaaguauucaggccaagucuauucaagucuuacccucacaugagcuagugagcacuagaauugcugagcaucugggcgauagccagagcuuggguagaaugcuggccgauuaucgagccagaggaggaagaauucagcccaaaaauucagacccuuuugcucauucaaaggaugcaucaaguacuucaaguggccaaucaggaagcaaaaaugagggugaugaagagagagggcuuauucugagugaugcuguguggucaacaaagguggacugucugaaucccauuaaucaccagagacuuugugugcucuucagcagcucuucugcccaguccagcaaugcuccuagugccugugucaguccuuggauuguaacaauggaauuuuauggaaagaaugaucuuacauuaggaauauuuuuagagagauacuguuucaggccuucuuaucaguguccaagcauguucugugauacccccaugguacaucauauucggcgcuuuguucauggccaaggcugugugcagauaauccugaaggaguuggauucuccaguaccuggauaucagcauacaauucuuacauauuccugguguagaaucugcaaacagguaacaccaguuguugcucuuuccaaugaguccuggucuaugucauuugcaaaauaccuugaacuuagguuuuaugggcaccaguauacucgcagagccaacgcugagcccuguggucacuccauccaucaugauuaucaccaguauuucuccuauaaccagaugguggcgucuuucaguuauucucccauucggcuucuugaaguauguguuccacuccccaaaauauucauuaagcgucaggccccauuaaaagugucccuucuucaggaucugaaggacuucuuucaaaaaguuucacagguauauguugccauugaugaaagacuugcaucuuugaaaacugauacauuuaguaaaacaagagaggaaaaaauggaagauauuuuugcacagaaagagauggaagaaggugaguucaagaacuggauugagaagaugcaagcaaggcucaugucuuccucuguagauaccccucagcaacugcagucggucuuugagucacucauugccaagaaacaaagucucugugaagugcugcaagcuuggaauaacagguugcaggaccuuuuccaacaggaaaaggguagaaagagaccuucaguuccuccaaguccuggaagacugagacaaggggaagaaagcaagauaagugcgauggaugcaucuccacggaauauuucuccaggacuucagaauggagaaaaagaggaucgcuucuuaacaacuuuguccagccagagcuccaccaguucuacucaucuccaauugccuacgccaccugaagucaugucugaacagucagugggagggcccccugagcuagauacagccagcaguuccgaagauguguuugaugggcauuugcugggauccacagacagccaagugaaggaaaagucaaccaugaaagccaucuuugcaaauuugcuuccaggaaauagcuauaauccuauuccauuuccuuuugauccagauaaacacuacuuaauguaugaacaugaacgagugcccauugcagucugcgagaaggaacccagcuccaucauugcuuuugcucucaguuguaaagaauaccgaaaugccuuagaggaauugucuaaagcgacucaguggaacagugccgaagaagggcuuccaacaaauaguacuucagauagcagaccaaagaguagcagcccuaucagauuaccugaaaugaguggaggacagacaaaucguacaacagaaacagaaccacaaccaaccaaaaaggcuucuggaauguuguccuucuucagagggacagcagggaaaagccccgaucucucuucccagaagagagagaccuuacguggagcagauagugcuuacuaccagguugggcagacgggcaaggaggggaccgagaaucaaggcguugagccucaagaugaaguagauggaggagauacacaaaagaagcaacucauaaauccucauguggaacuucaauuuucagaugcuaaugccaaguuuuacugucggcucuacuaugcgggagaguuucauaagaugcgugaagugauucuggacagcagugaagaagauuucauucguucccucucccacucaucacccuggcaggcccggggaggcaaaucaggagcugccuucuaugcaacugaggaugauagauuuauuuugaagcaaaugccucgucuggaaguccaguccuuccucgacuuugcaccacauuacuucaauuauauuacaaaugcuguucaacaaaagaggcccacggcguuggccaaaauucuuggaguuuacagaauugguuauaagaacucucagaacaacacugagaagaaguuagaucuccuugucauggaaaaucuuuucuacgggagaaagauggcacagguuuuugauuugaagggcucucuuaggaaucggaauguaaaaacugacacuggaaaagagaguugugaugugguccugcuagaugaaaaucuccuaaagaugguucgagacaacccucuauauauucguucucauuccaaagcugugcugagaaccucgauccauagugacucccauuuccuuucuagccaccucauuauagauuauucuuugcugguugggcgagaugauacuagcaaugagcuaguaguuggaauuauagauuauauucgaacauuuacaugggacaaaaagcuugagaugguugugaaaucaacaggaauuuuagguggacaagguaaaaugccaacaguggugucuccggaguuguacaggacuagguuuugugaggcaauggacaaguauuuccuaaugguaccagaccacuggacaggcuugggucugaauugcugaaaucaagcacauauuuugaaauggacugugaaggaaaaggggacaggaacaaaggaccaaaaauaagcuacauguuuuauuucuucaucguguucaccacuguaugccaaggcuuuucaguucuguggcuguuuagacuguccguaauggaaugguaaaacuccaugaauuugcacuuugguuuuugauaccuguggagcugucuguagguugggaaguggcaugaaaauuuucuuaagcuaaaauacagacauguuucaaagggcuaaaguuggagaugaguagauagggugaaaaauggguuaaauuugcuagcuuaauuguuuuaagaagaaaacagugucucauaaauugacuauccuggcaucacauuuaacauguuaucuacuuagaaagcauuuguagagcugcugaauuuguuuuguguuuuucuguaauaauuuaauguuacuuauuaucagaauuucugaaaccuuuacaaaaauucugauuuauuccauuaauggccgguuaaacacgugggcauuuauuguuuuauugaggaauuugacuuaaacugggaauccugucauguuguuuaucuuuccagcuugccuguuuuugaguauguuugauguuuuuaaaauuuugucuucucuguggaagacaggaggcuacagcaauuaacuuuaagccuccuuuuagagauauuuuuaaaacuuguuuaaaauuuuugugcaauucauauauuaaauugcacuuacuugcauacgcucauauucuaggguuuuuucucuauuuuuaggguaucauaguaaaucauuaguaaaugagucuguaguuacuaaacccuaauggaauaauuauuaaugaaagauuuuugaaauauaaaaaauaaauuaggcccaauccaagaaauugagugagaaggaaacacuuguuuuauucacagagguaaagugucuuuucaauauaaccagcaauuuagguggcaucuauaaaauaaaaaauuucuacuguggacauccccuuuuccaacuuucuacauaauggcuaguucugacuacuaagaaauguuaagaaauaggccaagugcgguggcucacgccuauaauccuaucacuuugggaggccuaggcaggcagaucaccugaggucaggaguucaagaccagccuggccaacaugacgaaaccccaucucuacuaaaaagacaaaaaauuagcugggcaugguggcauauaccuguaaccccaacuacuuggguggcugaggcaggagaauuguuugaaccugggaggcggaggcugcagugagcugggauuacaccauugcauuccagccugggcaacagagcaagacugucucaaaaaacaaaacgaaacaaaaaaagaaaguuauucuuaguaaggaacuucuuguuuaauagcauuuuuguuuauuuuaaaaagugaucagaaguaguaaacuaucuuugaggaaauacuguaaccccagaauauuuccucuugacuucuuuuuguaacaaggauaauuuagggauuuauaaaguuguaaggauuucacuguuuuuggacugccuauaauaauagcacauuaaccuucacauaauaagaaaucuggacaaguucaguuacacaguaugaugaauacuugaauuaggaacauuguggaaaauuugcuuuagagaaucaaggcaguaguuugguauuuggugcuuauuaaaaaugugguuuguuuugaacuggaagcaaguugaccaaggacuuaugacuaaugugaugcuaaguuccacuuggccccuuuuaaaaacguguaugugccuuuugaagauacacaaaacacugaggauuuuaguuuugaaaucaaagacuauuaaaggagcuguacagagguaaaaaaauaaauguggaacauuauuaacuuacuuugugucuaggaacaauggauuuuguaucugauuuaaaaugccaacacuguuuugucucuguucauuuuuucugugaggauacuuaagguuauuauuccugucuguuuccuguacuccccuagucaugagcacuugaaguacaaggugucucccccuaggugcaauuagguuguuucuuuguuuuuaguuucaauucuaugugcauagcaggaaugcuccacaggaauggcuucugacaauaaucuguccuguugauuuuguuuuccuugcccaugacuugaacaacuguguuuuaaaguacuguagucuaguagguaacuuuguggcaaaaauuuucaauauaauacauucugaaacaauaguugcugccuugcaaagguaaucucucauuuuaaaauuggacaguauuaaugaaggggaaauauacaauuuauuucuauugagugguagaacuauaugucuggucccuugcugcucuuguuuaggccacuaucauagauauauuucaaauauuguacuacucaguguuaaguauugaaugacuguuucccuuuccuucaaggccuagaguauauucugaaaauuuaggaaugaggaagaaaucuuaauacuuccuuccuuaacauacaacaugagucccgagaauaauugauaguagcaagagaaaacuaugucaguaacauguugcuuuguauaaaaaucuuauuuauaaaugugaagcuuuuugaugccaucaaaacuuauuaaaaaauaggauuuacuuuuuucuaauucugaccuaagaaaaauaaugagaacaagcuguugcaagcucuuuuguagucuauugaauauuuuauagauauucaaaauuuccuacaaacuauaauuuuuuccaugauuuagcagugagugauuuucuagcuuuggcucuuauuagguauuguaaauaguaggguuauaucgauaucagcuuuugugauggcauuguggucaucagcuucaugacauuuuacccauuugcagugauccuguguaaaacugccaaggaaaguaauuaccuguaggaguuugcugagcuugaagagugaaaacuguugugaaugagccugaucauaaaacggaccaggccauucauuauuccucaaguguuaauauacugacuuaugcaguauucaaaccaucuagugcaauguuuuuguuuuuguuuuuuuuuugguaacacaggugcaguguauuauagaaaaaauaaaaacuacaaucauuagcaguuuuaauacugcugugucaguuuuguaaaaaauguacauuaugucuuuugacauguugaauuuuaaacuagggaaaugacauuguaaaucauaguagccucuuuuaauuuaauaugaaaaaugccacuauauugaaaguacuuaauguauuguauauauuucucuacuuugguucuagcuauuuuauaugauugacauguuauuuaaaagauaacugccuugaacuuuuggagacuuguacuguaaauaaagaaaucuuaacaauaaacucagaaucuacuuacucca

SEQ ID NO: 264 - RNA, 60 nt, Homo Sapiens
acaaaugguuaugauggagaauuguauggaucacagucccugaauagaagaucuggcagg

SEQ ID NO: 265 - RNA, 93 nt, Homo Sapiens
gcauuagagaggcagaaagaguucuuugauuccguaaggagugaacgggaugaucuuagagaagaaguagucaugcugaaagaggaauuaaag

SEQ ID NO: 266 - RNA, 102 nt, Homo Sapiens
gugccuccuuugguaguagauacccuacaauuggaaagauacagagauuagcaaggccucaguacaaggaugacacagauucacgaaggguuccauauuuuu

SEQ ID NO: 267 - RNA, 5218 nt, Homo Sapiens
acucuggagugggagugggagcgagcgcuucugcgacuccaguugugagagccgcaagggcaugggaauugacgccacucaccgacccccagucucaaucucaacgcugugaggaaaccucgacuuugccagguccccaagggcagcggggcucggcgagcgaggcacccuucuccguccccaucccaauccaagcgcuccuggcacugacgacgccaagagacucgagugggaguuaaagcuuccagugagggcagcagguguccaggccgggcugcggguuccuguugacgucuugcccuaggcaaaggucccaguuccuucucggagccggcugucccgcgccacuggaaaccgcaccuccccgcagcaugggcaccagccucagcccgaacgacccuuggccgcuaaacccgcuguccauccagcagaccacgcuccugcuacuccugucggugcuggccacugugcaugugggccagcggcugcugaggcaacggaggcggcagcuccgguccgcgcccccgggcccguuugcguggccacugaucggaaacgcggcggcggugggccaggcggcucaccucucguucgcucgccuggcgcggcgcuacggcgacguuuuccagauccgccugggcagcugccccauaguggugcugaauggcgagcgcgccauccaccaggcccuggugcagcagggcucggccuucgccgaccggccggccuucgccuccuuccgugugguguccggcggccgcagcauggcuuucggccacuacucggagcacuggaaggugcagcggcgcgcagcccacagcaugaugcgcaacuucuucacgcgccagccgcgcagccgccaaguccucgagggccacgugcugagcgaggcgcgcgagcugguggcgcugcuggugcgcggcagcgcggacggcgccuuccucgacccgaggccgcugaccgucguggccguggccaacgucaugagugccguguguuucggcugccgcuacagccacgacgaccccgaguuccgugagcugcucagccacaacgaagaguucgggcgcacggugggcgcgggcagccugguggacgugaugcccuggcugcaguacuuccccaacccggugcgcaccguuuuccgcgaauucgagcagcucaaccgcaacuucagcaacuucauccuggacaaguucuugaggcacugcgaaagccuucggcccggggccgccccccgcgacaugauggacgccuuuauccucucugcggaaaagaaggcggccggggacucgcacggugguggcgcgcggcuggauuuggagaacguaccggccacuaucacugacaucuucggcgccagccaggacacccuguccaccgcgcugcaguggcugcuccuccucuucaccagguauccugaugugcagacucgagugcaggcagaauuggaucaggucguggggagggaccgucugccuuguaugggugaccagcccaaccugcccuauguccuggccuuccuuuaugaagccaugcgcuucuccagcuuugugccugucacuauuccucaugccaccacugccaacaccucugucuugggcuaccacauucccaaggacacugugguuuuugucaaccaguggucugugaaucaugacccagugaaguggccuaacccggagaacuuugauccagcucgauucuuggacaaggauggccucaucaacaaggaccugaccagcagagugaugauuuuuucagugggcaaaaggcggugcauuggcgaagaacuuucuaagaugcagcuuuuucucuucaucuccauccuggcucaccagugcgauuucagggccaacccaaaugagccugcgaaaaugaauuucaguuauggucuaaccauuaaacccaagucauuuaaagucaaugucacucucagagaguccauggagcuccuugauagugcuguccaaaauuuacaagccaaggaaacuugccaauaagaagcaagaggcaagcugaaauuuuagaaauauucacaucuucggagaugaggaguaaaauucaguuuuuuuccaguuccucuuuugugcugcuucucaauuagcguuuaaggugagcauaaaucaacuguccaucaggugaggugugcuccauacccagcgguucuucaugaguagugggcuaugcaggagcuucugggagauuuuuuugagucaaagacuuaaagggcccaaugaauuauuauauacauacugcaucuugguuauuucugaagguagcauucuuuggaguuaaaaugcacauauagacacauacacccaaacacuuacaccaaacuacugaaugaagcaguauuuugguaaccaggccauuuuuggugggaauccaagauuggucucccauaugcagaaauagacaaaaaguauauuaaacaaaguuucagaguauauuguugaagagacagagacaaguaauuucaguguaaagugugugauugaaggugauaagggaaaagauaaagaccagaaauucccuuuucaccuuuucaggaaaauaacuuagacucuaguauuuauggguggauuuauccuuuugccuucugguauacuuccuuacuuuuaaggauaaaucauaaagucaguugcucaaaaagaaaucaauaguugaauuagugaguauagugggguuccaugaguuaucaugaauuuuaaaguaugcauuauuaaauuguaaaacuccaaggugauguuguaccucuuuugcuugccaaaguacagaauuugaauuaucagcaaagaaaaaaaaaaaagccagccaagcuuuaaauuaugugaccauaauguacugauuucaguaagucucauagguuaaaaaaaaaagucaccaaauagugugaaauauauuacuuaacuguccguaagcaguauauuaguauuaucuuguucaggaaaagguugaauaauauaugccuuguauaauauugaaaauugaaaaguacaacuaacgcaaccaagugugcuaaaaaugagcuugauuaaaucaaccaccuauuuuugacauggaaaugaagcaggguuucuuuucuucacucaaauuuuggcgaaucucaaaauuagauccuaagauguguucuuauuuuuauaacaucuuuauugaaauucuauuuauaauacagaaucuuguuuugaaaauaaccuaauuaauauauuaaaauuccaaauucauggcaugcuuaaauuuuaacuaaauuuuaaagccauucugauuauugaguuccaguugaaguuaguggaaaucugaacauucuccuguggaaggcagagaaaucuaagcugugucugcccaaugaauaauggaaaaugccaugaauuaccuggauguucuuuuuacgaggugacaagaguuggggacagaacucccauuacaacugaccaaguuucucuucuagaugauuuuuugaaaguuaacauuaaugccugcuuuuuggaaagucagaaucagaagauagucuuggaagcuguuuggaaaagacaguggagaugaggucaguuguguuuuuuaagauggcaauuacuuugguagcugggaaagcauaaagcucaaaugaaauguaugcauucacauuuagaaaagugaauugaaguuucaaguuuuaaaguucauugcaauuaaacuuccaaagaaaguucuacaguguccuaagugcuaagugcuuauuacauuuuauuaagcuuuuuggaaucuuuguaccaaaauuuuaaaaaagggaguuuuugauaguuguguguaugugugugugggguggggggaugguaagagaaaagagagaaacacugaaaagaaggaaagaugguuaaacauuuucccacucauucugaauuaauuaauuuggagcacaaaauucaaagcauggacauuuagaagaaagauguuuggcguagcagaguuaaaucucaaauaggcuauuaaaaaagucuacaacauagcagaucuguuuugugguuuggaauauuaaaaaacuucauguaauuuuauuuuaaaauuucauagcuguacuucuugaauauaaaaaaucaugccaguauuuuuaaaggcauuagagucaacuacacaaagcaggcuugcccaguacauuuaaauuuuuuggcacuugccauuccaaaauauuaugccccaccaaggcugagacagugaauuugggcugcuguagccuauuuuuuuagauugagaaauguguagcugcaaaaauaaucaugaaccaaucuggaugccucauuaugucaaccagguccagaugugcuauaaucuguuuuuacguauguaggcccagucgucaucagaugcuugcggcaaaaggaaagcuguguuuauauggaagaaaguaaggugcuuggaguuuaccuggcuuauuuaauaugcuuauaaccuaguuaaagaaaggaaaagaaaacaaaaaacgaaugaaaauaacugaauuuggaggcuggaguaaucagauuacugcuuuaaucagaaacccucauuguguuucuaccggagagagaauguauuugcugacaaccauuaaagucagaaguuuuacuccagguuauugcaauaaaguauaauguuuauuaaaugcuucauuuguaugucaaagcuuugacucuauaagcaaauugcuuuuuuccaaaacaaaaagaugucucagguuuguuuugugaauuuucuaaaagcuuucaugucccagaacuuagccuuuaccugugaaguguuacuacagccuuaauauuuuccuaguagaucuauauuagaucaaauaguugcauagcaguauauguuaauuuguguguuuuuagcugugacacaacugugugauuaaaagguauacuuuaguagacauuuauaacucaaggauaccuucuuauuuaaucuuuucuuauuuuuguacuuuaucaugaaugcuuuuagugugugcauaauagcuacagugcauaguuguagacaaaguacauucuggggaaacaacauuuauauguagccuuuacuguuugauauaccaaauuaaaaaaaaauuguaucucauuacuuauacugggacaccauuaccaaaauaauaaaaaucacuuucauaaucuuguuaugaaguuuuauguuguagcaaauauagucuaauguaucacuuuauuucaacuauuacuauggauuauucaauuaaaauauugcacuguaaaca

SEQ ID NO: 268 - RNA, 5126 nt, Homo Sapiens
acaugcuccuccuguccuucuggcggagcgugcuucccgcugcggggacguucgagcaauggcagcccugcugagauccgcgcguugguugcugcgugccggggcggccccgcgccucccgcucucccugcgccuccucccuggcggcccgggccggcugcaugccgccuccuaucugcccgccgcucgcgccgggcccguggccggaggacuacugagcccagccaggcuguaugccauugcugccaaagaaaaagauauucaagaggaguccacuuuuucuucuaggaagauuuccaaucaguuugauugggcucuaaugagacuagaucuuucuguucgaagaacuggccgcauuccaaagaagcuucuacaaaaaguuuuuaaugauaccugccgcucagcagguggccuaggugguagucaugccuugcuucuacuacguaguugugguucucucuugccugaacuaaagcuugaagagagaacagaauuugcucauaggauaugggacacacuucagaaauuaggugcuguguaugaugugagucacuauaaugcuuuacuuaaagucuaucuucaaaaugaauauaaauucucaccaacugauuuccuggcaaaaauggaggaagcaaacauucaaccaaaucgagugacauaccagagauugauugcuucuuauuguaauguaggagauauugaaggugccagcaagauucuuggauuuaugaaaacuaaggaucucccaguuacagaggcaguauucagugcccuugugacagggcaugccagagcuggugauauggagaaugcagaaaacauucucacagugaugagagaugccggaauugagccugguccagacacauaccucgcauuauugaaugcauaugcugagaagggcgacauugaccauguuaagcagacucuggagaagguggagaaguccgagcuucaccuuauggaccgugauuuacugcaaauuauuuuuagcuucaguaaagcuggguauccucaguaugucucagaaauuuuggaaaaaguuacaugugaaagaagauauauuccagaugcaaugaaccucauuuuacuuuuagucacugaaaaauuggaagauguagcguugcaaauuuuacuagcaugccccguaucaaaggaagauggcccaagugucuuuggcaguuucuuuuuacaacacugugugacuaugaauacgccuguggagaagcuaacagacuacuguaagaaguuaaaggaaguccagaugcacuccuuuccucugcaguucacccuccauugugcuuuacucgccaauaaaacugauuuggcaaaagccuuaaugaaggcugugaaggaggaagguuuuccuaucagaccucacuauuucuggccauugcuaguuggacgucggaaggaaaaaaauguucaagguauaauugaaauccucaaaggaaugcaagaauugggaguacauccugaucaggaaacauauacagauuaugugauuccaugcuuugauaguguaaacucagcacgagccauuuugcaggaaaauggaugucugucugauagugauauguuuucucaagcuggauugagaagugaagcagcaaaugggaacuuagacuuuguauuaucauuuuugaaaucaaauacauugcccaucucgcugcagucuauaagaaguagccuacugcuaggcuucaggaggugucuaugaauauaaaucuuuggagcgagagauaacagaauuguuguacaaggauggacguuauugccaggagccucgaggaccgacggaagcuguuggcuauuuucuuuauaacuugauugacagcaugagugacucagagguacaggccaaggaggagcauuugagacaauacuuccaucagcuggagaagaugaauguaaaaauuccugaaaauaucuacagaggcauucguaaucuccuggaaagcuaccauguuccugaauugauuaaggaugcucacuuguugguugagaguaagaauuuagacuuucaaaaaacugugcaacuuacaucaucugaauuggaguccacacuugaaacacuaaaagcugaaaaucaaccuauaagagauguccuaaagcaacucauauuagugcuuuguucagaagagaauaugcaaaaagcccuugaauugaaagcaaaauaugaauccgacaugguuacugguggcuaugcagcuuuaauaaauuuaugcugucgacaugauaaaguagaagaugccuugaacuugaaagaagaauuugaccgcuuagauucaucugcuguccuugacaccggcaaguauguaggccuuguaagaguauuggcaaagcauggcaagcuccaagaugcuauuaacauucugaaggagaugaaagagaaggauguucuuaucaaagauacaacagccuuguccuuuuuccacaugcuaaauggcgcagcuuuaagaggugaaauugaaacaguaaaacaguugcaugaagccaucgugacucuaggguuagcagaaccauccaccaacauaaguuucccauuggucacuguacacuuggaaaagggcgaccuaucuacugcucuugaggucgccauugacugcuaugaaaaguauaaaguauuaccaaggauucaugaugucuuguguaaacugguagagaaaggcgagacugaucuaauucagaaagcaauggacuuugugagccaagaacaaggugaaauggugaugcucuaugaucucuucuuugccuuccuacaaacaggaaauuacaaagaggccaagaagaucauugagacuccagggauuagagcucgaucugcaaggcuucagugguuuugugacagauguguugcaaauaaucagguugaaacucuggaaaaauuaguggagcugacacagaagcuauuugaaugugauagagaccagauguacuacaaucugcuaaaacuguauaaaauaaacggugacuggcaaagagcugaugcagucuggaauaaaauccaagaagaaaauguuauuccucgugaaaagacauuaagauuauuagcagaaauccuuagagaggguaaccaggaaguuccguuugacguaccugaguugugguaugaagaugaaaaacauucccugaauucuucgucagccucaaccacagaaccugauuuccagaaagauauauugauugccugccgauugaaccaaaaaaaaggcaagcacauacggggaugggggugggcauaugauauuuuccugaaugcaaaagagcaaaacauuguguuuaaugcugaaaccuacagcaaucucauuaaauuacugaugucagaagauuauuuuacacaagcaauggaagugaaagcauucgcggagacccacaucaagggcuucacacugaacgaugcugccaacagccgccucaucauaacgcaaguuaggcgggauuauuugaaagaggcugugacaacacugaaaacaguauuggaucagcagcagaccccuucuagguuagcagugacccgugucauccaggcauuggccaugaagggugauguugaaaacauagaaguaguucagaagauguuaaauggacucgaagacuccauuggacuuucaaaaaugguuuucaucaauaacauugcuuuggcucaaauaaagaauaauaacauagaugccgcaauagaaaacauugaaaauaugcuuacuucagagaauaaagucauugaaccccaauacuucggcuuggcauacuuauucagaaaaguaauagaggagcaguuggaaccagcaguugaaaagauaagcaucauggcggagagauuggccaaucaguuugcaauuuauaaaccugucacugauuuuuuccuucaacuuguggaugcaggcaagguggaugaugccagagcucuccuacagagauguggugcaauugcugaacaaaccccgauuuuguuguuguuccuccuuaggaauucuaggaaacaaggaaaggcaucaacugugaaaucuguguuagaauugauuccugaauuaaaugaaaaggaagaagcauacaauucccucaugaaaagcuaugucucagagaaagaugucacaucugcuaaagcacuguaugaacauuugacugcaaagaauacaaaauuggaugaucuguuucuaaagcguuacgcaucuuugcugaaguaugcuggagagccugucccuuucauugaacccccugaaagcuuugaauuuuaugcacagcagcuaagaaaauugagggaaaacucuucuugaaauaaccaggcgauacuuuguuuuguauauauuugugauucugugucuacauguuauuuugaaguauaucugagggaaaaauaaaugaaaauuuucuuuauguacuuauguaugugugaugcauguucaaagucuuauugaccauaacucugugcacuugguuauuggacauuuuuggaguuuuuuucucugggaaaaaucgauaguguuuucuucaaugcugcugcugugugaagccauacuuuuucaggauucuuccccuaauuggcucuuugguuucccugcucuguuucauuuauuucauuaaaauguuauuccuuuauuuaagauucacuuauuagucugcuguuucucugaaaaauuuuagagcuagguauagugaccgugaacuuucuaacgcauaauauucugugauacagccauuccguacaugugugaaguccugcauaacuuucgaacuuuguuaaauguuggcacuaggagucaucagaucuaggcuucaucauuuuccagugagaagcagagacccaaagggccuguuacuugugcuuggucaggggacugucugucaugccuggaggcucuucggcacacuuccccaucuuucccuucugccacuguggcuucaagcaccucuguucauagagcgucucugaaauugagucucggucaugacuuaucccgaaguagagcaauguguuuccucucauuguaguuucaggacuuugucaguacaagcucugcccuaggcuuguuacuuuauacucauauccugaaaagaugugauuucaucuaugaagggguaaaauauugguuuguauuuaauuguuugaaauaaaagugaucccuaua

SEQ ID NO: 269 - RNA, 81 nt, Homo Sapiens
uauaaauggaaucaugcauacagagaagaguagcauggccccugugcaagaaugacaugcaaauuuaugaagcauucauua

SEQ ID NO: 270 - RNA, 657 nt, Homo Sapiens
augguuaaguauuuccugggccagagcgugcuccggaguuccugggaccaaguguucgccgccuucuggcagcgguacccgaaucccuauagcaaacaugucuugacggaagacauaguacaccgggaggugaccccugaccagaaacugcugucccggcgacuccugaccaagaccaacagaaugccacgcugggccaagcaacuauuuccugccaauguugcucacucgguguacauccuggaggacucuauuguggacccacagaaucagaccaugacuaccuucaccuggaacaucaaccacgcccggcugauggugguggaggaacgauguguuuacugugugaacucugacaacagcggcuggacugaaauccgccgggaagccugggucuccucuagcuuauuuggugucuccagagcuguccaggaauuuggucuugcccaguucaaaagcaacgugaccaagacuaugaaggguuuugaauauaucuugacuaagcugcaaggcgaggccccuuccaaaacacuugagacagccaaggaagccaaggagaaggcagaggagacggcacuggcagcuacagagaaggccaaggaccucgccagcaaggcggccaccaagaagcagcagcagcagcaacaguuuguguag

SEQ ID NO: 271 - RNA, 2516 nt, Homo Sapiens
aaaggccccucggucuaaggcuucccuauuuccugguucgccggcggccauuuuggguggaagcgauagcugaguggcggcggcugcugauuguguucuaggggacggaguaggggaagacguuugcucucccggaacagccuaucucauuccuuucuuucgauuacccguggcgcggagagucagggcggcggcugcggcagcaagggcggcgguggcggcggcggcagcugcagugacauguccagcaugaaucccgaauaaguucaauuuuuccccaucuugauuauuuauucaaguuacuucugauuggcgacucagggguuggaaagucuugccuucuucuuagguuugcagaugauacauauacagaaagcuacaucagcacaauugguguggauuucaaaauaagaacuauagaguuagacgggaaaacaaucaagcuucaaauaugggacacagcaggccaggaaagauuucgaacaaucaccuccaguuauuacagaggagcccauggcaucauaguuguguaugaugugacagaucaggaguccuucaauaauguuaaacaguggcugcaggaaauagaucguuaugccagugaaaaugucaacaaauuguugguagggaacaaaugugaucugaccacaaagaaaguaguagacuacacaacagcgaaggaauuugcugauucccuuggaauuccguuuuuggaaaccagugcuaagaaugcaacgaauguagaacagucuuucaugacgauggcagcugagauuaaaaagcgaaugggucccggagcaacagcugguggugcugagaaguccaauguuaaaauucagagcacuccagucaagcagucagguggagguugcugcuaaaauuugccuccauccuuuucucacagcaaugaauuugcaaucugaacccaagugaaaaaacaaaauugccugaauuguacuguauguagcugcacuacaacagauucuuaccgucuccacaaaggucagagauuguaaauggucaauacugacuuuuuuuuuauucccuugacucaagacagcuaacuucauuuucagaacuguuuuaaaccuuugugugcugguuuauaaaauaauguguguaauccuuguugcuuuccugauaccagacuguuucccgugguugguuagaauauauuuuguuuugauguuuauauuggcauguuuagaugucagguuuagucuucugaagaugaaguucagccauuuuguaucaaacagcacaagcagugucugucacuuuccaugcauaaaguuuagugagauguuauauguaagaucugauuugcuaguucuuccuuguagaguuauaaauggaaagauuacacuaucugauuaauaguuucuucauacucugcauauaauuuguggcugcagaauauuguaauuuguugcacacuauguaacaaaacaacugaagauauguuuaauaaauauuguacuuauuggaaguaauaucaaacuguauggugauaaguauuguuuugauucuuaugguuaaagggaaauagagccuugcauuauauucaacacagccauuugugugugcacaaugcaaacuaagguauucuagaccuaucuuagagcagcauccaguauuugcuuucuagauaauaugcccaauaacaugaccuagaggggcuucugugcuguguagggauuuaaccaacuucagugguucagggagcucaaacuauauguaaaacaaguuuagaauguaugcuaucuagcccguuaucucugauccuucucuaaaaccauuugaaauagcuucauugaucaacauuucauaaaugcaucugugguagagguagaaagcagcaccuuuccuaauuggcaaaugaucagacuaaugugugcuaauguuuuucuuccaugcuuucagucagauucaacuauuuuauccuccacaguugcuuaacuugguguuggaggaggguuuaagcauuaagauaggaagcaggaaauuugauugcucuaaauuuagaaauuauaucccuaaaaauuaaaacaugaauacugggugguaaugauaauugaggcaaauguauuuauuuuggugacauuuugcauauaugaagauuuucugaaauaggaccuucaagauccuaggggguuuuguuugguuuuuaauugugaggaauaaaaaaucuucugcccacacuggcauuuuaaggugacugaggucaaacguuguuuccuuagguugaaauagcagccaaaacauucuucacgcaggggcuugggauauggcugcuggcaacacauuuuguugugggcuccuuaauuuaaugauaaaauuuaagcuaaacacaagccaaaaaugaauagguuuuuuuaauuuuuauuuuucacuaaacaggcaauugaaauacaugguacaaaaauaagugguaagauaauuguaaaaugaaauggacagaauauucaauuuuccaucuaugaaaauuucacaauaaaaaucauaguuuacuuugu

SEQ ID NO: 272 - RNA, 4152 nt, Homo Sapiens
acucgggcaccgcagguagggcaggaggcuggagagccugcugcccgcccgcccguaaaaugguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacagcuaccuugggcuaaucuauugagcuaaugaagcucuggucugaagagcccagaggaggaguuuggccagguggacuguggcagaucaauaaagaaaggcuucuucaggacagcacugccagagaugccugggugugccacagaccuuccuacuuggccuguaaucaccugugcagccuuuugugggccuucaaaacucugucaagaacuccgucugcuugggguuauucagugugaccuagagaagaaaucagcggaccacgauuucaagacuuguuaaaaaagaacugcaaagagacggacuccuguucaccuaggugaggugugugcagcaguuggugucugaguccacaugugugcaguugucuucugccagccauggauuccaggcuauauauuucuuuuuaaugggccaccuccccacaacagaauucugcccaacacaggagauuucuauaguuauuguuuucugucauuugccuacuggggaagaaagugaaggaggggaaacuguuuaauaucacaugaagacccuagcuuuaagagaagcuguauccucuaaccacgagacccucaaccagcccaacaucuuccauggacacaugacauugaagaccaucccaagcuaucgccacccuuggagaugaugucuuauuuauuagauggauaaugguuuuauuuuuaaucucuuaagucaauguaaaaaguauaaaaccccuucagacuucuacauuaaugauguauguguugcugacugaaaagcuauacugauuagaaaugucuggccucuucaagacagcuaaggcuugggaaaagucuuccagggugcggagauggaaccagaggcuggguuacugguaggaauaaagguagggguucagaaauggugccauugaagccacaaagccgguaaaugccucaauacguucugggagaaaacuuagcaaauccaucagcagggaucuguccccucuguuggggagagaggaagagugugugugucuacacaggauaaacccaauacauauuguacugcucagugauuaaauggguucacuuccucgugagcccucgguaaguauguuuagaaauagaacauuagccacgagccauaggcauuucaggccaaauccaugaaagggggaccagucauuuauuuuccauuuuguugcuugguugguuuguugcuuuauuuuuaaaaggagaaguuuaacuuugcuauuuauuuucgagcacuaggaaaacuauuccaguaauuuuuuuuuccucauuuccauucaggaugccggcuuuauuaacaaaaacucuaacaagucaccuccacuaugugggucuuccuuuccccucaagagaaggagcaauuguuccccugagcaucuggguccaucugacccauggggccugccugugagaaacagugggucccuucaaauacauaguggauagcucaucccuaggaauuuucauuaaaauuuggaaacagaguaaugaagaaauaauauauaaacuccuuaugugaggaaaugcuacuaauaucugaaaagugaaagauuucuauguauuaacucuuaagugcaccuagcuuauuacaucgugaaagguacauuuaaaauauguuaaauuggcuugaaauuuucagagaauuuugucuuccccuaauucuucuuccuuggucuggaagaacaauuucuaugaauuuucucuuuauuuuuuuuuauaauucagacaauucuaugacccgugucuucauuuuuggcacucuuauuuaacaaugccacaccugaagcacuuggaucuguucagagcugacccccuagcaacguaguugacacagcuccagguuuuuaaauuacuaaaauaaguucaaguuuacaucccuugggccagauauguggguugaggcuugacuguagcauccugcuuagagaccaaucaacggacacugguuuuuagaccucuaucaaucaguaguuagcauccaagagacuuugcagaggcguaggaaugaggcuggacagauggcggaagcagagguucccugcgaagacuugagauuuagugucugugaauguucuaguuccuagguccagcaagucacaccugccagugcccucauccuuaugccuguaacacacaugcagugagaggccucacauauacgccucccuagaagugccuuccaagucaguccuuuggaaaccagcaggucugaaaaagaggcugcaucaaugcaagccugguuggaccauuguccaugccucaggauagaacagccuggcuuauuuggggauuuuucuucuagaaaucaaaugacugauaagcauuggaucccucugccauuuaauggcaaugguagucuuugguuagcugcaaaaauacuccauuucaaguuaaaaaugcaucuucuaauccaucucugcaagcucccuguguuuccuugcccuuuagaaaaugaauuguucacuacaauuagagaaucauuuaacauccugaccugguaagcugccacacaccuggcaguggggagcaucgcuguuuccaauggcucaggagacaaugaaaagcccccauuuaaaaaaauaacaaacauuuuuuaaaaggccuccaauacucuuauggagccuggauuuuucccacugcucuacaggcugugacuuuuuuuaagcauccugacaggaaauguuuucuucuacauggaaagauagacagcagccaacccugaucuggaagacagggccccggcuggacacacguggaaccaagccagggaugggcuggccauuguguccccgcaggagagaugggcagaauggcccuagaguucuuuucccugagaaaggagaaaaagaugggauugccacucacccacccacacugguaagggaggagaauuugugcuucuggagcuucucaagggauuguguuuugcagguacagaaaacugccuguuaucuucaagccagguuuucgagggcacaugggucaccaguugcuuuuucagucaauuuggccgggauggacuaaugaggcucuaacacugcucaggagaccccugcccucuaguugguucugggcuuugaucucuuccaaccugcccagucacagaaggaggaaugacucaaaugcccaaaaccaagaacacauugcagaaguaagacaaacauguauauuuuuaaauguucuaacauaagaccuguucucucuagccauugauuuaccaggcuuucugaaagaucuagugguucacacagagagagagagaguacugaaaaagcaacuccucuucuuagucuuaauaauuuacuaaaauggucaacuuuucauuaucuuuauuauaauaaaccugaugcuuuuuuuuagaacuccuuacucugaugucuguauauguugcacugaaaagguuaauauuuaauguuuuaauuuauuuugugugguaaguuaauuuugauuucuguaauguguuaaugugauuagcaguuauuuuccuuaauaucugaauuauacuuaaagaguagugagcaauauaagacgcaauuguguuuuucaguaaugugcauuguuauugaguuguacuguaccuuauuuggaaggaugaaggaaugaaucuuuuuuuccuaaa

SEQ ID NO: 273 - RNA, 3375 nt, Homo Sapiens
ggcagucgcggaaggcgcgggagcuugcgugcugcugggccugagcugucugucucguuucuguccgcgcgcccugcaucccggccccgggcgcccgcuggaggucgccgaggagccacagggcugacuggucugcugcccgggcccaggagugccugguguagcagucgcggagccaucccggcgucugcugccaugaccgacucuccccucagaggagacucuuccucagcgguggcugcagagacagaugagcggcggcuccuggccgcgggaccgugagacggguucguggccggccauuuagggggacgcugcgaccaccgccugcgccccuccggacugguuccuugggccccggaagcucgcggcgggcccugcgggaggcggcaugcucccgcggaggcugcuggccgccuggcuggcggggacgcggggcgggggccugcuggcgcuucuggccaaucagugccgcuucgucacgggccugcgcgugcggcgcgcgcagcagaucgcgcagcucuacggccgccucuacuccgagagcucacgccgcguucuccucggccgccucuggcgccggcugcacggccguccuggccaugccucugccuugauggcggcguuagccggcgucuucguuugggacgaggagaggauccaggaggaggaguugcagagaucuauuaaugagaugaagcgguuggaagaaaugucaaauauguuucagagcucuggaguccagcaccacccuccagaaccaaaagcccaaacagaagggaaugaagauucagagggcaaagagcaacguugggaaauggugauggauaagaaacacuuuaagcuguggcggcgcccaauuacaggcacccaccuuuaccaguaccgaguuuuuggaaccuacacagaugugacaccucggcaguucuucaauguucagcuggacacagaguauagaaaaaaaugggaugcccugguaaucaagcuggaggugauugagagggaugugguuagugguuccgagguucuucacuggguaacccauuuuccuuauccaauguacucacgggauuauguuuauguucggcgguauaguguggaucaggaaaacaacaugaugguguuggugucgcgugcuguggagcauccgagugugccagagucuccagaauucgucagggucagaucauaugaaucccaaaugguuauccguccccacaagucauuugaugagaauggcuuugacuacuuacuaacauacagugacaauccccaaacgguguuuccucgcuacuguguuaguuggaugguuuccaguggcaugccagauuuccuggagaagcugcacauggccacucugaaagccaagaauauggagauuaaaguaaaggacuacaucucagcuaagccucuggaaaugaguagugaagccaaggccaccagccaguccucugagcgaaagaacgagggcagcuguggcccugcucggauugaguaugcuugacaggcuuugggauaagaagggacaaggugcuucuagcccugucucaguccguuaucacucugcuguagaagggggacaugccacauguauuagaaggcaucugcuguaacuuccagugcaagauaauucaauaacugaugucccauuucauucagagcccuuauugcucuuaucaaaacagaagaaggcuacauuugugggaguguugucauauucucaggccaacuguuuugaaauucgguaucucacugagcuaaucuggaacaaaccucucaccucaggccagaaggggaugaccuccauuugcuucucugaguaguuuccucugcugacauuccaaaucccaccaucgauugugcagcgcuuuggauuuccuucaguucuccagguccaccuggaaaguauaguuggccaguugagucucucaaaugaggggcuacugggagugcucuugguaacaaucaugaugugaaugggugugaacgauacuuggcuauguuaagugccuuguccgcaccuugcuuuuaucucuagagacaugaaguuauuauuaauuuuuuuuuuuuuuaaguagagauggaguuucacucuguuucccaggcuggucuugaacuccugggccaugccuggccagggacaugaauuuguacaaagaaauuucccucccugccugcacaauaucacccauugacucaccuuauccaaagcaaguuuccugugaaucggccaguucuucuauauucauuggaucauugccuccuuccuaaccuuccccauuuaccaagaacacugggagacuaauccuuuuagauaguagcuuuuugaugcucaaaacaucacauuuaaauuuaguuuaaaaauuuuuuaacuuuugugucaaauaggaguugaggaauugagcaggauucuacccuaguccgauuguauagaaaacaccauuuugauucagguauuauuuuucauauuucagguuugacuuguucuuuucagaaggcuaaagucagaggaaugggggcugggccacucccuuggagcucucagaucuacagacaagcugugugaaugcauagauguaaucuugucucaaauacuaauacaguggagauuugguuuauguuaccauuaaguuccucuaaaaaguuuuucuuccucucuucagagccaaaauaaaagugaacuacacuguucagauaaggucacaaucugaugcugucaguuugaccgagcugguuuugcuuauggucaugcugcaauuuguuagaauaauagggaucaaguuuuaaauccuccuccuucccuuuuuucuggagucuugagggccagaguuuuuguuuuuguuuuuguuuuuguuuuccugcuugcuacuguuuugugguguugaaaagugguuuaaaccugagacuaacuuaaacacuuccuugaccuucuuguugccuguucauuuuugugccaaggaaguagcugccccaguguaugucuugccuucuccgcgucauuguuggaagaggagagaugcaucgagcagucccagcugcuuuucauuuauuacuucuucuuuccaggaccugacagaagucagggaagagucccuggguuauguccaaacuuagcaccugcaauuguugggauguggauggaugugugcauaagagagagagagaauaugugugugugugugugcgucugcgagcgcacacacaugcacaagugcgaaggaguugcgguugcuccauguucugacuuagggcaauuugauucugcacuuggggucugucuguacaguuacucaugucauuguaaugauuucacuccuaacugugacauuuuuaucaaaugugugaauaaauacauaaagauugguacaaaaaaaa

SEQ ID NO: 274 - RNA, 1394 nt, Homo Sapiens
cucaccgccagcguaggugcuaccaccgcugccgucgccgccgccauuuugauggcaggaagaguccgguucugggacagcuggagacagugguggugacugaaauaacuuuaccaaaggaaagcuauuuugcgaacuaucuucuccagcggagauggccaauguugccaaugugcuuuguaacagagccagacugguuuccuaucucccaggauuuugcucuuuaguuaaaaggguugucaaucccaaagccuuuucgacugcaggaucaucagguucggaugagucucauguggcugcugcaccuccagauauaugcucucgaacaguguggccugaugaaacuaugggacccuuuggaccucaagaucagagguuccagcuuccugggaacauagguuuugauugucaccucaaugggacugcuucacagaagaaaagccugguucauaaaacuuugccugauguucuagcagaaccuuuaucaagugaaagacaugaguuugugauggcacaauaugugaaugaauuucaggguaaugaugcaccuguugaacaagaaauuaacagugcagaaacuuacuuugaaagugccagaguagagugugcaauacagacauguccagaauugcugcgaaaagauuuugaaucacuguuuccagaaguagcuaauggcaaacuaaugauucugacuguaacacaaaaaacuaagaaugauaugacuguuuggagugaagaaguagaaauugaaagagaagugcucuuagaaaaguucaucaauggugcuaaggaaauuugcuaugcucuucgagcugaggguuauugggcugacuuuauugacccaucaucugguuuggcauuuuuuggaccauauacaaacaacacucuuuuugaaacugaugaacgcuaccgacauuuaggauucucuguugaugaccuuggaugcuguaaagugauucgucauagucucugggguacccauguaguuguagggaguaucuucacuaaugcaacaccagacagccauauuaugaagaaauuaaguggaaauuagcagaaauauccauucauuugcuguacuauuuguauguaauauuuggguugaucuauaaacacugucagacuaaaguuuuuaaaauauauuuauuucuaaguauuuauuucagcauuuaugaauuuacaacauuggcaagugauuugggauuuuaaaauugcaaauguucauuuauucauaucauugaauacacguugaacacauccacauuguauaggaugugguaauuagcuuguaaccaggguaugaucugcuauuguuauuucuccucuuuauuggaaaaaggccucaguuuuaauuauuuucuucccaaaauaaaucacacauuugguuacaauaa

SEQ ID NO: 275 - RNA, 107 nt, Homo Sapiens
acgcuucccucagcagcacauauacuaaaacuggacugauacagagaagauuagcauggucccugcacaaggauaacacgcaaauucaugaagcauuccauguuuaa

SEQ ID NO: 276 - RNA, 6906 nt, Homo Sapiens
ggcgggagccgcgugcgcccgaggacccggccggaaggcuugcgccagcucaggaugaggacaggcugggcgaccccucgccgcccggcggggcuccucaugcugcucuucugguucuucgaucucgcggagcccucuggccgcgcagcuaaugaccccuucaccaucguccauggaaauacgggcaagugcaucaagccaguguauggcuggauaguagcagacgacugugaugaaacugaggacaaguuauggaagugggugucccagcaucggcucuuucauuugcacucccaaaagugccuuggccucgauauuaccaaaucgguaaaugagcugagaauguucagcugugacuccagugccaugcugugguggaaaugugagcaccacucucuguacggagcugcccgguaccggcuggcucugaaggauggacauggcacagcaaucucaaaugcaucugaugucuggaagaaaggaggcucagaggaaagccuuugugaccagccuuaucaugagaucuauaccagagaugggaacucuuaugggagaccuugugaauuuccauucuuaauugaugggaccuggcaucaugauugcauucuugaugaagaucauagugggccauggugugccaccaccuuaaauuaugaauaugaccgaaaguggggcaucugcuuaaagccugaaaacgguugugaagauaauugggaaaagaacgagcaguuuggaaguugcuaccaauuuaauacucagacggcucuuucuuggaaagaagcuuauguuucaugucagaaucaaggagcugauuuacugagcaucaacagugcugcugaauuaacuuaccuuaaagaaaaagaaggcauugcuaagauuuucuggauugguuuaaaucagcuauacucugcuagaggcugggaauggucagaccacaaaccauuaaacuuucucaacugggauccagacaggcccagugcaccuacuauagguggcuccagcugugcaagaauggaugcugagucuggucuguggcagagcuuuuccugugaagcucaacugcccuaugucugcaggaaaccauuaaauaauacaguggaguuaacagaugucuggacauacucagauacccgcugugaugcaggcuggcugccaaauaauggauuuugcuaucugcugguaaaugaaaguaauuccugggauaaggcacaugcgaaaugcaaagccuucaguagugaccuaaucagcauucauucucuagcagauguggaggugguugucacaaaacuccauaaugaggauaucaaagaagaaguguggauaggccuuaagaacauaaacauaccaacuuuauuucaguggucagaugguacugaaguuacucuaacauauugggaugagaaugagccaaauguucccuacaauaagacgcccaacuguguuuccuacuuaggagagcuaggucaguggaaaguccaaucaugugaggagaaacuaaaauauguaugcaagagaaagggagaaaaacugaaugacgcaaguucugauaagauguguccuccagaugagggcuggaagagacauggagaaaccuguuacaagauuuaugaggaugaggucccuuuuggaacaaacugcaaucugacuaucacuagcagauuugagcaagaauaccuaaaugauuugaugaaaaaguaugauaaaucucuaagaaaauacuucuggacuggccugagagauguagauucuuguggagaguauaacugggcaacuguugguggaagaaggcgggcuguaaccuuuuccaacuggaauuuucuugagccagcuuccccgggcggcugcguggcuaugucuacuggaaagucuguuggaaagugggaggugaaggacugcagaagcuucaaagcacuuucaauuugcaagaaaaugaguggaccccuugggccugaagaagcauccccuaagccugaugaccccuguccugaaggcuggcagaguuuccccgcaagucuuucuuguuauaagguauuccaugcagaaagaauuguaagaaagaggaacugggaagaagcugaacgauucugccaagcccuuggagcacaccuuucuagcuucagccauguggaugaaauaaaggaauuucuucacuuuuuaacggaccaguucaguggccagcauuggcuguggauugguuugaauaaaaggagcccagauuuacaaggauccuggcaauggagugaucguacaccagugucuacuauuaucaugccaaaugaguuucagcaggauuaugacaucagagacugugcugcugucaagguauuucauaggccauggcgaagaggcuggcauuucuaugaugauagagaauuuauuuauuugaggccuuuugcuugugauacaaaacuugaaugggugugccaaauuccaaaaggccguacuccaaaaacaccagacugguacaauccagaccgugcuggaauucauggaccuccacuuauaauugaaggaagugaauauugguuuguugcugaucuucaccuaaacuaugaagaagccguccuguacugugccagcaaucacagcuuucuugcaacuauaacaucuuuugugggacuaaaagccaucaaaaacaaaauagcaaauauaucuggugauggacagaagugguggauaagaauuagcgaguggccaauagaugaucauuuuacauacucacgauauccauggcaccgcuuuccugugacauuuggagaggaaugcuuguacaugucugccaagacuuggcuuaucgacuuagguaaaccaacagacuguaguaccaaguugcccuucaucugugaaaaauauaauguuucuucguuagagaaauacagcccagauucugcagcuaaagugcaauguucugagcaauggauuccuuuucagaauaaguguuuucuaaagaucaaacccgugucucucacauuuucucaagcaagcgauaccugucacuccuaugguggcacccuuccuucaguguugagccagauugaacaagacuuuauuacauccuugcuuccggauauggaagcuacuuuauggauugguuugcgcuggacugccuaugaaaagauaaacaaauggacagauaacagagagcugacguacaguaacuuucacccauuauugguuagugggaggcugagaauaccagaaaauuuuuuugaggaagagucucgcuaccacugugcccuaauacucaaccuccaaaaaucaccguuuacugggacguggaauuuuacauccugcagugaacgccacuuugugucucucugucagaaauauucagaaguuaaaagcagacagacguugcagaaugcuucagaaacuguaaaguaucuaaauaaucuguacaaaauaaucccaaagacucugacuuggcacagugcuaaaagggagugucugaaaaguaacaugcagcuggugagcaucacggacccuuaccagcaggcauuccucagugugcaggcgcuccuucacaacucuuccuuauggaucggacucuucagucaagaugaugaacucaacuuugguuggucagaugggaaacgucuucauuuuagucgcugggcugaaacuaaugggcaacucgaagacuguguaguauuagacacugauggauucuggaaaacaguugauugcaaugacaaucaaccaggugcuauuugcuacuauucaggaaaugagacugaaaaagaggucaaaccaguugacaguguuaaauguccaucuccuguucuaaauacuccguggauaccauuucagaacuguugcuacaauuucauaauaacaaagaauaggcauauggcaacaacacaggaugaaguucauacuaaaugccagaaacugaauccaaaaucacauauucugaguauucgagaugaaaaggagaauaacuuuguucuugagcaacugcuguacuucaauuauauggcuucaugggucauguuaggaauaacuuauagaaauaagucucuuaugugguuugauaagaccccacugucauauacacauuggagagcaggaagaccaacuauaaaaaaugagaaguuuuuggcugguuuaaguacugacggcuucugggauauucaaaccuuuaaaguuauugaagaagcaguuuauuuucaccagcacagcauucuugcuuguaaaauugaaaugguugacuacaaagaagaauauaauacuacacugccacaguuuaugccauaugaagaugguauuuacaguguuauucaaaaaaagguaacaugguaugaagcauuaaacauguguucucaaaguggaggucacuuggcaagcguucacaaccaaaauggccagcucuuucuggaagauauuguaaaacgugauggauuuccacuauggguugggcucucaagucaugauggaagugaaucaaguuuugaauggucugaugguaguacauuugacuauaucccauggaaaggccaaacaucuccuggaaauuguguucucuuggauccaaaaggaacuuggaaacaugaaaaaugcaacucuguuaaggauggugcuauuuguuauaaaccuacaaaaucuaaaaagcugucccgucuuacauauucaucaagauguccagcagcaaaagagaaugggucacgguggauccaguacaagggucacuguuacaagucugaucaggcauugcacaguuuuucagaggccaaaaaauuguguucaaaacaugaucacucugcaacuaucguuuccauaaaagaugaagaugagaauaaauuugugagcagacugaugagggaaaauaauaacauuaccaugagaguuuggcuuggauuaucucaacauucuguugaccagucuuggaguugguuagauggaucagaagugacauuugucaaaugggaaaauaaaaguaagagugguguuggaagauguagcauguugauagcuucaaaugaaacuuggaaaaaaguugaaugugaacaugguuuuggaagaguugucugcaaagugccucugggcccugauuacacagcaauagcuaucauaguugccacacuaaguaucuuaguucucaugggcggacugauuugguuccucuuccaaaggcaccguuugcaccuggcggguuucucaucaguucgauaugcacaaggagugaaugaagaugagauuaugcuuccuucuuuccaugacuaaauucuucuaaaaguuuucuaauuugcacuaauguguuaugagaaauuagucacuuaaaaugucccagugucaguauuuacucugcuccaaaguagaacucuuaaauacuuuuucaguuguuuagaucuuaggcaugugcugguauccacaguuaauucccugcuaaaugccauguuuaucacccuaauuaauagaauggaggggacuccaaagcuggaacugaaguccaaauuguuuguacaguaauauguuuaauguucauuuucucuguaugaaugugauugguaacuaggauauguauauuuuaauagaauuuuuaacaaaacuucuuagaaaauuaaaauaggcauauuacuaggugacaugucuacuuuuuaauuuuuaagagcauccggccaaaugcaaaauuaguaccucaaaguaaaaauugaacuguaaacucuaucagcauuguuucaaaauagucauuuuuagcacuggggaaaaauaaacaauaagacaugcuuacuuuuuaauuuuuauuuuuuugagacugagucucucucuguugcccaggcuggaguacaauggcgugaucucggcucacugcaaaucuccgccucccagguucaagcgauucuccugccucagccuccugaguagcugggauuacaggcaacugccaccaugcccggcuaauuuuuguauuuuuaguagagaugggguuucaccauguuggccaggcuggucucgaacucgugaccgcaggugauccucccgccucggccucccaaagugcugggauuacaggcaugagccaccgcgccuggccucugcuuacuuuuuauauagcaaaaugauuccucuuggcaagauguuucuuauauuauuccaaaguuauuucauaccauuauuauguaaauaugaagaguuuuuuucuguuuauaauuguuuauaaaacaaugacuuuuaaagauuuagugcuuaacauuuucccaagugugggaacauuauuuuuagauugaguagguaccuuguagcagugugcuuugcauuuucugauguauuacaugacuguuucuuuuguaaagagaaucaacuagguauuuaagacugauaauuuuacaauuuauaugcuucacauagcaugucaacuuuugacuaagaauuuuguuuuacuuuuuuaacauguguuaaacagagaaaggguccaugaaggaaaguguaugaguugcauuuguaaaaaugagacuuuuucaguggaacucuaaaccuugugaugacuacuaacaaauguaaaauuaugagugauuaagaaaacauugcuuugugguuaucacuuuaaguuuugacaccuagauuauagucuuaguaauagcauccacuggaaaaggugaaaauguuuuauucggcauuuaacuuacauuuguacuuuauuuuuguauaaaauccauagauuuauuuuacauuuagaguauuuacacuaugauaaaguuguaaauaauuuucuaagacaguuuuuauauagucuacaguuguccugauuucuuauugaauuuguuagacuaguucucuuguccugugaucuguguacaauuuuagucacuaagacuuuccuccaagaacuaagccaacuugaugugaaaagcacagcuguauauaauggugaugucauaauaaaguuguuuuaucuuuuaaguaaaa

SEQ ID NO: 277 - RNA, 1809 nt, Homo Sapiens
auggcggcggaacggcgcuguggaaguaugcgagacuuaagagcucaagugacuaguggucuccugccauuuccagaagugacucuucaagcccuuggagaagacgaaauaacauuagaaucugugcuucguggaaaguuugcugcggggaaaaauggacuugcuugcuuggcuugugguccacaacuugagguaguaaacucuauaacaggagagcgauugucugcuuacagauucaguggagucaaugaacagccuccuguaguuuuagcugugaaagaauucucuuggcagaagagaacuggauuauuaauaggauuggaagaaacagaagggaguguucucugucuuuaugaccuuggaauaucaaaaguaguuaaagcaguuguucuuccuggaaggguaacagcuauugaaccuauaauuaaucauggaggagccagugcaagcacucagcauuuacauccaagucugcgauggcuuuuuggaguggcagcuguggucacugauguuggacagauccuucuuauugaccuauguuuggaugacuugucaugcaaucaaaaugaaguugaagcaucagaucuugaaguucuaacugguaucccagcugaaguaccacacauuagagaaagugugaugagagaagggcgccaucuguguuuccaguuaguaaguccaacaggaacagccguuucaacucuuaguuacauaagcaggacaaaucagcuugcugcagguuuuucugauggcuaucuagcacuuuggaacaugaaaagcaugaaaagagaauauuacauacaauuggaaaguggacaaguuccuguauaugcugucacuuuucaagaaccugagaaugaucgucggaauugcugcuacuugugggcuguucagucuacacaagauagugaaggggauguuuugaguuugcaucuacugcagcuggccuuugguaauagaaaguguuuggcaucaggacaaaucuuauaugagugguuagaauacugugaagaaagauacacucuggaccugacagguggcauguucccuuugaggggacagacgaguaauaccaaauuguugggaugccagaguauagagaaauuucgaucucauggugacagggaggaaggcgugaaugaagcucuaucgccugacacuaguguuucagucuuuaccuggcaggugaauauauauggacagggaaagccuucuguauauuuggggcuuuuugauauaaaucguugguaucaugcacaaaugccagauucguuaaggucaggagaauaucuacauaauugcucuuauuuugcacuguggucauuggagucuguuguaaguaggacuucuccacauggcaucuuggauauauuaguacaugagagaaguuuaaauagaggagucccuccuucauauccaccucccgagcaguuuuuuaacccaagcacuuauaauuuugaugccacuuguuuguuaaacucgggaguuguucauuuaacuuguacuggcuuucagaaggagacuuugacuuuuuuaaagaaaucagguccaucacucaaugaacucauuccuggugguuauaaucgacgucuuguagcuggccuucuuuccccaaguuuuguugauguucagccuuccaguuuaagccaagaagaacaguuagaagcuauauugucaacagcaauucagacuaguucccugggacuuuugacugguuauauccgaagauggauaacagaagaacaaccaaauucugccacuaauuugcgcuuuguucuugaauggacguggaauaaagugguucucaca

SEQ ID NO: 278 - RNA, 4801 nt, Homo Sapiens
aggcaacgcgggaggcccagcgggaaggcaggaggcggcggcggaggaggagcucuacugagccgcaacuguggcgacagcaaccggagucgcagccgccgccaccugcaccuggcgccuagcccacguccagcgccugcccggccgccgcuucccgccacccugcccugcccacccgccagguacuaccauuaaagauaccuucuucucagcaaaucuaugauaaaaaauauaaguaacagaagaagaaauaacuguuauuugucaagugacaagcuuuuaaugucagaauggcucaccuaaagcgacuaguaaaauuacacauuaaaagacauuaccauaaaaaguucuggaagcuuggugcaguaauuuuuuucuuuauaauaguuuugguuuuaaugcaaagagaaguaaguguucaauauuccaaagaggaaucaaggauggaaaggaacaugaaaaacaaaaacaagauguuggauuuaaugcuagaagcuguaaacaauauuaaggaugccaugccaaaaaugcaaauaggagcaccugucaggcaaaacauugaugcuggugagagaccuuguuugcaaggauauuauacagcagcagaauugaagccuguccuugaccguccaccucaggauucaaaugcaccuggugcuucugguaaagcauucaagacaaccaauuuaaguguugaagagcaaaaggaaaaggaacguggggaagcuaaacacugcuuuaaugcuuucgcaagugacaggauuucuuugcaccgagaucuuggaccagacacucgaccuccugaguauguugaagaauauuuauuguuuauucuuuaucaccaggcuuugcaggggagagaggggugagcuaaggaaguuaucuguuuuuuagcuacucuaaggcagaaaaucagcaaauacuguuuauuuaaccuguuguauuuauuuuuugcuuauaaugauugaggcuacauaucccuauuuaugcuuggugaggcagugcagauaugaaaaguuauuagcuuggaaauuagaaaacugaauucuagaucugacugcuauccacaaggaaauucuuuauuccuaaauacugugguuuucucaucuauuuagggggaauuauuggacaauuuguauaggaaguagaagguagaggaauuguuuccauuucucuguauuucuuuagaauaaaaauguuuaaaaacaugccaagauuuuggaacuguuggauaauauuuuauauauguguaaagcaauucacagacuuugugauuacuuugacucaaaguuuuugaguaccuaauuauauuucagaaugcccuauuuuuuauguauugaacaaaaauuuaagcgcugcccuccccugcccaccaccagugucauaauaguuuuucauaaugaagcgugguccacguugcuuagaacuguccacagugugcucuauucuucaccugcaauacugcugaaggaaaucauuuugguggaugaugcuaguguagauguguaaucccagcauuuugggaggcugaggccugcaaauagcuugaguucaggaguuccagaccagccugggcaacaugaugaaaccccgucucuaaaaaaaaaaaaaaagaaaaaguacuuacaugauaaacuagaugaauauguaaaacaauuuucuauaguaaaaauagucagacaaagagaaagaaaaggucugaucacugcucgguugcuaggagcaacagucgcaacagcugaaacgcucacauuuuuagaugcucacugugaguguuucuaugguuggcuagaaccucuguuggccagaauagcugagaacuacacggcugucguaaguccagauauugcauccauagaucugaacacguuugaauucaacaaaccuucuccuuauggaaguaaccauaaccguggaaauuuugacuggagucuuucauuuggcugggagucgcuuccugaucaugagaagcaaagaaggaaagaugaaaccuacccaauuaaaacacccacuuuugcaggaggacuuuuuuccauaucaaaagaauauuuugaguauauuggaagcuaugaugaagaaauggaaaucuggggaggugaaaauauagaaaugucuuucagaguauggcaauguggugggcaguuggagauuaugccuugcucuguuguuggacauguuuuucgcagcaaaagcccucauagcuuuccaaaaggcacucaggugauugcuagaaaccaaguucgccuugcagaagucuggauggaugaauacaaggaaauauuuuauaggagaaauacagaugcagcaaaaauuguuaaacaaaaagcauuuggugaucuuucaaaaagauuugaaauaaaacaccgccuucaguguaaaaauuuuacaugguaucugaacaacauuuauccagagguguaugugccagaccuuaauccuguuauaucuggauacauuaaaagcguuggucagccucuaugucuggauguuggagaaaacaaucaaggaggcaaaccauuaauuauguauacaugucauggacuugggggaaaccaguacuuugaauacucugcucaacaugaaauucggcacaacauccagaaggaauuaugucuucaugcugcucaaggucucguucagcugaaggcauguaccuacaaaggucacaagacaguugucacuggagagcagauaugggagauccagaaggaucaacuucuauacaauccauucuuaaaaaugugccuuucagcaaauggagagcauccaaguuuagugucaugcaacccaucagauccacuccaaaaauggauacuuagccaaaaugauuaaguguuccuuaaaauuaaguugaaaaaggaaauauucuuucucauaaaacugugacuaggcauacacuguaguuuuugaaaauuaugcaaaagcagcuaaauguaacuuauuccaagugcauuuuucuuauuuauaucuuuauguagcacuacuacagaaauucugcaaguuucuguuucaaagcacaauaacuaguaauaccaaagacuauuucaaaauguccagauguaggggaagagauguuuacaguaugaugaaaauaauuuuccaaguaaagugauguuuguguguuuuguacacuuagggauauauauauauagcuacauucacacacucacaauuuaaaauauuuccccuaguuuuuuggggggauaggaagaaagauuuguuacuguauuuuuuuaacuacauaaaaauagaucaauaaaugucagcauuggccucuguguacaaaccaagagcuuuuacagauccagaauuuauuaguuuaaaaugcaggugaacuuuuuuuugcguuugguuuacuugucugucaaauguuuccuuaaacaugaaacugaauaaggagaagaguauuuuuaacacuuaaauuucuuggcaaauuuuaaaacauuuuuuagucuguaauacacuccacuugaagcacuuaagucuuccuuaaaugacuuuucuuaaguaaugauacuguguguuuucccaaagcacuuuuaaaaaaauuuuuauaaauuacuaucuguugaaaagguguccuuuuccuuucuucuaguauuuuuuucuuaccaaaauucacuaaucuugaauguuugugauauuaaauuucaaaugcagaauacuugacucauuuaaagcuaaauuuuguuacugauucaauuauaauuguaauggauuuuugacuuuguaauggauucuuuucaucaaaaagccuuauuuuuuuaucuauguggaaaacacaauaaaaaauccucaacacuauuguaaucauuugguuaaguuuuuuuccucuuuuggguaaaaucuguaauugauaauaggugggggaaaaugaauuuuguaugcugaauuucuaagcgccuauuguuuguaaaaccaucagauauuucuuauggcacaaaaaaugaggaauagcaaaauuccuguguucaauauuuagaaaauuuuguauuaauuucugauaaaguuccuuaagcaucugauagaaugauguuuuaaaaaaauuugacgcuugcuuaggagauuuaccacuuuuuuuuuuuguuuuucgucauuuuauauuuagaucuccuguauucuuguucccgaaguaaaauacgaucgguuucauauuuuaaaucuggcagagccucagcuguacgaaaaagagcauauacugguuauugacccuaucuucucauuguuuguuuguaaguuugaauuuguauuaaaaagccugcauucugagcuggacaugguggcucagcuucuaaucccagcacuuugguaggcaaaggugggaggaucauuugagcucaggaguuccagaccagccugggcaacauagcaaaaucucaucucuacaaaaaguaaaaauuaaaaaaugaaauuaaaaauaaaauuaccuaggugugguggcacgcaucuguaguuccagcuauacaggaaggugaggcagaagcauugcuugagcuugggagaucgaggcuacagugagcuaugauuacaccacugcacuucagucugugugacugagcaagacucuuucaaaaaaaaaaaaaaaagccuacauucuccaguugauuauuucaacuaauguguauuaugugccuaauuuucuaucagaaguuguauuagcccguuuucacacugcuguuaaagacauaccugagacuggguaauuuauaaagaaaaauagguucgauggacucacagguccgcguggcuggggaggcuucacaaucauggcggaaggugaaaggcaugucuuacguggagg

SEQ ID NO: 279 - RNA, 501 nt, Homo Sapiens
ggcaagauggcagaaguagagcagaagaagaagcggaccuuccgcaaguucaccuaccgcggcguggaccuggaccagcugcuggacauguccuacgagcagcuggagcagccgaugcagcuguacagugcgcgccagcggcggcggcugaaccggggccugcggcggaagcagcacucccugcugaagcgccugcgcaaggccaagaaggaggcgccgcccauggagaagcaggaaguggugaagacgcaccugcgggacaugaucauccuacccgagauggugggcagcauggugggcgucuacaacggcaagaccuucaaccagguggagaucaagcccgagaugaucggccacuaccugggcgaguucuccaucaccuacaagcccguaaagcacggccggcccggcaucggggccacccacuccucccgcuucaucccucucaaguaauggcucagcuaauaaaggcgcacaugacuccaaaaaaaaaaaaaaaaa

SEQ ID NO: 280 - RNA, 5607 nt, Homo Sapiens
agaucgcaaguccugcaaacuuacguggcauuucugaagucaucagaggagguagagaugcaguuucagagcuuaaaagaauuuuaugaaaccgaaaucccucagaaggagcaggaugaugcuaaagccaagcauuguucugacucggcugagaagcaguggcagcuauuuuuaaagaagaguuuuauaacacaagaucuagggcuugaguuccuuaauuuaauaaauauggcaaaagagaacgagauauuagaugugaaaaaugaaguguaccucaugaagaacaccauggaaaaccagaaagcagaacgggaagaacuuagccuccuucggcuggcauggcagcuuaaagccacggaaagcaagccuggaaaacagcagugggcggcauucaaagagcaacuuaaaaagacuucucacaacuuaaaacuucuucaggaagcacuuaugccugugucugcacuugaccucggagggagccuccaguucauuuuagaucuacgacaaaaauggaaugacaugaagccucaguuccagcaauugaaugaugagguucaguacauuaugaaagaaucagaggaguuaacuggcagaggagccccuguaaaagaaaagucucaacaacugaaggaccuuauucacuuccaucaaaaacagaaagagagaauccaggauuacgaggauauccuguacaaggugguccaguuccaucaagucaaggaagagcugggacgucucaucaaaucaagagagcuggaguuuguagagcagccgaaggaacugggugaugcccaugaugugcagauucaccuccggugcucucaggaaaagcaagcccguguagaccaucuccacagacuggcccuuuccuuaggagucgacaucaucucaucagugcagcggccucacugcucuaauguuucugcaaagaaccuacagcagcagcuggagcuccuugaggaggacagcaugaaguggcgugccaaagcugaggaguauggacggacccugucccguaguguggaguacugcgccaugagagacgagauaaaugagcucaaagacucauucaaagauaucaaaaagaaauucaauaauuugaaguuuaauuacacuaagaaaaaugaaaaaucucggaaucugaaggcgcuuaaauaucaaauucagcaaguugauauguaugcugaaaaaaugcaggcuuugaaaaggaaaauggaaaaaguuaguaauaaaaccucugauucuuucuuaaauuauccaagugauaaaguuaauguccuuuuggaagucaugaaggauuugcaaaaacauguggaugacuuugacaaaguugugacagauuacaagaagaauuuggaccugacugagcauuuccaggaggugauagaagagugucauuuuugguacgaagaugcaagugccacaguuguaagaguuggaaaauauuccacagagugcaagacaaaggaagcugugaaaauucuccaccagcaguuuaauaaguuuauugcacccucagugccgcagcaagaagaaaggauucaggaggccacugaccuugcucagcacuuauaugguuuggaagaaggacagaaauauauugagaaaauagugacaaaacacaaagagguucuugaaucugugacugaauuaugugagucccucacagagcucgaagaaaaacugaagcagggagauguuuuaaagaugaauccgaauuuggaagacuuccauuaugauuacauugacuugcuaaaggaaccagcaaaaaauaagcagacaauauucaaugaagaaaggaauaaggggcaggugcagguggcagaucuuuugggcaucaauggaacaggggaagagcgacuaccacaagaccugaagguguccacugacaaggaggguggcguccaggaccugcuccugccugaagacaugcucucaggggaagaauaugagugugucucaccugaugacaucuccuugccuccucucccaggaagcccugaguccccucuugcaccaucugacauggagguggaagagccugucagcuccucccucagccuucacauaagcagcuauggggugcaggcugggaccagcagcccaggggaugcccaggaaucuguucuuccaccaccuguugccuuugcggaugcaugcaaugauaagagagaaacauuuucaagucauuuugagaggccuuaccuccaguucaaagcugagcccccacuaaccuccagaggauucguggaaaagaguacugccuuacacagaaucagugcugaacauccagagagcaugaugagugaagugcaugagagagcuuuacagcagcacccucaggcucagggugguuugcuagaaacacgggagaaaaugcaugcugauaauaacuucacuaaaacccaagauaggcugcaugcuuccucugaugcauucucgggccucagguuucaaucaggcaccagcaggggcuaucagaggcaaaugguuccucgagaagagauuaaaagcacaucagcaaagagcagcguggucagccuagcugaccaggcaccuaauuucuccaggcuccugucuaauguaacugucauggaagguucuccagugacuuuggaaguugaaguaacaggauuuccagagccuacacugacaugguggguagccuauaaugacaagccauaaauggaaacaaauucaaucacagagaaaaaucauucugugagcacuaacugaaagguuuagggcuagcugauuaauauucuaugacacugcaacucugcaugauucaaucucacaucagaccccucucauuuuaguagcagcauaguuaauaccuuuaagaaaaauaaaagguaaccauauaaaguacuaauaauuuaacaaauuuccaaagcacuguagguugguugugcuuguuuucuucuguguuuaacauuccacauuucuaaagauuguggguugaaauuauuuuuuauugucuauuuccauauaagcauggcaucugcuugcuuuaacuaccuuuaugcaauugaaaauauaagaauuuguuuuuauuucccuuuacucucauuuaccucuuucaucuuuuuccucuuuccaacagagucacacgugucaucuuuguaacauuuuguuuuacuaggauuucuuuuuacaaauuuuuucaaugugagagguggaauauaaauauuucugucacaguuccuccaggugacaggcaauaaacucauuuuugaaagguaguauaauaacugagcuguaaacaauaugauuucacucuggagacaucauuauuuuuuagccucuuuuuuucaguaaaagcaaacuguagaauacugguuuuggaucaccuacuauugguaacaaaagcaguucuuucucaauauguggguuacuuuuaaacauuuagaaaauucucauccuuaaguaaauuuauuucaggacaaaguuacaaaucugcaaaagccaguuuauacuuauaaacuaagauuaaguaaaauagcauuuauugaucacaauguuucaguagauauuaaaugaucaguuucaguuauugugugugcccauugaugguacuugaaauaugaaccaguuaucuaaggaacuuaugagaaaacuuugguuucucaaauuauuuaaaaaacugcacuugugcuauauuagugcagucacuuuugcuuuuuguuuuauugucuuuacuguugcauguuuuuuacaaaucaagagugucauauuuaugaauuuuaaagauauuuaauucauuauuaaaucucaguucacuccguacaagaagggccagaaauugucugcagaugggcacuuacagguuuuacacaaggagacaaggcauucgguguucauuccaaagguaugcaaggcagacgcaggccucuauguggcucgggcccaaaacucuagcggcgcucucucuuccaaugucauccuccacgugacagguaacugcaggcugccaaucacaagaguaaacuggauaacccugugugucgucuauguuagugugucccuaauguacuggcuccucacacaauaacugugguguuggcaccaauggacaucauucucaugugccuaaagaaaagugccgccguuuaucuuccugcaccuccugcaaagcaucucccaccaaguguaucuccagucugaucaccauacuuguuuggcuaauaccacugcuaggugaaauaaucaaauuuucuggagcguuuaauauauuugagaagcuugguaaauuaucuguaguggauaagaacagauuuuuguacucuagaaacagauguuuucaacauaauaugcagcaaaauuauucuaugccuauucccuccuaauuuaagggcgugcagaugaaggcugacaucggcauagaaaugugcuaaauuucaaauaugguuguucaauaauauauuuuuaauuguauuuuaaaacaucccuuuguagggaauaucaguagaacuauugaauugauguuguauuuuugcauuagcuguccuuuaauuuugcuuuccaugucuugaucuuguuaccgaaaugcauucuguguaauuucaacguagacuacguuccugagucugaugaugucauuguaaauaaucauuccucauguugcucucacggguuugacauuggaggauagaugugccaucaacuuuaaauagaguuuccaucuuuugucagcucugcaugucauacagcaagauggaacacagguugcaagaaagaaccaacguuauuccugacauucuauugauguguuuugagcagcaauguguaaccagguguuucugcuucuaaucuugauucugcugaugaccauuuuuauacuuuauggcaaagccucauugccucaguuuccugucuggaaaaugaguucaucaucuaccucuugggcaauugagaguuuucauuuugugucuuuuaaacaucuggaaaauggaaaacacugagggcuaaggauaaugauauuguuuaauguaauuugucaucagaccggccuccugcucacuauuucuuuuuuuuuagaugcuguuuuuuuagaauauuaaauuaaaggagugcuguuaauauguaaucuucaacuaguuccauggaggaaagugauguuuuaugaauuagagcuuaaauuccuaucuaauuucugaagacugcauucuuuucaaagacuugaaauuaaacucaggaggauacauuuuguuuguucuagggggaaacguaauagaaugguaugagaugaauucuauccuuuuacaauaauuauuacuauaauauugaaguauucuaugccuuucugaaacacuuuauucagaaaagaucauuuuuuggcuuccuuuuaaaaauaagcuugaaguagggaagcauuugcuucuuagauuuuaaauguagucuuauuaugcugaggaaaaucuuuaguugaaagaauaauucauuacagauuuuugaugaagggaagaaauuaauuauguugcuggaagacugucuacaaauaaucaaaauauuuaaauguaauguauucaaguuguuauuaaaaaguuacugaauguuaucugaagaugugaaauguguagucaaguaaaaaguuggcguauacuu

SEQ ID NO: 281 - RNA, 4211 nt, Homo Sapiens
auucccaacugccagugaucucugaagccgacucugaggcucccucuuugcucuaacagacagcagcgacuuuaggcuggauaauagucaaauucuuaccucgcucuuucacugcuaguaagaucagauugcguuucuuucaguuacucuucaaucgccaguuucuugaucugcuucuaaaagaagaaguagagaagauaaauccugucuucaauaccuggaaggaaaaacaaaauaaccucaacuccguuuugaaaaaaacauuccaagaacuuucaucagagauuuuacuugaacagcagucucagcgguuagcagcacaagagaugauuuacacaaugaagaaaguacaugcacuuugggcuucuguaugccugcugcuuaaucuugccccugccccucuuaaugcugauucugaggaagaugaagaacacacaauuaucacagauacggaguugccaccacugaaacuuaugcauucauuuugugcauucaaggcggaugauggcccauguaaagcaaucaugaaaagauuuuucuucaauauuuucacucgacagugcgaagaauuuauauaugggggaugugaaggaaaucagaaucgauuugaaagucuggaagagugcaaaaaaauguguacaagagauaaugcaaacaggauuauaaagacaacauugcaacaagaaaagccagauuucugcuuuuuggaagaagauccuggaauaugucgagguuauauuaccagguauuuuuauaacaaucagacaaaacagugugaacguuucaaguaugguggaugccugggcaauaugaacaauuuugagacacuggaagaaugcaagaacauuugugaagauggucguaaguuuauuucuuauuucauuuuaguucauuuauagcgaaugguuuccagguggauaauuauggaacccagcucaaugcugugaauaacucccugacuccgcaaucaaccaagguucccagccuuuuuguuacaaaagaaggaacaaaugaugguuggaagaaugcggcucauauuuaccaagucuuucugaacgccuucugcauucaugcauccauguucuuucuaggauuggauagcauuucaugccuauguuaauauuugugcuuuuggcauuuccuuaauauuuauauguauacgugaugccuuugauagcauacugcuaauaaaguuuuaauauuuacaugcauaguaaaaauuucacggucccucauggugucucacuccagcagacagaggauugugucgugccaaugagaacagauucuacuacaauucagucauugggaaaugccgcccauuuaaguacaguggaugugggggaaaugaaaacaauuuuacuuccaaacaagaaugucugagggcauguaaaaaagguuucauccaaagaauaucaaaaggaggccuaauuaaaaccaaaagaaaaagaaagaagcagagagugaaaauagcauaugaagaaauuuuuguuaaaaauaugugaauuuguuauagcaauguaacauuaauucuacuaaauauuuuauaugaaauguuucacuaugauuuucuauuuuucuucuaaaaugcuuuuaauuaauauguucauuaaauuuucuaugcuuauuguacuuguuaucaacacguuuguaucagaguugcuuuucuaaucuuguuaaauugcuuauucuaggucuguaauuuauuaacuggcuacugggaaauuacuuauuuucuggaucuaucuguauuuucauuuaacuacaaauuaucauacuaccggcuacaucaaaucaguccuuugauuccauuuggugaccaucuguuugagaauaugaucauguaaaugauuaucuccuuuauagccuguaaccagauuaaggaauacagcucuuaaaaaaucaagaacuuccugaguuucacauauaaaauggugacaaacaccugcuucugauaaaguuuauccaauuuuguauuuauaguauucuauuguaauaauagaauucuauuaugugcuucccuccuuagacauaguuuuucuccuuuuguacuaaccaguacuuccaucuauauugagcuaaacugucuuugaacagucaacucugcaucaugugccugccugauuuggauugguuucacuuuuuuuuuuguuugaccauagcccauucuaucagucaagaugacugaauaauuguguguuaaauacaacucaugauaaggagaaccuuuauggaaacaagaaguuuuauggcaaucgagagggaauuauuuauauguacuucuuaauacuaugcuucccaauauuuuuucuuacuaaaaauaacaaaaauauuuaaaccuucugaaaucuauucaguuaucauuaggauuugcacacaaugcaacuaauaauucaugcuuuaaaaaguagguuauuucuguugaagagaaaauuaucagcagggaagagucuacuagaaaauucaugugcuagucauucuuggggauuuaauauuuugcuggaguuaauucacuauauccagaccuguaucuuucauuuauugcugagccaugugcagucuggcaucucaacaaccucaacaaccucaacaaccuccaagacaugucaguuucuguaguguucaccucaaaucugacacuggaauuggaacugauuuagaaacaaccauuucauucauuugguaugacuagcuucaugacuagcuucaugaauagcuucaugaauagcuucaugacuucucgcuaacaaugauaguauaauucugccuguucuucaggauugaaauuuugaacucaauuuagauuuccuguuuucccucauauaccacaucuaaacagucuccaaaucuuuaugcuuuuuuuuuuuuuuuucgaaaaaguucacccaaucccuaggcuuuuuacuuuuuucuuuuucuuuucuuuuuucuuguuuuuuuuuuuuuuucauuuuguuuuguuuuguuauguuuuuuuagacagggucccacucugucacccaggcuggagugcaguggugcaaucacaggacacugaaaccucccaccuagcugggacuagaggugcaggccaccacaccagcuaauuuauguaauuuuuguagagacgaguuucaccacguuaccuaggcuugucuugaacaccugggcucaagcaaucuuccagccccagccucccaaagugcugggauuacagguauaaaccacaaugcccccguuuuuacucuuuacugcauccuucccaucaguauuaauuccucagaaauuuaguacauuccuccaccauuucaaaaugcucccagaacucacacuaguugguacuuaacuacaaccuucaaccucaccauuuaauuuugauguauguuuuuggauuuaccaacaguacuuucuuucaugacuacuuugauuuaguuaagaaugcucacuguacacugaauguuaauuacucagcuaauucacacugauuuccuguuuaaaaauaugauccccuccaggccauucaugugaagucaggguacagcugaugccagcuacagaaucacuauguuucaauauggaauaugaaaaguccuaacacauaauugcaaaucauuuucuacuaugguauacaaauuuuaucauuacaaaauaguaucagcuuuuuucacuuaaggaaaauaauacaucuucauucaaauauucagugcauaaauaauugccuuaaauugagucuuugcuguggaauuugagaguuuuggaaaucaaaggcccuugugaaacauuuccuguugccauuuauuuauagauagcaauagcuucaaaugagugggaaagucuacuuaggugaagugguaaauagucacuaagauuguauaaauagcgcauugaugaguugccuaauuguuuucuccaacaauaaccacugguccauugguucacuacuuacucaagaaagacauauacugagauggcuugaaauguuuaaugcaugugaacguuauuuuuaccguguuuuggaaaaagaucuugauguuauugucuuccuuuauuuuccacaauuaagugcaucuaacugugaauuguauauggaauuacauuauucagcauauacauauauuuaccugcuuuguucauucucuguauucaaaauuaacagaucaugcugaaaaccacucaaacgauuauauuuuuuacauuauaagaaguaaaauauauuauucugaauaaugaaa

SEQ ID NO: 282 - RNA, 3431 nt, Homo Sapiens
gggacgcccgggcggcccugaaggggacggggcggccccagucggaggucgcagggagcuccgcccccgacucgguauaagagcugggcccggcccacggcggcggcggcggcggcggagagagcuggcucagggcguccgcuaggcucggacgaccugcugagccucccaaaccgcuuccauaaggcuuugccuuuccaacuucagcuacaguguuagcuaaguuuggaaagaaggaaaaaagaaaaucccugggccccuuuucuuuuguucuuugccaaagucgucguuguagucuuuuugcccaaggcuguuguguuuuuagaggugcuaucuccaguuccuugcacuccuguuaacaagcaccucagcgagagcagcagcagcgauagcagccgcagaagagccagcggggucgccuagugucaugaccagggcgggagaucacaaccgccagagaggaugcuguggauccuuggccgacuaccugaccucugcaaaauuccuucucuaccuuggucauucucucucuacuuggggagaucggauguggcacuuugcggugucuguguuucugguagagcucuauggaaacagccuccuuuugacagcagucuacgggcuggugguggcagggucuguucugguccugggagccaucaucggugacuggguggacaagaaugcuagacuuaaaguggcccagaccucgcuggugguacagaauguuucagucauccuguguggaaucauccugaugaugguuuucuuacauaaacaugagcuucugaccauguaccauggauggguucucacuuccugcuauauccugaucaucacuauugcaaauauugcaaauuuggccaguacugcuacugcaaucacaauccaaagggauuggauuguuguuguugcaggagaagacagaagcaaacuagcaaauaugaaugccacaauacgaaggauugaccaguuaaccaacaucuuagcccccauggcuguuggccagauuaugacauuuggcuccccagucaucggcuguggcuuuauuucgggauggaacuugguauccaugugcguggaguacguucugcucuggaagguuuaccagaaaaccccagcucuagcugugaaagcuggucuuaaagaagaggaaacugaauugaaacagcugaauuuacacaaagauacugagccaaaaccccuggagggaacucaucuaaugggugugaaagacucuaacauccaugagcuugaacaugagcaagagccuacuugugccucccagauggcugagcccuuccguaccuuccgagauggaugggucuccuacuacaaccagccuguguuucuggcuggcaugggucuugcuuuccuuuauaugacuguccugggcuuugacugcaucaccacaggguacgccuacacucagggacugagugguuccauccucaguauuuugaugggagcaucagcuauaacuggaauaaugggaacuguagcuuuuacuuggcuacgucgaaaaugugguuugguucggacaggucugaucucaggauuggcacagcuuuccuguuugaucuugugugugaucucuguauucaugccuggaagcccccuggacuuguccguuucuccuuuugaagauauccgaucaagguucauucaaggagagucaauuacaccuaccaagauaccugaaauuacaacugaaauauacaugucuaaugggucuaauucugcuaauauugucccggagacaaguccugaaucugugcccauaaucucugucagucugcuguuugcaggcgucauugcugcuagaaucggucuuugguccuuugauuuaacugugacacaguugcugcaagaaaauguaauugaaucugaaagaggcauuauaaaugguguacagaacuccaugaacuaucuucuugaucuucugcauuucaucauggucauccuggcuccaaauccugaagcuuuuggcuugcucguauugauuucagucuccuuuguggcaaugggccacauuauguauuuccgauuugcccaaaauacucugggaaacaagcucuuugcuugcgguccugaugcaaaagaaguuaggaaggaaaaucaagcaaauacaucuguuguuugagacaguuuaacuguugcuauccuguuacuagauuauauagagcacaugugcuuauuuuguacugcagaauuccaauaaauggcuggguguuuugcucuguuuuuaccacagcugugccuugagaacuaaaagcuguuuaggaaaccuaagucagcagaaauuaacugauuaauuucccuuauguugaggcauggaaaaaaaauuggaaaagaaaaacucaguuuaaauacggagacuauaaugauaacacugaauuccccuauuucucaugaguagauacaaucuuacguaaaagagugguuagucacgugaauucaguuaucauuugacagauucuuaucuguacuagaauucagauaugucaguuuucugcaaaacucacucuuguucaagacuagcuaauuuauuuuuuugcaucuuaguuauuuuuaaaaacaaauucuucaaguaugaagacuaaauuuugauaacuaauauuauccuuauugauccuauugaucuuaagguauuuacauguauguggaaaaacaaaacacuuaacuagaauucucuaauaagguuuaugguuuagcuuaaagagcaccuuuguauuuuuauuaucagauggggcaacauauuguaugaagcauauguagcacuucacagcaugguuaucauguaagcugcagguagaagcaaagcuguaaaguagauuuaucacacaaugacugcauacagacuucaaauaugucaauaguuuggucauagaaccuagaagccaaaagccacacagaagggcaagaaucccaauuuaacucauguuaucaucauuagugaucuguguuguagaacaugaggguguaagccuucagccuggcaaguuacauguagaaagcccacacuugugaagguuuuguuuuacaaaucacuugauuuaacacacucagguagaauauuuuuauuuuuacuguuuuauacccagaaguuauuucuacauuguucuacagcaagaauauucauaaaaguaucccuuucaaaugccuuugagaagaauagaagaaaaaaaguuuguauauauuuuaaaaaauuguuuuaaaagucaguuugcaacaugucuguaccaagaugguacuuugccuuaaccguuuauaugcacuuucauggagacugcaauacguugcuaugagcacuuucuuuauccuuggaguuuaauccuuugcuucaucuuucuacaguaugacauaaugauuugcuauguuguaaaaucuuuguaaaaaauuucuauauaaaaauauuuugaaaaucuuaa

SEQ ID NO: 283 - RNA, 2445 nt, Homo Sapiens
gccccgacgcgcaccgcgauucgccccaagggcccugcgcaggacgcugacgcgaagacucggaggcggaagaaaaaaggagcuguuucuaggcuuuucuaggcgcccagccgagacgcggugccgcggggcgggaguagaggcggagggaggggacacgggcucauugcggugugcgcccugcacucugucccucacucgccgccgacgaccugucucgccgagcgcacgccuugccgccgccccgcagcagaaaugcuucgguuacccacagucuuucgccagaugagaccgguguccaggguacuggcuccucaucucacucgggcuuaugccaaagauguaaaauuuggugcagaugcccgagccuuaaugcuucaagguguagaccuuuuagccgaugcuguggccguuacaauggggccaaagggaagaacagugauuauugagcagaguuggggaagucccaaaguaacaaaagauggugugacuguugcaaagucaauugacuuaaaagauaaauacaaaaacauuggagcuaaacuuguucaagauguugccaauaacacaaaugaagaagcuggggauggcacuaccacugcuacuguacuggcacgcucuauagccaaggaaggcuucgagaagauuagcaaaggugcuaauccaguggaaaucaggagaggugugauguuagcuguugaugcuguaauugcugaacuuaaaaagcagucuaaaccugugaccaccccugaagaaauugcacagguugcuacgauuucugcaaacggagacaaagaaauuggcaauaucaucucugaugcaaugaaaaaaguuggaagaaagggugucaucacaguaaaggcaagugauggaaaaacacugaaugaugaauuagaaauuauugaaggcaugaaguuugaucgaggcuauauuucuccauacuuuauuaauacaucaaaaggucagaaaugugaauuccaggaugccuauguucuguugagugaaaagaaaauuucuaguauccaguccauuguaccugcucuugaaauugccaaugcucaccguaagccuuuggucauaaucgcugaagauguugauggagaagcucuaaguacacucgucuugaauaggcuaaagguuggucuucagguuguggcagucaaggcuccaggguuuggugacaauagaaagaaccagcuuaaagauauggcuauugcuacugguggugcaguguuuggagaagagggauugacccugaaucuugaagacguucagccucaugacuuaggaaaaguuggagaggucauugugaccaaagacgaugccaugcucuuaaaaggaaaaggugacaaggcucaaauugaaaaacguauucaagaaaucauugagcaguuagaugucacaacuagugaauaugaaaaggaaaaacugaaugaacggcuugcaaaacuuucagauggaguggcugugcugaagguuggugggacaagugauguugaagugaaugaaaagaaagacagaguuacagaugcccuuaaugcuacaagagcugcuguugaagaaggcauuguuuugggaggggguugugcccuccuucgaugcauuccagccuuggacucauugacuccagcuaaugaagaucaaaaaauugguauagaaauuauuaaaagaacacucaaaauuccagcaaugaccauugcuaagaaugcagguguugaaggaucuuugauaguugagaaaauuaugcaaaguuccucagaaguugguuaugaugcuauggcuggagauuuugugaauaugguggaaaaaggaaucauugacccaacaaagguugugagaacugcuuuauuggaugcugcugguguggccucucuguuaacuacagcagaaguuguagucacagaaauuccuaaagaagagaaggacccuggaaugggugcaauggguggaaugggaggugguaugggagguggcauguucuaacuccuagacuagugcuuuaccuuuauuaaugaacugugacaggaagcccaaggcaguguuccucaccaauaacuucagagaagucaguuggagaaaaugaagaaaaaggcuggcugaaaaucacuauaaccaucaguuacugguuucaguugacaaaauauauaaugguuuacugcugucauuguccaugccuacagauaauuuauuuuguauuuuugaauaaaaaacauuuguacauuccugauacuggguacaagagccauguaccaguguacugcuuucaacuuaaaucacugaggcauuuuuacuacuauucuguuaaaaucaggauuuuagugcuugccaccaccagaugagaaguuaagcagccuuucuguggagagugagaauaauuguguacaaaguagagaaguauccaauuaugugacaaccuuuguguaauaaaaauuuguuuaaaguuaa

SEQ ID NO: 284 - RNA, 4558 nt, Homo Sapiens
aguuggcaggcugcugcgggaggcggcggcgguaggaagccggagacagcagggugacagaauuggaaaauauuuaacucuuaacaaaugaauuccccacuugaacucugccgaauuccugugccaccuccuccuuuagaaaacugaucuuaauacagagauaaaagaggaguagaagguaaaagaaaaugcugggaacugaccguuguguuguggaagaaugguuaucagaauucaaggcauuaccugacacucagaucaccaguuaugcagcaacuuuacaccggaaaaaaacacuuguaccagcccucuauaaaguuauucaagauucaaauaaugagcuccuggagccugucugccaucagcuguuugagcucuaucguagcucagagguucgacuuaagagguucacacugcaguucuugccagaauugauguggguuuauuuacggcuuacaguuagccgagacagacagaguaaugguugcauugaagcacuucuguuaggaauuuacaauuuggaaaucgcugauaaagaugggaacaauaaaguucugucuuucacuauccccuccuuauccaagccuucaauauaccaugaaccuucaacaauuggauccauggcuuugacagaaggggcauugugucagcaugaucucaucagaguuguuuauagugaucuucauccucagagggaaacauucacugcacagaaccgguuugaaguccugaguuuucucaugcuguguuauaauucugcuauuguauauaugccugccucaucuuaccaaucucuuugucggauggguuccaggguuugugugaguggcuuuccacggcaacaugaaaaacacuggaaagaacucuguggucgaauaguauuggauccugaauuuauggugcaacuucucacagggguuuauuaugccauguauaauggacagugggaccuuggccaggaaguucuugaugauaucauuuauagagcccagcuagagcuuuuuucucaaccacuauugguugccaaugccaugaaaaacucauuaccauuugaugcuccugauucuacacaagaaggccagaaaguccuuaaaguugaagucacuccaacagugccgaggauuucucggacugcaauuacaacagcuucaauccgucgucauagauggagaagagaaggugcugaggguguaaauggaggagaggagucuguaaaccugaaugaugcagaugaaggauuuucaucaggggcuucccucagcagucagccaauugggaccaaaccauccuccucuucucagaggggaagcuuaaggaaaguagcaacugggcguucagccaaggauaaagaaacagccucugccaucaaauccagugagagcccucgagauucaguaguucgcaagcaguauguacagcaaccaacugaucuuaguguagauucaguugagcugacaccaaugaagaaacaccugagccugccugcuggccagguggugccaaaaaucaauagcuuaagucuaauccggacagccagugcuuccucaaguaaaucauuugacuauguaaauggcagucaagcaaguaccagcauugggguuggcacugagggagguacuaauuuagcagccaacaaugcuaaucgauacucaacugucagucugcaggaagaccggcuaggucaagcuggcgaagguaaagagcuccucagcccaggagcccccuugaccaagcagucucgauccccaaguuucaauaugcagcuaauaucccagguguaguuuugacauccucccucaucuuucugcuuaccuuuuaaacugaacauuucauugugcaagaagacacuucaucccacauugugaaaauauuggucacuguuaucagauuucauuuaguuuagguaucuucauacuguauuuuguaucaaaacagcaauaagguuuucuuuaucccucuuuccuacaucuucucuucaccuaucccuuguaaauguguuugugaagcaguauaaaaugguugccuuuuccaugccuuccuuucuccuugggugaugugcaauccaucguaggcugaucggucccauuucaacacugugagacugaggguacauuagaggaaaugguguauaugaucccuaugaaacgauucuuuggcuuuuguuuaaaaacaaaacggguuuguucucauaaucuauagaacuaugaagauuacuggaucauauuuuuuucucuuaaccaggagugccucagagauucugcuaugacuuuggacuucucugagucugugcaaucauuuucuggagaagcauggggaaaggugguagacugcugcacuuuuucauuaaaaugaggguagcucuuucuccacccccccaucuccuuuaucccgaagacauaaauguucaauuacggaggcauuuaaaucaaguugugaccaccuccauuggagggcaggacucuugauuguguaauugauaaugcacuuucucaauggcuguauagucauuauuaacgugucuucccucuuccccacaaggacauauaaggucauuucuguccuucaaguuuggccaacuaacaaaucagaaucugaggggcauguucuauuucccaggaaugauugacacuuuggugcugggguuuugugggggcgggggguaguuuuuguuuagcuuuuguggagauugugugugugagaggagauuugauuuuuuuuucuucuuuuccuuugugagcugauggcugaaguguaacaguacaucuucagguaaagagagggauuucucaaucuacuuucuguuaugucagacuauaagagaaacccuuucagcugcuuucuagauguaccuaaauucagucagacauuuuggauuaagaaaccuaaaguccugauacauuacauacuccaaggaaauauaucagggacagacaauuggcugaaacacugauacuucaaugugacacauuuuuauagaacauuucuaccaggggguacugaccuugauuucuccuacaaggaccacacugccuuuguguuuaauguaaugcaauuuguguaccuucuaaucauauaucugcaguuccucauuuuuauaaaacuuugauaucaugccaguaagcuagauguugaauguauguaaguagcauuugguaacugcuaagagguuacaaaaacauuauugguaaaaaaaauuuccuuaguucugaucugguuggauaagauuuuaucauaacuuuucugggucucaggcucugauguuugaaaaagaagggaauauauuggguuuuaaaaaaguguauugugacuuaaacuguuauaaguuauccuuccacagaauacaucagagcuaucagugcuuuguacauuuagauguuuuuacuugauuauuguuuaagaaaaauauacugaauuuauagaaagcaaguauucuccuaauuagcaaaaguuaaaauuuuaucucuaccauuaaaauuacaauagauuuugauaaauaaccagaaaaaacgccuuuuuuuuuuucacaccuagcaauccucccguuuuuauuguaaggacuuucuuuuuucccuaagagacuuucuguuagacucuuuauauaugagaugcuuguuuaaauaugguggucuguaacauuuuuccagcucaugugaaaauggaaaacuagaaccugaacuaguaucuacaacauugccaaaguccaggguaaagcuaaaaguugauaaguagacaauuuauuguuuugugugugucuguguguguguguguguguguguguguguguguaugguguguauauguauauaucacaaaguuguauuuuaaauauuuuaaauacccuuucuuuuaauuuaagggaugucaaauaaaugaaaggaguuuaaaaauagccaaaauaaaugagcuauaaaggcccauaacauacuaaaacaggcaguuucagguauguaaggaaaggaacauuauacuuaccuagaaagugagaucuaaaaaaaaauuaaaaauaaauaaaaaauaaaaaagaaagugagaucuuggcuauggcuggaggucagucacuuuauggcauaaauuauuugggagguaaaaagacuguuuucaauucaaauugugcauuuauuggcaucuaaaucuagcaugauuuugguuagagcacaaaagaaauaccacauaauaccaaaucacagcaaauguuagaauuaauacaacaaaauuuuccuuuggcuagaaaucuuauguuauaccugaaaaauugguuuuaaaaaauguucaucuuggccgggcacgguggcucacgccuguaaucccaacacucugggaggcugaggugggugaaucaugaggucaggaguucgagaccagccuggccaacauggugaaacccugucucuacuaaaaauacaaaaaauuagcugggcgugguggcaggcgccuguaaucccagcuacucgggaggcugaggcaggagaaucucuugaaccugggagguggagguugcagugagccaagaaugcacuacuguacuccagccuaggcaacagugcaagacuccaucucu

SEQ ID NO: 285 - RNA, 110 nt, Homo Sapiens
cuaaggcgagcucagggaggacagaaaccucccguggagcagaagggcaaaagcucgcuugauguugauuuuuaguacgaauacagaccgugaaagcagagccucaugaa

SEQ ID NO: 286 - RNA, 3824 nt, Homo Sapiens
uucuccaggcccggcugacagaguuagccgaggccgccauauugaauaagcgacccggccuccuagggggucgucgugguccagacaguuuagcagaacagccuccgcggcuccggggagaagcaauauguuaaggauaccuguaagaaaggccuuaguaggccuuucuaagucuccuaaaggauguguucgaacaacugccacagcagcaagcaacuugauugaaguauuuguugauggucagucugucaugguggaaccgggaacgaccguccuccaagcuugugagaagguuggcaugcagaucccucgauucuguuaucaugaaagguugucuguugcuggaaacugcaggaugugccuuguugaaauugagaaagccccuaagguuguagcugcuugugccaugccaguaaugaaggguuggaauauccuaacaaacucagaaaaauccaaaaaagccagggaaggugugauggaguucuuauuagcaaaucacccauuggacuguccuauuugugaccagggaggugaaugugaucugcaggaccaguccaugauguuuggaaaugauaggagccgauuuuuagaggggaagcgugcuguggaagacaagaacauugggccauugguaaagaccaucaugacaagauguauacaguguacucgcugcaucagguuugcaagugagauugcaggaguagaugauuugggaacaacaggcagaggaaaugauaugcaaguuggcacauacauugaaaagauguucaugucugaacugucugggaauaucauugauaucugcccuguaggugcccuaaccucuaagcccuaugccuuuacugcccggccuugggaaacaagaaagacagaauccauugauguaauggaugcgguuggaaguaauauugugguuagcacaagaacuggagaagugaugaggauuuugccacguaugcaugaggacaucaaugaagaguggaucucugauaaaaccagauuugccuaugaugggcuaaaacgucaaagacuuaccgagccaauggucagaaaugaaaaagggcuuuuaaccuauacuucuugggaggaugcgcucucucgcguagcuggaauguugcagaguuuucaaggcaaagauguggcagcaauugcagguggcuugguggaugcugaagcccugguagcucucaaagauuugcuuaauagaguggacucugacaccuuaugcacugaagaggucuuccccacugcaggagcuggcacagauuugcguuccaauuaucuucuuaauacuacaauugcugguguggaagaggcagauguuguucuucugguugguacaaacccacguuuugaggcaccacuguuuaaugcuagaauucgaaagagcuggcugcauaaugacuuaaaaguggcccuuauaggcaguccaguggaccucacuuacacauaugaccaccugggagacucccccaaaauucuucaagacauugcuucgggaagccauccauuuagccagguccuaaaggaagcuaaaaaaccaauggugguuuuaggcaguucugcacuccaaagaaaugauggagcagcaauucuugcagcuguuucuagcauugcacaaaagauucggaugacuagugguguuacuggugauuggaaaguuaugaauauccuucauaggauugcaagucaaguagcugcuuuggaccuuggcuauaagccugggguggaagcaauucggaagaacccucccaaggugcuguuucuccugggagcagauggagguuguaucacacgacaggauuugccaaaggauuguuucauuauuuaucaaggacaucauggugauguuggggcucccauagcugauguuauucucccaggagcugcuuacacagagaagucugcuacauaugucaacacugaggguagagcucagcagacuaagguagcagugacaccuccuggcuuggcaagagaagacuggaaaauuauaagagcacucucugagauugcuggaaugacucuuccauaugauacucuggaucaaguaaggaacagauuggaagaagucucuccuaaucuuguucgauaugaugauauugaaggggcuaauuacuuccagcaagcaaaugagcucucaaagcuagugaaccagcagcuucuugcugacccacuuguuccaccucagcuaacuauaaaagacuucuacaugacagauucaauuagcagagccucacagacaauggccaaaugugucaaagcugucacagagggugcccaggcaguagaggaaccauccauaugcugaagcuucuacuaggaucccaguuuugccgcagauaauuaauggacaacuguagugcagugauccuuuacagguuuauuucuuuguaaaaaaaaauaauaauaauuugaaucauguaauauuuaagguuauacuaugccuauuugaaaaugauauuaguuaucaacuuugcaguuugaaaaacauguauuguguguaaagguuaaauaacaaaacuaugcagaugcucuuaaaagcauugauaaccuuugugacgaacauaaagagauccuuaaauuaugaguuguuggcuuaucuucauaaauaauuugucuguaaaauggaugaaaugaaaagagguucaauuaaaaccuacuuuuuucuagugcuaaagaaaagauuuaagcaccuugucaagcuggguaaauaggaaaaauacauaaucaugcucagauauguaucuaggauaauuauaauuaauaauaaucauaguaacaauggcuaaugauaauuuagcuuuauuauaugugcuaagcacucugguuuuacaugcauuaucuucuuuuguucuugcuacaacccugugagauaguaguauuaucucauuuuacugaugaagacugaagccuagguauauuaaauagcuugcccaaggccacacagcaaaagucaccaacucaaaccuacuucuuauuuacuccaaagccuguuguucuuaacugcaacauauuauuucgucucauuaauguugauucuauagguuguuacuucuaaaaauuaguauugaguuuaauggugaacacauuuuucuauuuucucuugaaucugcuucuauaaugucauggugauuuauguggcuuuuuuuuuuuuauaaguuauacauguaugcauguauacuuaugagaccucccuuggaaugagggaggucucaagagauauaauuuagauucucauugauguucuguauucauuauccuaacaccaucuguaguguuaaaucaacuaaauuauuucagcaauaggagacaaaacaaccagcuuucauaauuuuuaauugucaaaaccaaaaggaaucagaauaaggaucacugagaauuuaaaaaaauaaaaaaggaaguaaaaauuuuacaauuaggagauaauuaaaaauagauaauuuuuuuuuuuaaucuaagguugggugugguggcuuacaccuguaaucccaacacuuggggggccaagguggguggaucgcuugagcccaggcaguuggagaccagucugggcaacauggugaaaccccaucucuacaaaaaauacaaaaauuagcuggguguggugguguacaccuauagucccagcuacucggaaggcugaggugggaggaucaccugacccaggagguugaggcugcuacuggggaggcugaagcaggaaaaucgcuugaacugagagucaaggcggaggucgcgguaagccgagaucacaccauugcacugcagccugggugaagaaacaagccucccucucaaaaaauaaauaaauaaauaaauaa

SEQ ID NO: 287 - RNA, 70 nt, Homo Sapiens
aagggcuuagcuuaauuaaagugguuuauuugcguucaacugaugcagaauagagucuugcagcccuuag

SEQ ID NO: 288 - RNA, 69 nt, Homo Sapiens
cuuuuaaaggauuagaguuaccguuggucuugggaacuaaaaacauuggugcaacuccaaauaaaaaua

SEQ ID NO: 289 - RNA, 72 nt, Homo Sapiens
uggaggugaugaacugucugagccugaccuuguagaauggaggcaaaaaaacugauuuaaugagccugaucc

SEQ ID NO: 290 - RNA, 930 nt, Homo Sapiens
gcuguggcccuggcaccugccccugggcugggacagcccacuguuccaugcugcccaagaaggcucagcacaggcacaaaccauugcccggcacuggcccgugcugccugagaaggauuggcacgggcacagaccacugcccccaccugcccugcgccaucuacccaagaaggcucggcacgggcaccaaccacugccuccaacugccccaugcugccugagaaggcacugcacggccacccccaacugccccgcacugucccuacccgggcagccaugcgagcggcuggaacucugcuggccuucugcugccuggucuugagcaccacugggggcccuuccccagauacuuguucccaggaccuuaacucacgugugaagccaggauuuccuaaaacaauaaagaccaaugacccaggaguccuccaagcagccagauacaguguugaaaaguucaacaacugcacgaacgacauguucuuguucaaggagucccgcaucacaagggcccuaguucagauagugaaaggccugaaauauaugcuggagguggaaauuggcagaacuaccugcaagaaaaaccagcaccugcgucuggaugacugugacuuccaaaccaaccacaccuugaagcagacucugagcugcuacucugaagucugggucgugcccuggcuccagcacuucgaggugccuguucuccguugucacugacccccgccucuucagcaagaccacagccaugacaaacaccaggaugcaugcuccuuguccccucccacccgccucaugacccagccucacagacccucucaggccucugacgagugagcgggugaagugccacugggucaccgcagggcagcuggaauggcagcaugguagcaccuccuaacagauuaaauagaucacauuugcuucuaaaauuaa

SEQ ID NO: 291 - RNA, 833 nt, Homo Sapiens
gcggcccccgcgcauauaagugggcgcguccgcgcgugcgcaccccgcgcgcgccucuaucccaccagccagcaagcuaaagcauggcggccauccccuccagcggcucgcucguggccacccacgacuacuaccggcgccgccuggguuccacuuccagcaacagcuccugcagcaguaccgagugccccggggaagccauuccccaccccccaggugagugcaggaucgccccuuucuccccccgcuccuccaggagcuggcagcaucaagaccccacuucgcuucucucaggucuccccaaggcugacccgggucauuggugggccagcuucuuuuucgggaaguccacccucccguucauggccacgguguuggaguccgcagagcacucggaaccuccccaggccuccagcagcaugaccgccuguggccuggcucgggacgccccgaggaagcagcccggcggucaguccagcacagccagcgcugggcccccguccugaccugagcgguuaccaccagccccaggccugcggaggcgcuaguccaccagagccccuccccgccccucuccccacuccgcaucccucgccccccuccccaccucccaccccccacccuguaaacuaggcggcugcagcaagcagaccuucgcaucaacacagcagacaccaaaaaccagugagagccccgcucucuaccgcccggccccagcacucgcuagcuuuccugacaccuggaacugugcaccuggcaccaagcggaaaauaaacuccaagcagccaguagccccgauggugugugccugagcuguguggcccgagguucca

SEQ ID NO: 292 - RNA, 104 nt, Homo Sapiens
guacucacuuuggcagcacagauacuaagagugaaaugauacagagauuaguauggccuguguacacggauggaaugcaaauuugugaugcauuccauauauuu

SEQ ID NO: 293 - RNA, 100 nt, Homo Sapiens
guuugguccgagugcagcaguguuuacaacuaauugaucgcaaucaguuacagguuuuuuuguuccuucucuacucccacugcuucaauugacuaguuaa

SEQ ID NO: 294 - RNA, 1713 nt, Homo Sapiens
ggcugguuuggauccgggucagucgggugccgagauuugggagagacgcucugaacugacugccccgcaucaccggagcgucccagcugcgaggaggaaagaacuuugugcuuuggcugcagcgcugcgaguauaaagggaugaguggguugcacggagagggcuaugaagaaaaacacaaauggaaguaucaaccuuacugguuucuagaccaacuggggagauucccguuaaaaauguaaacaggaacaucgauaaguaguguaaaaacuugcacaaugaaauccgaagccaaggauggagaggaggagagucuacagacugcuuucaaaaaauuaagaguggaugcaucagggucuguagcaucucugucuguuggagaaggcacaggugucagagcaccagucagaacagcaacagaugauaccaaaccuaaaaccacaugugcaucuaaagacaguuggcacgggucuacaaggaagucuucacgaggagcagugagaacucagcgucgucgacguucuaagucuccuguccuucauccuccaaaguuuauacauugcaguacaauagcgucuucuuccagcagucaacucaagcacaaaagccagacugacucaccugauggcagcagugggcugggaauuucauccccuaaagaguucagugcaggagaaagcucuacuucucucgaugcuaaucacacaggggcagucguugagccuuugagaacuucuguuccaaggcucccaucagagaguaagaaggaagacuccucugacgcuacccaagucccccaagcaagucucaaagccagugaucucucugacuuucaaucaguuuccaagcuaaaccagggcaagccaugcacaugcauaggcaaggaaugccaguguaagagauggcaugauauggaaguguauuccuuuucaggccugcagagugucccucccuuggcuccagaacgaagauccacacuugaggacuacucucagucgcugcacgccagaacucugucuggcucuccccgauccuguucugagcaagcucgagucuucguggaugaugugaccauugaggaccugucaggcuacauggaguauuacuuguauauucccaagaaaaugucccacauggcagaaaugauguacaccugauagcaagaagcuaauucauaugcuuuaaaccaaugaaggcuugucaaagagauuuaguuaauggcagaccuuguggccacuuugugugagaagacaucucuuucugcucacugugcuugcaauaaaaacuuuucuuggcaucucaguuaaucuucauucuuucaacuuacucucuugaguucuuacauacacuucaaggcgagcagaucaaagaaaaaucccccuuauuuagaaauguuccugggggaugaagaaaccauaauuacuugagacuggcagcaguggguauaugguaaaagccuuuguaaaacagugcauuuuucagauuuguuuaagguuugcuagccaaggaaaguaaaaugugauuuuguaacugcacuaaacauuugucaugcuguaguugccagcccagaauauuagaaguuacaagacugauuuaaaccgucucugauuuaaugcaagauauauugugucuauaaagguuucucuuguuauuguuaagccagagaucuaagguuuagauucaauuugaauaaacuagcuggccugcccucua

SEQ ID NO: 295 - RNA, 3742 nt, Homo Sapiens
cggccgccauugccucgugcccgcgccggucgguugguggcgccuuuguccuacggcgggcaggugggccgacgcggaggcggcagcggcgggccugaggcgaaggagcggccgggagcccgccgcgcugguagcgggaggcccugcuucaugggauauuggaaguuuuaagacaaugaaauccagcuauuacuucuuaguaacauaaaauagaauuauuugccuuugcucuuuuguuuuuuaaacucuccuuaucuucccccccacuuucuuccucacaaaaagaaucuuacagcugcuuucuaagaguuuagaaaacaaccuuuuccuccccuuggagggaaugugucaggucuaggucuuggcagcguguuaaagcauugacguaauuaguuuaagacaaauuacguguuaacuagaaaacgaagggacauuucuuaccaagccgugacaauguacuaccuuaacucaauaauaaaaauugcccaagugacagugugucucugcugaauggcuuuucuuacaccaucugguugucauuguaguuuuuguuguuguugcuuucauuugaaaugugcugaugaucuuguuuuuauuccguagcauugaacagauggguugauuauucuuuucagauauuaauaaggcagcggaaagaagaaauaugaauacggcuccaucaagacccagccccacacgaagggauccauauggcuuuggagacagucgagauucaaggcgugaucgauccccaauucgaggaaguccaaggagagagcccagggauggcagaaauggccgggaugcccgggacagcagagacauucgagacccccgagacuugcgggaccacagacauaguagagauuugcgggaucacagagacagcaggagugugcgcgacguucgggacgugagggaucuuagagacuuucgugaucuaagagacucuagggauuuucgagaucagcgagaccccauguacgacagauacagagacaugagagacucccgagauccuauguacaggagagaaggcucuuaugaccgauaccuacgaauggaugacuauugcaggagaaaggaugacucuuauuuugaccguuacagagauagcuuugauggacggggcccuccaggcccagaaagucagucucgugcaaaagagcguuugaaacgugaggaacggcguagagaagagcuuuaucgucaauauuuugaggaaauccagagacgcuuugaugccgaaaggcccguugauuguucugugauuguggucaacaaacagacaaaagacuaugcugagucuguggggcggaaggugcgagaccugggcaugguaguggacuugaucuuccuuaacacagaagugucacugucacaagccuuggaggauguuagcaggggagguucuccuuuugcuauugucaucacccagcaacaccagauucaccgcuccugcacagucaacaucauguuuggaaccccgcaagagcaucgcaacaugccccaagcagaugccauggugcugguggccagaaauuaugagcguuacaagaaugagugccgggagaaggaacgugaggagauugccagacaggcagccaagauggccgaugaagccauccugcaggaaagagagagaggaggcccugaggagggagugcgugggggccacccuccagccauccagagccucaucaaccugcuggcagacaacagguaccucacugcugaagagacugacaagaucaucaacuaccugcgagagcggaaggagcggcugaugaggagcagcaccgacucucugccuggugagcuacguggcagggccgaggcccgauuucccgccaaccacucggggcgaccucgggugccucgcugaagacacagccaagcucccaaccgcuccagagcggccaagugcuccccucugcuacacccacuccaucugcaccccccaccucccagcaagagcuucaggccaaaauccucagccucuucaauaguggcacagugacggccaauagcagcucugcaucccccucgguugcugccggaaacaccccaaaccagaauuuuuccacagcagcaaacagccagccucaacaaagaucacaggcuucuggcaaucagccuccaagcauuuugggacagggaggaucugcucagaacaugggccccagaccuggggcuccuucccaagggcuuuuuggccagccuuccagucgccuggcaccugcuagcaacaugacuagccagaggccugugucuuccacagguaucaacuuugacaauccaaguguacagaaggcucuggauacccugauccagaguggcccugcucucucccaccugguuagccagaccacagcacagauggggcagccacaggcccccaugggaucuuaccagaggcauuacugaagcuaaaucuuucaacucuccccaguccccucauccccuggccuccucccacuuacuuguucuaaauagagcuguuuggaggauguucucugcgcucccaggccggcaucgagugucaucaauuucuaccaccugcucucucuucugcccaaggcuguguugcuuauuccuuacaaaguuuauacugcauuuggggcuguaucuuuuuuuguuuuuuguuuuguagaaaauaaauaucuccgggggcaguacaggugucugggcuuguauuugaugggguuucuccggucccuguuucuacuggauuuggagccaggcccagcuagccaaguuuggaauggcauuugucaugucaguagccaccaccuuuguucauugugaaccuaccaaggcuuuccagcuucauacacauugaccagagcucaagcuccugccugcaacuccugccuagaguugaagaaaagcaaacuggccuuggcaggcacagugucaucauacccucaccccauauguuuggggucugcuugaggauucauaaaucagccacucuggauuguugaggaauggccauggcagccacagaaaaaagaauuuuucucucugagccaagguuguuuuuuguuuuuuucucuuuucuuuuuuguuuucauuucauuggaagaucuccaauggacugaacagcuccagucagcagcaguuaccacaaacugugaaucugggccccaccacucuucccuguuaaccaguucugucagcaucccccucuccagcagcacuuccaugaaguugguucugagacucuggccgugaacacccguuucuucagugauuuguuuugggcuuuuggcucaaaaccccaggcucuuguuuuugucuagacucuuauucuguuuccugagcagcaggagguagggaccacuuugaugucagacuucugguagcuggacauguucucgagauggguggcuguucgcgacuuuuguaccagagugaaauuguuagaaggaggguuucuggcugugguucuaaauggagccccaggaagcugcccucuccccaggguuugugcucaguagagcccuguggaucacagucuugagguccucuagcaggggugagggagagcagcgacuucagcugagucccugccagugguuaagcaaacaaugguuucaaaauucaagguccccaaauggcagcauuuuauguucugaccuguuuguguuauauagugguuuuuuuuuuccucuuuggaacucuuguguuguuaauaaaaugaaaugauuacuuuuuaauuaaaaugaaaaaaguaaaa

SEQ ID NO: 296 - RNA, 7198 nt, Homo Sapiens
gccccgcaucgugcccggccccgucgcggagaucccggacgaccgucgcggguugauggucgcauuccagauguaaacagcuucagaagccugacggucauaugguagaaucacuguggacugagacccaccuuucuagaccugaagcccaggaggaggaagaggaggcugguugguaccaugggcauaaugcucugaauccuagucucucaccuaguaugugagcagucccugcagauggcccauuuggagaucuugacaaagccucuucuguuuccaaugggguuuuuggcgcauucucacagacuuagaugaaacugugauggccaccgcagggggcaggugcugacaucguccccagcccuguggcuguucauccggacaucauuuccaaccucaauaucuaaaugccacagugcucuuggagcaaguugggcuggggaccacuguugccuuuuaagaccauaaaaccaugggaaacgcagaaagucaacauguagagcacgaguuuuauggagaaaagcaugccagccuggggcgcaagcacacuucccgcucccugcgccucucgcacaagacgcggaggaccaggcacgcuuccucggggaaggugauccacaggaacuccgaagugagcacccgauccagcagcacccccagcaucccccagucccuggcugaaaauggccuggagcccuucucccaagaugguacccuagaagacuucgggagccccaucuggguggaccgaguggacaugggcuugagaccugugucuuacacugacucuucugucacucccagcguagacagcagcaucguccucacagcagccucugugcagagcaugccagacacugaggagagcaggcuuuacggggaugacgcuacauauuuggcugagggaggcaggaggcagcauuccuauacauccaaugggcccacuuucauggagacggcgagcuuuaagaagaaacgcuccaaaucugcagacaucuggcgggaggacagccuggaauucucacucucugaucugagccaagaacauuuaacaagcaacgaagaaaucuuggguuccgccgaagagaaggacugcgaggaggcucgggggauggaaacgcgggcgaguccgcggcagcucagcaccugucagagagccaauuccuugggugacuuguaugcucagaaaaacucuggagugacagcaaacggggggccggggagcaaauuugcaggcuacugucggaauuuggugucugauauucccaaucuugcaaaccauaagaugccaccagcugcugcugaagagacuccuccguacaguaauuauaacacacuucccuguaggaaaucucacugucucucugaaggugccaccaacccacaaauuagccauagcaacagcaugcaaggcagaagagcuaaaacaacucaggauguuaaugcaggcgagggcagugaguuugcagacagugggauugaaggggccacuaccgacacggaccuccuguccaggcgaucuaaugccaccaacuccagcuacucacccaccacaggccgggccuuugugggcagcgacagcggcagcagcuccaccggggaugcggcucgucaggggguguacgagaacuuccggcgggagcuggagaugagcaccaccaacagcgagagccuggaggaggccggcucggcgcacagcgaugagcagagcagcggcacccugagcucuccgggccagucggacauccugcugaccgccgcacagggcacggugcgcaaggccggcgcccuggccgucaagaacuuccuggugcacaagaagaacaagaagguggagucagccacccggaggaaguggaagcacuacugggugucccugaaaggaugcacgcuauuuuucuacgagagcgacggcaggucugggauagaccacaacagcauccccaaacacgccgucuggguggagaacagcauugugcaggcggugccugagcaccccaagaaggacuuugucuucugccucagcaauucccugggugaugccuuccuuuuucagaccacuagccagacggagcuugaaaacuggaucaccgccauccacucugccugcgccacugcggucgcgaggcaccaccacaaggaagacacgcuccgacuccugaaaucagagaucaaaaaacuggaacagaagauugacauggaugaaaagaugaagaaaaugggugaaaugcagcugucuucagucacugacucaaagaaaaagaaaacaauauuagaucagaucuuugucugggagcaaaaucucgagcaguuccaaauggaccuguuucguuuccgcuguuauuuagccagccuucaggguggggagcugccaaaccccaaaaggcuucucgcuuuugcaagucgaccaacgaaaguggccaugggccgccuuggaaucuuuucgguaucaucguuucaugcccugguggcagcacgcacuggugaaacuggagugagaagacguacucaggccauguccagauccgcgagcaagcgaaggagcagguuuucuucucuguggggucuggauacuaccuccaaaaagaagcagggacggccaagcaucaaucagguguuuggagagggaaccgaagcuguaaagaaaucuuuagagggaauauuugaugacauuguuccagauggcaagagggagaaagaaguggucuuaccuaacguucaccagcacaacccugacugcgacauuuggguccacgaguauuucacuccauccugguucugucugcccaauaaucagccugcccugacggucguccggccaggcgacacugcacgggacacccuggagcugauuugcaagacacaucaacuggaucauucugcucauuaccugcgccugaaauuucuaauagaaaacaaaaugcagcucuauguuccacagcccgaggaagacaucuaugagcugcuguacaaagaaauugaaaucuguccaaaagucacucagagcauccacauugagaagucagauacagcugcugauacuuacggguuuucacuuucuucuguggaagaagaugguauucgaaggcuguacgugaauagugugaaggaaaccgguuuagcuuccaagaaaggccugaaagcaggagaugagauucuugagaucaauaaucgugcugcugacgcccugaacucuucuaugcucaaagauuuccucucacagcccucgcugggccuccuggugaggaccuaccccgagcuggaggaaggaguggagcugcuggaaagcccgccccaccgaguggacggcccugccgaccuuggcgagagcccccucgccuuucucaccagcaacccagggcacagccuuugcagcgagcagggcagcagugcugagaccgcuccagaggagaccgaggggccagacuuggaauccucagaugagacugaucacagcagcaagaguacagaacagguggccgcauuuugccgcaguuugcaugagaugaaccccucugaccagagcccaucuccucaggacuccacggggccucagcuggcgaccaugagacaacucucggaugcagauaagcugcgcaaggugaucugcgagcuccuggagacggagcgcaccuacgugaaggauuuaaacugucuuauggagagauaccuaaagccucuucaaaaagaaacuuuucucacccaggaugagcuugacgugcuuuuuggaaauuuaacggaaaugguagaguuucaaguagaauuccuuaaaacucuagaagauggagugagacugguaccugauuuggaaaagcuugagaagguugaucaauuuaagaaagugcuguucucucuggggggaucauuccuguauuaugcugaccgcuucaagcucuacagugccuucugcgccagccacacaaaaguucccaagguccuggugaaagccaagacagacacggcuuucaaggcauucuuggaugcccagaacccgaagcagcagcacucauccacgcuggagucguaccucaucaagcccauccagaggauccucaaguacccacuucugcucagggagcuguucgcccugaccgaugcggagagcgaggagcacuaccaccuggacguggccaucaagaccaugaacaagguugccagucacaucaaugagaugcagaaaauccaugaagaguuuggggcuguguuugaccagcugauugcugaacagacuggugagaaaaaagagguugcagaucugagcaugggagaccugcuuuugcacacuaccgugaucuggcugaacccgccggccucgcugggcaaguggaaaaaggaaccagaguuggcagcauucgucuucaaaacugcugugguccuuguguauaaagaugguuccaaacagaagaagaaacuuguaggaucucacaggcuuuccauuuaugaggacugggaccccuucagauuucgacacaugauccccacggaagcgcugcagguucgagcuuuggcgagugcagaugcagaggcaaaugccgugugugaaauuguccauguaaaauccgagucugaagggaggccggagagggucuuucacuugugcugcagcuccccagagagccgaaaggauuuccuaaaggcugugcauucaauccugcgugauaagcacagaagacagcuccucaaaaccgagagccuucccucaucccagcaauaugucccuuuuggaggcaaaagauugugugcacugaagggggccaggccggccaugagcagggcagugucugccccaagcaagucucuugggaggaggaggcggcggcuggcucgaaacagguuuaccauugauucugaugccgucuccgcaagcagcccggagaaagagucccagcagccccccggugguggggacacugaccgauggguagaggagcaguuugaucuugcucaguaugaggagcaagaugacaucaaggagacagacauccucagugacgaugaugaguucugugaguccgugaagggugccucaguggacagagaccugcaggagcggcuucaggccaccuccaucagucagcgggaaagaggccggaaaacccuggauagucacgcgucccgcauggcacagcucaagaagcaagcugcccugucggggaucaauggaggccuggagagcgcaagcgaggaagucauuuggguuaggcgugaagacuuugcccccuccaggaaacugaacacugagaucugacugcgucaccugccccguagagaauguguguagauacuuccugcccuaacucugcccacccuccuguaccgucgacaagaauguccccuuaggucgcgcucuugcacacacgguuuuggcagcugacuugguucugaagccauguagccacccaacuuugucauuuucaacaacaucagaaagaauugaucagaaucccaaauaagcuugaguccuaucuucuguauauuacuaagggcuuuuauuuauucucaauaaaucagggccugaacaauuaaaagaaaaaagauucuauagcacuggaaagcaaaucaccccaggaguuaacggauguacaacagauuaauuuaagggauaguagcacacacacgauccuucuaucugaaaucagucuccuagcuggggaaaccucuuucacacacaaaaugaaauguguacagcuugccguguucugacuguacccuucccucuuccaugucugagaaucuccguguauuuuaagaaugugugaggagaggguggcgauucauguuucaaugagccucuuuuuuuuuuuccuuccuguuuuggucuauggcuggucuuacucuguguccauguucggaagcucuaguuuugcauagaauuauagagaugccaaacucuuugaaaagagauccaaauuuaucgcuugagagaaagaaaagaaacacuauuuuuuguauuuuaccugagauacaggggcacaaauagaugagaauuuuacaguguuaguguauguaucccugagccuaaaaaaugaggauauaaccuuuuacagagagagugaggcguggugguuuuauauuuauauaugaaaggccagcaagcucaugcgaaggauauacuuuucuuccaaaaagcggauuuuuuuuuuuuaauguuugaaucuauauuugagaugggaguuugguuggauuaaacaugacaccccggugggcggugugugugucuguugcacauggcagggaggggagccuccuucucaugggguugccauggugaucauugguuuuuccaucaaaauugcaucuucauccauagauuaccuuccccuucccugacaguccauaaccaaaccuuuaaacagaacaaccucuuuaaaaacuucucuuguguuuaacacuuucuucaugccaacgaaacaggguaaacaugcucaaaacauuaacagucuaaacagauauccaaauacuaagaagaaaaacaaguuauagcacuuucaauuuuuuuuuuuuuuuuaaaaaaagguuuauagcuuuuucuuuucccaugucacaauguccacuuccuaagaaggguuuaaaauacuaugaaaacuuucuuuuuggggaaaauaucuauuugguguuugacacaucaguagguacuuuaaagaccugaauuuuauaguagcuuuaggaguuauauuuuauaaaaaucaguuaugacuuuauauuuccagacaauagagaguucaguacaucaugcucuugugccucugccugcuuuuccugcguucccacccuguauuccccccgccuuucggguuuccagggcuucgagcuugaucuuuugaaaguuuuauucuauuaaauuuuugcuauaucuucugguuuucugaaaaagcuuuagaaugguuucuauacccuuuguaucacugcauuuuuccauaucaucuccgguucgaucgcguccagauggaaaacggaagcagaggcuucuaaucgucgcauuuacuggcuccagugcaacacauccaucugaaaacacucggaagucuggugcuuggagagggugccauugucucuuguacauaaggucaugacgugucuaugucaaaaguucuuauauauuucuuuuauaagcugaaagaaggucuauuuuuauguuuuuaggucuaugaauggaacguuguaaaugcuugucaaacaauaaaaauaacgaaaagug

SEQ ID NO: 297 - RNA, 2109 nt, Homo Sapiens
gguaaagaccuagaggugaggucucugagcaagggagucccaucccauccucugcccucuguuggcuguuguccucucaucuucaucaggagaauuaaaaucauagaauguuguacugacgacacaagaucucagacuugugugauucuagcagcugaacacaccccaggcucuucugacuggcaguggcucuggaagcagucuggucuauagaguuauggauucacuaccagauucuacuguaugcucugacaacuaugaccacaauggcagcaagauuaagaaaauugugcauucaauuauaucauccuuugcauuuggacuauuuggaguuuuccuggucuuacuggaugucacucucguccuugccgaccuaauuuucacugacagcaaacuuuauauuccuucggaguaucguucuauuucucuagcuauugccuuauuuuuucucauggauguucuucuucgaguauuuguagaagggaaacugaacugaacugaaguccaggucuucuguaauagagugucucuccuucaacagggaacaacacuacagucgcccguaguuuuguuucuguucagucuccauuguggcaugccacacucuccugguuugggcccugcucauuucuuuacugccuuccugccugcccuuuuugugcagguggauucuugcucugucacccaggcuggagcguaauggcacaaucuucgcucacuucaaccucugccuucuggguucgagcaauucuccugccucagccuccugaguaacugggauuacagggcaugguggcacacaccuguaaucccagcuacucgggaggccgaggcaggagcauugcuuguacccaggaggcagagauugcagugagcugagaucacgccauugcacuccagucugagcaacaagagcaaaacuucgucucaaaaaaauaaaaaauuaaaaaauaacaaaaaaugagacagaaaacucauccacaccgcucagcacgaaggccuuguucucaggggccugcuucucaaugaggcggaucugcuugagguuggcauggggcccaaugcccaccgggaucacgaugaccuucuucuucuucaggcccuggacguagcggacaaaguuccgggacauccguuggggcuccuggcuggccaucaggagcagggcgaugcggaaggcuucagggcggucgaucuugcugaugauuuggaacaguguguauuucaaggccucgcugguggaggccaccuggcugcccgcauacuucaccuggcuggcaacgcgccgcagcucugacggucgcuuccgguccuugagcccgauguaggcgugggagccgucgugguacuccaccacagccacgcggacccacuucuaggagaugcgcagccgcuccaucauguccaccacaaaggccuucagcacuucaaacucagccucggacagccuggaggagccauccagcaggaagaucagguccaguagccugcugcaguagaaaucgugcaacagcgguucugagauguccuccacauacagagugguggggcucaccggggcaucugugggagguaccaccaggccucccggcuccuggcaggcuucacaggugagggugacaccaucacaguggcugcagaaaagagcgaagaaauuaaaaugguucagaaagaaccuauggacacuucugagcccuacaguguaugacuacuuccauauucccacagaaucuccucuguuccaccugaacuugagaucccacggaccauuccacacccaagugagaugucacuguuuaacaucuguccccaaauagcaugcccccccacuucaaaacacacacauagccgacuuccuuugauucuagaaaccaaagcuuuagcccauccuaggauaugaaaaaauauacucguuguucuaggccauccacacagccacucaaagcugauuucuuuucaaccuacaucuuuagcaacaugaauacuuaauuauaaucuaagccuucuuacaagugucuccaagaacaaauguuacuaaaauguagacgcuaaccugugcuuguacauguucuguugaagauaaaugcuuuacaguacauauucuaacag

SEQ ID NO: 298 - RNA, 958 nt, Homo Sapiens
aguaagccgggcugccgucuucucgccaugggcuccgggccgcgcggggcgcugagcuuacugcuccugcugcuggccccgccgagccgcccggccgcagguugcccggcgcccuguagcugcgcggggacgcucguggacugcgggcgccgcgggcugacuugggccucgcugccgaccgccuucccugucgacacaaccgagcuggugcugaccggcaacaaccugacggcgcugccgccggggcugcuggacgcgcugcccgcgcugcgcaccgcacaccugggcgccaaccccuggcgcugcgacugccgccuugugccgcugcgcgccuggcuggccggccgccccgagcgugcgcccuaccgcgaccugcguugcguggcgcccccagcgcugcgcggccgccugcugcccuaucuggccgaggacgagcugcgcgccgcuugcgcucccggcccgcucugcuggggggcgcuggcggcgcagcuugcgcugcugggccuugggcugcugcacgcguugcugcuggugcugcugcugugccgccugcggaggcugcgggcccgggcccgcgcucgcgccgcagcccggcugucgcugaccgacccgcugguggccgagcgagccggaaccgacgaguccugaggagagaaccggugcguccugaggagagaaccggcgcugggcaacacgggccugcaaacucgacaggacccugcccgaggggcccucgcgccaaccuggaccgguccccgccuccuccgcugcccaaucucucagacccaccccaccugcaggcccagaccacgugggacagaacuccugcccacccuaccccgagggaggcgaacccgcacuuccaggcuugggaggaccauggggcacaaugcgguccagacccugcugcgucucccuuccaaacucuggugcugaauaaacccuucugaucuggucu

SEQ ID NO: 299 - RNA, 2330 nt, Homo Sapiens
ggaagaaacacagauggcggcggcgcagcgccauuccgggccgggagcaggcagccagcagcccuguccucaccgcgguccgcccgccgccgcuaaauacccggaugcgccgcccaagcgccagacgcggagcugggaaaagggaggcagaggaggcggaggcagaggcagaggcagaggcagagcccgagcccggugccgagaccaagcgacagaccggcggggcugggccucgcaaagccggcucggcgagcucucccgacacccgagccggggaggaaaagcagcgacuccucgcucgcauccccgggagccgcacuccagacuggcccgguagucaggggcucaggagcagaucccgaggcaggcuuugcucagccuccgacgagggcuggcccuuuggaaggcgccuucaacagccggaccagacaggccaccaugaccgagaauuccacguccgccccugcggccaagcccaagcgggccaaggccuccaagaaguccacagaccaccccaaguauucagacaugaucguggcugccauccaggccgagaagaaccgcgcuggcuccucgcgccaguccauucagaaguauaucaagagccacuacaaggugggugagaacgcugacucgcagaucaaguuguccaucaagcgccuggucaccaccgguguccucaagcagaccaaaggggugggggccucgggguccuuccggcuagccaagagcgacgaacccaagaagucaguggccuucaagaagaccaagaaggaaaucaagaagguagccacgccaaagaaggcauccaagcccaagaaggcugccuccaaagccccaaccaagaaacccaaagccaccccggucaagaaggccaagaagaagcuggcugccacgcccaagaaagccaaaaaacccaagacugucaaagccaagccggucaaggcauccaagcccaaaaaggccaaaccagugaaacccaaagcaaaguccagugccaagagggccggcaagaagaagugacaaugaagucuuuucuugcggacacucccuccugucuccuauuuucuguaaauaauuuucuccuuuuuucucucuugaugcucaccaccaccuuuugcccccuucuguucugacuuuauaagagacaggauuuggauucuucagaaauuacagaauaauucauuuuuccuuaaccaguugugcaaggacagcaacaaccaaucuaaugaugagaauguacuuauauuuuguuuugcuauuaaccuacuuacgggguuagggauuugcggggggggcuuguguguuuuguuggcuuguuugccaugaagguagauguggguggggagaagacacaaggcaguuuguucuggcuagaugagagggaacccaggaauugugagguuagcaggaauaucuuuagggugagugaguuuucuuugaguugggcacccguugugagaguuucagaaccuuuggccagcaggagagaggugguagggagcagccagccggcaaaggaaggagggggaaaaaaaccgccaccgggcugacuuccaccucccaguggugagcagugggggcccaaacccaguuuccuucucauuuuuguuaguuugcgcuuucggccucccuauuuucuuagggaaggggagugggguccaagugacagcuggaugggagaagccauaguuucucccagucagcuaggauguagccauugggggaucuuuguggcuucagcaaauucucuuguuaaaccggagugaaaacuucaggggaaggguggggagucagccaagugccucagugugcccuguugaaacuuagguuuuuccacgcaaucgauggauuguguccuaggaagacuuuucuuuuccucuggauuuuuguuccuccuguacaagaggugucuuugcuugguuugguggggcugcggccacuuaaaaccucccgaucucuuuuugaguccuuuauuauaaguaguuguagcugcgggagggggagggggagugggcgggcaguggauaguaagacuuacugcagucgauuugggauuugcuaaguaguuuuacagagcuagaucugugugcauguguguguuuguguauauauacauaucuagggcuaguacuuaguuucacacccgggagcugggagaaaaaaccuguacaguugucuuucucuuauuuuuaauaaaauagaaaaaucgcgcacuugcgcgucccccccccacccccuuuuuuaaacaaguguuacuugugccgggaaaauuuugcugucuuuguaauuuuaaaacuuuaaaauaaauuggaaaagggagaaacuga

SEQ ID NO: 300 - RNA, 149 nt, Homo Sapiens
ugccuuaaacuuaugaguaaggaaaauaacgauucggggugacgcccgaauccucacugcuaaugugagacgaauuuuugagcggguaaaggucgcccucaaggugacccgccuacuuugcgggaugccugggaguugcgaucugcccg

SEQ ID NO: 301 - RNA, 866 nt, Homo Sapiens
cggggcggaugcggggacagcggccuggcuaacuccugccaggcagugcccuucccggagcgugcccucgccgcugagcuccccugaacagcagcugcagcagccauggccccgcccugggugcccgccaugggcuucacgcuggcgcccagccuggggugcuucgugggcucccgcuuuguccacggcgagggucuccgcugguacgccggccugcagaagcccucguggcacccgccccacugggugcugggcccugucuggggcacgcucuacucagccaugggguacggcuccuaccuggucuggaaagagcugggaggcuucacagagaaggcugugguuccccugggccucuacacugggcagcuggcccugaacugggcauggccccccaucuucuuuggugcccgacaaaugggcugggccuugguggaucuccugcuggucaguggggcggcggcagccacuaccguggccugguaccaggugagcccgcuggccgcccgccugcucuaccccuaccuggccuggcuggccuucacgaccacacucaacuacugcguauggcgggacaaccauggcuggcgugggggacggcggcugccagagugagugcccggcccaccagggacugcagcugcaccagcaggugccaucacgcuugugaugugguggccgucacgcuuucaugaccacugggccugcuagucugucagggccuuggcccaggggucagcagagcuucagagguggccccaccugagcccccacccgggagcaguguccugugcuuucugcaugcuuagagcauguucuuggaacauggaauuuuauaagcugaauaaaguuuuugacuuccuuua

SEQ ID NO: 302 - RNA, 72 nt, Homo Sapiens
uaggaugugguguauuauguagcacggagaauuuuggauucucauggguagguucaauuccuguaauucuag

SEQ ID NO: 303 - RNA, 105 nt, Homo Sapiens
gugcuugcuucagcagcacauauacuaaaauuggaaugauacagagaagauuagcauggccccugugcaaggaugaugcaaauucaugaaauguuccauauuuuu

SEQ ID NO: 304 - RNA, 447 nt, Homo Sapiens
augaagugcaucuugguggccauugagggcacagaggcccucuucuacuggacggaugaggaguuugaagagagucuccagcugaaguucgggcagucagagaaugaggaagaagagcucccugcccuacaggaccagcucagcccccuccuagccccggucaucaucuccuccaugacgaugcuggagaagcucucggacaccuacaccugcuucuccauggaaaacagcaacucccuguauguccuucaccuguuuggagaaugccuguucauugccaucaauggcgaccacaccaagagcgagggggaccugcagcggaagcugucaugguuucagcugcggcccccagaccuggggcagcguguccagcugugggagcacuuucagagccugcuguggaccuauagccgccugcgggagcaggaacagugcuucgccauggag

SEQ ID NO: 305 - RNA, 1184 nt, Homo Sapiens
gagagccucagagucauccucccgcccacccagcauacaggcggggcguuccuccuuagccaaugggaaaagacauucgcccgcgguccgcacgcgcugcuugcaaaggggugggguuguggaguggaugcuuuggcaagauggcggggagcggcguccgccaagcuacuucuaccgccagcaccuucgugaagcccauuuucagucgggacaugaacgaggccaagcggagggugcgcgagcucuaccgcgccugguaucgggaggugccgaacacugugcaccaauuccagcuggacaucacugugaaaaugggacgggauaaaguccgagaaauguuuaugaagaaugcccaugucacagaccccagggugguugaucuucuggucauuaagggaaagaucgaacuggaagaaacaauuaaaguauggaagcagcggacacauguuaugcgguucuuccaugaaacagaagcgccaaggccaaaggauuuccuauccaaguucuauguuggccacgauccaugaagucauucaguggaaagaugcacguugauacuauuuuagagcacaaauaaacucacuauacaauggucacuuugugauagaauuccauugaugaaccaauuuucugcagccucuuuuugccugagcaagugggaccuugguauacacaucaccuguucuuucccuuuucuugaaaugugguguuugcuguaaauuggauugaauuauuuuucucagagccuugcaugucaguaaacaggaaggaaggaggccaucuguucaaaaauugugacauugggcaugaggcuggacgacuuguuaauguaguuguuucuauagccccuaugauuagacacuucagugucagggcacagauuaucuaaaauuagccagcucuuccugucagggaucagggcagcacuaacaggcgcaaaaguagagcugucaagaugggcuaguuuuccuuggguucugaagaaaauggaugugcaaaggcuuggcuccgcuacuuguaacaagcuccagcccuuaaaaugaaauuaacuuccuacucaggcacccugcuuaggugcacagcuguucaauauacacagagaacagaaauauuccuacugucuuuggaaacccugguguaccucucaguggcagaauaaacaucaacacagguucaagaacuga

SEQ ID NO: 306 - RNA, 7407 nt, Homo Sapiens
gggccucugauucaucuuuauucccuccaucaucuagacuugauuuuauuuguaccaaggagaugcgugucuaauguuuuucuuucuucuauuucuaggagggcuguuggccugcugcugugcugcugaacaguaugcaguccuuucgggagcaaagcaguuaccacggaaaccagcaaagcuacccacaggagguacacggcucaucccggcuagaagaguucagcccucgucaggcccagauguuccagaauuuuggagguacagguggcaguaguggcagcaguggcaguggcaguggugguggacgacgaggagcagcagcugcugcggcagcgauggcuagcgagaccucuggccaucaagguuaccaggguuucaggaaagaggcuggagauuuuuacuacauggcaggcaacaaagaccccgugacuacaggaaccccacagccuccucagcgaaggccuucugggccugugcagagcuauggacccccccaggggagcagcuuuggcaaucaguaugggagugagggucaugugggccaguuucaagcacagcacucuggccuuggcggugugucacauuaucagcaggauuacacugggccuuucucuccagggagugcucaguaccaacagcaggcuuccagccagcagcagcagcagcaaguccagcaguugagacaacagcuuuaccagucccaucagccccugccacaggccacuggccaaccagcauccagcucaucccaucuacagccaaugcagcggcccucaacucugccauccucugcugcugguuaccaguuaagagugggucaguuuggccaacacuaucagucuucugcuuccuccuccuccuccuccuccuucccuucaccacagcguuuuagccagucuggacagagcuaugauggcaguuacaaugugaaugcuggaucucaguaugaaggacacaauguggguucuaaugcacaggcuuauggaacacaauccaauuacagcuaucagccucaaucuaugaagaauuuugaacaggcaaagauuccacaagggacccaacaggggcagcagcagcagcaaccgcagcaacaacaacacccuucucagcaugugaugcaguauacuaacgcugccaccaagcugccccugcaaagccaaguggggcaguacaaccagccugagguuccugugaggucccccaugcaguuucaccagaacuucagccccauuucuaacccuucuccagcugccucugugguucagucuccaagcuguaguucuaccccaucuccucucaugcagacuggggagaaucuccagugugggcaaggcagugugccuauggguuccagaaacagaauuuuacaguuaaugccucaacucaguccaaccccaucaaugaugcccaguccuaauucucaugcugcaggcuucaaaggguuuggacuagaagggguaccagaaaagcgacugacagauccuggguugaguaguuugagugcucugaguacucaaguggccaaucuuccuaacacuguccagcacauguuacuuucugaugcccugacuccucagaagaagaccuccaagaggcccucaucuuccaagaaagcagauagcugcacaaauucugaaggcuccucacaaccugaagaacagcugaaguccccuauggcagagucauuagauggaggcugcuccagcaguucagaggaucaaggcgagagagugcggcaacuaaguggccagagcaccagcucugacaccaccuacaaggguggagccucugagaaagcuggcuccucaccggcacaaggugcucagaaugaaccccccagacucaaugcuaguccugccgcaagagaagaggccaccucaccaggcgcuaaggacaugccauugucauccgacgggaacccaaagguuaaugagaagacuguuggggugauugucucccgggaagccaugacaggucggguagaaaagccugguggacaagauaaaggcucccaagaggaugauccugcagccacucaaaggccaccuagcaaugguggggcaaaggaaaccagucaugcaucacuuccccagccagagccuccaggaggaggagggagcaaaggaaacaagaauggcgauaacaacuccaaccauaauggagaaggaaauggccagaguggccacucugcagcgggcccugguuuuacgagcagaacugagccuagcaaaucuccuggaagucugcgcuauaguuacaaagauaguuucgggucagccgugccacgaaaugucaguggcuuuccucaguauccuacagggcaagaaaagggagauuucacuggccauggggaacgaaaggguagaaaugaaaaauucccaagccuccugcaggaagugcuucaggguuaccaccaccacccugacaggagauauucuaggaguacucaagagcaucaggggauggcugguagccuagaaggaaccacaaggcccaaugucuugguuagucaaaccaaugaauuagcuagcaggggccuucugaacaaaagcauugggucucuauuagaaaauccccacuggggccccugggaaaggaaaucaagcagcacagcuccugaaaugaaacagaucaauuugacugacuauccaauucccagaaaguuugaaauagagccucagucaucagcacaugagccuggggguucccucucugaaagaagaucagugaucugugauauuucuccacuaagacagauugucagggacccaggggcucacucacugggacacaugagugccgacaccagaauugggaggaaugaccgucucaauccaacuuuaagucagucggucauucuuccuggugguuugguguccauggaaaccaagcugaaaucccagagcgggcagauaaaagaggaagacuuugaacagucuaaaucucaagcuaguuucaacaacaagaaaucuggagaccacugccauccuccuagcaucaagcaugagucuuaccgcggcaaugccagcccuggagcagcaacccaugauucccuuucagacuauggcccgcaagacagcagacccacgccaaugcggcgggucccuggcagaguugguggucgggagggcaugaggggucgguccccuucucaauaucaugacuuugcagaaaaauugaaaaugucuccugggcggagcagaggcccagggggagacccucaucacaugaauccacacaugaccuuuucagagagggcuaaccggaguucuuuacacacucccuuuucucccaacucagaaacccuggccucugcuuaucaugcaaauacucgggcucaugcuuauggggacccuaacgcagguuugaauucucagcugcauuauaagagacagauguaccaacagcaaccagaggaguauaaagacuggagcagcgguucugcucagggaguaauugcugcagcacagcacaggcaggaggggccacggaagaguccaaggcagcagcaguuucuugacagaguacggagcccucugaaaaaugacaaagaugguaugauguauggcccaccaguggggacuuaccaugaccccagugcccaggaggcugggcgcugccuaaugucuagugauggucugccuaacaagggcauggaauuaaagcauggcucccagaaguuacaagaauccuguugggaucuuucucggcaaacuucuccagccaaaagcagcgguccuccaggaauguccagucaaaaaagguaugggccgccccaugagacugauggacauggacuagcugaggcuacacagucauccaaaccugguaguguuaugcugagacuuccaggccaggaggaucauucuucucaaaaccccuuaaucaugaggaggcguguucguucuuuuaucucucccauucccaguaagagacagucacaagauguaaagaacaguagcacugaagauaaaggucgccuccuucacucaucaaaagaaggcgcugauaaagcauucaauuccuaugcccaucuuucucacagucaggauaucaagucuaucccuaagagagauuccuccaaggaccuuccaaguccagauaguagaaacugcccugcuguuacccucacaagcccugcuaagaccaaaauacugcccccacggaaaggacggggauugaaauuggaagcuauaguucagaagauuacauccccaaauauuaggaggagcgcaucuucgaacagugcggaggcugggggagacacgguuacgcuugaugauauacugucuuugaagagugguccuccugaaggugggaguguugcuguucaggaugcugacauagagaagagaaaaggugagguggcuucggaccuagucaguccagcaaaccaggaguugcacguagagaaaccucuuccaaggucuucagaagaguggcguggcagcguggaugacaaagugaagacagagacacaugcagaaacaguuacugccggaaaggaacccccuggugccaugacauccacaaccucacagaagccugguaguaaccaagggagaccagaugguucccuggguggaacagcaccuuuaaucuuuccagacucaaagaauguaccuccagugggcauauuggccccugaggcaaaccccaaggcugaagagaaggagaacgauacagugacgauuucaccgaagcaagaggguuucccuccaaagggauauuucccaucaggaaagaagaaggggagacccauugguagugugaauaagcaaaagaaacagcagcagccaccgccuccacccccucagcccccacagauaccagaagguucugcagauggagagccaaagccaaaaaaacagaggcaaaggagggagagaaggaagccuggggcccagccgaggaagcgaaaaaccaaacaagcaguucccauuguggaaccccaagaaccugagaucaaacuaaaauaugccacccagccacuggauaaaacugaugccaagaacaagucuuuuuacccuuacauccauguaguaaauaagugugaacuuggagccguuuguacaaucaucaaugcugaggaagaagaacagaccaaauuagugaggggcaggaagggucagaggucacugaccccuccaccuagcagcacugaaagcaaggcgcucccggccucguccuuuaugcugcagggaccuguugugacagagucuucgguuauggggcaccugguuugcugucuguguggcaagugggccaguuaccggaacaugggugaccucuuuggaccuuuuuauccccaagauuaugcagccacucucccgaagaauccaccuccuaagagggccacagaaaugcagagcaaaguuaagguacggcacaaaagugcuucuaauggcuccaagacggacacugaggaggaggaagagcagcagcagcagcagaaggagcagagaagccuggccgcacaccccagguuuaagcggcgccaccgcucggaagacugugguggaggcccucggucccuguccagggggcucccuuguaaaaaagcagccacugagggcagcagugaaaagacuguuuuggacucgaagcccuccgugcccaccacuucagaagguggcccugagcuggaguuacaaaucccugaacuaccucuugacagcaaugaauuuuggguccaugaggguuguauucucugggccaauggaaucuaccugguuuguggcaggcucuauggccugcaggaagcgcuggaaauagccagagagaugaaauguucccacugccaggaggcaggcgccaccuugggcugcuacaacaaaggcugcuccuuccgauaccauuacccgugugccauugaugcagauuguuugcuacaugaggagaacuucucggugaggugcccuaagcacaagccuccccuuccgugcccucucccccccuugcagaacaagaccgcgaaaggcagccucagcacagagcagucggagcgggggugaggggggcagugugcucgugggaauggaaaggacagcaagcacaggugagacuguggagaugagaaggugguggacacucgugauggaauggaaaucguccuaccgugcagccacacccugcccugccccgccccgccccgcccgcgugccugcccaugccagcacuuccuuaaguucucacaucacacucaaaccagugacaccacaggaaagaaagacccaagacguuggaauggcuguuuccauggacacaaucuccauagugacaauguggggggaggggggaggggugggaugauggggaaaggguggggggaauuaaaagggagggauaaauauauauauauaaaucuauuuuuagucuggaaagacuuuguuuaaaugaaaggugcgcuaucccuuuugauucuguuuuaaaauuaucucguuaaagaucuccaaauuuguuccgaugacaagugaaauuuaaaugugagauugaacugaacaaacccucaucucaugaaggacgggguguguguguggcguugaucuuuagccugucucacaccaguucagaaaacacuagacccaggauugaaaaagcaaaccacagcagaaccauccuuuugucauuaauuugucucaaagugggaagguuuugggggagggggaaauacagggaugguccauguuuucaagaguaggggaaugauguuuaaacacaaaaauaaauuuuuuuucauuuccagaaacacuauuuauuuaugguuuuuuuuuuuuaauuuuuucuuuuugggggugaaauuggcagaugccugaggucauagcuguguccugggucacuguggcuggugaggaccucaaggaccccaucaaguguacacagcagcagcaaaaucaagggaugacccuccucuggggcccccuguccucagcacauuccaggcagcugugcccugacccacagggacccguggggaugggaggagguccaggccuguguugccagagcuggcagugugagcuguaggcagggacggggagggacugucgcugugaucagaguggguuaagcugaccaggaacacccauuuaaccccuuuuucuuuuugcuuucauuuuuauaaaggaaaagaggaccugucagauaggcagccccaugcuacgugauucuuuauguuguguuguuuuguuuuguaaauuguauaauuuuuaaauaucugaguuuuaaaaaaagaaaaaaguacaaaaaaaucuuguuauggccuuaagaagggguuagugcaucuuucaggggucacucugccauggggauaaaauagcuguuucacaaacaguuuuauuuaaaaaaacaaaaaacaaaaaaaaucaaaaaaucaaaaaaauaauaaacuucauuuuaaccuug

SEQ ID NO: 307 - RNA, 3308 nt, Homo Sapiens
ccgugggugccggguccgcgcgcaccccaacacccccaccagcugggccucggggcacaucuccagacuucaauuuggcugaaauaauucaugccacggaccugugcacaugccuggaauugagagacacaguuaaaagacuccaaguugcuuucugccuuuugaaaacuccugaaaaccaucccuuuggacucuggaauucuacacagcucaaccaagacuuugcuugaauguuuacauuuucugcucgcuguccuacauaucacaauauaguguucacguuuuguuaaaacuuuggggugucaggaguugagcuugcucagcaagccagcauggcuaggaugagcuuuguuauagcagcuugccaauuggugcugggccuacuaaugacuucauuaaccgagucuuccauacagaauagugaguguccacaacuuugcguaugugaaauucgucccugguuuaccccacagucaacuuacagagaagccaccacuguugauugcaaugaccuccgcuuaacaaggauucccaguaaccucucuagugacacacaagugcuucucuuacagagcaauaacaucgcaaagacuguggaugagcugcagcagcuuuucaacuugacugaacuagauuucucccaaaacaacuuuacuaacauuaaggaggucgggcuggcaaaccuaacccagcucacaacgcugcauuuggaggaaaaucagauuaccgagaugacugauuacugucuacaagaccucagcaaccuucaagaacucuacaucaaccacaaccaaauuagcacuauuucugcucaugcuuuugcaggcuuaaaaaaucuauuaaggcuccaccugaacuccaacaaauugaaaguuauugauagucgcugguuugauucuacacccaaccuggaaauucucaugaucggagaaaacccugugauuggaauucuggauaugaacuucaaaccccucgcaaauuugagaagcuuaguuuuggcaggaauguaucucacugauauuccuggaaaugcuuuggugggucuggauagccuugagagccugucuuuuuaugauaacaaacugguuaaagucccucaacuugcccugcaaaaaguuccaaauuugaaauucuuagaccucaacaaaaaccccauucacaaaauccaagaaggggacuucaaaaauaugcuucgguuaaaagaacugggaaucaacaauaugggcgagcucguuucugucgaccgcuaugcccuggauaacuugccugaacucacaaagcuggaagccaccaauaacccuaaacucucuuacauccaccgcuuggcuuuccgaagugucccugcucuggaaagcuugaugcugaacaacaaugccuugaaugccauuuaccaaaagacagucgaaucccuccccaaucugcgugagaucaguauccauagcaauccccucaggugugacugugugauccacuggauuaacuccaacaaaaccaacauccgcuucauggagccccuguccauguucugugccaugccgcccgaauauaaagggcaccaggugaaggaaguuuuaauccaggauucgagugaacagugccucccaaugauaucucacgacagcuucccaaaucguuuaaacguggauaucggcacgacgguuuuccuagacugucgagccauggcugagccagaaccugaaauuuacugggucacucccauuggaaauaagauaacuguggaaacccuuucagauaaauacaagcuaaguagcgaagguaccuuggaaauaucuaacauacaaauugaagacucaggaagauacacauguguugcccagaauguccaaggggcagacacucggguggcaacaauuaagguuaaugggacccuucuggaugguacccaggugcuaaaaauauacgucaagcagacagaaucccauuccaucuuaguguccuggaaaguuaauuccaaugucaugacgucaaacuuaaaauggucgucugccaccaugaagauugauaacccucacauaacauauacugccagggucccagucgauguccaugaauacaaccuaacgcaucugcagccuuccacagauuaugaagugugucucacaguguccaauauucaucagcagacucaaaagucaugcguaaaugucacaaccaaaaaugccgccuucgcaguggacaucucugaucaagaaaccaguacagcccuugcugcaguaauggggucuauguuugccgucauuagccuugcguccauugcuguguacuuugccaaaagauuuaagagaaaaaacuaccaccacucauuaaaaaaguauaugcaaaaaaccucuucaaucccacuaaaugagcuguacccaccacucauuaaccucugggaaggugacagcgagaaagacaaagaugguucugcagacaccaagccaacccaggucgacacauccagaagcuauuacaugugguaacucagaggauauuuugcuucugguaguaaggagcacaaagacguuuuugcuuuauucugcaaaagugaacaaguugaagacuuuuguauuuuugacuuugcuaguuuguggcagaguggagaggacggguggauauuucaaauuuuuuuaguauagcguaucgcaaggguuugacacggcugccagcgacucuaggcuuccagucuguguuugguuuuuauucuuaucauuauuaugauuguuauuauauuauuauuuuauuuuaguuguugugcuaaacucaauaaugcuguucuaacuacagugcucaauaaaaugauuaaugacaggaugggguuccccugugcuuuuaccaguagcaugaccccuucugaagccauccguagaaaguacuuuguccuccaaaaagcuaacauacgguuuugaagcagcauugaaacuuuuguagcaaucuggucuauagacuuuuaacucaagaagcuaaggcuagacuuguuaccuucguugaaugauguuaguugacuguacuguaauguuguaucaacugaauugaauguuugccuuuaaacaaugaauuuucuuuuucuuuccuuuuuuuuuuuuuuguuguaauaguuaaagaggcuuagaacaagcuaacaggcaauagaaauauguauaucagauuuuuuaauguaacaaacuacauguuaauuguuaucuuauucuuuuuaucuuuaguagacacuuuuaaaagaaaagacaaguuuguuguguuuaacucaccaacacgugguguauaaugaagacagaacuauaauaaauuaguuuuguucugauuuuuua

SEQ ID NO: 308 - RNA, 2449 nt, Homo Sapiens
ggcgcccgcgcccgcccccgcgccgggcccggcucggcccgacccggcuccgccgcgggcaggcggggcccagcgcacucggagcccgagcccgagccgcagccgccgccuggggcgcuugggucggccucgaggacaccggagaggggcgccacgccgccguggccgcaguugguggaagguggguguguagucgugguacuuuacgccucgguguuuagggaggagccuaagguaaggagucagaaacggggaguaaccgagcugcggcuuuuauauaaggucagugguagguaaggaaggggccuuaaccucugcuggugaccagaagccugcauuucugcauucugcuuaauucccuuuccuuagauuugaaagaagccaacacuaaaccacaaauauacaacaaggccauuuucucaaacgagagucagccuuuaacgacugaugucuugacucauggguguauucacaaauucuguuacuucaagucuuuuucuuuuaacggauugaucuuuugcuagauagagacaaaauaucagugugaauuacagcaaaccccuauuccaugcuguuaugggugaaacucugggagauucuccuauugacccagaaagcgauuccuucacugauacacugucugcaaacauaucacaaggaaaugaccaugguugacacagagaugccauucuggcccaccaacuuugggaucagcuccguggaucucuccguaauggaagaccacucccacuccuuugauaucaagcccuucacuacuguugacuucuccagcauuucuacuccacauuacgaagacauuccauucacaagaacagauccagugguugcagauuacaaguaugaccugaaacuucaagaguaccaaagugcaaucaaaguggagccugcaucuccaccuuauuauucugagaagacucagcucuacaauaagccucaugaagagccuuccaacucccucauggcaauugaaugucgugucuguggagauaaagcuucuggauuucacuauggaguucaugcuugugaaggaugcaaggguuucuuccggagaacaaucagauugaagcuuaucuaugacagaugugaucuuaacugucggauccacaaaaaaaguagaaauaaaugucaguacugucgguuucagaaaugccuugcaguggggaugucucauaaugaggaacuacaaaaggauaguuauuagauugccaaauccugcagaaccuccagcaggcacaaguugguuuuucucccucaagaaagagaagugagccaagcgugguggugcaugccuguggucccagcuacucaggaggcugagccaucagguuugggcggaugccacaggccgagaaggagaagcuguuggcggagaucuccagugauaucgaccagcugaauccagaguccgcugaccuccgggcccuggcaaaacauuuguaugacucauacauaaaguccuucccgcugaccaaagcaaaggcgagggcgaucuugacaggaaagacaacagacaaaucaccauucguuaucuaugacaugaauuccuuaaugaugggagaagauaaaaucaaguucaaacacaucaccccccugcaggagcagagcaaagagguggccauccgcaucuuucagggcugccaguuucgcuccguggaggcugugcaggagaucacagaguaugccaaaagcauuccugguuuuguaaaucuugacuugaacgaccaaguaacucuccucaaauauggaguccacgagaucauuuacacaaugcuggccuccuugaugaauaaagaugggguucucauauccgagggccaaggcuucaugacaagggaguuucuaaagagccugcgaaagccuuuuggugacuuuauggagcccaaguuugaguuugcugugaaguucaaugcacuggaauuagaugacagcgacuuggcaauauuuauugcugucauuauucucaguggagaccgcccagguuugcugaaugugaagcccauugaagacauucaagacaaccugcuacaagcccuggagcuccagcugaagcugaaccacccugaguccucacagcuguuugccaagcugcuccagaaaaugacagaccucagacagauugucacggaacacgugcagcuacugcaggugaucaagaagacggagacagacaugagucuucacccgcuccugcaggagaucuacaaggacuuguacuagcagagaguccugagccacugccaacauuucccuucuuccaguugcacuauucugagggaaaaucugacaccuaagaaauuuacugugaaaaagcauuuuaaaaagaaaagguuuuagaauaugaucuauuuuaugcauauuguuuauaaagacacauuuacaauuuacuuuuaauauuaaaaauuaccauauuaugaaauugcugauagua

SEQ ID NO: 309 - RNA, 1012 nt, Homo Sapiens
auagucuccaucggccauuuugugcgagaagccgcagcgccgccucuucucucgcgcccucgccucuuccuccgccuccuccuucgccucuuccugccuccucccggcuuccgccgccgccacuccagccuaaucccaaccccagggcgaagcguuuucuuauuuauuuccguuuucucgccacuacagccuccugacaaggugauccgggcgggccccgcaggaauuuuauccccucaccggccucacacuaguaucgcauguccacuauccagaaccuccaaucuuucgaccccuuugcugaugcaacuaagggugacgacuuacucccggcagggacugaggauuacauucauauaagaauccagcaacggaacggcagaaagacacugacuacuguucagggcauugcagaugauuaugacaaaaagaaacuugugaaagcuuucaaaaagaaauuugccuguaaugguacugugauugaacauccugaauacggagagguuauucagcuucaaggugaccaaagaaaaaacaucugccaguuucucuuggagguuggcauuguaaaggaggaacagcuuaagguucauggauucuaaaaugaaccuaaauacguggagaauuucuugaauaguuuuguucucuaaacccgguuuggcugccuugugaaaugauucccugcaguaaacggacuuuucauuuauuuaaucauucaaacuuccauucacaucugcaugauuacagaaaacaugggguauguagacuaguaacacauaagaaaauugcaguaagaugguaacaaaaccucauauugucuuuacauguuuccaauggaaaauguuuugaguguuuauuguucaguuuauuacguuucacuugauuaaauuuuuuuguuguuguauuaaaccauguacguugcagcuuaacaauaaaaaaaaaucuaugaaucuuugugagcaauuaugcucccaaaucuaagcaaguaaaauacacauuuugucuuucuuaa

SEQ ID NO: 310 - RNA, 3525 nt, Homo Sapiens
ggaaggaggugguugugcaggauggcgacggcggccuacgagcagcugaagcugcauaucacaccugaaaaauuuuauguggaagcuugugaugauggagcagaugacguacuuaccauugaccguguguccacagagguuacccuugcagucaagaaagauguuccuccuucagcugucacaagaccaauauuugguauacugggcacaauccaucugguggcagguaauuaucuuauagucauuaccaaaaagauaaaaguaggugaauuuuucagucauguagucuggaaagcaacagauuuugauguccuuucuuauaagaagacaauguugcacuuaacugauauucaguuacaagauaauaaaaccuuccuagcgaugcuaaaccaugucuugaauguggauggauuuuacuuuucaacaacauaugauuugacccauacuuugcagcggcuauccaacacuaguccugaauuccaagaaaugagucucuuggaaagggcagaucagcgguuuguauggaauggucaucuucuaagagaacuuucugcacagccagagguucaucgguuugcccuuccaguguuacauggcuuuauuaccaugcauucauguucuauuaauggaaaauacuuugauuggauucucaucucgaggaggagcuguuucagagcuggugugcgcuauuauguaagaggaauugauucggaaggccaugcagcuaacuuuguagaaacagaacaaauugugcacuacaaugggagcaaagcuucguuuguacagacucgaggaucaauaccuguuuucuggucccaaagaccaaaccucaaguacaaaccacugccacagaucagcaaaguagcaaaucacauggacgguuuccaaaggcauuuugauucccaaguaauuauuuauggaaaacaaguuauaaucaaucugauuaaccagaagggcucggagaagccacuugagcagacauuugcaacaauggugucuuccuugggaaguggaaugaugagauacauugccuuugacuuccauaaggaauguaaaaauaugagaugggaucgacuaaguauuuuauuggaucagguagcagaaaugcaagaugaauuaaguuauuuucuaguggacucugcuggccaggugguggcaaaccaggaaggcguguuccgaagcaauugcauggauugucuagauagaaccaaugugauccagaguuuguuagcucgucguucacuucaggcccaacuucagagacuaggaguuuugcaugugggacaaaagcuugaagaacaagaugaauuugagaagauuuacaaaaaugccugggcugacaacgcaaaugcuugugccaagcaauaugcgggaacuggugccuugaagacugacuuuaccagaacuggaaagagaacucauuugggacuuauaauggauggcuggaacucaaugauacgauauuauaagaacaacuuuuccgauggauuuagacaagauuccauagacuuauuucuuggaaacuauucaguggaugaauuagaaucucauaguccuuuaaguguuccaagggacuggaaauuccuggcuuugccuauuaucaugguuguugccuuuucaaugugcauuaucuguuugcuuauggcuggugacacuuggacagaaacacuggccuaugugcucuucuggggaguugcaagcauuggaacauuuuuuaucauucuuuacaauggcaaagauuuugucgaugcucccagacugguccagaaagaaaagauagacugaauuuguauuuguggaaagcggcuuggcuuggaagauuccauugugcagaacuggagucuuuacugacccgcuuuccacaucagcccaaggucuuuuuaaugccuuuauccaaaagcacaucuugugcuccaugcaggaugaugacagaauugaucugauguuacugccuugauggucucuuuacuauugggacaguuagauuuauaauuugaagcuauucuguaauuaaaauauaaccugaauucagcuugcagaauggaagcugaaucuguucauuguauucuauugauugucaauuuaauuagcuguugcagaauaaguaauauauuuuaaaaaccuagcuccuuucauuauuuaaaacagcaaaauuauuuuuguagcucaguuucauuauugucauuguagaagcggucacuauuagcaggcauacuuuuccacacaucuuuggacuuuucuuaaaaguucaguaauaagcuaacuguguuuauaaaauguaagucucuuacagacaucaaguaguuugaugagacagucugugacuucaugauaggaaagaggaggaugaggucugggguucuuuaaagucucuggugggcugccucaugacuuuaaucagcuugaacugccagugcaccagcaguuuaggugugaugagagaauucagauauacuuuaucuuuuuaaaaaaguguaaauaaaaucaaagaauguaaagucuaucucuuacgcuagagguccaaagcugccucuguuuuaaagauuaucccaauguggaagaugcccaugacuggucagcuacuuccuccuauacauuuugguuucuuugagggucacucauugagacacgcaggccucugagagggucuuguucuagauuucauauugcacuuggaggguaacagcugcuuuuucacgcaugguacucuugauguuuuucacucugucaaggauuuuguuggcuaucaaugaaugugucuaaaacuuagugcuuccagguaguuauaguacuccaaaucaaggaccaacuuaaacguuaauuuuugugcaaaaacaaaccugaaaaauaugcuucggaaacugugcauaguucuaauuguaagucagauuguauauucaaauuguaauuaagagauuuaaauauuagaacgguauguaagguaguauaauuaccacuauuuuaaauaauucaguuaaacacugcugcaauauuucaguguugugcuugaaaauauguacaguuuuuuuccaauauuaauaccuuauguuguccuuaaauauuucuaaaagcgccuuuauuucagcauuaccuuuuuuucaucacuaucuuuuauaaaacauuaauauaagucguuacuuuuagaaacuaaaggaaauaauagcuggaaaacccucuguaguuuaaaaucagucauuaaacucacaauaggguaaguaaauauagccaccuguuaacauguaaauaagcauaauuuguuccaaagauggaauauugaaacuuaguucaugucugcuguaaaauauuauuuaaaugcugcugggcauuucacuuaaagaacuuaaugucaacagcuacaacaaagaccaaaucugaacugcuaauguggcugcuuuguagggaauggacuaauaucaguguguuagaucuuaagguaucaguauuucagaauccugcgacgauuuuauuucuaaauucauguacuguauguccauaagugaaaauaaaaugucauauucuuuucua

SEQ ID NO: 311 - RNA, 294 nt, Homo Sapiens
gcugggugugguggcacauaccuguaguccuagcuacucgagaggcugaagcaggauugcuugaacccaggaauucugggcuguaguguguuaugucaauuggguguccacacuaaguuugacauccguauggugaccucuugaaagcaggcaacagcagguuaccuaaggagggguaaaccggcccagcucagaaaccaagcaguuaaaaacucucaugcugaucagcagcaggauagcaucugugaauaggcaccgcacuccagccugggcaauauagugaaaccccaacuc

SEQ ID NO: 312 - RNA, 2953 nt, Homo Sapiens
cgggcgccauguuggaggguuggugguagcggcuuggggaggugcucgcucugucggucuugcucucucgcacgcuucccccggcucccuucguuucccccccccggucgccugcgugccggagugugugcgagggagggggagggcgucggggggguggggggaggcguuccgguccccaagagacccgcggagggaggcggaggcugugagggacuccgggaagccauggacgucgagaggcuccaggaggcgcugaaagauuuugagaagagggggaaaaaggaaguuuguccuguccuggaucaguuucuuugucauguagccaagacuggagaaacaaugauucaguggucccaauuuaaaggcuauuuuauuuucaaacuggagaaagugauggaugauuucagaacuucagcuccugagccaagagguccucccaacccuaaugucgaauauauucccuuugaugaaaugaaggaaagaauacugaaaauugucacuggauuuaaugguaucccuuuuacuauucagcgacuaugugaauuguuaacagauccaaggagaaacuauacaggaacagacaaauuucucagaggaguagaaaagaaugugaugguuguuagcuguguuuauccuucuucagagaaaaacaauuccaauaguuuaaaucgaaugaaugguguuauguuuccuggaaauucaccaagcuauacugagaggucuaauauaaaugggccugggacacccaggccacuuaaucgaccaaagguuucuuugucagcccccaugacaacaaauggguugccugagagcacagacagcaaagaggcaaauuugcagcaaaaugaggagaaaaaucacagugacucuucgaccucugaaucagaaguuuccucagugagcccuuugaaaaauaaacauccagaugaagaugcuguggaagcugaggggcaugagguaaaaagacucagguuugacaaagaaggugaagucagagaaacagccagucaaacgacuuccagcgaaauuucuucaguuaugguaggagaaacagaagcaucaucuucaucucaggauaaagacaaagauagccguuguacccggcagcacuguacagaagaggaugaagaagaggaugaagaggaagaagaagagucuuuuaugacaucaagagaaaugaucccagaaagaaaaaaucaagaaaaagaaucugaugaugccuuaacugugaaugaagagacuucugaggaaaauaaucaaauggaggaaucugaugugucucaagcugagaaagauuugcuacauucugaagguagugaaaacgaaggcccuguaaguaguaguucuucugacugccgugaaacagaagaauuaguaggauccaauuccaguaaaacuggagagauucuuucagaaucauccauggaaaaugaugacgaagccacagaagucaccgaugaaccaauggaacaagacuaacuauuuagaaacauuuagaugcaguauuuuacauacaguucugguuuuaacacuguauaaaacuuuuguguaauaaaauggaccuuuaguuuuacaagagaagcagguuguaaaauaaaguacuuuauggauaauuccugaaagaguuguacauguaagaacugugaauaucagcuccucuggguccugcuuaccuuaccgcugacuuuucuuucuuucuuuuuuuggucugggcaaaucagugguuuguguauagauuuuuuuuuuuuuuuaauuuaggauugaaguuuuuaaacuggaaaguaauuacaauuuugaaaaguuuuuugagauuaucacauuuaguuuauacauaugcaagaagcuuuuugucuugucucuuucugauagcucuagcaguuuucauauuuuggucauaguuucaacauuuuaacaugugaauuauaggguuucaugcugguuuccagauuuuauuguuuggcuacguacaauggaacuuuaagucauauauacauacauauauauauauauauauauauaauucuaaggggggaaauguuauauuuuucuguuucuauaagagaugaauacaguggauacuuuuucuauugguaaugauugaguucaccucuuucagaagacauuuucuuucucuucugaguaauugaaauaaaaucuggcccuugugaaacccuggaaaucuuaagucuguugaaauaccagguuaaacacauuccaagagaucuguucaaacucaaauucuuuuguauacuucugaggugccugagaaaaagacuucauuauuuaugagaaaauaugcuuuaucuuggaaauuguguucaaauguuagcuuacuauuuuguagaaugaauguuuaugaagcugauaugagaccaucucagaagaaccaaguagguuccuugaccuuuugcuugcuuuucugaacauugugaauauuacacaugucuuucuaaauuauucuaggguaugcaaaugucaaugguaugaaacaccacuguacuggaagaauuaauauauuacuuuaguauguaccugagcuaaaugacugaagcuuuaggggugcauagaaaccaccauaauuuguaugacauuuugaagugaauuaaauauuuuugaacaugcuucuucgacagccaguguuauauuuuucagaucaacacaaagcacaaugauuacucgaaauucaguauuuucaaauuuacauauuuaaagucaugcaagcuguaacuucccugucaaaauuacuggcugccaaauuuauaccuguuucuucagcuguaccuuuugauauuuaaaguuuuuaaauuucuguaaaguagauuuuguagaauguaauguguucacugccuuugugaagcgguauauaauuguauaauuucuguguguaaacugaaugcuugggcuuucaauacaguauucauauaaagcaauaaauauuaauguuaugaaa

SEQ ID NO: 313 - RNA, 2543 nt, Homo Sapiens
aaaaaguguguuaguucccggucaccugagcuccgggugacgcggcugcgguagcugcggauacaagccuuccgcggguccugccuggcgaccccgaccuccuccugcugucucuccgcuccgccaccccgaacccgccaagguccuguccuuuuccuccuguccuuugccagcguugggccggaccgggccgagccgggccgcccgggcgcagucuuuaaccauggcgucccucuucaagaagaaaaccguggauggauguaauaaaggaacagaaucgagaguuacgagguacacagagggcuauaaucagagaucgagcagcuuuagagaaacaagaaaaacagcuggaauuagaaauuaagaaaauggccaagauugguaauaaggaagcuugcaaaguuuuagccaaacaacuugugcaucuacggaaacagaagacgagaacuuuugcuguaaguucaaaaguuacuucuaugucuacacaaacaaaagugaugaauucccaaaugaagauggcuggagcaaugucuacuacagcaaaaacaaugcaggcaguuaacaagaagauggauccacaaaagacauuacaaacaaugcagaauuuccagaaggaaaacaugaaaauggaaaugacugaagaaaugaucaaugauacacuugaugacaucuuugacgguucugaugacgaagaagaaagccaggauauugugaaucaaguucuugaugaaauuggaauugaaauuucuggaaagauggccaaagcuccaucagcugcucgaagcuuaccaucugccucuacuucaaaggcuacaaucucagaugaagagauugaacggcaacucaaggcuuuaggaguagauuagucaaaagaagucauacuauuuugcuuacuuauaauuauguaguauaaaccaagcacagugcagauuucuuuuacaaaacacauguauuuugcaaaaaaaaaaaaaaugaagaccaugagugaacaguuguuuccuaacccauggcuauuuagaaucuuuugccaaagaaugacaaugaugcaaaaaugggaacaguuuggauuuuaauuagaacuguuuaggagugaugauguguaaaaaguugacuucucuuuugcauggcacagagaaauuauauuccuuacuucaugucaguuuauguucuaaaucuuuuucacugaauauaaaaaucuuguuaaaugccauuaggcaccaacuuaaagaggguuguaaaaauauuaaaaguauaucguuaauucuguaucuguugcuugucuuuuguaagugauuauguguuaugaccauaggugguuacagcugccaaauuauuuuuaaauggucaaaaagaagagugcuauuuaaacaucugucuuaaacaaaaacugucauaacuuuucuuuuuucuuuuuccauuaggagaacauucuaguugguaaauuucaaaaugugcuugacaccugccuuaaauagcacagaccuauugugcacaucuuuaaauuauuucagcuggcagaaaagaauuacauuuaaaacugaaaucaaggccucaauacaaagauuauccuggcucuuuucuaucucugugggccuaauugaaauauguacucuuauuuuagacacgccucuguuaaaacagaccagguuuuccuggucucagaccuaugaugacuugucccuuugaugucacuacugugaauugaauauaauuaguaaaaauagacgaugaauaaauaacacuuuauaguaagaaaacaauauauuuuggccaucuaaaaaugagaauuauaauuauaugaauuauaauuuaaacuguuuaauuuuguuuaauguguauauugaaucuuccaaauugaagccauuauucucaauuaaguacuacaacuaugacaaugcuugaccuacauuucuaaaauaaaaauucacauuuuuugauaaauaaacuacaguuuuaccagaaauuacuaucuaaauguguauuagcaguauuuuuuaaggugaaauugccuugguaucuaaugaauguguagacagggagauaaaaugaaggauugccagacuaguuagaauagaauuuaggauuagguuaguuuugaaaaaugauguuguaauauauggguucuaacacauccuaccauaaaaacuggaggagauauguguaaccugguuaauuugggaugguggacauuuugggcuaauacugacaaaauacaucuuaggacuaguauacaugugacacggauugcuaggaggaaugaaaaacuaaacuguauaguuuauauuccguaaaccauuuuauaauguucaaagauuagguuuuguuauugauaguauuaaauacacaguuucucuuaacagugaugggugaaaacauuuuaccggauuauggaauguuuaccagaacauguuuugauucuugaauguacauaauaaugccaucuaacuuauuuacguucuuguuuacaugugggagcuuuuguuuucaaaaauuauuuuguuaaaaaaucucaauaaagauuuauuauuguuguucuuuucuua

SEQ ID NO: 314 - RNA, 1865 nt, Homo Sapiens
uccccgccgugccuccucgcuggccgcgcucccucccggugccggcuucucugagucaccaaccugaggcugccccggccgccugcgcacccggcagcaccaugacagagaucaggccuuugugacacuaaccacaaacgaugccuacgccaaaggugcccugguccugggaucaucucugaaacagcacaggaccaccaggaggcuggucgugcucgccaccccucaggucucagacuccaugagaaaaguuuuagagacagucuuugaugaagucaucaugguagaugucuuggacaguggcgauucugcucaucuaaccuuaaugaagaggccagaguugggugucacgcugacaaagcuccacugcuggucgcuuacacaguauucaaaauguguauucauggaugcagauacucugguccuagcaaauauugaugaucuuuuugacagagaagaauugucagcagcaccagacccaggguggccugacugcuucaauuccggagucuucguuuaucagccuucaguugaaacauacaaucagcuguugcaucuugcuucugagcaagguaguuuugaugguggggaccaaggcauacugaacacauuuuuuagcagcugggcaacaacagauaucagaaaacaccugccguuuauuuauaaccuaagcagcaucucuauauacuccuaccucccggcauuuaaaguaugguuuggugcaagugccaaaguugugcauuuccugggacgagucaaaccauggaauuauacuuaugaucccaaaacaaaaagugucaaaagugaggcccaugaucccaacaugacucauccagaguuucucauccugugguggaacaucuuuaccaccaacguuuuaccucugcuucaacaauuuggccuugucaaagacaccugcucauauguaaaugugcuuucagacuuggucuauacacuggcuuucucuuguggcuucuguagaaaggaagaugucucaggagccauaucacaucugucccuuggggagaucccagcuauggcacagccguuuguauccucggaagaacggaaggaacgaugggaacagggccaggcugauuauaugggagcagauuccuuugacaacaucaagaggaaacuugacacuuaccuccaguagaaacacugcauuuuucugugaacacauccacuucacaagccuuguuucugauacuuaguaucuagagcuggguugagaaaagucuguuacaguugcuagagguuuucauuaaaacuuaucagaugagaggcuuuuuuaggauaagaggugagaacugggcaaaaguugugaagcagcaauucuguuauauggacaguguucugcuuuuuaauccuauuuagcuuguuucagaaauucucacuuuuguugacugccaacauacaaaguaagggaaacucaagauauuaagauggcuguaucaguucuuaaaaucugcagagccugguucaaaaucagucacucccuucagaagcagacauggcaucuguuccuugcuugcuuguugguuguguaccuuucacgagaccugaauuuuagaauugcccagugcugccagagugagugaguguaauucuccuuucagguaaagauaggcuaucucaacacugcugagugauucauaaacauaucaaccaauagcauuaacccauuuuauuuccuguccuuagugucugaagaugcucaccaguuuucuguguacaguaaggcagcaugcuaaaaugcuuuuguucaguucuguauauuugaaaauagcaguguguucucugaugguuaccugcaguggcacccuguacaaaaaauaaaagacuuauugcuguaguguaaa

SEQ ID NO: 315 - RNA, 1446 nt, Homo Sapiens
cacugggucagaagcuauauccagcugcuggcagaguuccugucaagggaucaagucuuccaacagaauggguuaugguuuaacucagcagaauuuguugaacaacuacgacaugcuggggaucauggcauggaaugcaacuugcaaaaacuggcuggcagcagaggcugcccuggaaaaguacuaccuuuccauuuuuuaugggauugaguucguugugggaguccuuggaaauaccauuguuguuuacggcuacaucuucucucugaagaacuggaacagcaguaauauuuaucucuuuaaccucucugucucugacuuagcuuuucugugcacccuccccaugcugauaaggaguuaugccaauggaaacuggauauauggagacgugcucugcauaagcaaccgauaugugcuucaugccaaccucuauaccagcauucucuuucucacuuuuaucagcauagaucgauacuugauaauuaaguauccuuuccgagaacaccuucugcaaaagaaagaguuugcuauuuuaaucuccuuggccauuuggguuuuaguaaccuuagaguuacuacccauacuuccccuuauaaauccuguuauaacugacaauggcaccaccuguaaugauuuugcaaguucuggagaccccaacuacaaccucauuuacagcaugugucuaacacuguugggguuccuuauuccucuuuuugugauguguuucuuuuauuacaagauugcucucuuccuaaagcagaggaauaggcagguugcuacugcucugccccuugaaaagccucucaacuuggucaucauggcagugguaaucuucucugugcuuuuuacacccuaucacgucaugcggaaugugaggaucgcuucacgccuggggaguuggaagcaguaucagugcacucaggucgucaucaacuccuuuuacauugugacacggccuuuggccuuucugaacagugucaucaacccugucuucuauuuucuuuugggagaucacuucagggacaugcugaugaaucaacugagacacaacuucaaaucccuuacauccuuuagcagaugggcucaugaacuccuacuuucauucagagaaaagugaggggcuugugaaacagauuguucuacagaugaaucuguaagccaguuacaguuugccuuaacucauagacaucaaucagagagugucacagauuuaaccuugaucuaaagacaaguuguacccagaguaugugaaaagaaugggacgacaagaauguacugguuucuuccucuaagaauugaaaggaguugaacugccuuauguuugggcauguaacuccaaaauacuagguaguauaaggcuuucucaaucagugcaaaaauggaagauauauaaagcaacaaguugucugcauuugaucacuggucagauuguaaaaaaaaaaaaaa

SEQ ID NO: 316 - RNA, 98 nt, Homo Sapiens
uugaggccuuaaaguacuguagcagcacaucaugguuuacaugcuacagucaagaugcgaaucauuauuugcugcucuagaaauuuaaggaaauucau

SEQ ID NO: 317 - RNA, 6541 nt, Homo Sapiens
acgucagagggaaccgggcggagcggccaacauggcggaacgcaggagacacaagaagcggauccaggaaguuggugaaccaucuaaagaagagaaggcuguggccaaguaucuucgauucaacuguccaacaaaguccaccaauaugaugggucaccggguugauuauuuuauugcuucaaaagcaguggacugucuuuuggauucaaagugggcaaaggccaagaaaggagaggaagcuuuauuuacaaccagggagucugugguugacuacugcaacaggcuuuuaaagaagcaguuuuuucaccgagcccuaaaaguaaugaaaaugaaauaugauaaagacauaaagaaagaaaaagauaaaggaaaagcugaaaguggaaaagaagaagauaaaaagagcaagaaagaaaauauaaaggaugagaagacaaaaaaagaaaaagagaaaaaaaaagauggugaaaaggaagaauccaaaaaggaggaaacuccaggaacuccuaaaaagaaggaaacuaagaaaaaauucaaacuugagccacaugaugaucagguuuuucuggauggaaaugagguguauguauggaucuaugacccaguucacuuuaaaacauuugucaugggauuaauucuugugauugcaguaauagcggccacccucuucccccuuuggccagcagaaaugagaguagguguuuauuaccucagugugggugcaggcuguuuuguagccaguauucuucuccuugcuguugcucgaugcauucuauuucucaucauuuggcucauaacuggaggaaggcaccacuuuugguucuugccaaaucugacugcugaugugggcuucauugacuccuucaggccucuguacacacaugaauacaaaggaccaaaagcagacuuaaagaaagaugagaagucugaaaccaaaaagcaacagaaguccgacagugaggaaaagucagacagugagaaaaaggaagaugaggaggggaaaguaggaccaggaaaucauggaacagaaggcucggggggagaacggcauucagacacggacagugacaggagggaagaugaucgaucccagcacaguaguggaaauggaaaugauuuugaaaugauaacaaaagaggaacuggaacagcaaacagauggggauugugaagaggaugaggaagaggaaaaugauggagaaacaccuaaaucuucacaugaaaaaucauaaucugacuaauuuugggacugaaugaauaaguacaagagguuggauuuucuauguuggcugauuaccauauugaacacauggcauuuguagcauucuuuaaaucuaucuacugaaauguauuugacauucaagcaguuauauucgguccuucauuuuauagaauauuggcacuauuauugguacaguuuaaagccauuaauauguuuuauccauuugauaauuuuacaguaaguaggucucauucauuuugacaguuaucaaagauguacuuuccacaguuaaauuuacauuaauggcaauuuuugauaguuuuauggcuuuuuacuguuagacuaaucaaaaauaacuuuaaaaggaacaaagaaacuccaacauuucacauuaugcauaguuauguagccauuucacaguuucuuuaagauguguaaacucauuguccuugauaguuuuuauuuuucauuauaaaauuauaccaggagauuucuuuuaagauucugaguuagcagaguucaaaacuauuuuguggaaacaagccaacuaguaacaaugcagcaacacuucugguuuagcuaaauuauuuuuccaauguaggaaauccacacugauuuguacgucugacugagagaaagauggucgucuccagcagagaaagugaacagcauuuguuggaaggugauggcucucccuccucccuccccauuucauuggcguaacguaaaguguauucuguacauaauuuacaaauaaaacauuuuauuuuaauuguuacuuauuauuuagauauuucucaacacuuaaauucauaaaauuaagaccauguaaggguauguuuuuagagaaauggaaguuugaguaacccacagaacaucugugaucuuucuacagcagcuucaguuuugugccaacauuccauguauuuugaauaugagcaaaaacugaucuuaagagcagacuuaaaguagcuuuguacgccuuaauguucauuuugauuuauuuuaaaucuuuacauucagaaaugagauacuguauuaucagaccaggaggcauugcugugaaagauaauuuccuauucuaaaauaucaaauuuaaaauaaagauaaugaaagaaaacauaagagaacuauuggacucuaauugcuuugaacuaguuuugcaguuugacuuuacgucuuauacaucuuaguuacaagucuuuggaaacucuuguuuacuuaugagcauaaucauuccuuggaguuauacuaacuaauaaugaauauuaaaugauuuuucuucagucacagugagagcaucuugcuuugugguugaaauagguaguguaugucagucuuugcuuuaggcuguuucucaucuaaguguuugaauuaaagauguuaaauuuuucuaauugugaaaaauauguuuucuguaucgacacauuuuauuaaacuuggcuugauugcuucuuuauaguagucccuguaaguggacauaaauguggcuauuugauguuaaugcaacuaugucaaggcugcaaucacuuuaauaguuucuuuuuagcaaauaaauguucauugaugaagugccuggguauuuucccgucccauuugcagagcucuacuacuucauuuccacaguaagcauauauauaaugaucacuucugaguuuaucaccaguaacauugauaccuauuuugggguauaaacaugguguuuuucagaaauaaaaauuauuucauuaaccuuuacuauuacugugauaauacccaggcacucaauauucauccugaaauuuuuuauaauauauguaauuugucuagucuuaaagacauuuggagcauggccaacaggaaggucagcuucuuacugauguguguggauucuuacagaauguuaguacaaauuuuuauaaauauuuggugaucccuggggggaaauaucauucuuacuaugguuagaaagugaauuagaaauuucagcucaguuucuauuuuacuauucaaguuguguacuuuaaacaaauauaaaaaucaaaaggcugccucuauuacaauccucaguggaauagauggcuaucuuucuuggcuaacauuaaauauucuuguaccagagcauggaaaaucguuuauaauuguuaauagaauggcgauuuuuuuuuaagaacuucagauuugcuaugcugcuguaaguagaaagcaugaagcuuuuugaucauguagggcuuauuguagaggguaucaauuggccuaacuaagcaggauugaauuuaccagaggcuaaguucagauaguaagaauaaugcauaugugauuguucuuaaagucaauguauuaaauaagguauuuuuccuuuucccucuuacuggauuuuucaauuuucaaaccauauggccuagguaacuuuaauugaaauaauauagauuuaguugaauacuauucaggaaguaauaaauuuuaauauaucacauugaaauuaugcaguggugaugaauuuugguguuuccccccucuuucugguuuuacaucaugaggaucaguuagcugcugacaagaaaagucaucuugugucuuuuguaaauugaauuuuuuuuuuaaaucuauuaggaacuggaaaacagcaaguaugguugauucucauuauucaagguaguuacguucuauaaagucacugcgaacacugaauuagcaaauauagaaccuaggggaaauacaaggcuagauuucugcaagccacuggucacauuuucaucaagcagucaacauguaaauuucuguuguaaagacaccuuauuuaauauaaucgauucauuaacauugaagucaugaccaacaacacuguaacucaugccugaaugaagcuuaucugacacauaagcuucauaaggcacacaacagccuuuuuacccuuaggaacagcuuuuugcccuuagcacuaugcuugggggccauuuuaaacagugaaaucaaaaaaagaacagaaaugcaaaaaccauggcauuagcguaaaaaggacacguuuauaguaugaaagcuggaacauggccuuguucaaccucagcucagaauauguguacagcaaguuuuuugcuguaccacaaaauuuuagguuaggcaaauucacaaauacggaauccaugaauaacgaggaucaacuguacuuaacuauauuuuaaagcugugacauuuaucuaccugguuuauggaauagaauuuauugcugaaucaugcuccaguauuugagugauguuuuaaauauccuaugucugaaaauaauuccuccuaauugugugguaauuugcuuuuacuguuuccacaguauuucaggucuuugcucauucacucaguaauacugagcacuuaccauguaccagaauuuuacuaggcacaaccaugaauaaaaauacaauucucuugcaccauuaaauaguguguuaagugcuacggcagcaaauugcuacaugugcuggauaucucuuguuuuccccuccagcuccacucugcucuugcccacaaagcugacccgaauggaccacagcagugggcuccuaugccuccuggcuucugaguggguuuggccaaggaguguccuggccagagaucagaggaugguagggugccuauucucggcucuucuccugggguuggggggcugccuuagcagccaaaggucacuucucccaaacuccuucccugcuuuccagguugccagucccugcacucuuccuuucuggccaaggaugaugucaguucugcugcuacuagccuggaguugcagaagcuacugugcuuccucuuuggguagccuauaccuauacuuaucuccucauaauaucuucauguaaagaaccaucuguuucuuauuggaaucaagaccaauaccaaggagaaauuccuagggaacaaaaauuccaaugaggaauugaccucuuugucagauccuuaucaccaaacauuagaaaagaucucauaacuuuauacagcauguuguaagcauuuugauaacuaaaauccuguucuagugaaugucaugcagauaacuacacaaggagauuaauuuaaauuugccuucuuuggcaagcccuuaaaccaauggcuaaagcaguuaguugugaguuucugaguaggucccaaugcguuuauuucauuuguccaaccuagcacagagauccuuugauacuuuaauugcauggcuuuuccaaucagacgaaauuucagucugagagaggacauauuuucugagguuuauaguuuuaggauuguccaaaaggccuaugaucucuucuuagcaugacagaaagagggaaagauaaguuaaauuucaagggggucauaucaucacacuuuggucuuauuucauuuucaaugauuuccuagaucacuuuaacuuuuuugugucauggacuccucagaauaauggguuuuuuuuguuuguuuguuuguuugagauggagucucacucugucacccaggcuggagugcaguggcgaaaucucagcucacugcaaccuccgccuccugagguucaagugauccuccugccucagccucccaaguagcugggauuacaggcacaugccaccacacccagcuaauuuuuguauuuuuuaguagagacaggguuucaccguguuggcgagacugaucuugaacuccugacaucaggugauccaccugccucggccucccaaagugcugggauuacaggcaugagccaccaugccuggccagaauaauguuuuuaaaugcagaaaaggaaaugcaugggguuacaagggaaacgaauuacacugaaguguaagcuaccaaauaauuuaugaugugguaguuauaggugugcauuuaauagccagaucuacgaguggauguaauaacugcuaugauguugaaguagcauaaaacauauauuagauaucugcaacaacugugauguaacaugaaaauaccugauuucuguugacaaaguuacugcuaguacaacuguggauuguugucugcacucgucauugaaggaaauacuaaauuuuaguuuuaggcuagugaaauuaaaguuaauuuuucccauccaaguucauguaucuucugaauucuauccgugaaucccuuagaggucugugaauuguagguuaagaaccccugcccuagcuaaucagauccaccaauguuucaaauaggacuauaacuuauucaaaggccaaugauacuucgcauaauucaauuuuaauauuauucacauuucaugucacaaauuuaguaaguuacauguguuaugugauguuuuguuuugauagauuauaucuuacuccuaaauaaaaagucaagauuuuuguagcaa

SEQ ID NO: 318 - RNA, 2018 nt, Homo Sapiens
ccggacgggacgugcgcgcucaaagguugcccgucucugacgcccgcauuuccuggucuggagccggcugagccacagcagggucgccgcggggucccggggccgugcuccccugccccucccgggagcgcgcggggcggggcggggcggggcgggaccaggcgggcgagcugggcccucgccccucccucgggcggucaccugggcacgggcgcugcaggugucggggccucaaccuugcggagccgacagccaucgauccucggguggccucgaggugguggcagggccgcccccugcaguccggagacgaacgcacggaccgggccuccggaggcagguucggcuggaaggaaccgcucucgcuucguccuacacuugcgcaaaugucuccgagcuuacucacauagcauauugguauaucaaaaugaaaugcaaggaaccaaaaauaacauaauugaaggcaguaaaagugaaauuaaauaggaagaucaucagucaaggaagacccacuggagaggacagaaaaugaagcaguguuuuaucauguguauuucagcaggucuucuugaaauuuaacuaaaaauaugacugcucucucuucagagaacugcucuuuucaguaccaguuacgucaaacaaaccagccccuagauguuaacuaucugcuauucuugaucauacuugggaaaauauuauuaaauauccuuacacuaggaaugagaagaaaaaacaccugucaaaauuuuauggaauauuuuugcauuucacuagcauucguugaucuuuuacuuuugguaaacauuuccauuauauuguauuucagggauuuuguacuuuuaagcauuagguucacuaaauaccacaucugccuauuuacucaaauuauuuccuuuacuuauggcuuuuugcauuauccaguuuuccugacagcuuguauagauuauugccugaauuucucuaaaacaaccaagcuuucauuuaagugucaaaaauuauuuuauuucuuuacaguaauuuuaauuuggauuucaguccuugcuuauguuuugggagacccagccaucuaccaaagccugaaggcacagaaugcuuauucucgucacuguccuuucuaugucagcauucagaguuacuggcugucauuuuucauggugaugauuuuauuuguagcuuucauaaccuguugggaagaaguuacuacuuugguacaggcuaucaggauaacuuccuauaugaaugaaacuaucuuauauuuuccuuuuucaucccacuccaguuauacugugagaucuaaaaaaauauucuuauccaagcucauugucuguuuucucaguaccugguuaccauuuguacuacuucagguaaucauuguuuuacuuaaaguucagauuccagcauauauugagaugaauauucccugguuauacuuugucaauaguuuucucauugcuacaguguauugguuuaauugucacaagcuuaauuuaaaagacauuggauuaccuuuggauccauuugucaacuggaagugcugcuucauuccacuuacaauuccuaaucuugagcaaauugaaaagccuauaucaauaaugauuuguuaauauuauuaauuaaaaguuacagcugucauaagaucauaauuuuaugaacagaaagaacucaggacauauuaaaaaauaaacugaacuaaaacaacuuuugcccccugacugauagcauuucagaaugugucuuuugaagggcuaugauaccaguuauuaaauaguguuuuauuuuaaaaacaaaauaauuccaagaaguuuuuauaguuauucagggacacuauauuacaaauauuacuuuguuauuaacacaaaaagugauaagaguuaacauuuggcuauacugauguuuguguuacucaaaaaaacuacuggaugcaaacuguuauguaaaucugagauuucacugacaacuuuaagauaucaaccuaaacauuuuuauuaaauguucaaaugaaagcaagaaaguaaaaa

SEQ ID NO: 319 - RNA, 3138 nt, Homo Sapiens
ggagcgggcgagcggcgacggcggcggcggcgggcacaggguuucaaauuggcccuuuggccucuggagcaaauucaaauguaacucuuccccaaccccccuucucuucuuccagauuaauuaaaagaagaaugaacuauaauccuugaagauaacugggcaauuuuuuaagucggaggcuguucuuacuggugugaggauuuacacacgucuucaguuuuucagcacagaccagcagaccaucauuuuuagaggaaauacucccucugcccuccuuuuugguuuccuuggugguaaagauuaaauuugguugcaucauuuugacuuguguuugagucuagauuuuauggcacaaggaauggcauaaacuuuucauguguuuugguuaaaacaaaccagaccauugcauugacccuggacaucuuuaauugagaaauugguaacuuuauuuuaauauguauaucugaagaauucaagaaaacaaaggcauccucagaggugugccucuuuucuuuauuauuagaggcaaaacgaacaauuuuauaggauuuguagugaaauuauaccagauuauaaggagaaccaaaacuaagucgcaaaauuuauuaauuuaaggggcucucgcuuugaaaguuugagaguaaguuacgauaggcauuuguauccauucauuacuuuccucuuuucaaauaagcaacuaaauagaaaugcuaaucucagacuuaauuauuuaacagaagaguguaccauggaaaaccuccagacaaauuucuccuugguucagggcucaacuaaaaaacugaaugggaugggagaugauggcagccccccagcgaaaaaaaugauaacggacauucaugcaaauggaaaaacgauaaacaaggugccaacaguuaagaaggaacacuuggaugacuauggagaagcaccaguggaaacugauggagagcauguuaagcgaaccuguacuucuguuccugaaacuuugcauuuaaaucccaguuugaaacacacauuggcacaauuccauuuaaguagucagagcucgcuggguggaccagcagcauuuucugcucggcauucccaagaaagcaugucgccuacuguauuucugccucuuccaucaccucagguucuuccuggcccauugcucaucccuucagauagcuccacagaacucacucagacuguguuggaaggggaaucuauuucuuguuuucaaguuggaggagaaaagagacucuguuugccccaagucuuaaauucuguucuccgagaauuuacacuccagcaaauaaauacagugugugaugaacuguacauauauuguucaagguguacuucagaccagcuucauaucuuaaagguacugggcauacuuccauucaaugccccauccugugggcugauuacauuaacugaugcacaaagauuauguaaugcuuuauugcggccacgaacuuuuccucaaaaugguagcguacuuccugcuaaaagcucauuggcccaguuaaaggaaacuggcagugccuuugaaguggagcaugaaugccuaggcaaaugucaggguuuauuugcaccccaguuuuauguucagccugaugcuccguguauucaaugucuggaguguuguggaauguuugcaccccagacguuugugaugcauucucacagaucaccugacaaaagaacuugccacuggggcuuugaaucagcuaaauggcauugcuaucuucaugugaaccaaaaauacuuaggaacaccugaagaaaagaaacugaagauaauuuuagaagaaaugaaggagaaguuuagcaugagaaguggaaagagaaaucaauccaaggcaaacagaugcaccaucaggaauggaauuacagucaugguauccuguuauaaagcaggaaggugaccauguuucucagacacauucauuuuuacaccccagcuacuacuuauacaugugugauaaagugguugccccaaaugugucacuuacuucugcuguaucccagucuaaagagcucacaaagacagaggcaaguaaguccauaucaagacagucagagaaggcucacaguagugguaaacuucaaaaaacagugucuuauccagaugucucacuugaggaacaggagaaaauggauuuaaaaacaaguagagaauuauguagccguuuagaugcaucaaucucaaauaauucuacaaguaaaaggaaaucugagucugccacuugcaacuuagucagagacauaaacaaagugggaauuggccuuguugcugccgcuucaucuccgcuucuugugaaagaugucauuugugaggaugauaagggaaaaaucauggaagaaguaaugagaacuuauuuaaaacaacaggaaaaacuaaacuugauuuugcaaaagaagcaacaacuucagauggaaguaaaaauguugaguaguucaaaaucuaugaaggaacucacugaagaacagcagaauuuacagaaagagcuugaaucuuugcagaaugaacaugcucaaagaauggaagaauuuuauguugaacagaaagacuuagagaaaaaauuggagcagauaaugaagcaaaaauguaccugugacucaaauuuagaaaaagacaaagaggcugaauaugcaggacaguuggcagaacugaggcagagauuggaccaugcugaggccgauaggcaagaacuccaagaugaacucagacaggaacgggaagcaagacagaaguuagagaugaugauaaaagagcuaaagcugcaaauucugaaaucaucaaagacugcuaaagaauagaaacuguuaaagagauucaucuguguauuacugacaagguuuuuuuuguuuguugcuugcuuugguaauugaauucugaagaauuuaucugcaugacgauaacuaggcauucuauccauuuguagaucagagaaagugaagagauuauauauuaguacuuaaauuuuuacauuuuccaaaugaaugaaaauguauguuucuuuguacuuuuuuaaaaaaaucagcuuaguaacaauacuauaugguuucaacuaguagguaaucugcuuauauuucuaaugcaaacuuaacaauuguguacuuuuuaaaagcugcaauauguguuggaaaa

SEQ ID NO: 320 - RNA, 8088 nt, Homo Sapiens
caauaaugaagguggcugcggcgcggcggcaggcucagcugcgccgggcgggggcggcgccggggccgcgccuguaggacucggggccgacgccgcgggauggggacgcggcgcggggagugaggcaguggcggcggcggcgguaagcggaacuucggcccgaggggcucgcccgcucccgccucugucuugucggccuccaccugcagccccgcggcccccgcgccccgcgggacccggacggcgacgacgggggaauguggcgcuggauccggcagcagcuggguuuugacccaccacaucagagugacacaagaaccaucuacguagccaacagguuuccucagaauggccuuuacacaccucagaaauuuauagauaacaggaucauuucaucuaaguacacuguguggaauuuuguuccaaaaaauuuauuugaacaguucagaagaguggcaaacuuuuauuuucuuauuauauuuuugguucagcuuaugauugauacaccuaccaguccaguuaccaguggacuuccauuauucuuugugauaacaguaacugccauaaagcagggauaugaagauugguuacggcauaacucagauaaugaaguaaauggagcuccuguuuauguuguucgaagugguggccuuguaaaaacuagaucaaaaaacauucgggugggugauauuguucgaauagccaaagaugaaauuuuuccugcagacuuggugcuucuguccucagaucgacuggaugguuccugucacguuacaacugcuaguuuggacggagaaacuaaccugaagguuugcuugcauauguuugaguauugcucuuggugaacaaagugucuuuggauuauaauuauacuuaacuuugguuaaaguaguaaaguuugaccagauuaaggggaaguuuuuaaaauuacuauuucaaaaauaaaaagguuuuaagaaagaaacacauguggcaguuccagaaacagcauuauuacaaacaguugccaauuuggacacucuaguagcuguaauagaaugccagcaaccagaagcagacuuauacagauucaugggacgaaugaucauaacccaacaaauggaagaaauuguaagaccucuggggccggagagucuccugcuucguggagccagauuaaaaaacacaaaagaaauuuuugguguugcgguauacacuggaauggaaacuaagauggcauuaaauuacaagagcaaaucacagaaacgaucugcaguagaaaagucaaugaauacauuuuugauaauuuaucuaguaauucuuauaucugaagcugucaucagcacuaucuugaaguauacauggcaagcugaagaaaaaugggaugaaccuugguauaaccaaaaaacagaacaucaaagaaauagcaguaagauucugagauuuauuucagacuuccuugcuuuuuugguucucuacaauuucaucauuccaauuucauuauaugugacagucgaaaugcagaaauuucuuggaucauuuuuuauuggcugggaucuugaucuguaucaugaagaaucagaucagaaagcucaagucaauacuuccgaucugaaugaagagcuuggacagguagaguacguguuuacagauaaaacugguacacugacagaaaaugagaugcaguuucgggaauguucaauuaauggcaugaaauaccaagaaauuaaugguagacuuguacccgaaggaccaacaccagacucuucagaaggaaacuuaucuuaucuuaguaguuuaucccaucuuaacaacuuaucccaucuuacaaccaguuccucuuucagaaccaguccugaaaaugaaacugaacuaauuaaagaacaugaucucuucuuuaaagcagucagucucugucacacuguacagauuagcaauguucaaacugacugcacuggugauggucccuggcaauccaaccuggcaccaucgcaguuggaguacuaugcaucuucaccagaugaaaaggcucuaguagaagcugcugcaaggauugguauuguguuuauuggcaauucugaagaaacuauggagguuaaaacucuuggaaaacuggaacgguacaaacugcuucauauucuggaauuugauucagaucguaggagaaugaguguaauuguucaggcaccuucaggugagaaguuauuauuugcuaaaggagcugagucaucaauucucccuaaauguauagguggagaaauagaaaaaaccagaauucauguagaugaauuugcuuugaaagggcuaagaacucuguguauagcauauagaaaauuuacaucaaaagaguaugaggaaauagauaaacgcauauuugaagccaggacugccuugcagcagcgggaagagaaauuggcagcuguuuuccaguucauagagaaagaccugauauuacuuggagccacagcaguagaagacagacuacaagauaaaguucgagaaacuauugaagcauugagaauggcugguaucaaaguauggguacuuacuggggauaaacaugaaacagcuguuagugugaguuuaucauguggccauuuucauagaaccaugaacauccuugaacuuauaaaccagaaaucagacagcgagugugcugaacaauugaggcagcuugccagaagaauuacagaggaucaugugauucagcaugggcugguaguggaugggaccagccuaucucuugcacucagggagcaugaaaaacuauuuauggaaguuugcagaaauuguucagcuguauuaugcugucguauggcuccacugcagaaagcaaaaguaauaagacuaauaaaaauaucaccugagaaaccuauaacauuggcuguuggugauggugcuaaugacguaagcaugauacaagaagcccauguuggcauaggaaucauggguaaagaaggaagacaggcugcaagaaacagugacuaugcaauagccagauuuaaguuccucuccaaauugcuuuuuguucauggucauuuuuauuauauuagaauagcuacccuuguacaguauuuuuuuuauaagaaugugugcuuuaucacaccccaguuuuuauaucaguucuacuguuuguuuucucagcaaacauuguaugacagcguguaccugacuuuauacaauauuuguuuuacuucccuaccuauucugauauauagucuuuuggaacagcauguagacccucauguguuacaaaauaagcccacccuuuaucgagacauuaguaaaaaccgccucuuaaguauuaaaacauuucuuuauuggaccauccugggcuucagucaugccuuuauuuucuuuuuuggauccuauuuacuaauagggaaagauacaucucugcuuggaaauggccagauguuuggaaacuggacauuuggcacuuuggucuucacagucaugguuauuacagucacaguaaaggauggcucuggaaacucauuuuuggacuuggaucaaccaucucguuaccuggggaucuauuauauuuuauuuuguauuuuccuuguuuuauggagggauucucuggccauuuuugggcucccagaauauguauuuuguguuuauucagcuccugucaagugguucugcuugguuugccauaauccucaugguuguuacaugucuauuucuugauaucauaaagaaggucuuugaccgacaccuccacccuacaaguacugaaaaggcacagcuuacugaaacaaaugcagguaucaagugcuuggacuccaugugcuguuucccggaaggagaagcagcgugugcaucuguuggaagaaugcuggaacgaguuauaggaagauguaguccaacccacaucagcaggugugaaaucucucuaaguagccuuugcugcagaugaguauccuaucuggaacaggaugaaccugccgcucuagauaccuaauaaaucagcagcugguuuuaccaacugaagcaggaagucugcuauuuauuagcacucuuuggugguagauuucacuuuguggcuuugggguaagggcuuuuucacucacaaaggaagagaaagcaccuuugaagagacuucaucuaaugaacaaaaaauuuuguuucauaaucuuucuaaaaugugcucaguaggaguguguuuaugguacucuuuuaugguuuguauaacuuucuuuuuuaaauuauacauauacuauuuccuuuuuauuuuuuuaaaauuuuuuugcuuuuugucuuuacaaaauaaucucaacauaacagugaagucaaaggcuuuccuuuucuuacucuguauguauauuuuccaguugguuauuugaggcuuugagguauuuauaaacacaaaaggcuguauuucugcuccccuaccucuucuuaugucuguaaugaaguuuugaaaugagucaugauuuuuaaguuucuuuugcuugguauuuauugccuaauuaaaaguguaugaguuagaaaucauggagugcaucggauccuuucuauaccaacgacaggagcaucuugacucucuccacaauggacucaucuacuuguuaaaggggcaguaguacuuugugggagccaguucaccuccuuuccuaaaauucagugugaucacccuguuaauggccacacuagcucugaaauuaauuuccaaaaucuuuguaguaguucauacccacucagaguuauaauggcaaacaaacagaaagcauuaguacaagccccucccaacacccuuaauuugaaucugaacauguuaaaauuugagaauaaagagacauuuuucaucucuuugucugguuugucccuugugcuuaugggacuccuaauggcauuucagucuguugcugaggccauuauauuuuaauauaaauguagaaaaaagagagaaaucuuaguaaagaguauuuuuuaguauuagcuugauuauugacucuucuauuuaaaucugcuucuguaaauuaugcugaaaguuugccuugagaacucuauuuuuuuauuagaguuauauuuaaagcuuuucaugggaaaaguuaaugugaauacugaggaauuuuggucccucagugaccuguguuguuaauucauuaaugcauucugaguucacagagcaaauuaggagaaucauuuccaaccauuauuuacugcaguauggggaguaaauuuauaccaauuccucuaacuguacuguaacacagccuguaaaguuagccauauaaaugcaaggguauaucauauauacaaaucaggaaucagguccguucaccgaacuucaaauugauguuuacuaauauuuuugugacagaguauaaagacccuauaguggguaaauuagauacuauuagcauauuauuaauuuaaugucuuuaucauuggaucuuuugcaugcuuuaaucugguuaacauauuuaaauuugcuuuuuuucucuuuaccugaaggcucuguguauaguauuucaugacaucguuguacaguuuaacuauaucaauaaaaaguuuggacaguauuuaaauauugcaaauauguuuaauuauacaaaucagaauaguauggguaauuaaaugaauacaaaaagaagagccucuuucugcagccgacuuagacaugcucuucccuuucuauaagcuagauuuuagaauaaaggguuucaguuaauaaucuuauuuucagguuaugucaucuaacuuauagcaaacuaccacaauacagugaguucugccagugucccaguacaaggcauauuucagguguggcuguggaauguaaaaaugcucaacuuguaucagguaauguuagcaauaaauuaaaugcuaagaaugauuaaucggguacauguuacuguaauuaacucauugcacuucaaaaccuaacuuccauccugaauuuaucaaguaguucaguauugucauuuguuuuuguuuuauugaaaaguaauguugucuuaagauuuagaagugauuauuagcuugagaacuauuacccagcucuaagcaaauaaugauuguauacauauuaagauaaugguuaaaugcgguuuuaccaaguuuucccuugaaaauguaauuccuuuauggagauuuauugugcagcccuaagcuuccuucccauuucaugaauauaaggcuucuagaauuggacuggcaggggaaagaaugguagagacagaaauuaagacuuuauccuuguuugcuuguaaacuauuauuuucuugcuaauguaacauuugucuguuccagugauguaaggauauuaaguuauuaagcuaaauauuaauuuucaaaaauaguccuucuuuaacuuagauauuucauagcuggauuuaggaagaucuguuauucuggaaguacuaaaaagaauaauacaacguacaaugucugcauucacuaauucauguuccagaagaggaaauaaugaagauauacucaguagaguacuaggugggaggauauggaaauuugcucauaaaaucucuuauaaaacgugcauauaacaaaaugacacccaguaggccugcauuacauuuacaugaccguguuuauuugccaucaaauaaacugaguacugacaccagacaaagacuccaaagucauaaaauagccuaugaccaacugcagcaagacaggaggucagcucgccuauaauggugcuuaaagugugauugauguaauuuucuguacucaccauuugaaguuaguuaaggagaacuuuauuuuuuuaaaaaaaguaaauggcaaccacuagugugcucauccugaacuguuacuccaaauccacuccguuuuuaaagcaaaauuaucuugugauuuuaagaaaagaguuuucuauuuauuuaagaaaguaacaaugcagucugcaagcuuucaguaguuuucuagugcuauauucauccuguaaaacucuuacuacguaaccaguaaucacaaggaaaguguccccuuugcauauuucuuuaaaauucuuucuuuggaaaguaugauguugauaauuaacuuacccuuaucugccaaaaccagagcaaaaugcuaaauacguuauugcuaaucaguggucucaaaucgauuugccucccuuugccucgucugagggcuguaagccugaagauaguggcaagcaccaagucaguuuccaaaauugccccucagcugcuuuaagugacucagcacccugccucagcuucagcaggcguaggcucacccugggcggagcaaaguaugggccagggagaacuacagcuacgaagaccugcugucgaguugagaaaaggggagaauuuauggucugaauuuucuaacuguccucuuucuugggucuaaagcucauaauacacaaaggcuuccagaccugagccacacccaggcccuauccugaacaggagacuaaacagaggcaaaucaacccuaggaaauacuugcauucugcccuacgguuaguaccaggacugaggucauuucuacuggaaaagauugugagauugaacuuaucugaucgcuugagacuccuaauaggcaggagucaaggccacuagaaaauugacaguuaagagccaaaaguuuuuaaaauaugcuacucugaaaaaucucgugaaggcuguaggaaaagggagaaucuuccauguugguguuuuuccuguaaagaucaguuugggguaugauauaagcagguauuaauaaaaauaacacaccaaagaguuacguaaaacauguuuuauuaauuuugguccccacguacagacauuuuauuucuauuuugaaaugaguuaucuauuuucauaaaaguaaaacacuauuaaagugcuguuuuaugugaaauaacuugaauguuguuccuauaaaaaauagaucauaacucaugauauguuuguaaucaugguaauuuagauuuuuaugaggaaugaguaucuggaaauauuguagcaauacuugguuuaaaauuuuggaccugagacacuguggcugucuaauguaauccuuuaaaaauucucugcauugucaguaaauguaguauauuauuguacagcuacucauaauuuuuuaaaguuuaugaaguuauauuuaucaaauaaaaacuuuccuauauaauuaaaa

SEQ ID NO: 321 - RNA, 7568 nt, Homo Sapiens
aagacgcaucgucaugugaucaucaccuaagaacuagaacaucagcaggcccuagaagccucacucuugccccucccuuuaauaucucaaagaggaugacacuucugugguguguagugagucucuacuuuuauggaauccugcaaagugaugccucagaacgcugcgaugacuggggacuagacaccaugaggcaaauccaaguguuugaagaugagccagcucgcaucaagugcccacucuuugaacacuucuugaaauucaacuacagcacagcccauucagcuggccuuacucugaucugguauuggacuaggcaggaccgggaccuugaggagccaauuaacuuccgccuccccgagaaccgcauuaguaaggagaaagaugugcugugguuccggcccacucuccucaaugacacuggcaacuauaccugcauguuaaggaacacuacauauugcagcaaaguugcauuucccuuggaaguuguucaaaaagacagcuguuucaauucccccaugaaacucccagugcauaaacuguauauagaauauggcauucagaggaucacuuguccaaauguagauggauauuuuccuuccagugucaaaccgacuaucacuugguauaugggcuguuauaaaauacagaauuuuaauaauguaauacccgaagguaugaacuugaguuuccucauugccuuaauuucaaauaauggaaauuacacauguguuguuacauauccagaaaauggacguacguuucaucucaccaggacucugacuguaaagguaguaggcucuccaaaaaaugcagugcccccugugauccauucaccuaaugaucauguggucuaugagaaagaaccaggagaggagcuacucauucccuguacggucuauuuuaguuuucugauggauucucgcaaugagguuugguggaccauugauggaaaaaaaccugaugacaucacuauugaugucaccauuaacgaaaguauaagucauaguagaacagaagaugaaacaagaacucagauuuugagcaucaagaaaguuaccucugaggaucucaagcgcagcuaugucugucaugcuagaagugccaaaggcgaaguugccaaagcagccaaggugaagcagaaagguaauagaugcggucagugaugaaucucucagcuccaaauuaacauuguggugaauaaggacaaaaggagagauugagaacaagagagcuccagcaccuagcccgacggcaucuaacccauaguaaugaaucaaacuuaaaugaaaaauaugaaaguuuucaucuauguaagauacucaaaauauuguuucugauauuguuaguaccguaaugcccaaauguagcuaaaaaaaucgacgugaguacagugagacacaauuuugugucuguacaauuaugaaaaauuaaaaacaaagaaaauauucaaagcuaccaaagauagaaaaaacugguagagccacauauuguuggugaauuauuaagacccuuuuaaaaaucauucaugguagacuucaagagucauaaaaaagauugcaucaucugaccuaagacuuucggaauuuuuccugaacaaauaacagaaagggaauuauauaccuuuuaauauuauuagaagcauuaucuguaguuguaaaacauuauuaauagcagccauccaauuguaugcaacuaauuaagguauugaauguuuauuuuccaaaaaugcauaauuauaauauuauuuuaaacacuauguaucaauauuuaagcagguuuauaauauaccagcagccacaauugcuaaaaugaaaaucauuuaaauuaugauuuuaaaugguauaaacaugauuucuauguugauaguacuauauuauucuacaauaaauggaaauuauaaagccuucuugucagaagugcugcuccuaaaugccagcuccaagauacacaguggaacuggcuugugguuuuggagccacaguccugcuaguggugauucucauuguuguuuaccauguuuacuggcuagagaugguccuauuuuaccgggcucauuuuggaacagaugaaaccauuuuagauggaaaagaguaugauauuuauguauccuaugcaaggaaugcggaagaagaagaauuuguauuacugacccuccguggaguuuuggagaaugaauuuggauacaagcugugcaucuuugaccgagacagucugccugggggaauugucacagaugagacuuugagcuucauucagaaaagcagacgccuccugguuguucuaagccccaacuacgugcuccagggaacccaagcccuccuggagcucaaggcuggccuagaaaauauggccucucggggcaacaucaacgucauuuuaguacaguacaaagcugugaaggaaacgaaggugaaagagcugaagagggcuaagacggugcucacggucauuaaauggaaaggggaaaaauccaaguauccacagggcagguucuggaagcagcugcagguggccaugccagugaagaaaagucccaggcggucuagcagugaugagcagggccucucguauucaucuuugaaaaauguaugaaaggaauaaugaaaaggguaaaaagaacaaggggugcuccaggaagaaagaguccccccagucuucauucgcaguuuaugguuucauaggcaaaaauaauggucuaagccucccaauagggauaaauuuagggugacuguguggcugacuauucugcuuccucaggcaacacuaaaguuuagaaagauaucaucaacguucugucaccagucucugaugccacuauguucuuugcaggcaaagacuuguucaaugcgaauuuccccuucuacauugucuaucccuguuuuuauaugucuccauucuuuuuaaaaucuuaacauauggagcagccuuuccuaugaauuuaaauaugccuuuaaaauaagucacuguugacagggucaugaguuuccgaguauaguuuucuuuuuaucuuauuuuuacucguccguugaaaagauaaucaaggccuacauuuuagcugaggauaaugaacuuuuuuccucauucggcuguauaauacauaaccacagcaagacugacauccacuuaggaugauacaaagcaguguaacugaaaauguuucuuuuaauugauuuaaaggacuugucuucuauaccacccuuguccucaucucagguaauuuaugaaaucuauguaaacuugaaaaauauuucuuaauuuuuguuuuugcuccagucaauuccugauuauccacaggucaacccacauuuuuucauuccuucucccuaucugcuuauaucgcauugcucauuuagaguuugcaggaggcuccauacuagguucagucugaaagaaaucuccuaauggugcuauagagagggagguaacagaaagacucuuuuagggcauuuuucugacucaugaaaagagcacagaaaaggauguuuggcaauuugucuuuuaagucuuaaccuugcuaaugugaauacugggaaagugauuuuuucucacucguuuuuguugcuccauuguaaagggcggaggucagucuuaguggccuugagaguugcuuuuggcauuaauauucuaagagaauuaacuguauuuccugucaccuauucacuagugcaggaaauauacuugcuccaaauaagucaguaugagaagucacugucaaugaaaguuguuuuguuuguuuucaguaauauuuugcuguuuuuaagacuuggaaaacuaagugcagaguuuacagagugguaaauaucuauguuacauguagauuauacauauauauacacacguguauaugagauauauaucuuauaucuccacaaacacaaauuauauauauacauauccacacacauacauuacauauaucuguguauauaaauccacaugcacaugaaauauauauauauauauaauuuguguguguguauguguauguauaugacuuuaaauagcuauggguacaauauuaaaaaccacuggaacucuuguccaguuuuuaaauuauguuuuuacuggaauguuuuugugucaguguuuucuguacauauuauuuguuaauucacagcucacagagugauaguugucauaguucuugccuucccuaaguuuauauaaauaacuuaaguauugcuacaguuuaucuagguugcaguggcaucugcugugcacagagcuuccauggucacugcuaagcaguagccagccaucgggcauuaauugauuuccuacuauauucccagcagacacauuuagaaacuaagcuauguuaaccucagugcucaacuauuugaacuguugagugauaaaggaaacaaauauaacuguaaaugaaucuugguauccugugaaacagaauaauucguaauuuaagaaagcccuuaucccgguaacaugaauguugaugaacaaauguaaaauuauauccuauauuuaaguacccauaauaaaucauuucccucuauaaguguuauugauuauuuuaaauugaaaaaaguuucacuuggaugaaaaaaguagaaaaguaggucauucuuggaucuacuuuuuuuuagccuuauuaauauuuuucccuauuagaaaccacaauuacucccucuauuaacccuucacuuacuagaccagaaaagaacuuauuccagauaagcuuugaauaucaauucuuacauaaacuuuaggcaaacagggaauagucuagucaccaaaggaccauucucuugccaaugcugcauuccuuuugcacuuuuggauuccauauuuaucccaaaugcuguugggcaccccuagaaauaccuugauguuuuuucuauuuauaugccugccuuugguacuuaauuuuacaaaugcuguaauauaaagcauaucaaguuuaugugauacguaucauugcaagagaauuuguuucaagauuuuuuuuuaauguuccagaagauggccaauagagaacauucaagggaaauggggaaacauaauuuagagaacaagaacaaaccaugucucaaauuuuuuuaaaaaaaauuaaugguuuuaaauauaugcuauagggacguuccaugcccagguuaacaaagaacugugauauauagagugucuaauuacaaaaucauauacgauuuauuuaauucucuucuguauuguaacuuagaugauucccaaggacucuaauaaaaaaucacuucauuguauuuggaaacaaaaacaucauucauuaauuacuuauuuucuuuccauagguuuuaauauuuugagagugucuuuuuuauuucauucaugaacuuuuguauuuuucauuuuucauuugauuuguaaauuuacuuauguuaaaaauaaaccauuuauuuucagcuuugauacaguggaagcaguuuuugauuucauucagagaagcagaaggaugauuguuguucugagcccugacuaugugacagaaaagagcaucagcaugcuggaguuuaaacugggugucaugugccagaacuccauugccaccaagcucauugugguugaguaccguccccuugagcacccgcacccaggcauucuucagcucaaagagucugugucuuuugugagcuggaagggagaaaaguccaaacauucuggcucuaaauucuggaaagcuuugcgguuggcucuuccccugagaagucugagugccaguucuggcuggaaugagagcugcucuucccagucugacaucagucuggaucacguucaaaggaggagaagucguuugaaagagcccccagaacuucagagcucagagagggcugcagguagcccuccagccccaggcacaauguccaagcaccgagggaaguccuccgccaccugccgcuguugugucaccuacugugaaggagagaaucaccuuaggaacaagagccgggcagagauucauaaccagccccagugggagacacaccucuguaagccuguuccccaagagucagaaacucaauggauacaaaauggcaccagauuggaacccccugcuccccagaucucagcccuugcucuucaucauuucacggacuuauccaauaacaacgacuuuuauauccuauaauuacuguguguggugggugguggcuacuaucucuaccaacccucuguaugucaugaaccugugggaaaaucugacauuuuuaucaucuaauggacuaucagauuucuguccccuuuauugauuuuuaaaaacuauuuauuucuaggagacaaaagaccugaaggaccugaauccagaauuauugccucuaaaggccucagaagagcacacucuucuugggcccuagaaggucaguaugugaaaguugccuaaagucugauccucuaucuuguccaaugguuuaaaacugagcuaagaauuuaaauguguuucuuuucagugaguugaucaaccucacauuauaagucagucagguguacuugggcuaugaugcuuacaggguguaugcauucccagggagcagcauggaaaggagcugguucugguggaagcuguaggacgaagcucaacagaaaaccuacagcacauuuuuccucaaagaaccaaacauacccacccagggauacauggcguucucugucucacuguaaacuaguguucucuaaacugccuaacauuguuagcaucaauaaaauucuauuuuuacgucauuuuauuuguacuaacaaauuuuuacaucucucucacccuucuacuuccuaugauuguuguauucuuaucuggagaguauuccauuucagaaaauggagauuugguuuagguaccagaaaaacuaagaugccuuuuuuguuucucucugauauguaaugggagagauguggaaaauaaccaaaagagagggagaaugugacuuaaaugaaauggaaguuuacaacaaucucauauuuuuagaacugacagaugaaaaauuccguauuguaagugauguagcguagaaauaggugccuucgucccauucaggcuucugagaagggauaauaaauucaagugccuacaaggaucagaagguaagagaaaagagaaaauauggccagauaccagcuuauuuuacaugcucuccaucuagaacugaugugaauagggacauaggcacagauaguuauuucuucucuguaaacauuuucauaaacucauauaaggcacauggcauuugauuuccaagucagguagaucauuggcccucuaagcaacugaagaacacauauuucuuaaaaagggucagcuucaggccgggugugguggcucaugccuauaaucccagcacuuugggaagucaagacuuguggaucaacugaggucaguuguucaagagcagccuggccaacauugugaaaccccaucucuacaaaaauacaaaauuagccagguaugguggugggcaccuguaaucccagcuacucaggaggcugaggcaggagaaacucuugaaccuaggagguggagguugcagugagccgagaucgugccacugcacuccagacuuggugacagagcaagacuccaucuu

SEQ ID NO: 322 - RNA, 2777 nt, Homo Sapiens
ugccucagccucccgaguagcugcgacuacaggcgccuccaccacgccuggcuaauuuuuuuguauuuuuaguagagacaggguuucaccuguuagccaggauggucucgauccccugaccucgugauccccccaccuuggccucccaaagugcugggauuccaggagugagccaccgagccugggccaccgccgauaguuuuccacuuucccgccaggcccgacgccgcucugacgccacugaggugcgccacgacgugacgucaacguucgcgccggaaguggaagaccaggcagcccagcugaaggcaguaagcucggcucacagucgcaggagaguucugggguacacgggcaaaggggcuugagaaggcccggaggcgaagccgaagagaagcaacugugccccggagaagagaagcucgcccauuccagacugggaaccagcuuucagugaagauggcagggccagaacuguugcucgacuccaacauccgccucugggugguccuacccaucguuaucaucacuuucuucguaggcaugauccgccacuacguguccauccugcugcagagcgacaagaagcucacccaggaacaaguaucugacagucaaguccuaauucgaagcagaguccucagggaaaauggaaaauacauucccaaacagucuuucuugacacgaaaauauuauuucaacaacccagaggauggauuuuucaaaaaaacuaaacggaagguagugccaccuucuccuaugacugauccuacuauguugacagacaugaugaaagggaauguaacaaauguccucccuaugauucuuauugguggauggaucaacaugacauucucaggcuuugucacaaccaaggucccauuuccacugacccuccguuuuaagccuauguuacagcaaggaaucgagcuacucacauuagaugcauccugggugaguucugcauccugguacuuccucaauguauuugggcuucggagcauuuacucucugauucugggccaagauaaugccgcugaccaaucacgaaugaugcaggagcagaugacgggagcagccauggccaugcccgcagacacaaacaaagcuuucaagacagagugggaagcuuuggagcugacggaucaccagugggcacuagaugaugucgaagaagagcucauggccaaagaccuccacuucgaaggcauguucaaaaaggaauuacagaccucuauuuuuugaagaccgagcagggauuagcugugucaggaacuuggaguugcacuuaaccuuguaacuuuguuuggagcuggcaccucuugaaauaaaaaggaggaugcacgagcuggcaggcaugcagcaaggcuuguucuugucugggcuggguuccccuuuauguuugaaacuagaggaaauaggaguaugcugggcaacuuguuauuuuuaaaauguuguaaauguuccuucuggugacucuaguaaugaaagucagagaaagggggaaaccucaggcuacugauaauauauaaaaucuuggccaggcgcaguggcucacgccuguaaucccaggauuuugggaggcugaggcgggugggucacgagaucaggaguucaagaucagccuggccaagauggugaaaccccaucucuacuaaaaauacaaaaaaaaauuagccgggcgugguggugggcaccuguaaucccagcuacuugggaggcugaggcagagaacugcuuaaaccuaggaggcggaggaugcagugagcugacaucgugccacugcgcuccagccugggcgacagagcaaaacuccaucugaaaaaaaaaaaaaaauauauauauauauauauauauaucuaucuuagcagaagcccagucuucgaaggaagcauuguuaauuauagcuaaugauuaugugcagucagccugacaucuagccacaguaaacuccuguuuucuugggauccaaacacccuguguuuuaccauuaguuuuguuaguauuguuaacuuucuuuacacaaguaaaccauuuccacuaccaaagguuuagaaacuauggaugaacaaaaugaaucucccuguucauuuugagccuacauagacauagagaccaaauaugucaaaaccuuauucaaauaaacucucuucagagugaauacccagggucaggacagacucagcaaaccuucuauaucacuuaauucugcccagugaaaaucagugacccugaggcacugccagauucuaaagugccuuugggaucaucagagacugucuauaaauaaugcaaaaucuugaucuggaugucaguguaucaaaucuuaucaaauccauugacaaaucaguggugcuauacuggaaauggcuacuccuuuggaugaaggaccucauuucccaguugcuuggaacaaaagagaauuuacauauugcuguaagaagggagagacggcaguuguugguagacacacagauaagggugcccaagaauaauucugucuggauuaaaggucccagggaagugacggugccauuucuguaccaagaggugaauauaauuugcauguugagugcaguaauuaagaacaaacgacucgacuccacaaauuaaaccguccuguuuucucuucuuugccugugaaaguguugccucuguaagucacuaacaaccuucugccagcaguugacugucuaucuuggaucagugcggggagucuaagacgaaagagaugugaaccuugcccucaacucacaagagagagacaccuaagagcu

SEQ ID NO: 323 - RNA, 3137 nt, Homo Sapiens
gcgaccugaugaugccgagcccaggccgguuccggcgaaguuaaacccucggagcuggccucggacugcuggggcguuaccccuucggccacccccgcugaccauggcaguguuucaugacgagguggaaaucgaggacuuccaauaugacgaggacucggagacguauuucuaucccugcccauguggagauaacuucuccaucaccaaggaagauuuggagaauggggaagacguggcaacguguccuagcugcucucucauuauaaaagugauuuaugacaaagaucaguuuguguguggagaaacagucccagccccuucagccaacaaagaauuaguuaaaugcugaagaagccuucaggaauccaaauccugaacauuuggaaugagcccagauagaaauaucgaaugcaaagcuacuggcuucacagagacaaccauuuaugauuugcuguucuguaagaguguggauucuuucuaucaacugcugauaucaucuucaggaagcaaguccauaacaugacauaucuggauuuugugcuuagaaccuuaaauuggaagcauucuuaauuaugcaucuaaauuuaaaagaagauaauuucaaaacagugcuuucuuucccuugguuucaucauuuucauaucuuaaaccaaauuacuucgguaucugacaacagcaucaucuaccucagucauuaggauuucuuaauaaaaaagagauuguauuuuugacuugguuauuaagauuauuaaaauuagcccuuccuuugaaauaugacaucagcuuugcuguucuaaauuuaaaauuaguugcuucaucaguaccacacuuccaguuucuauaccaagccagucuccucaguuuucccauuagaauggacauguucuguucagcgugucauuucuguaaugcuucaugcagagaguuuggucauaguauuaaagagaaaauacagugaggucacaaugucuccagagcuaaaaguuagugaacaagaaagaaaguccaaaaugaagugaugaaagaaugaggacuuuucuuauauucugcauauuccuuggaagucaggacaagaugaaaagaaaaacauccaaaagaagugaaauuggugacagaaugagaggagcaaagcauaccaguguaguaaguggaauguuugaaugacuuugccaggucagagcaaguaauauuucuguaucugaguuuuuguuuguguuuugauaaggcuaaugaaauugcauuccagguagggguuaacgucaaauuuccauggcugguagcugugcuuuuggcauaucacaguguugugucacuacuacaagguaaagcaucuacagcggagaaugagcuugaaaaugagagaccuauugugaauaaauaugcccaugagagcauauuuaauaagccucuauaacaugcagccaaaccagacauucacuccugcagagaaauguugcccuggagaaaaagaaauauauaaagauaggcuaucacccuucuuuugcugcaguacuaagcauagcaagaaauuagaaucauuuacauuggaaauuugaaaauucccuuuauauacacaacuuuacuguguauaaauaaaaaauauuuauuaaugcagugauguccgucagguuguuuuaggaauggcuucugcaauuagaaaaauagcuugcuagaauguaaauguucuguuacugguaaauguacugcacacauucauuggacguuaaaacaagugaguagccuuuuuuaccugccagcagcauggcugugugcagccacuaggcugagacaauaaauuaccaaaaauuauaauguaccgagcugaaaaugcucaguacauuauguggcauauucuggaugugaugagaaaucucauugccauuugggacacugacaucccagaaguaauccacaacugcuuugcaaaagcaaagugacugcucagaugaacagagcagaguacucacucacuaugguggcaucagcugcaaagcaaaaugaacugucccaugaucauguugaugguuuucuagauacugccaacauguuagcucuuucugaugcugaugaguuucaaacacgaacagacacccuugauguggguuugcuaagaacauagaagaacaggaagaaaaguugccagguucacacaucccaggaaaaaagaagcauaaaaagcauuagcagucagugacugaugauaaugcugcaauaaugggaaugguuuuguuucuaaaccaaauuauuucuaaaucaaaucauuuauugcuuuguuucuaaagcaauugagucacuaaguuugugaacuguaggagaacacaucaagauugaauccuguguuaagcagaagguaaaaccagagccaggcgcaguggcucgugccuguaaucccagcuacucaggaagcuaaggcaggaggaucaugugaggccaggaguucaagacuagccugggcaacauagaaagacccugucucuaaaaaaucuucuuuuaauuagcaagguguggggccuugagcaaauugcuugggcccaggaguuugaggcuguggugagcugugaucacaccacugcguuccagccugugugacagggcaagaccucaugccuaaaaaauaaagagaaagcagaguaaaacuggacucugagauacgacuaaaguucugugugauacgugugccuuauuuagcucaagacauuccuggagcaccuauaaaaacugacuuguaauccaggcuaugucucuuuuuagcuucguaaucuuuggcaaggccauuggauucuucagcuguacaauuaggagacucgaucaggugauugccuuucucagcugucaguucucuaauuucaggcuugguagcuuguaggaacugaaauugcaauuaaaaccuuuauaaacucaaacuaaaucaugaauuacagaaaaaguccauucuuccaaaacuugauguuaccacacuuacaaguuuaaaauaugaagucgacuguuuaaaggauucugcauauauucuagugugcacauucagaaacauuuuucuuggaaaaaguacccaacauuuuuuauaacugcacauauuaauuuauugccagaauaaauugcauugcaugcuaaauaaagucagauaauucaaaucc

SEQ ID NO: 324 - RNA, 5211 nt, Homo Sapiens
auggccaagucggguggcugcggcgcgggagccggcgugggcggcggcaacggggcacugaccugggugacucuuuuugaucagaacaaugcugcaaaaaaagaagagucagaaacugccaacaaaaaugauucuucaaagaaguugucuguugagagaguguaucagaagaagacacaacuugaacacauucuucuucguccugauacauauauugggucaguggagccauugacgcaguucauguggguguaugaugaagauguaggaaugaauugcagggagguuaccuuugugccagguuuauacaagaucuuugaugaaauuuugguuaaugcugcugacaauaaacagagggauaagaacaugacuuguauuaaaguuucuauugauccugaaucuaacauuauaagcauuuggaauaaugggaaaggcauuccaguaguagaacacaagguagagaaaguuuauguuccugcuuuaauuuuuggacagcuuuuaacauccaguaacuaugaugaugaugagaaaaaaguuacagguggucguaaugguuauggugcaaaacuuuguaauauuuucaguacaaaguuuacaguagaaacagcuugcaaagaauacaaacacaguuuuaagcagacauggaugaauaauaugaugaagacuucugaagccaaaauuaaacauuuugauggugaagauuacacaugcauaacauuccaaccagaucuguccaaauuuaagauggaaaaacuugacaaggauauuguggcccucaugacuagaagggcauaugauuuggcugguucguguagaggggucaaggucauguuuaauggaaagaaauugccuguaaauggauuucgcaguuauguagaucuuuaugugaaagacaaauuggaugaaacugggguggcccugaaaguuauucaugagcuugcaaaugaaagaugggauguuugucucacauugagugaaaaaggauuccagcaaaucagcuuuguaaauaguauugcaacuacaaaagguggacggcacguggauuaugugguagaucaaguuguugguaaacugauugaaguaguuaagaaaaagaacaaagcugguguaucagugaaaccauuucaaagguaaaaaaccauauauggguuuuuauuaauugccuuauugaaaauccaacuuuugauucucagacuaaggaaaacaugacucugcagcccaaaaguuuugggucuaaaugccagcugucagaaaaauuuuuuaaagcagccucuaauuguggcauuguagaaaguauccugaacugggugaaauuuaaggcucagacucagcugaauaagaaguguucaucaguaaaauacaguaaaaucaaagguauucccaaacuggaugaugcuaaugaugcuggugugguaaacauucccuggaguguacacugauauuaacagagggagacucugccaaaucacuggcugugucuggauuaggugugauuggacgagacagauacggaguuuuuccacucaggggcaaaauucuuaauguacgggaagcuucucauaaacagaucauggaaaaugcugaaauaaauaauauuauuaaaauaguuggucuacaauauaagaaaaguuacgaugaugcagaaucucugaaaaccuuacgcuauggaaagauuaugauuaugaccgaucaggaucaagaugguucucacauaaaaggccugcuuauuaauuucauccaucacaauuggccaucacuuuugaagcaugguuuucuugaagaguucauuacuccuauuguaaaggcaagcaaaaauaagcaggaacuuuccuucuacaguauuccugaauuugacgaauggaaaaaacauauagaaaaccagaaagccuggaaaauaaaguacuauaaaggauuggguacuaguacagcuaaagaagcaaaggaauauuuugcugauauggaaaggcaucgcaucuuguuuagauaugcugguccugaagaugaugcugccauuaccuuggcauuuaguaagaagaagauugaugacagaaaagaaugguuaacaaauuuuauggaagaccggagacagcguaggcuacauggcuuaccagagcaauuuuuauaugguacugcaacaaagcauuugacuuauaaugauuucaucaacaaggaauugauucucuucucaaacucagacaaugaaagaucuauaccaucucuuguugaugggcuuuaaaccuggccagcggaaaguuuuauuuaccuguuucaagaggaaugauaaacgugaaguaaaaguugcccaguuggcuggcucuguugcugagaugucggcuuaucaucauggagaacaagcauugaugaugacuauugugaauuuggcucagaacuuugugggaaguaacaacauuaacuugcuucagccuauuggucaguuuggaacucggcuucaugguggcaaagaugcugcaagcccucguuauauuuucacaauguuaagcacuuuagcaaggcuacuuuuuccugcuguggaugacaaccuccuuaaguuccuuuaugaugauaaucaacguguagagccugagugguauauuccuauaauucccaugguuuuaauaaauggugcugagggcauugguacuggaugggcuuguaaacuacccaacuaugaugcuagggaaauugugaacaaugucagacgaaugcuagauggccuggauccucaucccaugcuuccaaacuacaaaaacuuuaaaggcacgauucaagaacuuggucaaaaccaguaugcagucaguggugaaauauuuguaguggacagaaacacaguagaaauuacagagcuuccaguuagaacuuggacacagguguauauaaagaacagguuuuagaaccuaugcuaaauggaacagauaaaacaccagcauuaauuucugauuauaaagaauaucauacugacacaacugugaaauuuguggugaaaaugacugaagagaaacuagcacaagcagaagcugcuggacugcauaaaguuuuuaaacuucaaacuacucuuacuuguaauuccaugguacuuuuugaucauaugggaugucugaagaaauaugaaacugugcaagacauucugaaagaauucuuugauuuacgauuaaguuauuacgguuuacguaaggaguggcuugugggaauguugggagcagaaucuacaaagcuuaacaaucaagcccguuucauuuuagagaagauacaagggaaaauuacuauagagaauaggucaaagaaagauuugauucaaauguuaguccagagagguuaugaaucugacccagugaaagccuggaaagaagcacaagaaaaggcagcagaagaggaugaaacacaaaaccagcaugaugauaguuccuccgauucaggaacuccuucaggcccagauuuuaauuauauuuuaaauaugucucuguggucucuuacuaaagaaaaaguugaagaacugauuaaacagagagaugcaaaagggcgagaggucaaugaucuuaaaagaaaaucuccuucagaucuuuggaaagaggauuuagcggcauuuguugaagaacuggauaaaguggaaucucaagaacgagaagauguucuggcuggaaugucuggaaaagcaauuaaagguaaaguuggcaaaccuaaggugaagaaacuccaguuggaagagacaaugcccucaccuuauggcagaagaauaauuccugaaauuacagcuaugaaggcagaugccagcaaaaaguugcugaagaagaagaagggugaucuugauacugcagcaguaaaaguggaauuugaugaagaauucaguggagcaccaguagaaggugcaggagaagaggcauugacuccaucaguuccuauaaauaaaggucccaaaccuaagagggagaagaaggagccugguaccagagugagaaaaacaccuacaucaucugguaaaccuagugcaaagaaagugaagaaacggaauccuuggucagaugaugaauccaagucagaaagugauuuggaagaaacagaaccugugguuauuccaagagauucuuugcuuaggagagcagcagccgaaagaccuaaauacacauuugauuucucagaagaagaggaugaugaugcugaugaugaugaugaugacaauaaugauuuagaggaauugaaaguuaaagcaucucccauaacaaaugauggggaagaugaauuuguuccuucagauggguuagauaaagaugaauauacauuuucaccaggcaaaucaaaagccacuccagaaaaaucuuugcaugacaaaaaaagucaggauuuuggaaaucucuucucauuuccuucauauucucagaagucagaagaugauucagcuaaauuugacaguaaugaagaagauucugcuucuguuuuuucaccaucauuuggucugaaacagacagauaaaguuccaaguaaaacgguagcugcuaaaaagggaaaaccgucuucagauacagucccuaagcccaagagagccccaaaacagaagaaaguaguagaggcuguaaacucugacucggauucagaauuuggcauuccaaagaagacuacaacaccaaaagguaaaggccgaggggcaaagaaaaggaaagcaucuggcucugaaaaugaaggcgauuauaacccuggcaggaaaacauccaaaacaacaagcaagaaaccgaagaagacaucuuuugaucaggauucagauguggacaucuuccccucagacuucccuacugagccaccuucucugccacgaaccggucgggcuaggaaagaaguaaaauauuuugcagagucugaugaagaagaagaugauguugauuuugcaauguuuaauuaagugcccaaagagcacaaacauuuuucaacaaauaucuuguguuguccuuuugucuucucugucucagacuuuuguacaucuggcuuauuuuaaugugaugauguaauugacgguuuuuuauuauugugguaggccuuuuaacauuuuguucuuacacauacaguuuuaugcucuuuuuuacucauugaaaugucacguacugucugauuggcuuguagaauuguuauagacugccgugcauuagcacagauuuuaauugucaugguuacaaacuacagaccugcuuuuugaaaugaaauuuaaacauuaaaaauggaacugug

SEQ ID NO: 325 - RNA, 3511 nt, Homo Sapiens
gaaccuggcuucgcuaacgcccucccagcucccucgggccugacuuccgguuuccucgcgcgucccuggcgccgagcccgcggacagcggcagccccuuuuccggcugagagcucauccacacuuccaaucacuuuccggagugcuuccccucccuccggcccgugcuggucccgacggcgggccugggucucgcgcgcguauugcuggguaacgggccuucucucgcgucggcccggccccuccugccucggcucgucccuccuuccagaacgucccgggcuccugccgagucagaagaaaugggacucccuccgcgacgugcccggagcagcucccuucgcuguggaagcggcggugucuucgaagaaaccggaagcccguggugaccccuggcgacccgguuuguuuucgguccguuuccaaacacuaaggaaucgaaacucggcggccuugggggcggcccuacguagccuggcuucugguugucauggaugcacugguagaagaugauaucuguauucugaaucaugaaaaagcccauaagagagauacagugacuccaguuucaauauauucaggagaugaaucuguugcuucccauuuugcucuugucacugcauaugaagacaucaaaaaacgacuuaaggauucagagaaagagaacucuuuguuaaagaagagaauaagauuuuuggaagaaaagcuaauagcucgauuugaagaagaaacaaguuccgugggacgagaacaaguaaauaaggccuaucaugcauaucgagagguuugcauugauagagauaauuugaagagcaaacuggacaaaaugaauaaagacaacucugaaucuuugaaaguauugaaugagcagcuacaaucuaaagaaguagaacuccuccagcugaggacagagguggaaacucagcaggugaugaggaauuuaaauccaccuucaucaaacugggagguggaaaaguugagcugugaccugaagauccaugguuuggaacaagagcuggaacugaugaggaaagaauguagcgaucucaaaauagaacuacagaaagccaaacaaacggauccauaucaggaagacaaucugaagagcagagaucuccaaaaacuaagcauuucaagaguaucuguagcacagccuggagugcaguggcgcaaucaugggauagcaugaugauaauaugcagcaugcauacugggaacugaagagagaaaugucuaauuuacaucuggugacucaaguacaagcugaacuacuaagaaaacugaaaaccucaacugcaaucaagaaaggcaagucacuguuuaccggaaaccacugauuccagccaaacugccugaagagcaacuagcugucauaucuuaucaaaaucucaucaaaugagagauugauaagccaaaguauauauaguacauucgcagccuacccauucucugcuuuggcuucagucucauacuggucaacuucacacauaaagguguugcugauguguuuuuucuucaguacuguauucuuuuccccuuguggcuuuucucagccaaguguugcuuauguguauaagacugagguguuaaguuugcucuaguugaccuuuuaccacagcuacuucauauauuugaaaaaaaaaaaaaaaagaccugugccccuguaggaugcagugaagaccuuggaagagacagcacaaaacugcacuugaugaauuuuacugcaacauacacaagacaucccccucucuuaccaaauggcaaagcucuuugucauaccacaucuuccccuuuaccaggagauguaaagguuuuaucagagaaagcaauccuccaaucauggacagacaaugagagauccauuccuaaugaugguacaugcuuucaggaacacaguucuuauggcagaaauucucuggaagacaauuccuggguauuuccaaguccuccuaaaucaagugagacagcauuuggggaaacuaaaacuaaaacuuugccuuuacccaaccuuccaccacugcauuacuuggaucaacauaaucagaacugccuuuauaagaauuaauuuggaagagauucacgauuucaccaugaggacacuuaucucuuucagugguccucccaagaaauuauuuaacaaacugaaaggagauuuugauuaaaauuuugcagaggucuucaguaucuauauuugaacacacuguacaauaguacaaaaaccaacauaguugguuuucuaguaugaaagagcacccucuagcuccauauucuaagaaucugaaauaugcuacuauacuaauuaauaaguaaacuuaagguguuuaaaaaacucugccuucuauauuaauuguaaaauuuugccucucagaagaauggaauuggagauuguagacgugguuuuacaaaaugugaaaugucuaaauaucuguucauaaaaauaaaaggaaaacauguuucuucaaauugcauaauggaacaaauggcaaugugaguagguuacauuucuguuguuauaaugcguaaagauauugaaaauauaaugaaauaaaagcaucuuagguuauaccaucuuuauaugcuauugcguuucaauauuuaagauuuaaagugauuuuuuggucacaguguuuuguugauaaaauuuuuuuagaauugaaguuugaauucuaagacuugaaacaaccugaucacugaagccaacuuugucccagcacauuccuuaaguccuaauugggaaaaaaaaaaaaaaaaaugaaauaguugaaaaacucugggguguaaacaaaugauuguaacccuacacacuauucaauaaguaguagaaggagcaucacacagauuucagucuaaucugcccuucugugggccauaauauaaacauaaauguguguaaugauaaaaagucauuuucuucaaagagacuacagcuagcugcacauuguguagagcagcuucuaaauuguuagacuuuguguugaaauguaauauucuauuuauugagaaagugauuuaaaauuauuauuuuuaaucauagaaaucaggguuugggcuguauugauauugucgaucaugaaauguccacacuuauucuaaguggccaauuauuuggaaauaaagaaggaaauaaagauggcuucacauggaaauuuaaguucuuucaggguggagauuuacuugguucauacaccuuuugccugaauuaaaguauuucauguaggaggacuuuuauccuuuuugauagacaguuucauauaucuugaacucaauaucucagaucucuucuacuguauuacugaauagcauacauacauagacaauguucgccauucacuagauauuuuuuucuauuaucuuacacuuauucaagcuugucugugauuaauggaauuggugucagaugcuggaauuuauucugaccaaugaacacagcugacucaggggaguacaaucuccugccaaguaauagaaccaaacccaauaugcauaaaagaaauacaauacuccaggcuuua

SEQ ID NO: 326 - RNA, 1343 nt, Homo Sapiens
gggaggacugggugcgccugcagggaucggaagccgguuggggugugagagguuuucucgcucuagggagauucuucaagcaaucacuaugucaacagacacagguguuucccuuccuucauaugaggaagaucagggaucaaaacucauucgaaaagcuaaagaggcaccauucguacccguuggaauagcggguuuugcagcaauuguugcauauggauuauauaaacugaagagcaggggaaauacuaaaauguccauucaucugauccacaugcguguggcagcccaaggcuuuguuguaggagcaaugacuguugguaugggcuauuccauguaucgggaauucugggcaaaaccuaagccuuagaagaagagaugcugucuuggucuuguuggaggagcuugcuuuaguuagaugucuuauuauuaaaguuaccuauuauuguuggaaauaaacuaauuuguauggguuuagaugguaacauggcauuuugaauauuggcuuccuuucuugcaggcuugauuugcuuggugaccgaauuacuagugacuaguuuacuaacuaggucauucaaggaagucaaguuaacuuaaacaugucaccuaaaugcacuugaugguguugaaauguccaccuucuuaaauuuuuaagaugaacuuaguucuaaagaagauaacaggccaauccugaagguacucccuguuugcugcagaaugucagauauuuuggauguugcauaagaguccuauuugccccaguuaauucaacuuuugucugccuguuuuguggacuggcuggcucuguuagaacucuguccaaaaagugcauggaauauaacuuguaaagcuucccacaauugacaauauauaugcauguguuuaaaccaaauccagaaagcuuaaacaauagagcugcauaauaguauuuauuaaagaaucacaacuguaaacaugagaauaauuuaaggauucuaguuuaguuuuuuguaauugcaaauuauauuuuugcugcugauauauuagaauaauuuuuaaaugucaucuugaaauagaaauauguauuuuaagcacucacgcaaagguaaaugaacacguuuuaaauguguguguugcuaauuuuuuccauaagaauuguaaacauugaacugaacaaauuaccuauaauggauuugguuaaugacuuaugagcaagcugguuuggccagacaguauacccaaacuuuuauauaauauacagaaggcuaucacacuugugaaauucucuugucuaaucugaauuugcauuccaugguguuaacaugguauauguauuguuauuaaaguaagugacccaugucaaa

SEQ ID NO: 327 - RNA, 5020 nt, Homo Sapiens
aaagaggagaaccuccgcuuaccacagccggguagaaaugccugaggaaagcagcggagcugaccgugccagcauuuacacagggaacacuucuugggcagccaggugucauggggcacagacccacaguuccugagaaugaacagccuguuagcgcacaggcacgggaggcuucuuccggcucggccgugcugcucagcggguguaaacagccucugcgguguaaacagccucugcgguguaaacagccgcggcgggcaggccaggacugucagugcccgccccucggggcagguaauuucaugcucccaaaaugggacauaaagugguugucuucgacauuucugucaucagagccuugugggaaacucgugucaagaagcacaaagcuuggcagaagaaggagguggaaaggcuugagaagagcgccuuggagaagauaaaggaggaguggaacuuuguggccgaaugcaggaggaagggcaucccccaggcuguauacugcaagaauggcuucauagacaccagcgugcggcuucuggacaagauugaaaggaacacucucacaaggcagaguucacuucccaaggacagaggcaaacggagcagugcguuuguguuugaacuuucuggggagcacuggacggagcucccagauucauugaaggagcagacacaccugagagaaugguacauaagcaauaccuugauucaaaucauuccuacauauauucaguuauuucaagcgaugagaauucuggaucugccaaaaaaccaaaucucacaucuuccagcagaaaucgguuguuugaagaaccugaaagaacucaauguggguuucaacuaucugaagagcauuccuccagaauugggagauugugaaaaucuagagagacuggauuguucuggaaaucuagaauuaauggagcugcccuuugaauuaaguaauuugaagcaaguuacauuuguagauaucucagcaaacaaguuuuccagugucccaaucuguguccugcggaugucgaauuugcagugguuggauaucagcagcaauaaccugaccgaccugccgcaagauauagacaggcuagaggagcugcagagcuuucucuuguauaaaaacaaguugaccuaccuucccuauuccaugcugaaccugaagaagcucacucuguuagucgucaguggggaccauuugguggagcucccaacugcccuuugugacucauccacaccuuuaaaauuuguaagccuuauggacaauccuauugauaaugcccaaugugaagauggcaaugaaauaauggaaagugaacgggaucgccaacauuuugauaaagaaguuaugaaagccuauauugaagaccuuaaagaaagagaaucuguucccagcuauaccaccaaagugucuuuuagccuucaacuuugauauccaucagaagacugcaaaucucacuauucucuggagcuauauauaaaucuuuguuaugaucaugucauauaggaagaauggcuugugcuuaaggacaaagucuagaaaccacuaucauaguugcuaaaaaaaaugguuuucaaaugucaaauacaugaguaucucccuccauggacuggagaauugaaaaauugguuuguauauugauauuuccagguucauuugcauauacuuuuuuccaaauaaugcacauuuaauauguuuuaaaaugucuuauuuuuaagaauuauaacuaaaagaccaaauacugaaguuaagugcauuguuuucaggaaucaaaagauaaaggggccgggugugguggcucacaccuguaaucccagcacuuugggaggccgaaguggguggaucaccugagguccggaguucgaggcugguuuggccagcauggcgaaaccccaucucuacuaaaaauacaaaaaauuagcugggcaugguggcaguugccuguaauccuagcuacucaggaggcugaggcaggagaaucgcuugaaccugggagguggaguugcagugagccgagaucaugcgacugcacuccagccugggugacagagccagacucugucucaaaaaaaaaaaaaaagaaaagaaaaagauaaagggauugugaaaagagcauuuauauuggacuaaucagaugagaguguuuuguuauuuugaaagaguuucuuuuacugagaauaaucuuccuugaguuuauauaaacugcuauuuccauauguuuuaaguuauauuuuggcaaguguagacucccaggagagacuuguagguacaaucuaggccuugaagaaacaaaggcuggaauaucugcccaugcuuugggcaugagaugcucagauggugcguggguagaucuaguugaggaagugugggccuggcuguucaugggaagucuucaguggccuucauggauggccauccaguccugaguggucacccuggggguccugggacacaccucaguaaagagcaaaggcaacgcccucagggucccuuccuccaagauggccauguaggguaauggagaugaccaguccacacugauaaggaguuccuagcaaggcuuccuuguggguaccacaggacaacucugcccauagcaaagaugcuucaguccagagggagcccaugggcuguuugaauuugggagaggugggauucauuacaagacuuugggcucuuaugucacaucacaugauuuggagaaauuagacacaaucucuuauuuuuauaccacugucuugggcuaaaauaaacagguuguggcugaugguguugaagauaaauaagcuuaaacaaauaacuuuggccgggcacgguggcucacaccuauaaucccagcacuaugggaggcugaggcaagcagguuguuugagcccaggaauuugagaacaggauuuugagaacagcuuggacaucaugacgaaaccccaucuccacaaaaaaauucaaaaaauuagccaggugugguggcaugugccuguggucccagcuacucaggaggcugaggugggaaaaucacuugagcccaggaggucgaggcugcagugugcugugauugugacacugcccuccagccugggugacagagugagacccugucucaaaagcaaaacaaacagcaauaacaauauuauuauuguuauaacuaaaaaaaaaaaaacaaaaacaagcagcuuuugugacuaagaaggaaaauaugcauauaguggcauauuuuuauaugaaucaucuccucuguggucuugcccaguaccauccaguggagcuuucugcagugacggaaauguucuguauuugcguuguccaacgugguaaaccagacacaugugauucuugagcacuugaacaaugacugaugugauugaagaacccaucuuucaauucaauuaaauuuaaauagccacauuuaacuccagccuuggguuugaccugauggaaaauucccaugagagagugcuccaaaccguuccaagguggggccaguugcgauucuaaaggaagaagcacuaaauggcagggugaucaguccaaagcauuuaugaggggagcuuacauacagcaugggcugcagcguccuugugaugggcagugagacaagggauguucuaccugggcauguccccagcgaggggguugggggauggaguucacaugaagauguaaggaauuugggugggggcugggcuggcuucuacauguuuagcaacacggcugaucuuucaguguuuccagcaacaaccuaagcaccguuaucagugccuaggaauguucaaggcccaggcugggguucagaccugcagaggaaaacaucagcuggcugggucaaggcaccauguguuacuuggucaggacagagacaaaaaugaggaaaacuaggggaccccacacacauguggcuaccauacuccugaacaggucuagcuaguuauuuguuuuuuuggaaguuaaucugggguagaaauguauggugauuuuuauuuucucugucugaagaaccagccauuuuuaaaaagguuauuauugacaucccaauauuuugucuuggugggcuuacucauaaguccaaacauuuuauucucaacagguguaaaacaggcagagcauucuaaaaccacaugguagugcuuugguggaggacugcuuccacuuagaaacaaacucugagaaguaggcuaagagaagacaagagggccgggcgcggugacucacgccuauaaucccagcacuuugggaggccgagaugggugaaucaugaggucaggaguucgagaccagccuaaacaacauagugaaacccugucucuauuaaaaaugcaaaaaauuagccgggcguggugggcacccguaaucccagcuacucaggaggcugaggcaggagaauugcuugaacccaggaagcagagguugcaguaagcugagaucccaccauugcacuccagccugggcaacagagugagacuccaucucaaaaaaaaaaaaaaaaaaaaaaaaagagagagagaugaaaagaguaggaaaaugagaaaucaccuucguugaaucuuaaauaguuacauuuuuuucuuuuuaacacuaaaaauacaauucaaauuuauuagcucuacuacuugaaugauuuuggaauuuuaugucaugcuaagguauguguuacauauggccaaguggaaaauauaucugaagaggggcuuucauacaaauagacuguucauaauuuauguaaauuuuauuuuaauaaaaucaguuuuuuguuuaaaaaccuuguuucacugucacauaugaaaaaaauacugcauugauauauaauuauuucauguuacauaauaacccaaaacaaauaauuacuugaauauguuuguagagauacuauuuaauuuauucauauaaaugugcagaaagauuccaaaggagaauauauaucuugugaaaauauggagauuugaaaauuugacaugaugcaaauagacugauacauaauuuggaaagguuauuuacauggcagaauacauguaugaauauuaaagu

SEQ ID NO: 328 - RNA, 818 nt, Homo Sapiens
cgcccgucgggggcgcgucucuuucagcagccaaugggcucugcccaccuucguccucgucagcauuuugucuaaucgcggccugugacgcucgaagggcggggagcagagggagauacagaaaccgacaggggccaggcgcccgguggcuccgaagcggggaagugggacaagaugguuuacaucucgaacggacaaguguuggacagccggagucagucuccauggagauuaucuuugauaacagauuucuucuggggaauagcugaguuugugguuuuguuuuucaaaacucugcuucagcaagaugugaaaaaaagaagaagcuauggaaacucaucugauuccagauaugaugauggaagagggccaccaggaaacccuccccgaagaauggguagaaucaaucaucugcguggcccuagucccccuccaauggcugguggaugaggaagguaaaugucugcucuaagaagcagacaaccggacaugcgcauucauagcagaaggaaaccaucaagaaguggaaggcugaccaugaugagcaguagaugaauguguaugucuaaacaaggacugcucuguguccucacagaugaaugaggucaugcugggaauucccucugcagggaacuggccugacugacaugcaguuccauaaaugcagauguuugucucauuaccuuuuuguauaguuuauuaaaguauuaauauaguuuuaauaaguaaauauuuuuagguugcagaauggacuccucaucuuuauauucacgaaaaagcaaucugaagaaaacaaauaaaagccuguguauuuagca

SEQ ID NO: 329 - RNA, 921 nt, Homo Sapiens
cucagcuugcgccgccgccgccgccgccgccgccgcgcacgccaugggagccgugacugacggacgaaguuauacggaagcgucuccucauugauggagauggugcuggagaugaucggagaauuaaucugcuagugaagaguuucauuaaauggugcaacucugggucccaggaagagggauauagccaguaccaacguaugcugagcacgcugucucaaugugaauuuucaaugggcaaaacuuuacuaguauaugauaugaaucucagagaaauggaaaauuaugaaaaaauuuacaaggaaauagaauguagcauagcuggagcacaugaaaaaauugcugagugcaaaaagcaaauucuucaagcaaaacgaauacgaaaaaaucgccaagaauaugaugcuuuggcaaaagugauucagcaccauccagacaggcaugagacauuaaaggaacuagaggcucugggaaaagaauuagagcaucuuucacacauuaaagaaaguguugaagauaagcuggaauugagacggaaacaguuucauguucuucuuaguaccauccaugaacuucagcaaacauuggaaaaugaugaaaaacucucagagguagaagaagcucaggaagcaagcauggaaacagauccuaagccauagacaggcuaauugcccaccacucccaggaauauugaaauagcuacaugaccauaauguguuuaaaaugugguaugcucuugagauauuuaaaguuuuggcaguaaaauacucuguuuuuaaguaugaauguauuucauucauauuuccucucacaaaggaaaaugacuucaguauagauuuguuuuuauuaaaaugcauuuuuuauucuuaagugguaggaagcaacauccaaaaaugcuuaauaaaaugcuuuuaagcugca

SEQ ID NO: 330 - RNA, 1467 nt, Homo Sapiens
gagggcgccaugaggagccugugcugcgccccacuccugcuccucuugcugcugccgccgcugcugcucacgccccgcgcuggggacgccgccgugaucaccggggcuugugacaaggacucccaaugugguggaggcaugugcugugcugucaguaucugggucaagagcauaaggauuugcacaccuaugggcaaacugggagacagcugccauccacugacucguaaaaacaauuuuggaaauggaaggcaggaaagaagaaagaggaagagaagcaaaaggaaaaaggagguuccauuuuuugggcggaggaugcaucacacuugcccaugucugccaggcuuggccuguuuacggacuucauuuaaccgauuuauuuguuuagcccaaaaguaaucgcucuggaguagaaaccaaaugugaauagccacaucuuaccuguaaagucuuacuugugauugugccaaacaaaaaaugugccagaaagaaaugcucuugcuuccucaacuuuccaaguaacauuuuuaucuuugauuuguaaaugauuuuuuuuuuuuuuuaucgaaagagaauuuuacuuuuggauagaaauaugaaguguaaggcauuauggaacugguucuuauuucccuguuuguguuuugguuugauuuggcuuuuuucuuaaaugucaaaaacguacccauuuucacaaaaaugaggaaaauaagaauuugauauuuuguuagaaaaacuuuuuuuuuuuuuucucaccaccccaagccccauuugugcccugccacacaaauacaccuacagcuuuuggucccuugccucuuccaccucaaagaauuucaaggcucuuaccuuacuuuauuuuuguccauuucucuucccuccucuugcauuuuaaaguggaggguuugucucuuugaguuugauggcagaaucacugaugggaauccagcuuuuugcuggcauuuaaauagugaaaagaguguauaugugaacuugacacuccaaacuccugucauggcacggaagcuaggagugcugcuggacccuuccuaaaccugucacucaagaggacuucagcucugcuguugggcugguguguggacagaaggaauggaaagccaaauuaauuuaguccagauuucuagguuuggguuuuucuaaaaauaaaagauuacauuuacuucuuuuacuuuuuauaaaguuuuuuuuccuuagucuccuacuuagagauauucuagaaaaugucacuugaagaggaaguauuuauuuuaaucuggcacaacacuaauuaccauuuuuaaagcaguauuaaguuguaauuuaaaccuuguuuguaacugaaaggucgauuguaauggauugccguuuguaccuguaucaguauugcuguguaaaaauucuguaucagaauaauaacaguacuguauaucauuugauuuauuuuaauauuauauccuuauuuuuguc

SEQ ID NO: 331 - RNA, 108 nt, Homo Sapiens
gcgcucacuucaguagcacauauacuaaaauuugggaugauacagggaagauuagcauggccccuaugcaaggacgacacacaaauucgugaaguguuccauauuuuu

SEQ ID NO: 332 - RNA, 3474 nt, Homo Sapiens
aaacuuaggagaguccugguuguaagagguauuaacauuuucagcaguaguacucuagcuacacuugacuguuccccucucugugaauuuacaugauauguuugaaauacugccccucaaaagucucagaacuuugagaaauacgguccuuuccaaaaaaaccccuuauguccaauuugaaggggucgcugucagugggugcuuaaguggguaaagaaaagccaagaauaugucagggugaggaaggccaaggcugagcgaggucagcuugggacccaccuccuagaaugaccuccgccagcaggaaaaaaccguuaaggggaggaaagggcaggucccugcggccuccaggugccagccgcgugagugggcggagaggccucggugccuccuacccgcuccggacgugcgucccggcaucaccccgggauccgcuccuccccgcuggcggggggagaaagggcaggaggccuuccgucccggcuauaaagggccccggaccgccgcggcucgccucggcuugccucgacacgccuaggcgcccuccggcuccgcccuagccgccgcgucccagcuagagcuccagcgcccgcucaggccccacucgaccucucgggccucggcuacuuggacugcggcggaauauggcggcuccgaugacucccgcggcucggcccgaggacuacgaggcggcgcucaaugccgcccuggcugacgugcccgaacuggccagacuccuggagaucgacccguacuugaagcccuacgccguggacuuccagcgcagguauaagcaguuuagccaaauuuugaagaacauuggagaaaaugaaggugguauugauaaguuuuccagaggcuaugaaucauuuggcguccacagaugugcugauggugguuuauacugcaaagaaugggccccgggagcagaaggaguuuuucuuacuggagauuuuaaugguuggaauccauuuucguacccauacaaaaaacuggauuauggaaaaugggagcuguauaucccaccaaagcagaauaaaucuguacucgugccucauggauccaaauuaaagguaguuauuacuaguaaaagcggagagaucuuguaucguauuucaccgugggcaaaguaugugguucgugaaggugauaaugugaauuaugauuggauacacugggauccagaacacucauaugaguuuaagcauuccagaccaaagaagccacggagucuaagaauuuaugaaucucaugugggaauuucuucccaugaaggaaaaguagcuucuuauaaacauuuuacaugcaauguacuaccaagaaucaaaggccuuggauacaacugcauucaguugauggcaaucauggagcaugcuuacuaugccagcuuugguuaccaaaucacaagcuucuuugcagcuuccagccguuauggaacaccugaagagcuacaagaacugguagacacagcucauuccauggguaucauaguccucuuagaugugguacacagccaugcuucaaaaaauucagcagauggauugaauauguuugaugggacagauuccuguuauuuucauucuggaccuagagggacucaugaucuuugggauagcagauuguuugccuacuccagcugggaaauuuuaagauuccuucugucaaacauaagauggugguuggaagaauaucgcuuugauggauuucguuuugaugguguuacguccaugcuuuaucaucaccauggagugggucaagguuucucaggugauuacagugaauauuucggacuacaaguagaugaagaugccuugacuuaccucauguuggcaaaucauuugguucacacgcugugucccgauucuauaacaauagcugaggauguaucaggaaugccagcucugugcucuccaauuucccagggagggggugguuuugacuaucgacuagccauggcaauuccagauaaguggauucagcuacuuaaagaguuuaaagaugaagacuggaacaugggcgauauaguauacacgcucacaaacaggcgcuaccuugaaaagugcauugcuuaugcagagagccaugaucaggcauugguuggggauaagucgcuggcauuuugguugauggaugccgaaauguauacaaacaugaguguccugacuccuuuuacuccaguuauugaucguggaauacagcuucauaaaaugauucgacucauuacgcaugggcuugguggagaaggcuaucucaauuucauggguaaugaauuugggcauccugaaugguuagacuucccaagaaaaggaaauaaugagaguuaccauuaugccaggcggcaguuucauuuaacugacgacgaccuucuucgcuacaaguuccuaaauaauuuugacagggauaugaauagauuggaagaaagauaugguuggcuugcagcuccacaggccuacgugagugaaaaacaugaaggcaauaagaucauugcuuuugaaagagcaggucuucuuuucauuuucaacuuccauccaagcaagagcuacacugacuaccgaguuggaacagcauugccagggaaauauccuuuuuucuugaucaaaauugugcuagauucagaugcagcggaauauggagggcaucagagacuggaccacagcacugacuuuuuuucugaggcuuuugaacauaaugggcgucccuauucucuuuugguguacauuccaagcagaguggcccucauccuucagaauguggaucugccgaauugaagaggccugauuucagcuccaccagaugcagauuuguguuuuguuuucuuguuaucacugucacacagcuuauaacauguaugcuuuucagaauacaguugucuagccaagccaucaagugucugaaauucaauauugguuuaugcaaauacagcaaacuuuuauuuaaguagaugggagaauauguuuaaaauauuaggaauccuagaccauauuuucaagucaucuuagcagcuaggauucucaaauggaaguguuauauauaauauguuaaaaacauuuugcuuuccuggcuaauuauuugauccuuuuaaauucaaauuugaaucauuugucauguaugauuauuucuguuaaauguacacaguauuuaagauggauauuugguggcucuauuuguucugauaucuuuuggucuaaauuaugagguaccaagauuguuucuuuguuucuuuuuuucaaauuguguuuagaaauacuguaauaaauaugcaguagugauauaaagaauuauauccaagguaauauaaaagccauuacguaugaacucauccgugucucauuuuguguuuuauuuugugaucucuuguccacuaaguaucuuguuaaaugccaguaucucagucuuucugaagcccugaaaugguaauuguagcauuucagaaaaugucuuucauuucaaucaauaaaaagcuuuuguaaaauu

SEQ ID NO: 333 - RNA, 103 nt, Homo Sapiens
ggcuggcccgaaguuaguuaucucaauugacuguucacaguuacagaucgaacuccuuguucuacucuuuacccccuucucacuacugcacuugacuagugua

SEQ ID NO: 334 - RNA, 204 nt, Homo Sapiens
augagaauuuuaauuuuugaaauaacggcaauuuauccauugcacauaccacuguauuaugcaaaucaacguuuuggaaaauuuagacacagaagggaacuagacaguuuucccccuggagagaugaaaagcuuuuuggcucuuaagucuuugauaaaaggcguacauaauucuugugucuacuguacagaauacugccgcuag

SEQ ID NO: 335 - RNA, 3069 nt, Homo Sapiens
guggaucgguggguuuaucucaaggccugaguagccgguaacaaacgaggguucccgggauuggaccgacgcagccaugccucugcgacuugauaucaaaagaaagcuaacugcuagaucugaucgaguuaagaguguggaucugcauccuacagagccauggauguuggcaagucuuuacaauggcaguguguguguuuggaaucaugaaacacagacacuggugaagacauuugaaguaugugaucuuccuguucgagcugcaaaguuuguugcaaggaagaauuggguugugacaggagcggaugacaugcagauuagaguguucaauuacaauacucuggagagaguucauauguuugaagcacacucagacuacauucgcuguauugcuguucauccaacccagccuuucauucuaacuagcagugaugacaugcuuauuaagcucugggacugggauaaaaaauggucuugcucacaaguguuugaaggacacacccauuauguuaugcagauugugaucaaccccaaagauaacaaucaguuugccagugccucuuuggacaggacuaucaagguguggcaguugggcucuucgucaccaaacuucacuuuggaaggacaugagaaaggcgugaauugcauugauuacuacagugguggggacaagccauaccucauuucaggugcagaugaccgucuuguuaaaauaugggauuaucagaauaaaacaugugugcagacacuggaaggacaugcccaaaaugugucuugugccagcuuucauccugaguugccaaucauuaucacagguucagaagauggaacaguacguauuuggcauucaagcaccuaccggcuugagagcacacugaauuauggaauggagaggguauggugcguggccagucuaagagggucaaacaaugucgcuuugggcuaugaugaagggagcaucauuguuaagcuuggucgggaggaaccugccauguccauggaugccaauggaaagauaauuugggccaagcauucagaaguccagcaggccaaccuaaaagcaaugggagaugcugaaauuaaagauggugaaagauugccacuggcaguaaaggauaugggcaguugugaaauauacccucagacuauucagcacaauccuaaugggcgguuuguggugguguguggugauggggaguauaucaucuacacagcaauggcauugagaaacaagagcuuuggaucugcucaggaguuugcaugggcccacgauucuucagaguaugcaauaagagagagcaacagcauuguaaagauauuuaagaacuuuaaggaaaaaaaaucauuuaaaccagauuuuggagcagaaaguaucuacggcggcuucuuauugggagucagaucuguaaauggcuuagccuucuaugacugggacaauacagaacucauacgaagaauugaaauucagcccaaacauauuuucuggucugacucuggagagcuagucuguauugcuacugaggaaucauuuuuuauccuuaaguaucugucagaaaaagucuuggcugcacaggaaacacaugagggaguuacugaagauggcauugaagaugccuuugagguucuuggugagauucaggaaauugugaaaacagggcuuuggguaggcgauugcuucauuuacacaaguucugugaacagauuaaauuauuauguuggaggagaaauagucaccauugcccacuuggacaggacgauguaucuccuaggcuacauuccuaaagacaacaggcuuuaucugggggauaaagaauugaacaucauuagcuauucccugcugguuucaguccuggaauaccagacagcugucaugcggagggacuuuagcauggcugauaagguccuuccuaccauuccaaaagaacagaggaccagaguugcacacuuuuuggaaaagcagggcuucaagcagcaagcucuuacaguauccacagauccugagcaucguuuugagcuugcucuucagcuuggagaguuaaaaauugcauaccaguuagcaguggaagcagagucagaacagaaguggaaacaacuugcugaacuugccauuaguaaaugucaguuuggccuagcccaggagugccugcaucaugcacaggauuaugggggccugcugcuuuuggccacugccucuggaaaugcuaauauggugaacaagcuagcagagggugcggagagagauggcaaaaauaauguggcauucaugagcuacuuuuuacagggcaagguugaugccugccuagagcucuuaauuagaacuggacggcugccagaagcugccuucuuggcccgaacuuacuuacccagucagguuucaaggguagugaaacucuggagagagaaucucucaaaagucaaucagaaagcagcagaaucccuugcugacccaacagaguaugaaaaccuguucccuggauuaaaagaagccuuuguuguugaagaaugggugaaggaaacacaugcugaucuguggccagccaaacaauacccacuugucacgccaaaugaagagagaaaugucauggaagagggaaaagacuuucagcccucaagaucuacagcucaacaggaacuugaugggaaaccugcuucuccuacuccgguuauuguggccucccacacagccaacaaagaagaaaagaguuuacucgaacuagaaguagauuuggauaauuuggaauuagaagauauugacacaacagauaucaaucuggaugaagauauuuuggaugauugacuguaaugcuuuccauuuaccugacuaaacagaucauuauuauauauagguauugauugcuacccugaccacagugcuuuggacuaugagaaacuucuuagauuuuuauauguaaaugcuguggaccacugggagcacaaugcccacaucaucuuaagaagaguuuaugugcagcauuuaaaucacuguguuuuccuuguuaacuaaaacagacaugggcuuugauuuuuuucauacuauuagaccauaucucauaaaaccuuuugaauuaa

SEQ ID NO: 336 - RNA, 4060 nt, Homo Sapiens
acaccgcccucccgccagacucccggcggcuccuccucccucucccaaacccacucccaaagcuaagugcaggcuuccccguuccagccagaagcgcugcgugagccuccacacguagccgcaggcagcuccuuaaauagcguccgcgcugagcaaacaguccagacguggggcccaggagggcgagcugaggcgaccgcaccgggcgcgcagcggcggcgggucagccggcggccaauagccagggcgcggcccgccccgucgccuccccucggggagccuauaaggccuccgcagcgccccgggcgccugcugcuccgugccuccaccgacgaccucacucagcugcguuacgcgccgcuccggcugccggccgcgcgccuugcccgccggcucccgcccgcaaucggcggcucagggcggacccgggucucugcguucucgcgagaagcgcggcgcugcggggccgugggcgccugagcccgcgcggcccucgagggccgaauauggggggaugcacggugaagccucagcugcugcuccuggcgcucguccuccaccccuggaaucccugucugggugcggacucggagaagcccucgagcauccccacagauaaauuauuagucauaacuguagcaacaaaagaaagugauggauuccaucgauuuaugcagucagccaaauauuucaauuauacugugaagguccuuggucaaggagaagaauggagagguggugauggaauuaauaguauuggagggggccagaaagugagauuaaugaaagaagucauggaacacuaugcugaucaagaugaucugguugucauguuuacugaaugcuuugaugucauauuugcuggugguccagaagaaguucuaaaaaaauuccaaaaggcaaaccacaaaguggucuuugcagcagauggaauuuuguggccagauaaaagacuagcagacaaguauccuguugugcacauugggaaacgcuaucugaauucaggaggauuuauuggcuaugcuccauaugucaaccguauaguucaacaauggaaucuccaggauaaugaugaugaucagcucuuuuacacuaaaguuuacauugauccacugaaaagggaagcuauuaacaucacauuggaucacaaaugcaaaauuuuccagaccuuaaauggagcuguagaugaaguuguuuuaaaauuugaaaauggcaaagccagagcuaagaauacauuuuaugaaacauuaccaguggcaauuaauggaaauggacccaccaagauucuccugaauuauuuuggaaacuauguacccaauucauggacacaggauaauggcugcacucuuugugaauucgauacagucgacuugucugcaguagauguccauccaaacguaucaauagguguuuuuauugagcaaccaaccccuuuucuaccucgguuucuggacauauuguugacacuggauuacccaaaagaagcacuuaaacuuuuuauucauaacaaagaaguuuaucaugaaaaggacaucaagguauuuuuugauaaagcuaagcaugaaaucaaaacuauaaaaauaguaggaccagaagaaaaucuaagucaagcggaagccagaaacaugggaauggacuuuugccgucaggaugaaaagugugauuauuacuuuaguguggaugcagauguuguuuugacaaauccaaggacuuuaaaaauuuugauugaacaaaacagaaagaucauugcuccucuuguaacucgucauggaaagcugugguccaauuucuggggagcauugaguccugauggauacuaugcacgaucugaagauuauguggauauuguucaagggaauagaguaggaguauggaaugucccauauauggcuaauguguacuuaauuaaaggaaagacacuccgaucagagaugaaugaaaggaacuauuuuguucgugauaaacuggauccugauauggcucuuugccgaaaugcuagagaaaugacuuuacaaagggaaaaagacuccccuacuccggaaacauuccaaaugcucagccccccaaaggguguauuuauguacauuucuaauagacaugaauuuggaaggcuauuauccacugcuaauuacaauacuucccauuauaacaaugaccucuggcagauuuuugaaaauccuguggacuggaaggaaaaguauauaaaccgugauuauucaaagauuuucacugaaaauauaguugaacagcccuguccagaugucuuuugguuccccauauuuucugaaaaagccugugaugaauugguagaagaaauggaacauuacggcaaauggucugggggaaaacaucaugauagccguauaucuggugguuaugaaaaugucccaacugaugauauccacaugaagcaaguugaucuggagaauguauggcuucauuuuauccgggaguucauugcaccaguuacacugaaggucuuugcaggcuauuauacgaagggauuugcacuacugaauuuuguaguaaaauacuccccugaacgacagcguucucuucguccucaucaugaugcuucuacauuuaccauaaacauugcacuuaauaacgugggagaagacuuucagggaggugguugcaaauuucuaagguacaauugcucuauugagucaccacgaaaaggcuggagcuucaugcauccugggagacucacacauuugcaugaaggacuuccuguuaaaaauggaacaagauacauugcagugucauuuauagaucccuaaguuauuuacuuuucauugaauugaaauuuauuuuggaugaaugacuggcaugaacacgucuuugaaguuguggcugagaagaugagaggaauauuuaaauaacaucaacagaacaacuucacuuugggccaaacauuugaaaaacuuuuuauaaaaaauuguuugauauuucuuaaugucugcucugagccuuaaaacacagauugaagaagaaaagaaagaaaaaacuuaaauauuuauuucuaugcuuuguugccucugagaauaaugacaauuuaugaauuuguguuucaaauugauaaaauauuuagguacaaauaacaagacuaauaauauuuucuuauuuaaaaaaagcaugggaagauuuuuauuuaucaaaauauagaggaaauguagacaaaauggauauaaaugaaaauuaccauguuguaaaaccuugaaaaucagauucuaacuggauuuguaugcaacuaaguauuuuucugaacaccuaugcaggucuuauuuacaguaguuacuaagggaacacacaaagaauuacacaacguuuuccucaagaaaaugguacaaaacacaaccgaggagcguauacaguugaaaacauuuuuguuuugauuggaaggcagauuauuuuauauuaguauuaaaaaucaaacccuauguuucuuucagaugaaucuuccaaaguggauuauauuaagcagguauuagauuuaggaaaaccuuuccauuucuuaaaguauuaucaagugucaagaucagcaaguguccuuaagucaaacagguuuuuuuuguuguuguuuuugcuuuguuuccuuuuuuagaaaguucuagaaaauaggaaaacgaaaaauuucauugagaugaguagugcauuuaauuauuuuuuaaaaaacuuuuuaaguacuugaauuuuauaucaggaaaacaaaguuguugagccuugcuucuuccguuuugcccuuugucucgcuccuuauucuuuuuuuggggggaggguuauuugcuuuuuuaucuuccuggcauaauuuccauuuuauucuucugagugucuauguuaacuucccucuaucccgcuuauaaaaaaauucuccaacaaaaauacuuguugacuugauguuuuaucacuucucuaaguaagguugaaauauccuuauuguagcuacuguuuuuaauguaaagguuaaacuugaaaagaaauucuuaaucacggugccaaaauucauuuucuaacaccauguguuagaaaauuauaaaaaauaaaauaauuuuagaaa

SEQ ID NO: 337 - RNA, 2842 nt, Homo Sapiens
ccgagcgccagcgcgggaaccgggaaaaggaaaccguguuguguacguaagauucaggaaacgaaaccaggagccgcggguguuggcgcaaagguuacucccagacccuuuuccggcugacuucugagaagguugcgcagcagcugugcccggcagucuagaggcgcagaagaggaagccaucgccuggccccggcucucuggaccuugucucgcucgggagcggaaacagcggcagccagagcauaaaauacacaagaggauuuuuauggaauggcuccuuguuacaaggaccacauaaacccauuuugaauuauucaaccauugcugaacuucuugaaacuguuuuaaucauggacaaacaaaacucacagaugaaugcuucucacccggaaacaaacuugccaguuggguauccuccucaguauccaccgacagcauuccaaggaccuccaggauauaguggcuacccugggccccaggucagcuacccacccccaccagccggccauucagguccuggcccagcuggcuuuccugucccaaaucagccaguguauaaucagccaguauauaaucagccaguuggagcugcagggguaccauggaugccagcgccacagccuccauuaaacuguccaccuggauuagaauauuuaagucagguaauuucaaagacacaaaauacucauaaaaaacagaacugugcuuccagcuugcuuaaccagauuagcaaaugaauaauucaccaaagucugaaauagcaaaacuguauuuucugcuaacagauuacucuaauucuucuaggucugguucaauuuuaaagcaaaauacaaaugccuuagaaaauuguauuuucuguuaucuuaaauacaaucuaugauaauggccaauagcaaacauuuaauuagcacuguuuccugccuuuguuguaugccugauacauguauuaacucauuuaauccuuauugaaagucugugauguauaggugcuacauuuuucaaaagaagaaacugagguccagagagguuauauagcucacucuggggugagaaccuaaagagucaagacuguuuuuuuaaucccgaaacuuugguacugagcgaagugcucuuuagucucaauacugaauaauugccuuauaauuuggaagaaaauuuaaauaaaguuuauuguugaguuucaauaaguggccccaaacaagggguuaauauuuuauguauaauaugacucaccuuuuuauuguaacuaauaaaacugcauuuuuaugaugcugcuuuuguucuuuggaagaccuaauuuuauaaaugccauuaauaaaggaguaaaaagauagaucagauacugauucaucagcaaauugaacuucuggaaguuuuaacagguuuugaaacuaauaacaaauaugaaauuaagaacagcuuuggacagaggguuuacuuugcagcggaagauacugauugcuguacccgaaauugcugugggccaucuagaccuuuuaccuugaggauuauugauaauaugggucaagaagucauaacucuggagagaccacuaagauguagcagcuguuguugucccugcugccuucaggagauagaaauccaagcuccuccugguguaccaauagguuauguuauucagacuuggcacccaugucuaccaaaguuuacaauucaaaaugagaaaagagaggauguacuaaaaauaagugguccauguguugugugcagcuguuguggagauguugauuuugagauuaaaucucuugaugaacagugugugguuggcaaaauuuccaagcacuggacuggaauuuugagagaggcauuuacagacgcugauaacuuuggaauccaguucccuuuagaccuugauguuaaaaugaaagcuguaaugauuggugccuguuuccucauugacuucauguuuuuugaaagcacuggcagccaggaacaaaaaucaggagugugguaguggauuagugaaagucuccucaggaaaucugaagucuguauauugauugagacuaucuaaacucauaccuguaugaauuaagcuguaaggccuguagcucugguuguauacuuuugcuuuucaaauuauaguuuaucuucuguauaacugauuuauaaagguuuuuguacauuuuuuaauacucauugucaauuugagaaaaaggacauaugaguuuuugcauuuauuaaugaaacuuccuuugaaaaacugcuuugaauuaugaucucugauucauuguccauuuuacuaccaaauauuaacuaaggccuuauuaauuuuuauauaaauuauaucuuguccuauuaaaucuaguuacaauuuauuucaugcauaagagcuaauguuauuuugcaaaugccauauauucaaaaaagcucaaagauaauuuucuuuacuauuauguucaaauaauauucaauaugcauauuaucuuuaaaaaguuaaauguuuuuuuaaucuucaagaaaucaugcuacacuuaacuucuccuagaagcuaaucuauaccauaauauuuucauauucacaagauauuaaauuaccaauuuucaaauuauuguuaguaaagaacaaaaugauucucucccaaagaaagacacauuuuaaauacuccuucacucuaaaacucugguauuauaacuuuugaaaguuaauauuucuacaugaaauguuuagcucuuacacucuauccuuccuagaaaaugguaauugagauuacucagauauuaauuaaauacaauaucauauauauauucacagaguauaaaccuaaauaaugaucuauuagauucaaauauuugaaauaaaaacuugauuuuuuugua

SEQ ID NO: 338 - RNA, 2620 nt, Homo Sapiens
agcugagggacgcgucagccaggcaccccgggguguggccagaggacuucggcgacgcuuccccgagaguagccccccuccucaacccagaaaagacaaccccgcggggcugcagcgagccaggcaugcucacuggcgcaggcccggcccgcagcccgagcaggaagcgccggcgcuaggcggcccccugcgcugccagcuggagccgggcggagccagcgccccggcgcaggguggcucugccaguccccgcgcgccugggcggccgcacacguguccaggcgucacguccgcgcgcgcccccggggcuugcgucagcggcuguuccagaagcgggugggccagggcucugcgcaccgcugggguucggggcccgggacgccgccgggaggagggcaccgcgcgggguccgacgcggaggcgugcucggaacgccgggggcugcggagugcaucagcgcgguccagcccuccgccugccgggcgccgagcgucuccgccgcccggaccugggcugggcgccguggcguugccucggagcucgcugcccgcggggcgcgcaccgccuugacccgggcggccccgcggcaggcaggcgcccgcaguuccaugguugguucggagcgcgaugagccgcccguccuccaccggccccagcgcuaauaaacccugcagcaagcagccgccgccgcagccccagcacacuccguccccggcugcgcccccggccgccgccaccaucucggcugcgggccccggcucguccgcggugcccgccgcggcggcggugaucucgggccccggcggcggcggcggggccggcccgguguccccgcagcaccacgagcugaccucgcucuucgaguguccggucugcuuugacuauguccugccuccuauucugcagugccaggccgggcaccugguguguaaccaaugccgccagaaguugagcugcugcccgacgugcaggggcgcccugacgcccagcaucaggaaccuggcuauggagaagguggccucggcaguccuguuucccuguaaguaugccaccacgggcuguucccugacccugcaccauacggagaaaccagaacaugaagacauaugugaauaccgucccuacuccugcccauguccuggugcuuccugcaaguggcaggggucccuggaagcugugaugucccaucucaugcacgcccacaagagcauuaccacccuucagggagaagacaucgucuuucuagcuacagacauuaacuugccaggggcugucgacugggugaugaugcagucauguuuuggccaucacuucaugcuggugcuggagaaacaagagaaguacgaaggccaccagcaguuuuuugccaucguccugcucauuggcacccgcaagcaagccgagaacuuugccuacagacuggaguugaaugggaaccggcggagauugaccugggaggccacgccccguucgauucaugacgguguggcugcggccaucaugaacagcgacugccuuguuuucgacacagccauagcacaucuuuuugcagauaaugggaaccuuggaaucaauguuacuauuucuacauguuguccaugaugugacuuucguaaaccuucaaaauuauuugggcauagugcucuauguuuaauaaagguuuuuauagauguuuuauuccauaugucuucacaagucaggacccacaauuacccguguuuuguuugaacagcagugucccaucuggcuucgacccaacaaaguucauuaaccugggaugaaugggguuggccuguuggugauuuggaugcuguucugugaucuaaaacaacucuuauugaauuguauuuacucccuaaacaacacuugacaggcuguugcacagggcuucuauagaucaguguguuaggaaugggaggccccuuccugccugccuucccauauuggucccuugacauugacaaaagcacagugacugucagcagauuccuuuacuuuuguuugugggagguaggaauuguuuuaaugcauuuuaaacaguguuucugaaauuggauggcuggcuaauagacacugaaucacccggagugcuuaucuuaaaauugcagauuuagggagccugccaauuuaacagucucaucaggugauucuuuucaacaguaauguuugagaauuacuggguuaaauugugggaaaggguccagauuuuaaaggugcuuuaagguugcccucugccgauacuguuugucuuucuacuguuucauccccuaacuucccccaacccucaaauuaaaacuagaacuauagauccacaugaacgcacgccugagauuuggccacucaccuauguuuuggguggauugccuaggaaagcaagucauauggccauugauaguucucauguaauuaguuuugcucaccacuaguacagaugacccguuuacacguggcuucccucggaagcccuccucaacaguagcuggugugaaagacuaaaucaguagaguuggaaaagcuuuauaaccggugugucauaugcuugcuauuuaaagcuguguguugguuuuguuuuucugccacauucacuaguuuuuuaauaaauauuuuccaaaaauggaua

SEQ ID NO: 339 - RNA, 438 nt, Homo Sapiens
ugggccugggaggggugguggccauuuuuugucuaacccuaacugagaagggcguaggcgccgugcuuuugcuccccgcgcgcuguuuuucucgcugacuuucagcgggcggaaaagccucggccugccgccuuccaccguucauucuagagcaaacaaaaaaugucagcugcuggcccguucgccccucccggggaccugcggcgggucgccugcccagcccccgaaccccgccuggaggccgcggucggcccggggcuucuccggaggcacccacugccaccgcgaagaguugggcucugucagccgcgggucucucgggggcgagggcgagguucaggccuuucaggccgcaggaagaggaacggagcgaguccccgcgcgcggcgcgauucccugagcugugggacgugcacccaggacucggcucacacaugc

SEQ ID NO: 340 - RNA, 3664 nt, Homo Sapiens
auugcugggucuccacuccuagcuguuacugcaaguccaugccucuaccaugaggguggaggaguuaagaucaacagauccacauguaccuugaggugacagacuggcucugauucgcugcggagccggaggaggaggggagaggccuggaggacaccaacauggaacaaguugaaaucaucgcagaaggauaaaguucgucaguuuaugaucuucacacaaucuagugaaaaaacagcaguaaguugucuuucucaaaaugacuggaaguuagauguugcaacagauaauuuuuuccaaaauccugaacuuuauauacgagagaguguaaaaggaucauuggacaggaagaaguuagaacagcuguacaauagauacaaagacccucaagaugagaauaaaauuggaauagauggcauacagcaguucugugaugaccuggcacucgauccagccagcauuaguguguugauuauugcguggaaguucagagcagcaacacagugcgaguucuccaaacaggaguucauggauggcaugacagaauuaggaugugacagcauagaaaaacuaaaggcccagauacccaagauggaacaagaauugaaagaaccaggacgauuuaaggauuuuuaccaguuuacuuuuaauuuugcaaagaauccaggacaaaaaggauuagaucuagaaauggccauugccuacuggaacuuagugcuuaauggaagauuuaaauucuuagacuuauggaauaaauuuuuguuggaacaucauaaacgaucaauaccaaaagacacuuggaaucuucuuuuagacuucaguacgaugauugcagaugacaugucuaauuaugaugaagaaggagcauggccuguucuuauugaugacuuuguggaauuugcacgcccucaaauugcugggacaaaaaguacaacaguguagcacuaaaggaaccuucuagaauguacauagucuguacaauaaauacaacagaaaauugcacagucaauuucugcuggcuggacugaacugaagaucaauccucacaauucagacugaggguugagacaaaacuuuaaggauacaucuuggaccauaucguauuucauucuucuaauggugguuugggcuugucuucuagucugggccgcucuaaacauuuauaauuccaacauuguggauuucaucuuauaucuguggaccauccuaguuuauucucccauaagucuuagaagcuuuauggugauuauuuugagguuuucauucucgcauaaagcacaaugcugucuucaucagaaaacaguuggcauaagaauuaaacauaugaacaucacaaaacaauuuauaaaaacuucuuaaauauacgcuuugggcuaguugcaaagacuaugcuaauagcacuuccagugagagugauauauuuaaguguacuggaucuggaaugguguuuugguuuggggggaauuuuuuuuuuuuccuggcaaaucacauguguuguugaugugaguaucugaugaaaaaacaaugucagaauaaccgacaugaaaauuuuuuaggauaacuuggugccuaccugaaaaauguauuguguuuuagacucuugauuucaaaagguuccacagaacuagucugcgcuuaccuuacccauguuuauauauagcuguccuacagggagcuuuuauuuagaaaaugucugcauaauguuagauucuucuccugucuacauuaugcacuacauaauuggacuucauuaugcuuuugaaaugcuuaucugccugucacauaaguuaaacuauuuaauuuguuuugaauguuuuggauugcuacacaauacaauauucuaaauuuaggcaugaggguuuuuuuguuuuguuuuuacuuuuuuuuugucaucgcacuauggaacacaaauggaauucucuuaauuuauaagaagauaguugcaguuaaauuuugaaaaugguuguaaugagccaugaaguucaaucuuuauaauauagguacugcucuuucagacaaauaguccauuuucgaugacuuauuauuuuguugaaauugcuuuaacugcuaaucacugugguugccaaauauuuacuucaggagcaaagauuuucaaacaagcauacacgaugcaaaauaccaaucuggcuucuagucucuuuacuguuuucguuucacucagauuagcucaguuuucucaucaaagcagaaugcuaucuuguauguauuuuuuucauuacaagccccaugagcugcuuuuaugcugaaaauggucauuucccuguucacuuacugacaugugaagaaggguuucuugcuuucuuaaacauuuccguaaggcaggcuagaaauguaauacuucaaauguuugaugauuauggucuuuugauaggaauagauucugcuugggauauauauccaggcacucucuaaggucuaggguugauauuaacaaaggaauguacuuagaauagcaguacauuuuaugcaaauauggaaauuauuuuaagaaacaaugacauaucaaaacugcuuuuuacaugauuuugaaauagacuagaaagcuuucccuauagacauauuaauauuccaaucauaacuuuaauucaagaaugcaguuuuaccaaaagaaaaauuugaaaauuucuauucaggcuacuggaauugguuauuaaaagaaaaaggaaaaagaagaaucuugcugcuuucaguauuuccugauuuuuuuguaaauauaaagaggaacuucaauuaugaaaaauuuuuaaaagauauauauaucuauauaucuauauauauguacuguuuuguuuccugucuugaagauuuugaguuaugguuauugguuucagauugauuaauucacauaugcuguguuuugaaaugagaucccauuagcuuuuuuuuuuuuuuuuuuuuuucaauauaaaguguuuucuuuaaaagucauauugguucguggccuagugccuuggauuuuacauauuuuucuuuuuaaaugcaaaaccuuuucaacaaaauaguguuugucaucagguugguacuaaacauuuauaauuacuguguaauuauaaacaaaaauacauaaagcuuugaauauaauuauguagcauaaaaguuaagguuguucacuaugauggcaucuuagaauuaaacaaaacuuuuacuagggcugaaaagagaagacugauuuaauguggugugauuauucugaagauaaaugucuggcuacagggaauauuuuguacuaaaaaaugauuacacauauggcuguguguguuugagucugugucugugagagagccagagagagugagagagauugacagagaaagggagagacacacacacgccccuugaauugcuuuaacuccuaaguguuucaguccucauuccgguaaacuccccaugcugauucuuuguuuuaaacugaaccauagguacaguuuccuuuuugccaaaugucaaaacagguacaaauuuuaaaauguaaugcuuuuuaaauagaaaaauguauaaaauuagaagugcccacauauaaaaaauacuugagaugaagauuaucuuuagugaauaucaucugcauaucucuguaaguucaauuguguuucuuacagucccugucauauuaccaacagaggcaauaaaagcugcagugaaauug

SEQ ID NO: 341 - RNA, 7091 nt, Homo Sapiens
ggccugacuagucgucgccgucuucgcggcugcuaugaccagcgggcgaggcgcccuucgcagcuccgcgcaacgcuagucgcggccgugcgcccgccguagccgucugcgucccagcgcggccgcucccgcggcccccucggcuuugccagcgccgccugcgaggcggaggcaggaugaagaugacuguggauuucgaggagugucugaaggacucgccccgcuucagggcagcuuuggaagaaguagaaggugauguggcagaauuggaacuaaaacuugauaagcuugugaaacuuuguauugcaaugauugauacuggaaaagccuuuuguguugcaaauaaacaguucaugaaugggauucgagaccuggcucaguauucuaguaaugaugcugucguugagacaaguuugaccaaguuuucugacagucuucaagaaaugauaaauuuucacacaauccuguuugaccaaacucagagaucaauuaaggcacagcuucagaacuuuguuaaagaagaucuuagaaaauucaaagaugccaagaagcaauucgaaaaagucagugaagaaaaagaaaaugcguuaguaaaaaaugcccaaguacaaagaaacaaacaacaugaaguugaagaagccaccaacauucugacagcaacaagaaaauguuuccgacacauagcccucgauuaugugcuucagauuaauguucuucaaucaaaaaggagaucagaaauccuaaaaucaauguugucauuuauguaugcccauuuggccuucuuucaucaaggauaugaucuguuuagugaacuuggacccuacaugaaggaucuuggugcacaguuggaucgacugguuguggaugcagcaaaggagaaaagagaaauggagcaaaaacauuccaccauucaacaaaaggauuucuccagugaugauucuaaguuagaauauaacguagaugcugcaaauggcauaguuauggaaggauaucuguucaaacgagccagcaaugccuucaaaacuuggaacaggcgcugguuuucaauacagaauaaucaguugguuuaccagaaaaaauuuaaggauaauccgacugugguaguugaagaccucaggcuuugcacagugaaacauugugaagacauagagcgacgauucugcuuugagguggucucgccaacaaaaaguugcaugcuccaggcagauuccgaaaagcugcgccaggcauggauuaaggcuguucagaccaguauugcuacugcuuauagagagaagggugaugaaucagagaagcuggauaagaaaucaucuccauccacaggaagccuagauucuggaaaugaguccaaagagaaauuauugaaaggagaaagugcgcuucagcggguccaguguaucccuggcaaugccagcuguugugacuguggccuggcagauccacggugggccagcaucaaccugggcaucaccuuguguaucgagugcuccggaauucaccggagccuugggguucauuuuucaaaaguacgaucuuuaacuuuagacaccugggagccagaacuuuuaaagcuuaugugugaguuggggaaugauguuauaaaucgaguuuaugaagcuaauguggaaaaaaugggaauaaagaaaccccaaccaggacaaagacaggagaaggaggcauauaucagagcaaaauauguggagaggaaauuuguggauaaauauucuauaucauuaucaccuccugagcagcaaaaaaaguuugucucuaaaaguucugaagaaaagaggcugagcauuucuaaauuugggccaggggaccaagucagagcaucugcccaaaguucagucagaaguaaugacaguggaauucagcagagcucugaugauggaagagaaucuuuacccuccacggugucagccaauaguuuauaugagccugaaggagaaaggcaagauucuucuauguuucuugacucgaaacaucuuaauccaggacuucagcuuuauagggcgucauaugaaaaaaaccuuccuaaaauggcugaggcuuuggcucauggugcagacgugaacugggccaauucagaggaaaacaaagcgacaccacuuauucaggcuguauuagggggcucuuuggugacgugugaguuccuccuacagaauggugcuaaugucaaccaaagagauguccaagggcggggaccauugcaccaugccaccgucuuagggcacacagggcagguauguuuauuccuaaaacgaggugccaaucaacaugccacugaugaagaagggaaagacccuuugagcauagcuguggaagcagccaaugcugauauagucaccuuguuacguuuagcaagaaugaaugaagagaugcgggaaucagaaggacuuuauggacagccaggugaugaaacuuaucaggacauauuucgugauuuuucccaaauggcauccaauaauccagagaaacuaaaucguuuccagcaagauucacagaaauucugaauuuuuuuaaaaaugggaaaauaugaaaucuggugacccccuaauguauacagcuaaaaaaucacaauuuuuuuacugcuuuaauucuacuuaauuuugguagauauugaauggcuuggaaaagagguacccauucauauauuuauaaauuaaaacauaguuaucuaguaguaggagaggaaccuaguuuaggaccucuuuuauuaaaaaagccuauuuaaagggcuauuucuguagacagaaguucagucuagauuuaggccaucucuagguuacaagaugauaggagguuagacaaaagugauucuuuugccaaugggugguggcauugauuuuuuuccuccaugcaucuugcccaggaucacucagucaagcaugucuucaucaaguggaagccaacuguccugccugccucaagaauauguguuuucuuuagcuucccugaggcuuuuuggugguucagaaauagguguguguguugauguguuuuugguaaccuagcuuucauacacauaauauaugauuuauuagaacuagagaauguguuuuccccguuuguucauaaaugcggucgguuauacuucuuaggugacagguuauuguccaguacuuuaauguauguauguauaauggcuguacagguagaccauaauucaguccuuuagauuuauuuuaugcagcaaaaagaagcucuuuuuuuuuuuuaaucacaaaaaaaaaccccaguucaaaauguguaguucuucauuguuggguugauuccccaaaaccuugacagauguaucgauggaauaaaaguauguuuuaaagguuacuugaaugucacaaaauuaugccuucaucaaaacuuuaaaggaaaaaucaauuuauaaaaucauguaggccauuuuuauauuugaaauuuguccuuuuaaagauaguuuugcuguugcuccuagugaaagaaaaaucucuguacaaaggagaaaaagaaccccacuuauucuuaguuaauacuaaaauauauagcaauaaauugcuguuuauuuuuucuacaucuauuuuguguacuuguacacaguguacauucuuuuaaauuauaucguguauauagcuuuaguauucgguuacaugauucacagaccccugaauuccaaaauauuauggauaaacauuaccauuuauaugcuacaaauuagucugauuccaucuuugaaaaugucuuaaaguauaaaauaauuaauuugcuuuuuuuuuuuuuuuuucccgagauggcgucuugcugugucacccaggcuggagugcaguggcacgaucucagcucacugcagccuccuccucuuggguucaagcaauucuccugccucagccucccgaguagcugggacuacaggcacccgccaccauuccgagcuaauuucuauauuuuuaguaaagacggguuucaccauuuuggccagguuggucucgaacuccugaccucaggugaucagccugcuuuagccucccagagugcugggauuacaggcgugagccaccgcacccagccuaauuugccuuuugauuccuucccauuguugucaacaauuaagucuauucuucuuuuagaaauuauauguaaaugauauuauugauacucuuucuaaauaagagguuuuaaaauauauaaaaacuuuaugauccaauuauagauaaauuuucuaacauuucccagucacuaggguuuuauaaguugauuaaacaucaaaucagaaucuagccaagcaggaauuauauugaaauaaguucacauuacagaaaagguuccauaauuuggccaaacugcaugcauguaaugcuuauuuaguaauggucacuguauguuagauaaggauaaaaauauauuugugaauuacuucugaggaaaugcuaacuuccacagcauuguauuuaauuauaacaauaacaggaacauuaaaucuuuaucuuugcuguuucaccucaaagucauagaucaucuggcuuuuuaggcaccuucacuaaaggcaaaaaucugauuuguaguuuuuauuagcauguaccuugaaauuauuugaccaagaagcucaaagaaaagaaguacguuaaagaaaaagaaaaaaccucacuuuuccuuuauagugucccuuccuguuuuaauuccuaaagauccugacuuuuaucugaggaagucuagguaguuuuccuuuuggaucuggccauuggugcguguuucauucagaucaccucuggaaucucugugguugugaaggcaauuccuuaugagacucuugccuccuguggcuuacgugaugaauuguuaauauggcaguaauuaauuaguaucuacuuaaauuuaguggucagaaauguauuugaagugccuuaaagaugaucaugguucagaauaucuucagagaaagcaaaaucuuuaauauugcagggagccuagcaauacaaguacacauuucuguggcuugauuucuugaauaugcugagacccaauuuggacuacauuuggcagaaaugauggaguaaacagcaaggcuuuaaauuaaauuaauaguuacaagguagguuggcucuuaggugaauuuagccaugucaacuaauagcuuuuauaugguauguaacaaaucugaauuauguuaugcugugaauuauucagugcauuauaagaaaucuuaguuaaucaugcuuuugggcuucauuagucaaugugauuggccuuuuauuuucuuuccauaacuuaucugcuauuauuaguuucuuauuccuuauuauuaaucuguuagcucauuaucauuagcuuacuaacuugaaaguuagauuaauaucaaaauaagaauagcagcacuaugaagaguuaauaaaaugcaauuucauguuagagcuagaauaaaaguaauugagcagucauuugcaaaugcuucauuauaacauuuaugugcuuaagauuucuaagguuuuaaaaaguuaccuuuaauacaauccuuagaaacucagaaauuuccugauauucauuagauuaugguguuugccuaauuuauaccgguuuucacuguauauuuuaaugaacuuugauugguuacuuuuccagacauacagauuuaauuuggaauaugaacuuugguucuucaugagugcauuuugaaaaagaaaaaaaguacacauucagaaucuggccaauuuaaguuuguauuuuaaaaauauuuuaugcauguuaaguauggucgcaguaaaugaaauuguguuuaagacuaaauuuacuaccguuuugaacagacauucccagaucauucuuauauugucagauaacacuuguguauaauaucacuuuggaucauggacaugagcuggaaaaaugauguauuuuuguagauuguauguccagaaugacuuuagaaccgcaugauacgguggaaggagcacuggacuagucgucacuacccuuuuuggauucagggcuccucacaauuaaaaugaguguaaugaaacaaggugaaaauauagaagcaucccuuuguauacuguuuugcuacuuacaguguacuuggcauugcuuuaucucacuggauucucaugguaggauuucugagaucuuaaucuaagcuccaaaguugucuacuuuuuugauccuagggugcuccuuuuguuuuacagagcagggucacuugauuugcuagcugguggcagaauuggcaccauuacccaggucugacugaccaccagucagaggcacuuuauuuguaucaugaaaugauuugaaaucauuguaaagcagcgaagucugauaaugaaugccagcuuuccuugugcuuugauaacaaagacuccaaauauucuggagaaccuggauaaaaguuugaagggcuagauugggauuugaagacaaaauuguaggaaaucuuacauuuuugcaauaacaaacauuaaugaaagcaaaacauuauaaaaguaauuuuaauucaccacauacuuaucaauuucuugaugcuuccaaaugacaucuacagauaugguuuuguggacaucuuuuucuguuuacauaaauuuauccacuuaaaaugugauaauguggagacaaagcaagauuugauuacauaaacuuuucucugcauuggucuuuucacuaucuuauuugcuaacuuuucuuauuuuucuucaaccuccccacccuccauuuuuuggauauuaaacagggaaagcuugcuacauuauaaagauuguuggcaccauuuauuuuacacaaaggcuaaagguuaacuuuuggaaaugaugagcuacuuuuauauauguguuuacucaugcuuugugauauuucuggaucauuccagucauaaagacuuauuacauguacuauuucuugcuaccugugaaaagguauauuuuaaagaauguauaaccaacaguccauuuacuuuuuauuaguauguagaggauuuguaucuaauucaugaauguaguuuuacaguaguuugucauuguaaauggagcaaaguacauuaucuucuaaaauguacauuauguaagaauuguaaauauacuuaaguaauuuguaugccaaaaaauuacaauaagucaauaaagaucucaccucug

SEQ ID NO: 342 - RNA, 1379 nt, Homo Sapiens
gcgcucgccgggaccuggaaucccuguacgccgaggugggagccgguggaccggucccccagccggcccccaccuccgcuucccgguguuugaggguucgggccucccgccggggaguucaccccucgggcucgucaguagggcuguggcugucgccucuuccugcagcgccaggcuccgcccggucucacagucggcuuaggggcuuugcgugcacugcgguuggguggaaaaacccacuccugguuguuuagacguuggccugcagacgaugucauuucuguauuccucuaaggcaggaagucauuaugcaacuuacacauauucaucagauuuccucugacuuacccggacauguacaugggaaugaugugcacugccaagaaaugugggauuagguuucagccuccagcuauuaucuuaaucuaugagagugaaaucaaggggaaaauucgccagcgcauuaugccaguucgaaacuuuucaaaguuuucagauugcaccagagcugcugaacaauuaaagaauaauccgcgacacaagaguuaccuagaacaaguaucccugaggcagcuagagaagcuauucaguuuuuuacgagguuacuugucggggcagagucuggcagaaacaauggaacaaauucaacgggaaacaaccauugauccugaggaagaccugaacaaacuagaugacaaggagcuugccaaaagaaagagcaucauggaugaacuuuuugagaaaaaucagaagaagaaggaugauccaaauuuuguuuaugacauugagguugaauuuccacaggacgaucaacugcaguccuguggcugggacacagagucagcugaugaguucugauaccaaacacucaaaacaugcauugggcuagcagaauauccauguuuauuaccagacugguucuggaagaagcuguaaagaauacuaaauauguuggguuauaggggauugaccauguuacuuuucaaaaccaggacauuuaaagcaucuacuauguaggugcaugaggaguaugggaaaaacagaauaaaggaaucugccuuuaaggagcuuacaaucaugccgggugcgguggcucacgccuguaaucccagcacuuugggaggcugaggcggguggaucaccuaaggucaggaguucgagaccagccuagccaacauggugaaaccucgccucuacuaaaaauacaaaaauuagccaggcgugguggcgggugccuguaaucccggcuacucaggaggcugaggcaggagauucgcuugaaccugggaggcugagguugcagugagccgagaucgcgccauuguacuccagccugggcgaugagcaaaacuccaucucaaaaaaaaaaaaaaaaaaaa

SEQ ID NO: 343 - RNA, 104 nt, Homo Sapiens
agugcucgcuguggcagcauauacacuaaaacuggaaugauacagagaagauuagcauugccccugcacaaggacgacacacaaauuugugaagcguuccauac

SEQ ID NO: 344 - RNA, 1280 nt, Homo Sapiens
caccuagaaggaaggagagcugcucagagaggccccagggaaucugacucaacaggcccuaccaggcucuccucuuggucugugagcauccagccuuacuuuuguauccaaucauauuuccauacuucgcugaacuguguuuauggauaguuuccaccagaucuuuggaucuucaucuugaaggcugccgugccacauaagcuaugaucaaauacaucuguuaugcucuucuccuauucaucugccuucugcccguugauuuucagcaaacucccagaggaugaaggggaguuuucuguuuggccccacaggggaggagcgagcgagauugacguggaagcugggccucugaaggacacagagugcucuaagaaagggacgauggggcagauccauguucacaaacacgcccaugugaauucacucucagaugucuccucgugucagcacgcugggugccagcacgcucugauauugacacaaagggccacggagucaccacucacuccacacacacucaccccgugcccacuuacccagggagggccaggaaugaggaugccacuguggcucagugauggcgccgagacacaggugaacacuguaaaauguggaugccuggaggcagcccacacccugggccuuggcugggggaaagguuccagaaacgucaucacaacgaugcauuucaucagaacugagcacaugaauggggaggggcaggacuuccugaaugucccaaccccacugucccacccucugugucaauaugaggcugccuuauaaagcaccaagaggcugccagugggacauuuucucggcccugccagcccccaggaggaaggugggucugaaucuagcaccaugacggaacuagagacagccaugggcaugaucauagacgucuuuucccgauauucgggcagcgagggcagcacgcagacccugaccaagggggagcucaaggugcugauggagaaggagcuaccaggcuuccugcagaguggaaaagacaaggaugccguggauaaauugcucaaggaccuggaugccaauggagaugcccagguggacuucagugaguucauaguguucguggcugcaaucacgucugccugucacaaguacuuugagaaggcaggacucaaaugaugcccuggagaugucacagauuccuggcagagccauggucccaggcuucccaaaaguguuuguuggcaauuauuccccuaggcugagccugcucauguaccucugauuaauaaaugcuuaugaaauga

SEQ ID NO: 345 - RNA, 5660 nt, Homo Sapiens
ccccagcagccgccccagccgcagccgcagccgcccggcucgucugccaccaccccgggcggcggcagcggcggcucgcucagcgccaugccgccgcccagccccgacucagagaacggcuucuaccccgggcugccgucguccaugaacccggccuucuucccuagcuucucgcccgugucgccgcacggcugcacugggcucagcguuccgacgagcggcggcggcggcggcggcuucggcggccccuucucggcuaccgcugugcccccuccgccgccgcccgccaugaauauaccucaacagcagcccccgccgcccgcggcgccgcagcagccgcagagccggaggucgcccgucagcccgcagcuccagcagcagcaccaggcggcggccgccgccuuccugcagcagaggaacuccuauaaccaccaccagccucuucugaaacagucucccuggagcaaccaucagagcaguggcuggggcacuggaaguauguccuggggagcaaugcauggcagagaucaucguagaaccggaaacaugggaaucccaggaacuaugaaucagauaucuccauugaagaaaccguuuucugguaaugucauagcaccaccgaaauuuacucgcucaacuccaucacugacuccaaaaucuuggauugaagauaauguguucagaacagacaacaauaguaauacacucuuacccuuacagguaagaauggugagaucuaguuugcaguugccagcuuggggcucagauucacuccaagauaguuggugcacugcagccggaacauccagaauagaccaggaucgaaguagaauguaugacaguuugaauaugcacucuuuggaaaauucccuuaucgauauuaugagagcagagcaugauccucuuaagggucgauugagcuauccacauccaggaacugacaaucuguugauguuaaaugcaaggaguuaugggcgaagacgaggucguucuucccucuuuccaauagaugauggcuugcuugaugauggucacagugaucaaguuggaguuuuaaauucacccaccuguuauucagcucaccaaaauggagagcgaauagaacgcuucucucgaaaaguuuuuguugguggucuuccuccagauauugaugaagaugaaauaacugcuagcuucagaagauuugggccuuugguaguagauuggccucauaaagcagaaagcaaguccuauuuuccaccaaaaggcuaugcauuucuucucuuucaagaagagagcucaguucaggcacucauugaugcuuguauugaagaagauggaaaacucuaucuguguguuucuagcccuacuaucaaggacaaaccaguucaaauacguccuuggaauuuaagugauagugauuuuguaauggaugguucucagccuuuggauccccgaaaaacaauuuuuguuggagguguuccuaggccauuaagggcuguggaacuugcuaugaucauggaccggcuguaugguggaguuuguuaugcaggaauugauacagauccugagcuaaaauacccaaaaggugcugggcgaguugcuuucuccaaucagcagagcuauauugcugccauuagugcucgguuuguucagcuucagcauggugauauugauaaacguguggagguaaagccauaugugcuagaugaccagaugugugaugaaugccagggcgcacgcugugguggaaaauuugcucccuuuuuuugugccaaugucacuugccugcaguauuacugugaguuuuguugggcaaauauccacucucgugcuggacgugaguuccauaagccauugguaaaggaaggugcugaucgcccacgucagauccacuuccgcuggaacuaagaauagcaaacuggccucuguuuaacaaggaaagaaagggugcauguggcuuacugugucugaagauacugacaugcagaagaaauaagugcauucuucugcuuuucaccccagcuaucaauacaugcaucuuuaucagcagccaaaacacuacaagccucuuguuuuucaccaaaacccuacaucucaggcuuacuaauuuuugugauauuuucauguucaaauaaaauguuuuuuuguauuuucuccaaguuauuuuuauauguaaaguuaaaauuagauaugagaauguuuugcguaggggcaacacagucugcugcuauauagugggggaagcgugcacuuauuucuaaacauggguuuuuaacuucaagaucugccccaguaauuuaccaaagguagcaaaauaauagugaagauggaauaugucugcuacaaaugcuuauuuuuauuguugcuauuuucaguguauacauaaacuaaaaauuaggguugauuuuuuugcucuccauuuugacuugcaagaaauaauaccucaagauaaucugauuuauuagcuauuuuuaaacauuuuuaaucacaagcuguauuagcuuugcugcuauauagguguuauguguaaaugccaccuauuaauacgggacugaaaacguuagagacacacugcauugcagauaaaaugcaggcagcacaauauggccuaaacugccauaguuuuagaaugugaaaaaaaugcauguuuacuuaccuguauacaccauaugcaugcacuagaauuauuaacuaacgaggugagguauugcaaauguucaaaaaagcucucuugaaucuagguagcaugaacaaauuauaaaauuuguuuaaaaaagcaaacuugcaugcauuauugugacuucaaguuuaaaaaaucgucuuacauguguacaauaugcaaauuaguuuuagauuagagagugcagccauuuugugaucuggucaguaguggaauucgauuuuaugcagacuggauguaauauuuguaaucccugugcaauuuugugacgugcgguucuaauucaugugcagugauauaguauagauaaaagaaugaguaaaagaaaauacaagaauucuaaagaaaguugguuuuagccccuuugauaguccaugguuaagacauccuuuauaaaccaaagauggccagcacacugcuaaccagucaccaaauguaagacccauaagaaacccauauuuaaaaaucugaauuuuuuagaagaaugcaaaacuuuaguaaacccuaaguaaagucaaaauggagaaggggaaauauacagauggcuaguugcauaaaauuaaauuuuaccuuuauaagacaauggugaaaucuggcuugaacuugcuuauguguuuaaccuauaaauauuggggucuucugucuaaacuggggucacuguugcauggaacauuguucuuaauaguugagaauugcuuuuuugaaaauuuucaugaaggaauuuugguaaugacuuugcuugcagguuuuuugggguguuuugagaaaguggcauggaaacaugcaguaguuaaugaguuucucuugguacugaacacuauuagaauaucauuagugauauuuuuucucuuuagagcauuuuuaaugcaacuagccccuauauuuuaauguaagaguuacucugcaaucuaagcaaagcacccaacaaugguaaauguuuuuuaaaaaugcagaacuaagauuuuugacucuaaagagagaaaauuacaaggguguugccuuauagcaaacccuugggacaauccuucaugugagcaaaguguugaucuuaauauugguugucuguggugugcuuuuuuguacuguaaaaauaugugguucaugucuaacucugcuguuuuauugugguugugguucaaguuuuuaauguuuaaaguugaugcuguuuucagaagagcuuuuuacuaauuuauuugucaguguucccuauuuguuacuuaaccaugauccuccagauuuuuuggaguauucuuuucuaaccuuaacccugccaaaccuugauccauuuugacauuuguuaugcacuauuuuuauaucucugugagagauuuuuccaacagucagcuauuuuauggcacacuuuuuuugacugaugacaucuccuuugcuauaccucaauuuuuggaauuuagagaagaaaucaguaguuuugcaauguuaauuauuuagauauuuaauuucgcagauuuuuaaacuuuauuuucauaauuucugcuuaauguuuaaaauugaagagccuuuucauguauuaaauaaugaacacaaauuauauaauuaaaauaauuggagauguugaaaaucauuuucccuucuuaaacagaaauaaauauuuggaaugaaggggaauguacuagaacacccuuuuugccacggguaaaaauaacagaaauguaugguuuguuuuaccuucauuucuguacaaguaaagcuuauuagucuaauguuuuguuccuuucccaccucaccccuaccucuuuuguuuuguuuuguuuuugcccuuuauguacuacauucuuauuuucuaacuuuuaaacacuguauuggagguuuuuuuuuaauuuacagaucauauuuauuuuacuauuuuuguagaaaauuauuaauuuugauuguauuuuuguauuuuaaaagcuucuucacuuguguucccuaaauauucauauugcugcccaaaaguaugacuguggaggaaaaaaaaauacuuuaaaaauccacacuuuuuguuaagaaggaaacauuuagcauuuauauauuuguguauggaaaacacuugauauuuuaucccuguugcaucuggcugcacagagccucuccucaaagaugcuacaaaacuugaauauaacacauuuuggaaggcugacuaaccucgauucuguguugugaugugcaauacuguuucuaauguuuguauaaaaaaaaacaguguaaaccuuuuuaaugcaaauuuauuuuuuucauugcauauuuugcagauuuuauccacagugucauuuuuuacugucagaaaagauaccccuuuugucauugcaacuauuuuuuaaauccagaaaucuuuguacugauguaaaugauuguaguuauuuuggauaguguuuugcuaacaaaaggagagacuuuuuucaugcauauuucuauuuuguuuuuuuggguuuuauuuuauuuuaauaguaguaaaauacuuggaauaauuuuucauauucuugucauuaauauuauuuuguauuuuuauguggaaauauauaauuuuaugacacuaauugcuaaaguuuauuuuauguugaauuauuuuuggagcugaaaucuuuguaauauuaaagcaacuaguuucuaauucccaguuucuguauagaaucgcacaagugguuuauggaguguuuggauuguaauuauaaaugguucuuugauaugcaaauuaauauuuucaguugauuuuauuuuauauuccuaaugggguguuaaagccguuuuuuauuuuuuucuaaauaaaaagagaacccaugcuuuuauggacacuagguaaacaccuucagcuuaaauuuuucguuaaauauuuuaguuuauuuuauuguuaucuuccaggugucuaaaucuccagucugucuguuguacugguaauuuaacucuguaauggaauaguuugcugccaacuauuuauauuaaguaauuuuuaaauauuuguaauauuguugacugacuaauaaacuauuaaguuauuggc

SEQ ID NO: 346 - RNA, 2081 nt, Homo Sapiens
ugucuggaacgggaaacggcaaacagcgagauauccgagcgagagucccgcccugcaucaguuugcggaaccgccuugguagaaggagagaaggggaguggaggaagcacgggacuggagggaccaaaguuccccgauggcggcccaggggugcgcggcaucgcggcugcuccagcugcugcugcagcuucugcuucuacuguugcugcuggcggcgggcggggcgcgcgcgcgguggcgcggggagggcaccagcgcacacuugcgggacaucuuccugggccgcugcgccgaguaccgcgcacugcugagucccgagcagcggcaaauaagaaacagcagagaaccaccuguguuacacaccacccaggaacaagaacugcacagccaucugggaagccuuuaaaguggcgcuggacaaggaucccugcuccgugcugcccucagacuaugaccuuuuuauuaacuuguccaggcacucuauucccagagauaagucccuguucugggaaaauagccaccuccuuguuaacagcuuugcagacaacacccgucguuuuaugccccugagcgauguucuguauggcaggguugcagauuucuugagcuggugucgacagaaaaaugacucuggacucgauuaccaauccugcccuacaucagaagacugugaaaauaauccuguggauuccuuuuggaaaagggcauccauccaguauuccaaggauaguucuggggugauccacgucaugcugaaugguucagagccaacaggagccuaucccaucaaagguuuuuuugcagauuaugaaauuccaaaccuccagaaggaaaaaauuacacgaaucgagaucuggguuaugcaugaaauugggggacccaauguggaauccugcggggaaggcagcaugaaaguccuggaaaagaggcugaaggacaugggguuccaguacagcuguauuaaugauuaccgaccagugaagcucuuacagugcguggaccacagcacccauccugacugugccuuaaagucggcagcagccgcuacucaaagaaaagccccaagucuuuauacagaacaaagggcgggucuuaucauuccccucuuucuggugcuggcuuccaggacucaacuguaacuggaaacuguguugcucuaacccuccuccagcccugcagccuccccuugcagucaucauucguguucuguguauaccaaaugauucuguuaucuaaagaagcuuuuugcugggaaaacgauguccugaaaaugguauuucaaugaggcauauguucaggauuucagaaacaagaaguuaguucuauuuagcagguuaaaaaaugcugcauuagaauuaaagcaaguuauuuucuuauuuguauaaugacacaaagcauugggagucagacugcuuguauauuaucaaacauuuuaagagaauucuaauaaagcuguauuuuacaucaucuauauuuuccuauaucuccagcagcacggacacugcaugcuuguugauugcuuaagacauauguauacuauauaaauguaugcauauauggucugcaaaguuuucauuuuucauuuauuugguauaaagauguucaguuaaugguuccuuuuuguuuugagagacagaguuucgcuccuuugcccaggcuggagugagguggggagaucucagcucacugcaaccucugcuuccaggauucaagcgauucuccugccucagccucccaaguagcugggauugcaggugccugccaccauguccagcuaauuuuuguauuuuuaguagagaugggguuucaccauguuggccaggcuagucucgaauuccugaccucaggugauccacccaccucagccucccaaagugcuaggauuacaggcgugagccaccacauccagccauaauaguuacuuauaaugagggaaaaacccaaaauauccaguaauauuuacauauuuacugaaacuguuuggaacuuguauuaguuuguucuugcauugcuauaaagaacugcccgagacuggguaauuuacaaaaauaaaaauaaaaaagagguuuaauugacucaca

SEQ ID NO: 347 - RNA, 255 nt, Homo Sapiens
augccucucgcaaaggaucuccuucaucccucuccagaacaggagaagaggaaacacaagaagaaacgccuggugcagagccccaauuccuacuucauggaugugaaaugcccaggaugcuauauaaucaccacagucuuuagccacgcacaaacgguaguuuuguguguuggcugcuccacuguccucugccagccuacaggaggaaaagcgaggcuuacagaagguuauuccuucacgaggaagcagcacuaa

SEQ ID NO: 348 - RNA, 4118 nt, Homo Sapiens
acugagaaccuacuuaaagcuauggcaaaggcacuggaggauugagcuaggugggcagaaaagagcagugucguuauuugugcaacaacauugaaaaacaagcagaaauaaaacauugacggaacggauacgaccgcagauugcgggagcuguccucucaaucagcccggcagcggcggcccacaauuuacgcgugugcaacccuaaccccggcccaagcuugaccuacaauuugcgcaggcgcagauccuaacuuuggcgucccugugggcggccuuuggugugagacgcgugguauucugggaacgucggagacggaaguuacuucgucuuuagcuccuggcgcugcuggcuucugggcgguuuuugucuuuugauuucaagaguuaggagcucgagaaccguuuggcaauauguacgacgcggaugaggauaugcaauaugaugaggaugaugaugaaaucaccccggauuuguggcaagaagcaugcuggauuguaaucaguuccuauuuugacgagaaaggcuugguuagacaacagcuggauucuuuugaugaguuuauucagaugucuguucaaagaauuguggaagacgcuccuccuauagaccuacaggcugaagcucagcaugcuaguggagaaguugaagaaccgccacgauauuugcugaaguuugaacaaauuuaucuuuccaagccuacccauugggaaagagauggugcuccuucaccaaugaugcccaaugaagcuagauuaaggaaucucacguauucugcuccgcuuuauguugauauaacaaaaacagucauuaaagaaggugaagaacaacuucagacucagcaucagaaaacuuuuauaggaaaaauuccaauuauguugcggucaacuuacugccuuuugaauggcuugacagaucgugaucuuugugaguuaaaugaaugcccuuuggauccugguggcuauuucauuauuaauggaucagaaaagguucugauugcccaagagaaaauggcaacaaacacaguuuauguguuugccaaaaaggauucuaaauaugccuacacaggagaguguagaucaugucuugagaauucuucccgacccaccaguacuauauggguuagcaugcuggcaagaggaggacagggugccaagaagagugcuauuggucagcgcauuguggcaacucuaccauauaucaagcaagaaguucccaucauuauuguguucagagcauuagguuuuguguccgacagagauauuuuagaacauauuauuuaugauuuugaagauccagagaugauggaaaugguuaaaccuucucucgaugaagcuuuugucauccaagaacagaauguugcacuaaauuucauugguucaagaggagcaaagccugguguuacuaaagagaaaagaauuaaauaugcaaaggaaguuuuacaaaaagaaaugcucccucauguuggugucagugauuuuugugagaccaaaaaagccuauuucuugggauacaugguucauagguuacuucuggcagcuuuggguagaagagaacuagaugacagagaucacuauggaaacaagagauuggaucuugcugggccgcugcuugcauucuuauuuagagguauguuuaagaauuugcuuaaagaagugcggaucuaugcacagaaauuuauugaucgaggaaaggauuuuaacuuggaguuggcaauuaaaacacggaucauaucugauggccuaaaauacucuuuagcuacuggaaacuggggugaucaaaagaaagcucaucaagccagagcuggaguaucucagguguuaaaccgccugacuuuugcgucuacucuuucucaccugcgucguuuaaauucuccuauugguagagacggcaagcuagcaaaaccaagacaguugcauaauacguuguggggaaugguguguccugccgagaccccagagggccaugcuguaggacuugugaagaauuuagccuugauggcguauauuucaguuggaucucaaccaucuccaauucuggaauuuuuagaagaauggaguauggaaaauuuagaagaaauuucuccugcagcuauugcugaugcaaccaagauuuuuguuaauggcugcuggguuggaauacauaaagaucccgaacaacuuaugaacacccuaaggaaauugagacgucagauggacaucauugugucugaaguuucuaugaucagagauauucgagagagggagauucggaucuauacggaugcaggccguauuuguagaccacuucugauuguggaaaaacaaaagcuacuuuugaagaagaggcauauugaccaauugaaagagagagaauauaacaacuauaguuggcaggaucuuguggccagugggguaguggaguauauugauacccuggaagaagaaacagugaugcuugcaaugacuccagaugauuuacaggagaaagaaguagcuuauuguuccacauauacacacugugagauucaucccucaaugauccuuggugucugugcaucuauuauucccuuuccugaucauaaccaguccccuagaaacacauaccagucugcuauggguaagcaggcuaugggaguuuacaucaccaacuuccauguucgcauggacacauuggcccauguucucuauuauccucaaaagccacuugugacuacacggucuauggaauaucuacgauuuagagagcugccagcaggcaucaacucaauuguggccauugcaucauacacuggauauaaucaggaagacucuguuaucaugaaucguucagcuguagaccgcggcuucuucaggucuguuuucuaucgcucauacaaagaacaggagucuaaaaaaggauuugaucaagaagaaguuuuugagaagccuacacgugaaacaugccagggcaugaggcaugccauuuacgacaagcuggaugaugaugguuugauagcuccagggguucguguaucaggagaugauguuauuauaggcaaaacagucaccuugccugaaaaugaagaugaauuggagagcaccaauagacgcuauaccaagagagacuguagcacuuuucucagaacuagcgagacgggcauuguggaucagguuaugguaacucucaaucaggaaggauauaaauuuuguaaaauaaggguacgcucuguuaggauuccacagauuggagacaaauuugcuagucgacauggucaaaaggguacuugugguauucaguauagacaagaggauaugccuuucaccugugaagguaucaccccugauaucaucaucaauccccaugccauccccucucguaugacuauuggucacuuaauugaaugccuucaagggaagguaucggcuaacaagggugaaauuggugaugccacuccauuuaaugaugcuguuaacgugcagaagauuucuaaucuuuuaucugauuauggcuaucaucucagaggaaaugagguccuguacaauggguucacuggucgaaaaaucacaucacaaauauuuauuggccccacuuauuaccagcguuugaagcauaugguggaugauaagauucacucucgugcuaggggaccuauucagauccucaauagacagcccauggaggguagaucucgugaugguggccugcguuuuggagaaauggaacgagauugucagauugcccauggagcagcccaguuuuuaagggaaagauuguuugaggcaucagauccauaucagguucauguuugcaaucuuuguggaauaauggcgauugccaacaccaggacccauacauaugaaugcaggggcugccgcaauaaaacccagauuucuuuggugcgaaugccuuacgcaugcaaacuauuguuucaggaacuuaugucuaugaguauugcaccgcgaaugaugaguguuuagcuauuuuacaggagucaacaagauaauuaaauaucuuggugucuuguuucuauuguguggcuuuuuaaaaaugacaaauauguacuguguugugauaaaaaguauuuuauuuguuuaaugauaugcaugcuuuucuucuguaaauauauaauaaauuuuuguagauagucuugaugugug

SEQ ID NO: 349 - RNA, 1635 nt, Homo Sapiens
ggguggggaagcuuagagaccggugagggagcagagcuggggcgccuguguacagggauagagcccggcggcagcagggcgcggcuucccuuucccggggccuggggccgcaaucagguggagucgagaggccggaggaggggcaggaggaaggggugcggucgcgauccggacccggagccagcgcggagcaccugcgcccgcggcugacaccuucgcucgcaguuuguucgcaguuuacucgcacaccaguuucccccaccgcgcuuugggauuagugugaucucagcucaaggcaaaggugggauaucauggcaucuaucugggugugcgaauuaugggguuggacaccgaggaacaguaagagauuauccagacuuuagcccaucaguggaugcugaagcuauucagaaagcaaucagaggaauuggaacugaugagaaaaugcucaucagcauucugacugagaggucaaaugcacagcggcagcugauuguuaaggaauaucaagcagcauauggaaaggagcugaaagaugacuugaagggugaucucucuggccacuuugagcaucucaugguggcccuagugacuccaccagcagucuuugaugcaaagcagcuaaagaaauccaugaagggcgcgggaacaaacgaagaugccuugauugaaaucuuaacuaccaggacaagcaggcaaaugaaggauaucucucaagccuauuauacaguauacaagaagagucuuggagaugacauuaguuccgaaacaucuggugacuuccggaaagcucuguugacuuuggcagauggcagaagagaugaaagucugaaaguggaugagcaucuggccaaacaagaugcccagauucucuauaaagcuggugagaacagauggggcacggaugaagacaaauucacugagauccuguguuuaaggagcuuuccucaauuaaaacuaacauuugaugaauacagaaauaucagccaaaaggacauuguggacagcauaaaaggagaauuaucugggcauuuugaagacuuacuguuggccauaguuaauugugugaggaacacgccggccuuuuuagccgaaagacugcaucgagccuugaaggguauuggaacugaugaguuuacucugaaccgaauaaugguguccagaucagaaauugaccuuuuggacauucgaacagaguucaagaagcauuauggcuauucccuauauucagcaauuaaaucggauacuucuggagacuaugaaaucacacucuuaaaaaucugugguggagaugacugaaccaagaagauaaucuccaaagguccacgaugggcuuucccaacagcuccaccuuacuucuucucauacuauuuaagagaacaagcaaauauaaacagcaacuuguguuccuaacaggaauuuucauuguucuauaacaacaacaacaaaagcgauuauuauuuuagagcaucucauuuauaauguagcagcucauaaaugaaauugaaaaugguauuaaagaucugcaacuacuauccaacuuauauuucugcuuucaaaguuaagaaucuuuauaguucuacuccauuaaauauaaagcaagauaauaaaaauuguugcuuuuguuaaaaguaa

SEQ ID NO: 350 - RNA, 2716 nt, Homo Sapiens
uacccgcagcuccgaccacuggcucgcgcuacccaggucuccgcacgccgcgguggcuucagcccagaccugggcagccagcggagaaagaguuaacuggcaggggcgaggaggagcccagggaggaaggaaggauauugccguaauucugaaaguuuuuuuccuuccucucuucccuucgcagaggugagugccgggcucggcgcucugcuccuggagcucccgcgggacugccuggggacagggacugcuguggcgcucggcccuccacugcggaccucuccugagugggugcgccgagucauggagggcgcagagcuggccgggaagauccuuuccaccuggcugacgcugguucucggcuucauccuuuuaccuucggucuucggagugucucugggcaucuccgagaucuacaugaagauccuagugaaaacuuuagagugggccacaauacgaauugaaaaaggaaccccaaaggagucgauucuuaaaaacucugcuucuguugguauuauccaaagagaugagucacccauggaaaaagggcucucuggucuacgaggaagggacuuugagcugucugacguguuuuauuucuccaagaagggauuggaagccauuguagaagaugaagugacccagagguuuuccucagaggagcuagugucauggaaucuccucacaagaaccaauguaaauuuccaguacaucagucugcggcucacuauggugugggugcugggcgucauagugcgcuauuguguccuacugccucugaggguuaccuuggcuuucauugggaucaguuugcugguuauaggaacuacacugguugggcagcugccagacagcagccucaaaaacuggcugagugaacugguccaucugacuugcugccggaucugugugcgagcccucucugguaccauucauuaucauaacaagcaguacagaccccagaagggaggcauuuguguugccaaccauacuucccccauugauguuuuaaucuugacaacggauggauguuaugcuaugguuggccagguucauggcggcuugaugggaauuauucagagagcuauggucaaggcuuguccucaugucugguuugaacgcucagaaaugaaggaucgacaccugguuacuaagagacuaaaagaacauauugcugauaagaagaaacuacccauacuaauuuuuccugaaggaacuugcaucaacaauacuucagucaugauguuuaaaaaggggagcuuugaaauuggaggaaccauacauccaguugcaauuaaguauaacccucaguucggugaugcauuuuggaacaguaguaaauacaacauggugagcuaccugcuucgaaugaugaccagcugggccaucgucugugacgugugguacaugccccccaugaccagagaggaaggagaagaugcaguccaguuugcuaacaggguuaagucugcuauugcuauacaaggaggccugacugaacuucccugggauggaggacuaaagagagcaaaggugaaggacaucuuuaaggaagagcagcagaaaaauuacagcaagaugauugugggcaauggaucucucagcuaagaggacggaugacagccuuuagaucuagaacuagcccuuagaaauggaauggcuuuuuuuguuuuguuuuguuuuauuguuuuguuuuuauuauuguuaaucuuuucuacagaaugauugucucuaccucuuuaugccagaggcagaaccuacaggugcccuuuuuggcuuuuguuguuguuguaacauuagccccauggauuguaaggugguuuacugaguuaaaacagauucugcuuuuguaaaaugauggcaucacuguggacugaaugaaauauuuguauagaaaaaagugcuugaaaaguguguuuggaacucaucgauaggguaauucuccaaaaaugcccaaacucuuuuucuguaauuagccuugccacuuucuucagucacuuaaauggugagauuacacaucagugcaagaugaccauuaugguuauggucuacugcaagguugaaaggaaaaauggaggauuguauuuaggaaaagggacaacuuuguggccaccugcucugaaagucaaaaggaaauguaaauuagugucauuaguguguuggaagagaaauacuauucaguaagcuucgccaaagaaaagugagucaaaguuaaugugugugcgcauuuauauguaggcagcucguagaccacauuuuaaccagcaacugguaacaaagagcuuaguuuuccuuguuugaaugcuguagaucuguaccuaguaccccucccaucuacugauuuguuuguuuuuguaaccaaacacauuuucagauagaaggagccuuaaaaaaaaaaaaucacauugaguaacuucaguaugaaugaaugagaguguguggagcuaccccucacccuccaccccuuugugcuuuuuauucccgaauuuucccagucucuuaaacagaaaaaugacugauauaauuaucuuuuggaaacugagccuuaauuuuuuuuagagggggaaauaaguuuuccccaacucacacagcauaagcaauguuugacagcaauauaaugccguuguaaacuacugagaguauuguaucuguucugguaaccauguacagaaugugaaacugucuuaugaauauaaauaaauucuauauuucuaaa

SEQ ID NO: 351 - RNA, 4874 nt, Homo Sapiens
acuguugggagaggaaucguaucuccauauuucuucuuucagccccaauccaaggguuguagcuggaacuuuccaucaguucuuccuuucuuuuuccucucuaagccuuugccuugcucugucacagugaagucagccagagcagggcuguuaaacucugugaaauuugucauaagggugucagguauuucuuacuggcuuccaaagaaacauagauaaagaaaucuuuccuguggcuucccuuggcaggcugcauucagaaggucucucaguugaagaaagagcuuggaggacaacagcacaacaggagaguaaaagaugccccagggcugaggccuccgcucaggcagccgcaucuggggucaaucauacucaccuugcccgggccaugcuccagcaaaaucaagcuguuuucuuuugaaaguucaaacucaucaagauuaugcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaaaacuggaauuaaaaggaaagucaagaagaaugaacuaugucgaugcacaguaucuuuucuuucaaaaguagagcaaaacuauagguuuugguuccacaaucucuacgacuaaucaccuacucaaugccuggagacagauacguaguugugcuuuuguuugcucuuuuaagcagucucacugcagucuuauuuccaaguaagaguacugggagaaucacuagguaacuuauuagaaacccaaauugggacaacagugcuuuguaaauuguguugucuucagcagucaauacaaauagauuuuuguuuuuguuguuccugcagccccagaagaaauuagggguuaaagcagacagucacacugguuuggucaguuacaaaguaauuucuuugaucuggacagaacauuuauaucaguuucaugaaaugauuggaauauuacaauaccguuaagauacaguguaggcauuuaacuccucauuggcgugguccaugcugaugauuuugcaaaaugaguugugaugaaucaaugaaaaauguaauuuagaaacugauuucuucagaauuagauggcuuauuuuuuaaaauauuugaaugaaaacauuuuauuuuuaaaauauuacacaggaggcuucggaguuucuuagucauuacuguccuuuuccccuacagaauuuucccucuuggugugauugcacagaauuuguauguauuuucaguuacaagauuguaaguaaauugccugauuuguuuucauuauagacaacgaugaauuucuucuaauuauuuaaauaaaaucaccaaaaacau

SEQ ID NO: 352 - RNA, 97 nt, Homo Sapiens
gugccugcuucagcagcacauauccuaauacuggaacgauacacagauuaacacagccccugcacaaggaugacacgcaauuucaugaagcauucca

SEQ ID NO: 353 - RNA, 4400 nt, Homo Sapiens
ugacuuccgggucgcggugcuugaagggaguguuccgucguuuccguugccggcuguuugcaguggggaaaccgaggcagcuccugcucccccuaguucuuccgcuccugugaggaaaaaaaaauguuuauuucuuugugggaguucuucuaugggcacuuuuuucgauuuuggaugaaauggcuauuacgacagaugacugggaagugugaauugcagcgaauauuugauaccuauguaggugcacaaaggacacacaggauagaaaauuccuugacauacuccaagaauaagguuuuacagaaggcgacacauguuguucagagugaaguggacaaauauguagaugauauuaugaaggaaaagaauauuaacccugagaaggaugccaguuuuaaaauaugcaugaagaugugcuuacugcagauaacugguuauaaacagcuguauuuggauguagaaagugugaggaaaaggccauaugauucugauaaccuacagcaugaagagcuacucaugaagcuuuggaaucuucuaaugcccacgaagaaguuaaacgcuagaaucuccaagcagugggcugaaauugguuuucagggugaugaucccaagacagacuucagaggcaugggcauacuuggguuaaucaaucuuguguauuucagugaaaauuacacuagugaagcucaucagauucuuucccguucaaaucauccaaaauuaggguauucuuaugcaauaguuggaaucaaucuuacagagauggcuuauagcuuacugaagagugaagcuuugaaguuucaucucuauaaccuuguuccugguauaccaacaauggaacacuuucaucaguuuuacuguuaucuugucuaugaauuugacaaguuuugguuugaagaagaaccagaaagcauuauguauuucaauuuguauagagagaaguuucaugaaaagauuaaaggacuuuuacuggauuguaauguagcacuuacuuuaaaaguauaaaucauccacuguaucuucuauuucuaccacauuuugcacauucaacagaauuuauauguuguaauaggaauuaucugaucaauuacacucuuauauauaauuuccuacaaaaauauuucagaaauucuauuuaagaaagcuaguggacaaucaguguauguuuacaauuguuuauacacuguucuccaaagguaccuuauccuuccaaagauccccucuguagagucaugcgaacuacaguuuggaacuugggacuuagcccguugguguaaaaguauaaaucagguauuuguauuaaauugauuaaaauguguaaaaucaauuuucguuuuuauguguuauagggucaaguugguaucuuuuucaaagcucuuuaagauuuuuuugguuuuuaguuuggaaauggcuguuuuuaauuuugucugauuuuuauuucuagguuaauuaacagcaaguguuucuuuaugguuuucuuuguuugcaucuuaauuacaugucauaacguugcuucauuaguagcaaauagagcagagauacagcagagagaauaaagaauuagggccuccuuuuggguuucugugauuauugagcauaacugaugagagaaugacaguauuggugacuagcuuuuuuguuuuuaaauaacacacuuuaaaaugccacaguguuauuugaaagcuuaaaggcauuuucucaucuucaguauuugcuuuuuaucaguuguagaaaagaaccuuaguguuuucuucucuaccuauguaugcuuaugaaaccgcucuaccuacauaugaaacuucucuaccuauguauguuuacgaaaagagauguauuugccaagaaaaucuugauuauauaaaagacaaaaagauuauaaaagacaguuucuguuuaaguaaaacugucuuugaaacuuaagaaagcuuaaguuuuaaaaaaaucucaguuaaacaucauugguuuauuugacuuacuguuaacucuugcuucucuuugacuccaugguguuuuuagauaaccauguaugaacuuuauguuaaugguuugugggauacuaaaauagcuugaagaugacuugaugacugugcauuuuauauaguuuuauucuccuaaaaucucaggagggcagcaagugcugucaacgauuauauagugaugagauuuuuaugggaaugauuucuucuuggugcguuuuacacauuuguacugauagcaaaacuaaaguuuaaagcagcaaaguuuaaguucuccuuaaauccuacagaaaccaaccuuuuaaggacauaauuucaucuaaaacaugacgauauuuagcacaccuuuuaauguggguauauaucaaguguuuaaggacuggcuaguaugugauagagcaagaccugagacuuuauaaguauuugcucgugucuguugacagaccucuuucuuucaaacuuguuagaagagugguaagacauauccaauuggaaaauaagaugcaguguuguauagcacauacauuuaaagugcuugcguuaaaauuaguuucucaauaagauaaaauuauuuuaaaaauuugguucacuuuauuacaauaguggcaauuuagcuuuucaguauuacaggaauuuaaaaauugguuucuuguaggggacaucucaacuuugggaauaucuucacuuaauuuuuaaaaaauauuuucaugcuuuauuguccagcuauacaauaugucgcaaaauccugacaaguucauuguauuaagguauuaacuauuacauggaaagcaauucuguucaucuuuugauguuuguguugaaaaugcuuaucuuuguguuuugaucuuccaacagcugagagcuugaacugauuuaaacauuugucaauauacuuaagaaugcuuuaaguaaagaaggggaaaauuuuaaguaaguuuuuucccuucuaggaagaaaaacuaugaugauguuaagaaaaugucauuauagagcuugcucaauaauauguucuuuaaauccaccuccauuuguacauuauagguaucauucuguuuuugcuuaaaauaaucugcaaccauuucagauaguuuuacagcaaauugaucuaaaagccacuaauaaauucuaggguuugagucuagaagccaagcaaacugucaccaaugucaguuguaaauuagaaugcaacaugaggcuucagacucaugacaaugauauacaugaaaacaaaaauauaauugugucuaccuuccuacuuucccuuuugacauauguaguuggaauuuuacauagucuuaaaauccauauuuagaaucuuaccuguuucuauaauaauuaguaaaaugccaaaguagugauagaauauuguggcauugaaguagccgaaaaauuguuaguuuuagcaucaaaaaaguaaauagauguugaaaugaauuuuuguaugugccagguugaagagagugugccagugacaggaaguagucuaaaaaauuaacaguuaugguuuuaauaggaucugaaagacaaucuuuaaagaaaugggagaaauuggggguaucagugaaccuauaccaaccucucuuuguacauaaauauggugauguagcuagauauaaaaaucagugucuuacuggcaccauuuacaguuuagaaaacaaucuuuuucuuaaaaaugcccaucugauuucuauuuuuaggagcuacuuggauuuguauguauuuuuucuacgugaaaauauauguacucuucacuuuuguuccaguacuauaauugcucaugcacucuuucuccccuuugagaacauucagugaaauacaacuucaucaaagauuugcucaaaggagaagaaucgcaugagugugaaaaguagaugcucguagccagaacagaaaagguuacacaugaucauggcacagaagauaggagguuugacuuggugggccauaauguuuauuauccuuuuugaaauaacagggaccagcagcaguuuucucaggauaaaugcucuaccccacuucucuaugaacagguguggggaggcuuacuuuccauuuucauauuuauacaccucucuacaaaagcaauuuuuaaugaagguuaguggaauuguuaaaaaucugagaggaaugaugacuggagguguuugggguuuuuuucuguauucauuuuuuaaugagaaaaguuuuaaauguaguacagguuagacccaacuacuaccuuacuauuauaggacgauucuauguuucuguuaaaguauucaaguagcuuucucugggggaaaaaguaccacuuggacacuuaaaggaauugggauuuuugucuacuuuggauaaggcaguugacuucuuaaguaaaagcaauaguguaaaaugucauuuuguuuggaauguuaagugagcaaauaaaaaacauguugaaauugu

SEQ ID NO: 354 - RNA, 65 nt, Homo Sapiens
aauaagugaugaaaaaaguuucggucccagaugauggccagugauaacaacauuuuucugauguu

SEQ ID NO: 355 - RNA, 4809 nt, Homo Sapiens
cggaggcagcgagaaagcgcagccaggcggcugcucggcguucucucaggugacugcucggaguucucccaguucucuuuuaacaguguuugguguugcaagcaggauccaaaggagaccuauagugacucccaggagcucuuagugaccaagugaagguaccuguggggcucauugugcccauugcucuuucacugcuuucaacugguaguuguggaagcacuaauggacuaagacaaaaagauuccauuaugaaagugaaaaggcaaccgcagaguggcagaagcuuuuggagaugaugaauauguuuacuuccuggauugcggugaugauaccaugaguguauacauauguguguauacauaauguauacaaauuguguucauugauuauguacaguuucuuuguauaccaauuauaccuuaauaaagcuaaggaaaaaaaaaagaaaauccagaauaaauaugcaugguaugacccauuuauuuaaaaaaaaaaagagggaaugcgaagcagugguuuuggugcgaacacaaaaauucuggcuucaacagcauuuaaauucccaaaccaagcauguuuguguuuuaauucuuuguggccauaaauuguacagcucaggccuuuauagucucucagauucugugaauguggggaauuaguuuuacucauaaaaaguuuuguucuuggggauaaauuuuuuaaaaaaauuuuuguauaguuagcacacugagaaaauacagacaaaggcauacagaugcaagaaaugagguagcugaauagaccaaagaaugauauagggcccagaagguaggcaaagagaaaguuguuggguuuaugguuacaaguaaacuagcaguuguggugcagauaguuuuauuucccccacauuaaucugaacagcccauccagacuuaaacacugcuuuuugcauuuacuucuaggcaggaagacaggguucugauggugugagucuccuucaacucagcaaaccaccuuggucugccucgaguuuccaacaccccuccugccugcuagugauaggugugaggcagguugaugaacauggaacuuuuuucuuuuggucccaaagcaugcuacuccuggaguuucauucagugaaugagaacuauaguuugguucugugagaucucuaugaaucaaggcggccacugaagcggagaaaagaaaugcuuaaauguuaagaaaguuugaagugcagaaaaaggugauuguaaauccauaugguuaagcuuagcccauuucuuaaaaggcuugauugcucauuccuccauucauugauuuacucacucuuccaauccauguuauugagucuugcucuguaauuccggaugguugugcuuuuaaguacugcauagugguuguaugucuguguuagcauugcugaauguaucagggaauucauuuuuuuauccccauucauucguuccauucaucuguuucucucucucucucucuuuguguguguguguguguguguguguguguguguguguguguguguuaugccuagaaaacauuucucaagaauuagaauuacgauaugcugucaaacacaaugacuuauuugaaccucuuuuauuuguagguugaagcacuggacaaugccacauacuuuguggauggugugggucuugggggucaucaucagccucuccaaggaagaauccuccaaucaggcuucucugucuugugaccgcaaugguaucugcaagggcagcucaggaucuuuaaacuccauucccucagggcucacagaagcuguaaaaagccuugaccuguccaacaacaggaucaccuacauuagcaacagugaccuacagaggugugugaaccuccaggcucuggugcugacauccaauggaauuaacacaauagaggaagauucuuuuucuucccugggcagucuugaacauuuagacuuauccuauaauuacuuaucuaauuuaucgucuuccugguucaagccccuuucuucuuuaacauucuuaaacuuacugggaaauccuuacaaaacccuaggggaaacaucucuuuuuucucaucucacaaaauugcaaauccugagagugggaaauauggacaccuucacuaagauucaaagaaaagauuuugcuggacuuaccuuccuugaggaacuugagauugaugcuucagaucuacagagcuaugagccaaaaaguuugaagucaauucagaauguaagucaucugauccuucauaugaagcagcauauuuuacugcuggagauuuuuguagauguuacaaguuccguggaauguuuggaacugcgagauacugauuuggacacuuuccauuuuucagaacuauccacuggugaaacaaauucauugauuaaaaaguuuacauuuagaaaugugaaaaucaccgaugaaaguuuguuucagguuaugaaacuuuugaaucagauuucuggauuguuagaauuagaguuugaugacuguacccuuaauggaguugguaauuuuagagcaucugauaaugacagaguuauagauccagguaaaguggaaacguuaacaauccggaggcugcauauuccaagguuuuacuuauuuuaugaucugagcacuuuauauucacuuacagaaagaguuaaaagaaucacaguagaaaacaguaaaguuuuucugguuccuuguuuacuuucacaacauuuaaaaucauuagaauacuuggaucucagugaaaauuugaugguugaagaauacuugaaaaauucagccugugaggaugccuggcccucucuacaaacuuuaauuuuaaggcaaaaucauuuggcaucauuggaaaaaaccggagagacuuugcucacucugaaaaacuugacuaacauugauaucaguaagaauaguuuucauucuaugccugaaacuugucaguggccagaaaagaugaaauauuugaacuuauccagcacacgaauacacaguguaacaggcugcauucccaagacacuggaaauuuuagauguuagcaacaacaaucucaauuuauuuucuuugaauuugccgcaacucaaagaacuuuauauuuccagaaauaaguugaugacucuaccagaugccucccucuuacccauguuacuaguauugaaaaucaguaggaaugcaauaacuacguuuucuaaggagcaacuugacucauuucacacacugaagacuuuggaagcugguggcaauaacuucauuugcuccugugaauuccucuccuucacucaggagcagcaagcacuggccaaagucuugauugauuggccagcaaauuaccugugugacucuccaucccaugugcguggccagcagguucaggauguccgccucucggugucggaaugucacaggacagcacuggugucuggcaugugcugugcucuguuccugcugauccugcucacggggguccugugccaccguuuccauggccugugguauaugaaaaugaugugggccuggcuccaggccaaaaggaagcccaggaaagcucccagcaggaacaucugcuaugaugcauuuguuucuuacagugagcgggaugccuacuggguggagaaccuuaugguccaggagcuggagaacuucaauccccccuucaaguugugucuucauaagcgggacuucauuccuggcaaguggaucauugacaauaucauugacuccauugaaaagagccacaaaacugucuuugugcuuucugaaaacuuugugaagagugaguggugcaaguaugaacuggacuucucccauuuccgucuuuuugaugagaacaaugaugcugccauucucauucuucuggagcccauugagaaaaaagccauuccccagcgcuucugcaagcugcggaagauaaugaacaccaagaccuaccuggaguggcccauggacgaggcucagcgggaaggauuuuggguaaaucugagagcugcgauaaaguccuagguucccauauuuaagaccagucuuugucuaguugggaucuuuaugucacuaguuauaguuaaguucauucagacauaauuauauaaaaacuacguggauguaccgucauuugaggacuugcuuacuaaaacuacaaaacuucaaauuuugucuggggugcuguuuuauaaacauaugccagauuuaaaaauugguuuuugguuuuucuuuuuucuaugagauaaccaugaucauaagucuauuacugauaucugaauauagucccuugguauccaagggaauugguugcaggauccucguggauaucaaaauucauagaugaucaagucccuuauaagaguggcauaguauuugcauauaaccuguguacauucuccuguauacuuuaaaucaucucuagauuacuuaugauacccaauacaauguaaauacuauguaaauaguuguacugucuuuuuauuuauauuauuauuguuauuuuuuauuuucaaaauuuuuaaaacauacuuuugauccacaguugguugacuucauggaugcagaacccauggauauagagggccaacuguaaucuguagcaacuggcuuaguucauuaggaaacagcacaaaugaacuuaagauucucaaugacugugucauucuuucuuccugcuaagagacuccucuguggccacaaaaggcauucucuguccuaccuagcugucacuucucugugcagcugaucucaagagcaacaaggcaaaguauuuggggcacuccccaaaacuuguugcuauuccuagaaaaaagugcuguguauuuccuauuaaacuuuacaggaugagaaa

SEQ ID NO: 356 - RNA, 5996 nt, Homo Sapiens
agagggaaugagucaggcuccggcuccacacuggcacguagugggcggaucgcgccggcgcugaguaggaaggagcuucagccgccagcccggaacgcagugaguacagccacucaaaggaaagccaagucgcuuugcaggggagcgucucaugauuuuucagaaacgugcucaugguuaaaaagaaaaaucaaggcucggaauaaauacauucaagcacuguuaauuuuagcccaaagacaggcgguacuugccuggagauuugggaaaaucaacaugaaacuaaaaaugaaauuuuaguuggaguggagcaagcaguauugaucagaacauaccaaauacgaauuuuuucaaagucugcguagaaguuuaaauuacuaggaaaaauguaaaggagaaguauuuacuaauaaaugaaacaaaaguaauaaaauaaaaaugaauuaauauaguuugacaaaauaucagcgaacgcugaaaagaaaacauuaaaauaauguuugagacuuuuuagguuuugugcaggaagaauugggaaaaaugugcuggauggagugauacugcuuuucuuuuccacaaaaauuucauuauuuuagagagcgguagagccuuuuuaaagacaguaaguuauugccaauucacaaugaaauaagaucacaugcucugaaauguacaagagcugcaugcaauaaacuucauuuaucuauagguaauaacugauugauguuuauucaguagucgaaaugcaccucaugcacucuaauuagcacgucaaauuagucucuccguuucagagguguagggccuuuguggagccuucucaauaaaauaauuugccacucuugaagguuagacauucucuucuaucaauguacacauaaagguuuuguuuugcuuugcuuguugugaauuaaaauggggagaaaaugauguguuagcuaucacccagucaugugucuuuuuagucauagguuagcuuuucaagacacuuccugcaucucugaccuguugcaccucuguuaucuuggcaccucuguuaucuuagcagcaagcaccugccucagcugacccuugagccauaacccauguaagucacugcagggcugaaccucucuuugagccuaacaguagaauaauaauuauuuuuauugaauaguguuaaugugucaauguugaaaugugccucagugugucuuccucaaccacaucccuauagaggauguuuucuuaauagcaauguguuuuuguuuuaagaaaguccacacaauuucaaauacacauuuucuuuacuaaaguuuauugaccaguuuugaagugauccuuguuuucaguuaaacuaucuuuaauaaugguaaauaacauauuuuguagguuguuguauauuuaauauucucugcaagaacacauaaggaacaauacauggaccuuuaaauauuugucauugugaaauaaaauaacaaggaaaggugauuucagguguacuuuauucaauacauauauacaagaaguuauuacuauaacauuaaauuugcaggaaaaaagaaaccacuggauuauucugcuucuauuccagagggcuuauuccaaagggccagugugcaaaauaugaauccaagauggcauuguggaaagacgcuguaccuccugugauaaaauuacuuugguggugcuuuuuucucauguaucucgggaaacuaaaaaucugaauuguauucaguggccuuuuccaaaugaagcuccugaaaaguacaucaagucuaaagugaaccagcuaacucauuaagacuggaaucaugagcaacaauggagcagaccuaaccuuugguuacaucuccuguuuuguagcuauccuuuuguuuggcucaaauuuugugccacuuaaaaaauuugauacuggugauggaauguuucuccaguggguucuuugugcugccauaugguugguugccuugguugucaaucugauauuacauuguccaaaguuuuggccuuuugcaaugcuugggggcugcauuugggcaacagggaacauugcuguugucccaauuaucaaaaccauugguuuaggccuuggaaucuuaaucuggggaucauuuaaugccuuaacuggcugggcaagcucaagguuuggcugguuuggauuggaugcagaagaaguaucaaauccgcugcuaaauuacauuggagcugggcuaucaguaguaagugcuuucauauuuuuguucaucaaaagugaaauaccaaauaacacguguuccauggauaccacuccauuaauaacagagcaugugaguauaguaugagagacaacuugauuugaaacauaaaauuaagauaaauggauaauacauaaauuuuaaacacagaugaaaaagugguguuugcucaucacuccuggcuauguaaaauaucuuagcuuauuuauuauggguaggucuauguagcaaucaaucaauauuuccgcaguugagcuucucagcaagcacacggguuuauuuauuuugauuaacagaucucuacuaggugauauauauauaaccccauuuuuguaaugauuuaaagauuccuacaauagaggaacccuaaauacuguagaggaaugugaaaauaacuuuagaaagucagaggaaggagguuuugaaguugguccaggggagaauagaccauaggaggccaagaaagguaagugaaguccuaugagaauaggaacugguaucccauucuacccgaagugaaaaacagaaaauaugauaggagucacuguuuugaucuugaagaaucuaaaucagucuggaauaguaaaucugaaugaaacaggagcaacuuuuaaaagggaccugauaaagcgcaagugucaguagcuacauauacaaaagugacuucagggcaaagccucauugucaugaacccaggcucuaauccuucucaucucaagaaaucucuccugucugcccugggccagugcuauccagcugcccucugaauccagcgcuccucacccccagugggguauugccccuuggcagggugcuuauuuaccccuuacuucaaaauuaaucuuuucuccuuuccuucuuccccuauccaaacuuuuaucaacuaaaaccuuaguuaaauugacacuaaaguugaauaguaauuagcuuaaguguaaagagaagagguuuauuaauccacaggcaucucuaaucagggaaauguuucagggagaagggaggaguuggcuuugggaaaggguuccuugccugcuucagggauccagacaccuccugcccaaccauccuccaaaacaauggaacaaaauaauaaaauaaaugcagcuugguaaaagauacacaguaggcuaacugccugagauuuuucuaggcaauaaguuuaaagauccauaaacagcaugauugauggguacagaaccaugcaucaugagcuccuuaugaugaaagaaaccguuauugccaaaggaaaacuugacuuagcacaugacaaagaauucaaaucuacuuucuugucucuuacaaaaauaauaggauuauaacaucaagaacacuucaguuggccaggcgugauggcucaugcccguaaucccagcacugugggaggucaaggugggcagaucaccugaguucaggaguucaagaccagccuguccaacauggugaaacucuaucucuacuaagaauacaaaaaaaaaaaaaagugaucaacacaacccaagaccccuguuccuggguggauaaacuuucuacaguacaccaccgcauagugggcugcagucuugcagugauaucuggaguacucuauggaucuacauuugugccaaucaucuacaucaaggaccacagcaaaagaaaugauaguauauaugcaggggcaagccaauaugauuuagacuauguguuugcgcacuucaguggcaucuuucuuacaaguacugucuacuuucuggccuacugcauagccaugaaaaauaguccuaaacuauauccugaagcaguccuaccaggauuccugucaggaguacuuugggcuauagcuaccugcuguugguucauagcaaaucacucucugagugcuguggucaguuuuccaauaaucacugcugguccaggauuuauagcugcaaugugggguaucuucauguuuaaggaaauaaagggucuacaaaacuaccuauuaaugauacuugcauuuugcaucaucuugacuggagccuuaugcacugcuuuuucuaaaaucuaacaaugacaaaaccagcagguggcagcaguaguuaagagaacgcgucuaucggacagcggagagaucaugcugagaaaagagugcauuuucauauagcaaauggaucucagccacuguuggaguggguaaaugauuuuuuuccccaaaaaugugagaaugaaggaagauugaguuucauucaaguauaaaaaugaaaauuucuucugaugaacuguuuaugaagguaguacuuuacugggugacuaaaaugucuacauuauuauagcauuacauacgaggaugcucuuuuuaccacaguauguaccuaguguugcauaaucuagaacacaguauagaguccauauacaaagaaguuacaguccauauuucucaccuauuaccccagugaagugaggcagaaauaccuugggcgaggagggagagccuuaccuucuaauggaauuagauuccaaagauauuuggauccuuuguuucauaaaguaaaugcauaguugguaacuaaauguuaaaaaggccauuuuauuauuguuagccaaaacuucuguuuauuucaaguuaauaucgcccaacucuacaucaucuacccauuuuagcucauaaugcuuuugauuaucgccagauaaaguccauucucagagaacaaaaauuuuucaucauugagaaaaugugcauaacauaauacauacauacacaaguauauucacguacauaaauacacacagauauguugcuaaagugagauuguagguuaucaguaacaauuuaaaggaaacaaccacucuuuugaauguacaacuuuuuuuucugaaauacacuuuucuaaaacccucuuaacuggagguuuccuguuuucuucuuguuuuaacuggugguuuccaguaggcaaaauaaaaugacaggcaugcuaguuuuuuuuuuuuuuuuuuuuuuuuaagaaaacugaaauuaagccaggcaggguggcgcacuacuauaaucccagcugcuggggcggcugaaguaggagggucacuuagcccaagagugcaaaucugccagccuaggcaacauagcaaggucccaucucuaaaaaagaaauuuaauuuaaauuuguaagaaaaaagaaaacugaaacagaacugccaguacaauguuuguugcaauuguuuccaaaacuuugagauaacgaaaccccuauucaaauguaaauuuuacccauucccaccugauaguacuguuuauuacuuugcuaugcaggagaaacaaaacagcuuuuuauuuguguguauacucugaagucaaugugcauggguuaaaucccaccucugcuucauuuuauuuguguggcuuuggacaaguuccuaagcccucugugucaggccccucauuaacaaaauggaguuuaugauggcaucuaccucacaugguuauugugugguugaaauuaguucaaaucuguaaaguauguugaugaguaucugguacuuggcaaacacuauauaauuguuagcuuuauuauuauguguuguuugaaggggaaaaaaguuuuuguagauuggagaacaccauguaagagcuacuaagcucaccaccuucccauccaaacaauuauuacuccucuaaaugaauacuacuuaaaagugauggagcuucuguuuguuuauugaauugcuaauacaaauaaauauuugacuauaacuucuuauacucauuuuaauuuuaaccugaaaugucauuaaauuaugcugauaaacuuugaauaaauugugauacaaaag

SEQ ID NO: 357 - RNA, 6570 nt, Homo Sapiens
cuugccaucgugagagauugguacaugauguguaaauucaguucagcauauguuucuucauuaugaaaccacuagcaaucccagcuaaccauggaguuaugggccagcaggagaaacacucacuuccugcagauuucacaaaacugcaucuuacugacagucuccacccacaggugacccacguuucuucuagccauucaggauguaguaucacuagugauucugggagcagcagucuuucugauaucuaccaggccacagaaagcgaggcuggugauauggaccugaguggguugccagaaacagcaguggauuccgaagacgacgacgaugaagaagacauugagagagcaucagauccucugaugagcagggacauugugagagacugccuagagaaggacccaauugaccggacagaugaugacauugaacaacucuuggaauuuaugcaccaguugccugcuuuugccaauaugacaaugucagugaggcgagaacucugugcugugaugguguucgcagugguggaaagagcagggaccauaguguuaaaugauggugaagagcuggacuccuggucagugauucucaauggaucuguggaagugacuuauccagauggaaaagcagaaauacugugcaugggaaauaguuuuggugucucuccuaccauggacaaagaauacaugaaaggagugaugagaacaaagguggaugacugccaguuugucugcauagcccagcaagauuacugccguauucucaaucaaguagaaaagaacaugcaaaaaguugaagaggaaggagagauuguuauggugaaagaacaccgagaacuugaucgaacuggaacaagaaagggacacauugucaucaaggguaccucagaaagguuaacaaugcauuugguggaagagcauucaguaguagauccaacauucauagaagacuuucuguugaccuauaggacuuuucuuucuagcccaauggaagugggcaaaaaguuauuggagugguuuaaugacccgagccucagggauaagguuacacggguaguauuauuguggguaaauaaucacuucaaugacuuugaaggagauccugcaaugacucgauuuuuagaagaauuugaaaacaaucuggaaagagagaaaauggguggacaccuaaggcuguugaauaucgcgugugcugcuaaagcaaaaagaagauugaugacguuaacaaaaccaucccgagaagcuccuuugccuuuuaucuuacuuggaggcucugagaagggauuuggaaucuuuguugacaguguagauucagguagcaaagcaacugaagcaggcuugaaacggggggaucagauauuagaaguaaauggccaaaacuuugaaaacauucagcugucaaaagcuauggaaauucuuagaaauaacacacauuuaucuaucacugugaaaaccaauuuauuuguauuuaaagaacuucuaacaagauugucagaagagaaaagaaauggugccccccaccuuccuaaaauuggugacauuaaaaaggccagucgcuacuccauuccagaucuugcuguagauguagaacaggugauaggacuugaaaaagugaacaaaaaaaguaaagccaacacugugggaggaaggaacaagcugaaaaagauacucgacaagacucggaucaguaucuugccacagaaaccauacaaugauauugggauuggucagucucaagaugacagcauaguaggauuaaggcagacaaagcacaucccaacugcauugccugucaguggaaccuuaucauccaguaauccugauuuauugcagucacaucaucgcauuuuagacuucagugcuacuccugacuugccagaucaagugcuaaggguuuuuaaggcugaucagcaaagccgcuacaucaugaucaguaaggacacuacagcaaaggaaguggucauucaggcuaucagggaguuugcuguuacugccaccccggaucaauauucacuaugugaggucucugucacaccugagggaguaaucaaacaaagaagacuuccagaucagcuuuccaaacuugcagacagaauacaacugaguggaagguauuaucugaaaaacaacauggaaacagaaacucuuuguucagaugaagaugcucaggaguuguugagagagagucaaauuucccuccuucagcucagcacuguggaaguugcaacacagcucucuaugcgaaauuuugaacucuuucgcaacauugaaccuacugaauauauagaugauuuauuuaaacucagaucaaaaaccagcugugccaaccugaagagauuugaagaagucauuaaccaggaaacauuuuggguagcaucugaaauucucagagaaacaaaccagcugaagaggaugaagaucauuaagcauuucaucaagauagcacugcacuguagggaaugcaagaauuuuaacucaauguuugcaaucaucaguggccuaaaccuggcaccaguggcaagacugcgaacgaccugggagaaacuucccaauaaauacgaaaaacuauuucaagaucuccaagaccuguuugauccuuccagaaacauggcaaaauaucguaauguucucaauagucaaaaucuacaaccucccauaaucccucuauucccaguuaucaaaaaggaucucaccuuccuucacgaaggaaaugacucaaaaguagacgggcuggucaauuuugagaagcuaaggaugauugcaaaagaaauucgucacguuggccgaauggcuucagugaacauggacccugcccucauguucaggacucggaagaagaaauggcggaguuuggggucucucagccaggguaguacaaaugcaacagugcuagauguugcucagacagguggucauaaaaagcggguacgucguaguuccuuucucaaugccaaaaagcuuuaugaagaugcccaaauggcucgaaaagugaagcaguaccuuuccaauuuggagcuagaaauggacgaggagagucuucagacauuaucucugcagugugagccagcaaccaacacauugccuaagaauccuggugacaaaaagccugucaaauccgagaccucuccaguagcuccaagggcagggucacaacagaaagcucagucccugccacagccccagcagcagccaccaccagcacauaaaaucaaccagggacuacagguucccgccgugucccuuuauccuucacggaagaaagugcccguaaaggaucucccaccuuuuggcauaaacucuccacaagcuuuaaaaaaaauucuuucuuugucugaagaaggaaguuuggaacgucacaagaaacaggcugaagauacaauaucaaaugcaucuucgcagcuuucuucuccuccuacuucuccacagaguucuccaaggaaaggcuauacuuuggcucccagugguacuguggauaauuuuucagauucuggucacagugaaauuucuucacgauccaguauuguuagcaauucgucuuuugacucagugccagucucacugcacgaugagaggcgccagaggcauucugucagcaucguggaaacaaaccuagggaugggcaggauggagaggcggaccaugauugaaccugaucaguauagcuugggguccuaugcaccaauguccgagggccgaggcuuauaugcuacagcuacaguaauuucuucuccaagcacagaggaacuuucccaggaucagggggaucgcgcgucacuugaugcugcugacaguggccgugggagcuggacgucaugcucaaguggcucccaugauaauauacagacgauccagcaccagagaagcugggagacucuuccauucgggcauacucacuuugauuauucaggggauccugcagguuuaugggcaucaagcagccauauggaccaaauuauguuuucugaucauagcacaaaguauaacaggcaaaaucaaaguagagagagccuugaacaagcccagucccgagcaagcugggcgucuuccacagguuacuggggagaagacucagaaggugacacaggcacaauaaagcggagggguggaaaggauguuuccauugaagccgaaagcaguagccuaacgucugugacuacggaagaaaccaagccuguccccaugccugcccacauagcuguggcaucaaguacuacaaaggggcucauugcacgaaaggagggcagguaucgagagcccccgcccaccccucccggcuacauuggaauucccauuacugacuuuccagaagggcacucccauccagccaggaaaccgccggacuacaacguggcccuucagagaucgcggauggucgcacgauccuccgacacagcugggccuucauccguacagcagccacaugggcaucccaccagcagcaggccugugaacaaaccucaguggcauaaaccgaacgagucugacccgcgccucgcccccuaucagucccaaggguuuuccaccgaggaggaugaagaugaacaaguuucugcuguuugaggcacagacuuuucuggaagcagagcgagccaccugaaaggagagcacaagaagacguccugagcauuggagccuuggaacucacauucugaggacgguggaccaguuugccuccuucccugccuuaaaagcagcauggggcuucuucuccccuucuuccuuuccccuuugcaugugaaauacugugaagaaauugcccuggcacuuuucagacuuuguugcuugaaaugcacagugcagcaaucuucgagcucccacuguugcugccugccacaucacacaguaucauuccaaauuccaagaucaucacaacaagaugauucacucuggcugcacuucucaaugccuggaaggauuuuuuuuaaucuuccuuuuagauuucaauccaguccuagcacuugaucucauugggauaaugagaaaagcuagccauugaacuacuuggggccuuuaacccaccaaggaagacaaagaaaaacaaugaaauccuuugaguacagugcuuguccacuuguuuacaauguccuccuuuuaaaaaaaaaaaaugaguuuaaagauuuuguucagagaguaaauauauauccauuuaaugauuacaguauuauuuuaaaccuuaaguaggguugccagccugguuucugaaaaaccaaauaugccggacaggguguggccacaccaagaagacgggaagaccuggcuugugacccuggcuucccauguccuucuggucucacccgcgaagugcccuauccuggaaguaugaaauguuagccaauuaauaccaagacaccucaucugcuccuuccccaguggaugggguucuucuguaaaacuguuugcacauggccaggggagggaacuaggacccuuguguccugucugagccuuauggaggcaggacggugucauuggcggauguguccugcuccauugagauggauggcaaaccccauuuuuaaguuauauuucuuugauuuuuguuaauuuagagguguagguuuuguuuuuuguuuuuuuguuuuuuuuuaagagaaacauuuauaacuggauagcauugcagugaaagcagcuugggauguuggagcuaaugccagcuguuuauacugcucuuucaagacagccucccuuuauugaauuggcauuagggaauaaacaagccuuuaaacgugauaaaagaucaaaaaccugguuagacaugccagccuuugcaaggcagguuagucaccaaagacuaaccuccaaguggcuuuauggacgcugcauauagagaaggccuaaguguagcaaccaucugcucacagcugcuauuaacccuauaaugacugaaaugaccccuccacucuauuuuuguguuguuuugcacagacuccggaaaagugaaggcugccaaucugaguaguacucaaaugugaggaacugcuggucuuggauuuuuuuuccauuaaauucagcugaucauauugaucaguagauaaacguaaauagcuucaaauuuuaaaaguggaauugcaguguuuuuucacuguaucaaacaaugucagugcuuuauuuaauaauucucuucuguaucauggcauuugucuacuugcuuauuacauugucaauuaugcauuuguaauuuuacauguaauaugcauuauuugccaguuuuauuauauaggcuauggaccucaugugcauauagaaagacagaaaucuagcucuaccacaaguugcacaaauguuaucuaagcauuaaguaauuguagaacauaggacugcuaaucucaguucgcucugugaugucaagugcagaauguacaauuaacuggugauuuccucauacuuuugauacuacuuguaccuguaugucuuuuagaaagacauugguggagucuguaucccuuuuguauuuuuaauacaauaauuguacauauugguuauauuuuuguugaagaugguagaaauguacuauguuuaugcuucuacauccaguuuguacaagcuggaaaauaaauaaauauaacau

SEQ ID NO: 358 - RNA, 131 nt, Homo Sapiens
ggcuugcuggugcuuaccacaggcugaauucuuacacugacuauauagaaaaggagguagaguaaaccuacccaauauaccccucagcccaggcucugugccugaucuauauugugaaugugggaacauag

SEQ ID NO: 359 - RNA, 3475 nt, Homo Sapiens
gcgggcgcaugcgcaagggggcgcgccgccucugccccgcggcgagggugucuauggagaggcggcggccgcggcugcugaggcggaggcugaggcaguggcgauggcgcccuuuccugaagaaguggacgucuucaccgccccacacuggcggaugaagcagcugguggggcucuacugcgacaagcuuucuaaaaccaauuuuuccaacaacaacgauuuccgugcucuucugcagucuuuguaugcuacuuucaaggaguucaaaaugcaugagcagauugaaaaugaauacauuauugguuugcuucaacaacgcagccagaccauuuauaauguacauucugacaauaaacucuccgagaugcuuagccucuuugaaaagggacugaagaauguuaagccuacuacuguugacuggaagccuuaccaauaacauaaaacaaucgaauaacaauuauuucauguauuauauguaaaauauauauacuggauucuuacaguaagaaugaauaugaacaguuaaauuaugcaaaacaacugaaagagagauuggaggcuuuuacaagagauuuucuuccucacaugaaagaggaagaggagguuuuucagcccauguuaauggaauauuuuaccuaugaagagcuuaaggauauuaaaaagaaagugauugcacaacacugcucucagaaggauacugcagaacuccuuagaggucuuagccuauggaaucaugcugaagagcgacagaaguuuuuuaaauauuccguggaugaaaagucagauaaagaagcagaagugucagaacacuccacagguauaacccaucuuccuccugagguaaugcugucaauuuucagcuaucuuaauccucaagaguuaugucgaugcagucaaguaagcaugaaauggucucagcugacaaaaacgggaucgcuuuggaaacaucuuuacccuguucauugggccagaggugacugguauaguggucccgcaacugaacuugauacugaaccugaugaugaaugggugaaaaauaggaaagaugaaagucgugcuuuucaugagugggaugaagaugcugacauugaugaaucugaagagucugcggaggaaucaauugcuaucagcauugcacaaauggaaaaacguuuacuccauggcuuaauucauaacguucuaccauauguugguacuucuguaaaaaccuuaguauuagcauacagcucugcaguuuccagcaaaaugguuaggcagauuuuagagcuuuguccuaaccuggagcaucuggaucuuacccagacugacauuucagauucugcauuugacaguuggucuuggcuugguugcugccagagucuucggcaucuugaucugucugguugugagaaaaucacagauguggcccuagagaagauuuccagagcucuuggaauucugacaucucaucaaaguggcuuuuugaaaacaucuacaagcaaaauuacuucaacugcguggaaaaauaaagacauuaccaugcaguccaccaagcaguaugccuguuugcacgauuuaacuaacaagggcauuggagaagaaauagauaaugaacaccccuggacuaagccuguuucuucugagaauuucacuucuccuuauguguggauguuagaugcugaagauuuggcugauauugaagauacuguggaauggagacauagaaauguugaaagucuuuguguaauggaaacagcauccaacuuuaguuguuccaccucugguuguuuuaguaaggacauuguuggacuaaggacuagugucuguuggcagcagcauugugcuucuccagccuuugcguauuguggucacucauuuuguuguacaggaacagcuuuaagaacuaugucaucacucccagaaucuucugcaauguguagaaaagcagcaaggacuagauugccuaggggaaaagacuuaauuuacuuugggagugaaaaaucugaucaagagacuggacguguacuucuguuucucaguuuaucuggauguuaucagaucacagaccauggucucaggguuuugacucugggaggagggcugccuuauuuggagcaccuuaaucucucugguugucuuacuauaacuggugcaggccugcaggauuugguuucagcauguccuucucugaaugaugaauacuuuuacuacugugacaacauuaacgguccucaugcugauaccgccaguggaugccagaauuugcagugugguuuucgagccugcugccgcucuggcgaaugacccuugacuucugaucuuugucuacuucauuuagcugagcaggcuuucuuucaugcacuuuacucauagcacauuucuuguguuaaccaucccuuuuugagcgugacuuguuuuggccccauuucuuacaacuucagaaaucuuaauuuaccagugaauuguaauguuguuucucuugcaaauuauacuuuugguuuagaaagggauuaggucuuuucaaaagggugagaacagucuuacauuuuucuuuuaaaugaaaugcuuuaaagaauguugguaaugccaugucauuuaaaguauuucauagauaauuuugaguuuuaaaguccauggaggugauugguucucuuuacacauuaacacuguaccaagcuuugcagaucuuuuccgacacacaugucugaagacuuauuuucaaagacagcacauuuuuggaaacuaaucucuuuuccguaauauuuccuuuauuucaaugauucucagaaggccaauucaaacaaacccacauuuaagguucuuuaggauuauagaauaaauuggcuucugaguguuagcucagugagcuaggaaagcaccaaucgauauuuguuuccuuuagggauacuuuguucucaccacugucccuaugucaucaaauuugggagagauuuuuuaaaauaccacaaucauuugaagaaauguauaaauaaaaucuacuuugaggacuuuaccaaguaauacuguuguguugugauuuuuauuauaaaucucaauccagguuuacuuuaguauagaauaggacuacauacuuugucuuuggaccucccaugaacuuauuacccugacaaauaguuuuagacagauacugaauuuuauugagcugaauuuucuuuuugaaaugaguuauucaguagucaaaauuugaauccguaaguauaucuacuuugcuuuguuaaaacaucaugagaguggaggccugccacccagaaaggcacauacuagugccuuuuaguacaauuuuaugucauguagaagaaaauggcaauguuccuccuauugauacagauacaggcauaugucaucuuauugcguuuugcuuuauugcacuuugcaaauaaugcauuuuuuacaaauggaagguuuauggcaacucugcguugagccagucuauuggugccauguuuccaauaaaacuucuccuuucaugucucgu

SEQ ID NO: 360 - RNA, 2852 nt, Homo Sapiens
acagacugccaaauggaacagacaagcagguugucuuguguuaaagaaaaugagauauaagucaguuacucccggaggcaaugcugcuguucagcucuucuguuuuuguggccagggucuucaugaacacuaauagggguaccaggcccucuuccucguuagaagaaaucaggauaacaaaggcauauugggcaccccuacaaaagggaaucuguaucuguaucaagaugaucugaagaacagcuucuaccuuuaggaaugucuaguguuccaaaaugacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaaaucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcagcuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauagauuacacaucaagugaaaaauauuccuccuguugauauugcugcuuuuggaaguuccaacaaugacuuuauuuugcaucagcauagauguaaacacaauugugaguguaugauguagguaaaaauauauaccuucgggucgcaguucaccauuuauaugugguauuaaaaauuaaugaaaugauauaacuuugauuuaaacaguucugacacauaa

SEQ ID NO: 361 - RNA, 1309 nt, Homo Sapiens
ggaacuugccucauguguguguaugugugugugugugauuguggguguggguaguuuaaccuuuuuauaucuuagcugccuguaaacucagugauugcuacguucagaucaaaccuugaacuuuuuuuuuucuggugccaggagccuuccugugcuccccauugccugccagaaccaccaccguuucccaugguuacucuacagcagcuucacugccugaaaaugaaaacugaacaaagggauuaaauugugagaacaacugucaaucuauuauauauuuguacaaucugguauuaaaaugcuuuccccaaaagauauucugcgaaaagaucugaaguugguccaugguuaucccaugaccugugcuuuugcaagcaacugggaaaaaauugaacaguuccauagcagaccagaugacauugugauagccacuuauccuaaaucagguacuacuuggguuagugaaauuauagacaugauucuaaaugauggagauauugaaaaauguaagcgagguuuuauuacugaaaaaguuccaauguuggaaaugacucucccuggauuaagaacaucagguauagaacaauuggagaagaauccaucaccccggauugugaaaacacaucuaccgacugaucuucuuccuaaaucuuucugggaaaacaauugcaagaugauuuaucuggcucguaaugccaaggauguuucagucucauauuaccauuuugacuuaaugaauaauuuacagccuuuuccugguaccugggaagaauaucuggagaaauucuuaacuggaaaaguggccuaugguuccugguuuacucauguuaaaaacugguggaagaaaaaggaagaacacccaauacuuuuuuuguacuaugaagauaugaaagagaauccaaaggaggaaaucaagaagaucauuagauuucuagagaagaaccugaaugaugagaucuuggauaggaucauccaucacaccucauuugaagugaugaaggacaauccuuugguaaauuauacacaucuaccaacuacagugauggaucauagcaaauccccuuuuaugcguaaagggacggcuggugacuggaagaauuacuucaccguggcccaaaaugagaaauuugaugcuauuuaugagacagaaauguccaaaacugcacuucaauuccgcacagagauuuaaagugucuaaaucacacaucugaagaaauaagagauugucuguaguugauugaaacgagggcaguuaugaauugauuugggcaaucaaaugaauuuauaaaggagaauaauaugcuuuuaa

SEQ ID NO: 362 - RNA, 5326 nt, Homo Sapiens
cugccccgggucacgugcuuaggagccauauugucgcuaguggccgcuggggcugggaggggugugcuagagaggcgcagcuucucugggcgugguuuuuauccugggggaaggaucgguggaaugugaggggagguggaggagauggcggcgacggcccgggaagauggcgccagcggucaagagcgaggucagcggggcugcgagcacuaugacagaggaugucuccuaaaggcaccuugcugugacaagcuuuauacuugccgcuugugucaugauaacaaugaagaucaucaacuagaucgcuuuaaagugaaggaagugcagugcauaaacugugaaaaaauucaacaugcccaacagacuugugaagaauguagcacauuguuuggagaauauuauugcgauauaugccauuuguuugacaaagauaagaagcaguaucacugugaaaacuguggaauuuguaggauugguccaaaggaagauuuuuuccauuguuugaaauguaacuuaugccuagcuaugaaucuucaaggaagacacaaguguauugaaaaugugucccgacagaauuguccaauauguuuggaggacauucacacaucccguguuguugcucaugucuugccauguggacaucuuuuacauagguaaaguaacaucuuuuucucaaugauguuugaaaauaguggagacaguuuuuguuuuacuaaaauaaucuuauauuuucuuucagaacguguuaugaagaaauguugaaagagugaguguuugggauuuuaaaaauaauuguaagauguuugacuuuuuugugugugugguguggggagguggacaaacauuguuacuuauacuauauugggcauggcaauauuuauauugaaauggguaggguagaugaauauuguuaaaacaggacaaagugucuuggauauagaacuacacuuuugccauauguuucucuuaaaucuugucuccucccacaauuugagguaguuaccucuuuuuuuucuggccauauauaccaggaagugcaguuuuugccagaugcaguuauaguguuguaaaaaugcugaaaaauauugccaaaaauuuguuagguuguuauauuggccaaguauaguaaacuaaaagaaaguaggugaagugaucauuaaagcuaagacuuuauuaauggaaaagauauuaaaauuagaugaaaauaauugaaaagagaagacuguauuuugguccuacauauugaugagcaaaaaugugaagagcuagagagagcauucuuuuuuucaaauuuuuagaaaggaaauaauaucugaauaauuuuaaacaaauacagucucuuuacaugaguguauuaagaaauuaagguuguuuagauaaggaguagcuuaauuaguuuauaaaaauauaugaaguguauucuacaaagaauauggacuaauuccucuccauuuuagaguacugaggaaaaagacuuaguuuuaaauaaguauacaggaauuaauuuaaaaguuuuauagugugaaaguucccagguuccuaagagauuaucuugaaauggaggaaaaugccuguuuugaaugguucauguggcaguuagccugcaucuucuuguauaccugaauuaauauauucuuguuuaauauuuggaaaauaaccuuucuaucucuuucagaggcuacagauguccauuauguaugcacucugcuuuagauaugaccagguauuggagacagcuggaugaugaaguagcacagacuccuaugccaucagaauaucagaacaugacuguggauauucucugcaaugacuguaauggacgauccacuguucaguuucauauauuaggcaugaaauguaagauuugugaauccuauaauacugcucaagcuggaggacguagaauuucacuggaucagcaaugacgagccuacacaguacuggagaacuuggcauuuucugauauagaaaaaggcuuuccuugguaucguguuaucaugugucgucaucuaugcauuagaguugauguguuuuguacuagugucacagcauaaaaucauauuacaaguacguaaggauucagggucucuugauagacuuaucauagcucuauauugaaugaaagccacugugcuuguguuuugauuggaaauuccuuuagugucaguuuuuuggaagccaaugauguuugccacugauacauucauagaaguguauuauauuuucaugaagcuuugcuuuaagugacacuacgcgugcaguucauuucuaguucuugauagaacugcacuuaauuuucaguaguagucuugacuuuuuaagggcuguguuauauuaaguucucccuuacuguuaaaaccuaauuaaauaugcuuuagaauuuucuaagacaguccucuggauccucuaaaugugaauuuugauguaauaacugcuaauaaaauuauauugaaacuguuuuauagaaaguuuuuuccaaaguuuucuauguuuggcucaauuagggcaguaucaucaguucuauaauguaaaagaaauuuucuuucuuuugagguauuccauaaaaguaguugggaaaauuauuauguaaaauaauaagacucuuccaaagccuuaauaaaaacaucaacauugaaaacaguuuuuuuuagguugcccaaaauuauuucuucaaagagucauucauuccuucauuuagcaaguauuuauugagcaacugcuauguggcagauauguuucuagaugcuguagagacaacagugaacaauaaagauaaaaguccuuguccucacagcaguacauucuauuguucaucauauuugaucaauguacucauuuuucuuuaugcaaggaguggaugucuuauuguaaaugaauagaauauuucuucccuaagcgugugaaaauaggggauggaugagugggaagggcaugggauauuccuggcaagaucucugauuucauaauacuuuuuugggcucauguaguggaauuaaauauaccucuuacuucaggaacaaaguuaacaaauauguuugaugauccagccgacuuugacacuguuaucuccguaauagcuuuaccauuaggcuaggauguaaaauguacauuuaucaguugauaaguaccuauugagcaccaguuguauuuccaacuuugagcuauuugaaucuucuuugaauaaggaaguuagccuuuuaacuagaaagccuaagaguucuggcacauuuauuucuucuuuuguugaaauuuauucaccuagauaaaggcagcaguuugggacucagaucuuuauuuuaucccaccuucuugucuucuguauuccacucuucuuauguucuuucccuucaucuguuuccuuggccuggccagagcagcagugcugaucuucauuugggaaaggauguuccuggguauuaccaauuaguauacagauaaguaaagacuaguuuuccagaucuaauacuuuuuuuugaagugguuuugcucugucauuuaggcuagaguguagugaagugaucguagcucacugcagccuugacuuccugggcugaacugauccuuccaccucagccuccugaguagcugggacuacaggugugugccaccaugcccagcuaauuuuuaauuguuuuguagaaacaaaguccaggcuggucuugaacuccugggcucaagcauuucuccuaccucggccuuccaagggcuaggauuacaggcaugagccacugugcuugguccagauguauuacuuuuuauguuugguauuauucugccaaaccaaucauguuauuguuuuuaaucauugaaucauuggaucuuuaaauaggagugaguauauaauaauaaggcucuucuguuuucaacaucugugcugggucaugcauuagcauuaauuacuacaaugauucugugggguaaguguuguccucauagacaagaaagcugagguuuagagguuaaaaugacacauuggggguaaauaacagacacuauauguuggaguugggaaucagauccaaguuugacuccaaacccacuuuuaccacauugcuuuugaucuaaacuucuauuuugcuaaaauaccccucacagcuagucauccauaucauugaagcgcucaugauuugauagauuaaccuuucauuuuuuuaggugacucuaguuagaaagucuuauuucacaaucugauuguuucuuuaacuuaggauccaaacauguccaaaauaaugcagaguacauaugcaaucacucguuuaugcugucuagucaugcacuuaaagcaauuuucaaauguacucaaagucucuaggcuucgguacccaggguugcuucaaguauuuguucaugacacgucaacucgaugauuaaaauccuucaacacuucucauucacaauaagaauaaaaucuacaucccuuaccauucaguaugcaaaacuuaaaauacauaacuuuacccuuaaauauuuuuucuuucucugacuucauaaguauagguuauaccucuauaagaaagaagguaaaaaacucucaacaaucccuucuuucagagagaacuacuguuaacauuuuaacagacaacuucauucuuuuccuauucuuuuuuauaaugcuuacaggaauguuaaauacuuagacagaucuuaaguacacuagaauuaucugucccugaaauaaguuagguugcccugccgcagaauuuguaucuauaguuuauuuggauuauuuuugaaaaaaguaaaauaacaauacccuuacgaauuuuuuggugcauagcaucucagcuucuuuuaucauuaaagauguauguauaaaaaaaaaaugaguguauaucaaguuguucauuucuuaguuucuggggucuucuuaaccaguacauagaacucuuuaugaauuaacuuuagcuuauguuggaaguaguaguuuguuuauagugucauggauuuuaaaaucaaacucaguuuuuauuucuucacuaaaaccuauuuucauaugauauacauguuaaauuucccuuuuauuuuggucaugcaucaaaauaaauuuacuaaguacuaaagagccaacauuauuuuauaagugccuggcaauagguauucacuaguugaauaguuuaauuugaaaugaauuaauuuuaaaugggaguuguucaaaacuaugccacuuuuucuuuuguccuuuguguuauuaaaauuuaauugauaauuguguauauuauauauauggaguacaaugugauguuuugauauauguuuacaguguagaaugauuaaaucaauguaauaaauuuauugccucauaccauuuuuugugguaaaaaaacca

SEQ ID NO: 363 - RNA, 15818 nt, Homo Sapiens
gcggccgcagaaucgagcucgggccccggcccccggcccgcggcgcggggcucccgggccccgccgcggacgucgcgccggucgccccuuccccguagcccgugcgcccucggcgcggagccccggcccgccgcggucccgucuccugggccugucccgcccgcgcccuccgccggcccucagucagguauaauacuucuccacgucugcuucaggaagaaagugccugccauucuuaucauuucuaagcagguucaugccagcccagaacagagaaucagcuggagcccagauuucaaguuuugaguaaaauaccuucaagcgaaugggcccuauugugcucacacauucagaaccuguuacccaaggaauucccuaaagaauuagaagugcgucucaccaaccagccaagaugaacauggugaagaggaucauggggcggccgaggcaggaggagugcagcccacaagacaacgccuuaggacugaugcaccuccgccggcucuucacggaguugugccauccuccccggcacaugacucagaaggaacaagaagagaaacuguauaugaugcugccaguguuuaacaggguuuuuggaaaugcuccgccgaauacaaugacagaaaaauuuucugaucuucugcaguucacaacacaagucucacgacuaauggugacagaaauucgaaggagagcaucaaacaaauccacagaggcugcaagucgggccauaguucaguuccuagagauuaaucagagugaagaagccaguagaggcuggaugcuucuaacgacaauuaauuuguuagcuuccucuggucagaaaaccguggacugcaugacaacaaugucagugccuuccacccugguuaaauguuuauaucuguuuuuugaccuuccacaugugccugaggcaguuggaggugcacagaaugagcuaccucuagcagaacgucgaggacuacuccagaaaguuuuuguacagaucuuagugaaacugugcaguuuuguuuccccugcggaggagcuggcucagaaagaugaucuccagcuucuauucagugcaauaaccucuuggugcccucccuauaaccugccuuggagaaagagugcuggagaaguccucaugaccauaucucgucauggucuuagugucaauguagugaaguauauucaugagaaagaguguuuaucuacauguguucagaauaugcagcaaucagaugaccugucuccccuagaaauugucgaaauguuugcugggcuuucuuguuuccucaaagauuccagcgauguuucccaaacacuucuggaugauuuucggauauggcaaggauauaauuuucuuugugaucucuugcuuagauuggaacaagcaaaagaggcagaauccaaagaugccuugaaagaucugguuaaucugauaacuucccuaacaacauauggugucagugaacuaaaaccagcugguauuaccacaggggcacccuuuuuauugccuggauuugcaguaccucagccugcaggcaaaggucacagugugagaaacguccaggccuuugcaguucuucagaaugcauuuuuaaaagcaaaaaccagcuuccuugcccaaaucauccuugaugcuaucacaaauauuuacauggcugacaaugccaauuacuucauccuagagucacagcacacauugucacaguuugcagagaagauuucuaaacucccagaaguacaaaacaaauacuuugagaugcuggaguuuguuguuuuuagcuuaaauuauauaccuuguaaagaacuuauuagugucaguauccucuuaaaaucuagcucuucuuaucacuguagcauuauugcaaugaaaacacuucuuaaguuuacaagacaugacuacauauuuaaagacguguucagggagguuggccuuuuggaggucaugguaaaccuuuugcauaaauaugcugcccuguugaaggauccaacucaggcacuaaaugaacaaggggacucaagaaauaauaguucaguugaagaccaaaaacaccuggcuuuauugguuauggagaccuugacagugcuucuucaaggaucaaacacaaaugcaggaauuuuucgagaauuuggaggugcaagaugugcacauaauauaguaaaguacccucaaugccggcagcaugccuugaugacuauccaacagcuggugcucuccccaaauggggacgaugacaugggcacucuccuggggcuaaugcauucagccccaccgacggaauugcaguugaagacugauauuuuaagggcccuccugucgguccuucgagaaagccaucguucaagaacaguuuuuaggaaaguuggaggauuuguguacauuacauccuugcucguugcuauggaaagaucuuugagcuguccacccaagaauggcugggagaaagugaaccagaaucaaguguuugaacuucuucacacuguguucugcacguugacugcagcaaugcgcuaugagccagccaacucucauuucuucaaaacagagauucaguaugagaaguuggcagaugcuguucgauuucuuggcugcuucucagaccuaagaaaaauaagcgccaugaaugucuuccccucaaauacacagccauuucaaagacuuuuagaggaagauguaaucucaauagaaucagugucacccacguuacggcacugcaguaaacuuuuuauuuaucuuuacaaaguagccacagauucuuuugacagguauggcucugcucuguccucugaauuaaaggguguauacuaagcaugacuucaacauuaagacuugaauuaugaguuaauccaaaagaauaugaaaacagaugacucuucuccuauuuguuugaaguguaucacuuuauuuuugaauauuacucuugcucugguauuguuuuuuuuuuuuuuuagcauggaagccuguguacuauuuguaaauucagguucaauuaguucucauugcaguuauuggaacaguuucuaugaaguuuccuuuaaugauaguguuuacuguuguuuuuuuucuuuuuagccucaaaaggugcaucuggacuuauugauauguguuaucaauagaacaucauuaugauuauucuuauuuccagacacguacuccaucauucuccacauaucauacuccucaaaaaaugauauaguucccaaagagaggugucagugucuugaaccgucaaguucaagaggccaucagacucaauauuuacucauuccuucaugaaauaaguacuuaacaaaaagcugcugcaugccaagucacugugcuaggcauugaggauucagcucuacacagggcugucuugguccuugcuaucuuuuagcuaaaauguagacacauaaauaaacaauuacauauagugugacacauucuacagugggggaauccaggguucucaggcagauuguaggagagccacuucaucuagaucacuuauuuucagugcuucaacuguguuuucaaugaagaugucacuuugaaaauaauacuucuaauuuaugccccaaguguuauugcuuuuaacuuaccauaguuuuacuacauaaaauaaaugaacugcccucaucaauagaccauguaacuacauuggauagagcuuguaauagguuuuguguccuuuucuguggaauaucugcuuugaaguaucaacugagauauuuccugcuucuuaacaagauuucuuaguccucaguauuuacauuuaaaaauccaaacagcuuugacaacaauuguucgugcagaacagaucccuccuugccugacaagugagucuucucuccccucuccuugggguacaccagcuuuguccaggaaaaggcaugcauaucauucuguuucaacucccccuguuuacccuccuaaaaauguugccgaccugaaacuacaugugacaacuucaucucugcagaguucugaugcagucaucauucauccuggagccaugcuugccaugcuggaccuacuggccucuguugggucagugacacagccagaacaugcuuuggaucuucaacuugccguggcaaauauuuuacaaucccuggugcacacagaaaggaaccagcaagucaugugugaagcuggucuucaugcacgacugcugcagaggugcagugcugcauuggcugaugaggaccacucacugcacccgccccugcagcggauguuugaacgauuagccucucaggcucuggaacccaugguguugagggaguuuuuacguuuggcaaguccuuuaaauuguggugccugggacaaaaaacugcuaaaacaauauaggguccacaaaccaaguucacugaguuaugaaccagaaaugagaaguaguaugaucacaucucuggaaggucuggguacugauaauguuuuuagcuuacaugaagauaaccauuaccggauaagcaagagccugguaaaaucugcggaaggaaguacuguaccccugaccagggugaagugucuggucuccaugacaaccccacaugacaucagacuucaugggucaucaguuacuccagcuuuuguugaauuugacacaucacuugaaggguuuggaugucuuuuuuugcccaguuuggccccucauaaugcuccuacaaauaauaccgucacaacaggucuuauugauggggcuguggucaguggcauugguucuggugaaagauucuucccuccucccuccggcuuaaguuacucuagcugguuuuguauugaacauuuuaguucuccuccaaauaaccacccugucagacuucuuacuguugugcgccgagcaaauucuucugagcaacauuacgugugccuugcaauaguucuaucagcaaaagaccgaucucugauuguuuccaccaaagaggaacuccuccaaaauuauguugaugauuuuagugaagaguccucauuuuaugaaauucucccaugcugugcucgcuuucgauguggagagcuuaucauugagggacaguggcaucauuugguccugguaaugagcaaaggcauguugaaaaacaguacugcagcccuuuauauugauggacagcuuguuaacacuguaaagcuucauuauguccacaguacuccaggggguucagguucggcaaauccaccaguggugagcacggucuaugccuacauugguacuccaccugcccaacgccaaauugccucauugguuuggcgccugggacccacacauuuucuagaagaaguuuuaccuucuucaaauguuacuaccauuuaugaacuuggaccaaauuauguuggaagcuuucaggcuguauguaugccauguaaagaugcaaaauccgaagggguggugccauccccugugucauuaguaccagaggagaaagugucauuuggccucuaugcacucucugugucgucucuaacaguggcaagaauccggaaaguguauaacaaauuggauagcaaagccauugcuaagcaguuaggcauuuccucacaugagaaugccacuccugugaaguugauacacaauucagcaggacaucuuaauggaucugcacggacaauuggggccgcucugauuggauacuugggaguaagaacauuugucccuaagccuguugccacuacuuugcaguacguugguggagcugcagccauccugggccugguggccauggccucugauguggaaggguuauaugcagcagucaaggcccugguuuguguggucaagaguaacccacuagccagcaaagaaauggaaagaaucaagggcuaccaguugcuggcaauguugcuuaagaagaaacguucccuucuuaacagccacauccuccaucuaacuuuuucuuuggugggaacuguugauaguggacaugagaccuccauuauuccaaauucaacugcuuuccaggaccuccucugugauuuugaagucuggcuccaugcaccauaugaacuucaucuuuccuuauuugaacacuuuauugaacugcucacagaguccagugaagccucaaagaaugccaaauuaaugagagaauuccaguuaaucccaaagcugcuccugacucuucgagauaugucuuuaucccagccuacuauugcugcuauuaguaauguccugagcuucuuacugcaagguuuuccuagcagcaaugaucugcucagauuugggcaguuuauuucuucuacuuugccaaccuuugcgguuugugagaaauuuguaguaauggaaauaaauaaugaagagaagcuugacacuggaacugaagaggaguuuggaggucuuguaucagcuaaucuuauacuuuugaggaacagacuucuggauaucuugcuaaaacuaauuuauacaucuaaagaaaagacaagcauuaauuugcaagcuugugaagaacuggugaagacacuggguuuugacuggaucaugauguuuauggaggaacacuuacauuccaccacaguuacagcagccaugaggauucuuguuguccuacuaaguaaucagucuauucucaucaaguuuaaagaaggacucagugguggaggauggcuugaacagacagauucugucuuaacuaauaagauuggaacuguauuaggauucaacgugggcagaagugcuggugggagaucgacggucagggagauuaaccgagaugcuugucauuuuccugguuuuccaguccuucagucauuccuuccuaaacacacuaaugucccugcccucuauuuucuccucauggccuuguuucugcagcagccaguuagugagcugccugagaaccugcaggucagugugccugucaucagcugccggaguaagcaggguugccaguuugauuuggauuccauuuggacauucaucuuuggaguuccugccuccagcggaacuguggucucuucuauccauaacguaugcacagaagcuguuuuuuuauuauugggaaugcuccgcagcaugcugacuucaccuuggcaaucagaagaagagggaucuuggcuccgagaauauccugugacccugaugcaguucuucagauauuuguaucacaacgugccagaccuugccuccauguggaugagcccugacuuccugugugcauuagcagccaccgucuuccccuucaauauucgcccuuacucagagauggugacugaccuugaugaugaaguuggaucuccagcagaagaguuuaaagcguuugcagcagacacagggaugaacaggagccaaucagaguacugcaaugugggcaccaagacauaucugaccaaucacccggcuaaaaaguucguuuuugacuucaugcgggucuuaaucauagacaaccucugucucacuccugccagcaagcaaacuccacuaauugaucuuuuguuggaggcuuccccugaaaggucuacaagaacucagcaaaaagaauuucaaacuuacauuuuggauagcgugauggaccauuugcuugcagcugauguguuauuaggggaagaugcaucucugccuauuaccaguggaggaagcuaccagguauuggugaacaauguguuuuauuucacacagcgugugguggacaagcuuuggcaaggcauguucaacaaagaaucuaaacuucuuauagauuuuauaauucaacuaauugcacagucaaagagaagaucacagggauugucacuggaugcaguguaucauugccucaauaggaccaucuuguaccaguucucacgggcacacaaaaccguuccucagcaaguagcucugcuugauucacucaggguccucacuguaaacagaaacuugauccugggaccugggaaccaugaccaagaauucauuagcugucuggcccacugcuugauaaaucuacauguuggaagcaacguggauggauuuggacuggaagcagaagcccgcaugaccacauggcacauuaugauccccucggacauugaaccagaugguaguuacagccaagauauuagugaagggcgucagcuucucauaaaagcugucaacagaguuuggacugaacugauacauaguaagaaacaagucuuagaggaacuuuucaaaguaacucuaccugugaaugaaaggggccacguggacauagcuacagcaaggccacucauugaagaagcugcccugaagugcuggcagaaucauuuggcccaugaaaagaaaugcauaagucgaggagaagcuuuagcgcccaccacacaguccaaauuaucccgugucagcaguggcuuuggucuuuccaaguuaacaggaucaagaaggaaucgaaaagaaaguggucuuaauaaacacagucuuuccacccaggagauuucgcaguggauguuuacucacauugcuguuguucgugacuuaguagauacacaauauaaagaauaucaggagcgucagcagaaugcccugaaguacgugacagaagaguggugucagaucgagugcgagcuguugagggagcgggggcuguggggcccucccaucggcucccaccucgacaaguggaugcuggagaugacagaagggcccugcaggaugaggaaaaagauggugcgaaaugauauguuuuauaaccauuacccuuacgugccagaaacugagcaagagacaaauguggcgucugagaucccaaguaaacagccugagacacccgaugauauuccucaaaagaaaccugcucgauauagaagagccguaaguuaugacaguaaagaguacuacaugcgacuggccucuggcaaucccgccauuguccaagacgccauuguggagaguucagaaggugaagcugcucagcaagaaccagagcauggggaagacacuauugcuaaagucaaagguuuggucaagccuccucuaaaacgcucccgaucugcaccugauggaggagaugaggagaaccaggagcagcuacaagaccagauugcugagggcagcuccauagaagaggaggagaaaacagauaaugcuaccuuacugcgccuguuagaggaaggagaaaagauccaacacauguaccgcugugcucgaguccagggccuagauaccagugaggggcuccuucuuuuugguaaagagcauuuuuaugugauugauggauuuaccaugacagcaaccagggaaauaagagauauugaaaccuuaccuccaaauaugcaugagccuauuauuccuagaggagccaggcaaggcccuagucaacucaagagaacaugcagcauuuuugcauaugaagauaucaaggaaguucauaaaaggagauaucuccugcagccuauugcuguggaaguuuucucuggagauggacggaauuaccuccuugcuuuucagaaaggaaucagaaacaaagucuaucaaagguuuuuggcuguagugccaucucuaacggacaguucagaaucuguaucugggcaacgaccaaacacgaguguggagcagggaucuggguuacuuagcacuuugguuggagagaagucugugacucagagaugggagagaggugaaaucagcaacuuccaauauuugaugcauuugaacacuuuggcuggcagaucauauaaugaucucaugcaguauccugucuuccccuggauccuugcagauuaugacucagaggagguggaucuuacuaaucccaagacguuuagaaaccuggcuaagccaaugggagcacaaacagaugaacgauuagcucaguauaagaagcgguauaaagacugggaggauccuaauggagaaacuccugcauaccacuaugggacccacuauucaucugcaaugauuguggccucauaccuuguaaggauggagccuuucacacagauauucuuaaggcuacaggguggccacuuugaccuggcugaccggauguuucacagugugcgcgaggccugguauucagcgucaaagcacaauauggcagauguaaaagaacuuaucccagaguucuuuuauuuaccagaauuccuguucaauuccaacaacuuugaucuaggcuguaaacaaaauggcaccaagcuuggagauguuauccuuccacccugggcaaaaggggacccacgagaauucaucagaguccaucgugaggcuuuggagugugauuacgugagugcccaucuacaugaguggauugacuuaaucuucgguuauaaacagcaaggcccugcugcaguagaagcuguaaaugucuuccaucaucuuuuuuaugagggucaaguggauaucuacaacaucaaugacccacuaaaggagacagccacaauuggguucauuaauaacuucggucagaucccuaaacaguuauuuaaaaaaccucauccaccaaagcgagugagaagucgacucaauggagacaaugcaggaaucucuguccuaccaggaucuacaagugacaagaucuuuuuucaucaucuagacaacuugaggccuucucuaacaccuguaaaagaacucaaagaaccuguaggacaaaucguauguacagauaaagguauucuugcgguggaacagaauaagguucuuaucccaccaaccuggaauaaaacuuuugcuuggggcuaugcagaccucaguugcagacugggaaccuaugagucagacaaggccaugacuguuuaugaaugcuugucugaguggggccagauucucugugcaaucugccccaaccccaagcuggucaucacggguggaacaagcacgguugugugugugugggagaugggcaccuccaaagaaaaggccaagaccgucacccucaaacaggccuuacugggccacacugauaccgucaccugcgccacagcaucauuagccuaucacauaauugucagugggucccgugaucgaaccuguaucauuugggauuugaacaaacugucauuucuaacccagcuucgagggcaucgagcuccaguuucugcucuuuguaucaaugaauuaacaggggacauuguguccugcgcuggcacauauauccauguguggagcaucaaugggaacccuaucgugagugucaacacguucacagguaggagccagcagaucaucugcugcugcaugucggagaugaacgaaugggacacgcagaacgucauagugacaggacacucagauggagugguucggguguaguggugcaaucucggcuuacugaaaccucugccucccagguucaagcaauucuccugcaucagccucccaaguagcuggaauuacaagcaugcacugcuaugcccggcuaauuuuuguacuucuaguagagacaggguuucaccauguugaccuggcuggucucaaacuccugaccucaaaugauccgcccaucuuggcuucccaaagugcugggauuauaggcagcacuacaccuggccugaaccauguuuuuaaacuaauaugacuauaaucuuuuucccuguacuuugaaacagccauugugugcaggcagcccgcugccacaucuuccaagauacgggaaaucuaacuguauaacaugauggaaauuaaguuaucuguuaacccugacagucucucuucauugaguaauguaaauugguuccuuaaucuguuucuuaacuuuuuaauuuuuguacuuauuuaaauuuaguuuuggagaauggaauuuuugcaaguuccugaaacaccagcuccugagccugcugaaguccuagaaaugcaggaagacuguccagaagcacaaauagggcaggaagcccaagacgaggacagcagugauucagaagcagaugagcagagcaucagccaggacccuaaggacacuccaagccaacccagcagcaccagccacaggccccgggcagccuccugccgcgcaacagccgccugguguacugacaguggcucugacgacuccagacgcugguccgaccagcucagucuagaugagaaagacggcuucauauuugugaacuauucagagggccagaccagagcccaucugcagggcccccuuagccacccccaccccaaucccauugaggugcggaauuacagcagauugaaaccuggguaccgaugggaacggcagcugguguucaggaguaagcugacuaugcacacagccuuugaucgaaaggacaaugcacacccagcugaggucacugccuugggcaucuccaaggaucacaguaggauccucguuggugacagucgaggccgaguuuucagcuggucugugagugaccagccaggccguucugcugcugaucacugggugaaggaugaagguggugacagcugcucaggcugcucggugagguuuucacucacagaaagacgacaccauugcaggaacuguggucagcucuucugccagaagugcagucgcuuucaaucugaaaucaaacgcuugaaaaucucauccccggugcguguuugucagaacuguuauuauaacuuacagcaugagagagguucagaagaugggccucgaaauuguugaagauucaacaagcugaguggagaccauggucuguagaccccuucccgauucuccugucccagcuuggaaggcauugaaaacagucuccguuuacacaucucuucauaccacguguuugaaguguuaaaauucaaagggaucauugaauaaaacggguguagaguacaggaauggggcagacgcgauucaggugaacagcacaagaagaauaugaggugguuccuaggagcaacacuuucgaccuccaguucucccugaugacaguagcugucuccaagagaaaaauccucacuuauuaacucucuuuucuugcaucucauuuuuauagagcuacucauccuuauuuggaaaaaccaacaacaaaaaaggcuuuuagaaaaugguuguaaaucugacuucuuugcaaguaacuauguauauuguaaauagauauaaaaggccuuuuuucuaaauaaggacuuaacugccuguaacaugaaacuucaaacuaaaccacuaacucaaugaacuacuuaugguuugucugacaucccucacuuaccaauuaauuauaaauauguuuuuuuaaauccccaaagacauuaucuguggucuuuuuuuccuuucaagcucagccugugugccugaugucauuucuuucaaguugcccacaguaucuccacuuaaacuaggcuaguaaccaaaauaauguggaccuucuuuaggaaacagugugggagaauaggaguccagccguaagauaaacuggaaauauuugggcgucuuguaccuggcuacgcaccaccucaguguuguuccuacauaaacagggccccuuuuaaacuuguauguggacugcuguuuggucaaagaauaccuucuuagcauugcagaaagguggucagaugaccaguguagugcaggaaacagcccugucucaacuaauggaaauauauuugcauguaacccaaaauuagcuuaucuugcauagaacauaauaaguaugugucuuuggugacacuaauguucuacuauagcuuauuuucaaacaagggguaaaaaaaggaaagaaagaaguguacagaauuaacauauaaacuuuguuguaaaacugaaucaugucagaacugcuuaaaauuaaccuuuaccauuuaaugucaucuaccugaaaacagugagauuuauacuguaucaaugucuauuuuuuuguuuuugcuaugaauauaauuacaguauuuuaauauuuaguuauuuaauuuguucuacuaguuggauacagaacacacaaauccagggggauuaaagcuggaaggggcuaagagauuaguuuacagagaaaaggcuugguggugggauuuuuuuaaauguguguuauguacauauauauauauauauaauauauauuaaaaaugaaacaauuaaucuagauuuuaacauuuucagaaacuuagugauaacauuaugaacaauucuaaaagcccugugauuugaaaaauauagaaucauuaauggcccaagauaggccuucacaccuucacaggugcgaaaggaaaggccuucacacccucacagaggcaucaugcaaaggacagcggcuuuggcuuuuccaauuuuccaucuuuaggcccuggugagaggcacacuuaugcacuaaaaugcacauauaugcacaugcauucaaaaauaggcauuugguacaauggugaucuuguaccugaugggcugaaaccagcuuaagaacaaauuuguucuuccugauaugauaacuaggucuccaagagaaaauagaaaggcugcuuuagugccuuacgcuuacuaaauuuaaaucuuuauuuaccuggguuugagccuacagucuauuuaugauuacauaucaaaauugauuaaaacacuuccauuucuaaaaguucaaauauacuuguuaauaaaaggauuaucggcauuaauacuuuaauuuaaagaaaaguuguguucuguuuuccuuucugugucuuacuccccccacacucucccucccccaucaccaucuucaauucuaauaaauaaugcugauguucaacaguugcagaaauugugcuauuauguaacugugggccuugccccugucuggcccucuagaugauuuguagcaguguuauucuacacuuuuuaaaagaagcguccuccuuuuguccaugaaucauguuuaccccauacccaguggcagagguguucuuuaaagacuugaauauaugaauguguguguguaguuacuuaaagguuauuccucuuuguaauaggaaacuauaugggaugaacacuuuuaaacuuuccgacacaacuuccauuacuaacuuucuaacagaacuuccauaacuagaagguggaaaccaaaacccucaugguaguauuuccucuggcagcuggugcugugggcaacuguuuuguucaaucggguuucuuuucuuuuugccucuaaugcagaaaucaacagaaucacucacacauacaaguacacucacauacauaaacuaauuauuucucuggauaucuuucuguguuccauguaaauuuauuuaccaacaucuauugucaacauguacaucuaccuuaguauggucugcauucuuuuucugagaguaccucauagggcuccugccugaucuuuguaguuuguucauucauccauccaccuguucauuuguucauccauguauucuaacauuucuauguagugugcaacucuaaugucaugcuuuugaagaagagaauagcugcccauagcagccauccgucuggauaauagcaaaacacucuagauaaguuauuuugcacuuucuuauguauaaaguugguagaaacuuauuuuugcuuuguaucauuuaaauacauuuuguuuugguaaaugaacuguguauaaaauauuuaugccguuaaaacuguuuuuagaaaguauuuuuaauuucagcaaguuugguuacuuguugcaugacucuuaacacagcugacuuuuugugucagugcaauguauauuuuuuguccuguuauuaacuuguaagcccuaguaauggccaauuauuuguacagcaacagaaguaaauugaagauacuggcuaagacuggauugauuguggacuuuuauacuauauugcagaaaccaauaucuguuucuuggugguuauguaaaagaccugaagaauuacuaucuagugugcagucugugauaucugaauguucauuguauauuugucucugaugcaaaaagguagaguaacacaauuacaauacaugauuaaaugcaauaguccagguacuuaaguaauuuuuuuuucauuucaaauaaauaccuauuuaccaccaaaagaaag

SEQ ID NO: 364 - RNA, 4760 nt, Homo Sapiens
gaaaaaaggaacccaaggagauaggagagcuguuaauuucacucgggacauuuccucgaggcuaguuuacucggaaagccucaauguucccugguagcugcaggaucuacuuugggggcugccaaguuuccucucucauucuuucuccugccccaagagcaggcaggaaggaaaguuccuggacugauacucgucuguuuaguaggcguggguccugguugaagucugucuaggaaaacuccuaaguguagaaaucuucuucguauuaccacugucucugcacugagauuugggcugcuuugcuuccagcgucacacaucauaacugaggucagcgcugccugagcucguccccuggauguccgggucuccccaggcggccacccgccggcucccaucgugaccuccagccgcagcgccucccacgccggccgccgcgcgaggggagcgcucgggcgcgccgggugugguugggggaagggguugugccgcgcgcgggcugcgugcugugcccacucaaaagguuccgggcgcgcaggagggaagaggcagugcccgccacucccacugagauugagagacgcggcaaggaggcagccuguggaggaacuggguaggauuuaggaacgcaccgugcacaugcuugguggucuuguuaaguggaaacugcugcuuuagaguuuguuuggaagguccgggugacucaucccaacauuuacauccuuaauuguuaaagcgcugccuccgagcgcacgcauccugagauccugagccuuugguuaagaccgagcucuauuaagcugaaaagauaaaaacucuccagaugucuuccaguaaugucgaaguuuuuaucccagugucacaaggaaacaccaauggcuuccccgcgacagcuuccaaugaccugaaggcauuuacugaaggagcuguguuaaguuuucauaacaucugcuaucgaguaaaacugaagaguggcuuucuaccuugucgaaaaccaguugagaaagaaauauuaucgaauaucaaugggaucaugaaaccuggucucaacgccauccugggacccacagguggaggcaaaucuucguuauuagaugucuuagcugcaaggaaagauccaaguggauuaucuggagauguucugauaaauggagcaccgcgaccugccaauuucaaauguaauucagguuacgugguacaagaugauguugugaugggcacucugacggugagagaaaacuuacaguucucagcagcucuucggcuugcaacaacuaugacgaaucaugaaaaaaacgaacggauuaacagggucauucaagaguuaggucuggauaaaguggcagacuccaagguuggaacucaguuuauccguggugugucuggaggagaaagaaaaaggacuaguauaggaauggagcuuaucacugauccuuccaucuuguucuuggaugagccuacaacuggcuuagacucaagcacagcaaaugcuguccuuuugcuccugaaaaggaugucuaagcagggacgaacaaucaucuucuccauucaucagccucgauauuccaucuucaaguuguuugauagccucaccuuauuggccucaggaagacuuauguuccacgggccugcucaggaggccuugggauacuuugaaucagcugguuaucacugugaggccuauaauaacccugcagacuucuucuuggacaucauuaauggagauuccacugcuguggcauuaaacagagaagaagacuuuaaagccacagagaucauagagccuuccaagcaggauaagccacucauagaaaaauuagcggagauuuaugucaacuccuccuucuacaaagagacaaaagcugaauuacaucaacuuuccgggggugagaagaagaagaagaucacagucuucaaggagaucagcuacaccaccuccuucugucaucaacucagauggguuuccaagcguucauucaaaaacuugcuggguaauccccaggccucuauagcucagaucauugucacagucguacugggacugguuauaggugccauuuacuuugggcuaaaaaaugauucuacuggaauccagaacagagcugggguucucuucuuccugacgaccaaccaguguuucagcaguguuucagccguggaacucuuugugguagagaagaagcucuucauacaugaauacaucagcggauacuacagagugucaucuuauuuccuuggaaaacuguuaucugauuuauuacccaugaggauguuaccaaguauuauauuuaccuguauaguguacuucauguuaggauugaagccaaaggcagaugccuucuucguuaugauguuuacccuuaugaugguggcuuauucagccaguuccauggcacuggccauagcagcaggucagagugugguuucuguagcaacacuucucaugaccaucuguuuuguguuuaugaugauuuuuucaggucuguuggucaaucucacaaccauugcaucuuggcugucauggcuucaguacuucagcauuccacgauauggauuuacggcuuugcagcauaaugaauuuuugggacaaaacuucugcccaggacucaaugcaacaggaaacaauccuuguaacuaugcaacauguacuggcgaagaauauuugguaaagcagggcaucgaucucucacccuggggcuuguggaagaaucacguggccuuggcuuguaugauuguuauuuuccucacaauugccuaccugaaauuguuauuucuuaaaaaauauucuuaaauuuccccuuaauucaguaugauuuauccucacauaaaaaagaagcacuuugauugaaguauucaaucaaguuuuuuuguuguuuucuguucccuugccaucacacuguugcacagcagcaauuguuuuaaagagauacauuuuuagaaaucacaacaaacugaauuaaacaugaaagaacccaagacaucauguaucgcauauuaguuaaucuccucagacaguaaccauggggaagaaaucuggucuaauuuauuaaucuaaaaaaggagaauugaauucuggaaacuccugacaaguuauuacugucucuggcauuuguuuccucaucuuuaaaaugaauagguagguuaguagcccuucagucuuaauacuuuaugaugcuaugguuugccauuauuuaauaaaugacaaauguauuaaugcuauacuggaaauguaaaauugaaaauauguuggaaaaaagauucugucuuauaggguaaaaaaagccaccgugauagaaaaaaaaucuuuuugauaagcacauuaaaguuaauagaacuuacugauauuccugucuagugguauaauaucucaggaaucuuggcugaggguuuggaacuguggguagaguagagggccaggaguccaguaauagaauucuugcaccauuucuggaacauucuagcucugggaggucacguaaccuucuugggguaguucagugguuuagugguuuauaauccaggugugcgucagaaucaucugaggaacuuugcuaaaauacaaaaaucuggccuaaguagcuccagaucuaccuucauaaaggaaucugaccacuccuggauuugguaauuuccaaguucugaaaauuuuacuuaggauuuaauaacuauuaacaucugucccuacauagguuuucuuuccuacuuauauaccuuauguucucuucauucuaaccuucaucaguaauagggaaauguuuuaauuuuauuuuuuuaguugaaggguaauguaccaaaaaauauaguucagugaauuaaaaugaacacacaugugcaaccaucaauucaggucaagaaauagaagauuguagcacacaaaagccuacucagccauucucccagucacuacuuccuuccuuaccccuggguuauuuuugaaaugacacuugauguauuucccucuguugcuguuaugagaacauugcuacagccaaguguuguguuucugugugcauagguugauacuuaauuaucuccccacuuuuuaauaaacuuuuaauuuggaaauaauuuuagauugacagaaaaguugcaaagauagugaggaaaguuccugucuacucuuugcucagcuucccuuaauguuaacauuuuauauagcaagaugcauuugucaaagcuaacaaguuaacauugguacaaucacuguuaauuaaacugcacacaauauucagauuucaccacuuuuccacuaauauucuuucauuguucuaggauucaauucaggagaccacauuucaucuagcccucuuuuuuaaaaguaaauacuuuucagcacuuacaggaguuaacugagcuggggcaucaugguguauagacgcccugacacuggucaucuuggaauucauuuaguuugucagugggugcccugacauucugucacaacaucaauuugggaacauggcauuauauuuuuaucuuugaacuuuuuucuuuuuggaugacauuugauuaaugcgucaucuuggaacacauuaucuuuuuucuugguuaugugaucaggaagauuaaucaguuuuuccuguucuugguauaauuccugcuuuucacauaccugucccuuacaguucucuauauauacccuucccuuauuacacagagagaaauaucuaucuauacuuuuuacacaaaauauacuucaaaagaaacaaaacagccacaauuauuaacuuuuuaaauaaaugagaauuuaauuauauccua

SEQ ID NO: 365 - RNA, 416 nt, Homo Sapiens
aggcugcucacuggcccgucuccucucaugacugcugcucugggaaccaccucucugcucuccaucgcuaccacucuagccuguggccugcuccugguugaagaagccaucaaugaaaaugaauaccacucuggaaaucuuggguggucugaccugauauuuucgcauaguggccacagauauuuuaggcccccaagagguagucuuacucuuucaauuuuacuggcuccacuguuugaggaacuuggaacaauuuccccagggacuggucuggagguacuguugaauaacaccacgguguuuuuuuuccucuccaccaagggcccguugaugucucaagaccagacauaaaacuuuuggugcucaagucacucagaaugagaguccugcuuucccucagcacucuugcccuuuga

SEQ ID NO: 366 - RNA, 7763 nt, Homo Sapiens
aaaauuuaggaaaaguguugcugagcuguggaaucaggcguuucucccucaguucaacaacuaauacauagacugcugaucaagaauaaggaaccaaauaaagucaugcacguucuguugacagaggaacucuguggcuguugaauuuuacuguaacuaguuacucugucuucagagucaacuuaauauacaaguuaugucauaauggauggaaagaccuguguugauguauccagacucuagcaaaugaagauaaaaaacccguuaugacuaauccuugggaagagaaagucugcaaaauggcucaaaccaguuuacugcaagggaagcaguuuuacuguagggaguggguuuuccacaagcuucagcauugccuccaggagaaaaguaacugcugcaauagugcugucaaugcaccaucacuuguaaugaauucugggaauaaugcuaguggugucucuggaaagggagcugccugggguguguuguugguaggagggccuggcaguggcaagacggcccuauguacugaacucuuauggccaaguucaccugcaaguuugcagagagguuuacaucgccaagcuuuggccuuucauuucugcaaagcccaggacucugauacuuuguguguuggaggguuuauuagaggucuaguagcccagaucugccgcaguggacuacuccaaggauaugaggacaagcuaagggauccagcaguccaaagccucuuacagccuggggagugcgagagaaacccagccgaagcauuuaaaagguguguucuacucccucuucugggaaugaagccuccccagcaaagccuauaccugcuuguugauucuguugaugaaggguguaacauuacugaaggugaacaaacgucuaccagcuuaucugggacuguugcagcacuuuuagcuggucaccaugaguucuuuccaccauggcuauugcuucucuguucugcccgaaagcagaguaaggcuguuacuaaaauguuuacugguuuucgaaaaauaaguuuagaugaccuucggaaggcauauaucgucaaggauguucagcaguacauucuucaucguuuagaucaagaagaagcuuugcgacaacaccucacaaaagaaacugcagagauguuaaaucaacugcacauuaaaagcaguggaugcuuucuuuaccuagaacgaguuuuagauggaguuguagaaaauuuuauuauguuaagagaaauucgugacaucccaggaacucuaaaugguuuauaucucuggcugugccaaagacuuuuuguaagaaaacaauuugcaaagguucagccuauuuugaaugugauucuugcagccugccgaccuuugaccauaacggaauuauaucacgcaguauggaccaaaaacaugucguuaacuuuggaagauuuucaacgcaaguuagauauccucuccaaacuucuuguugauggacuaggaaauacaaaaauacuguuucauuauaguuuugccgaguggcuucuggaugugaaacacuguacucagaaguauuuauguaaugcagcagaaggacacagaauguuggcuaugaguuauaccugucaagccaagaauuuaacaccauuggaagcacaagaauuugcauugcacuuaauuaacucaaacuuacaauuagagacagcggaguuagcucuguggaugauauggaaugguacaccugucagagauucccuuucuacuuugauacccaaggaacaagaagugcuacagcuguugguuaaagcuggggcucaugucaacagugaagacgaucgcacaucaugcauaguucgacaagccuuagaaagagaggauuccauucggacauuauuagauaauggagcuucaguaaaucagugugauucaaaugggagaacauuauuggcuaaugcugcauauaguggcagucuugauguagucaauuuacuugucucuaggggagcagauuuagagauagaagaugcucauggacauacaccacucacucuagcggcuagacagggacauaccaaggugguuaauuguuugauuggguguggagcaaauauuaaucauacugaucaagaugguuggacagcauuaagaucugcugcuugggguggccauacugagguaguuucugcacuacuuuaugcuggcguaaaaguggauugugcagaugcugauagccgaacagcuuugagagcagcagcauggggaggacacgaggauauuguacugaauuugcuacaacauggcgcugaagugaacaaagcugauaaugaagguagaacugcuuugauagcagcagcauacaugggacauagagagauuguggaacaccuacuggaccauggagcagaaguaaaucaugaggauguugauggcaggacugcacucucuguagcugcacuuugugugccugcaaguaaagggcacgcaucaguuguuagccuuuuaauugaucgaggugcugaaguagaucauugugauaaagauggcaugacuccacugcugguagcugccuaugaaggacauguugaugugguugacuugcuucuagaagggggagcagauguagaucacacagauaacaauggccguacaccccucuuagcagcagcgucuaugggucaugcaucaguuguaaauacacuuuuguuuuggggugcagcuguggauaguauugauagugaagguaggacaguccucaguauagcuucagcacaaggaaauguugaggugguacguacucuacuggauagaggguuagaugaaaaucacagagaugaugcuggauggacaccuuugcacauggcagcuuuugaagggcacagauugauaugugaagcacuuauugaacaaggugcuagaacaaaugagauugacaaugauggacgaaucccuuucauauuagcuucacaagagggucauuaugauuguguucaaauauuacuggaaaacaaauccaacauugaucaaagagguuaugauggaagaaaugcacugcggguugcugcauuagaagggcacagggacauuguugaauugcuuuuuagccauggugcugauguuaacugcaaagaugcugauggucggccuacacuuuauaucuuggccuuagaaaaucagcuuacaauggccgaauauuuuuuagaaaauggugcaaacguagaagcaagugaugcugaaggaaggacagcacuucaugugucuuguuggcaaggccauauggaaauggugcagguccugauagcauaccaugcugacgucaaugcugcagacaaugaaaagcgcucugcuuugcagucugcagccuggcagggccauguaaaagugguucagcuucugauugagcauggugcuguaguugaccauacauguaaccaaggugcaacugcacucuguauugcagcccaggaagggcacauugauguuguucaggucuuauuagagcauggugcugauccaaaccaugcugaucaauuuggacgcacugcuaugcguguugcagccaaaaauggacauucucagauaauuaaauuauuagaaaaauauggugcaucuaguuugaauggcuguuccccaucuccuguucacacaauggagcaaaaaccucuacagucauugucuucaaaagugcagucauuaacaauuaaaucaaauagcucugguaguacugguggaggggauaugcagccuucguuacgugguuuaccuaaugggccuacucaugcuuuuaguucuccuucagaaucuccagauucuacaguugaccggcagaagucaucacugucaaauaauucccugaaaagcucaaaaaauucaucuuugagaacuacuucaucuacagcaacggcucaaacagugccaauugauagcuuucauaacuugucauuuacagaacaaauucagcagcauucauugccacgcaguagaagucgacagucaauuguuuccccaucuuccacaacacaguccuuaggacagagucauaauucaccaaguagugaauuugaguggagucaaguaaagcccaguuugaagucaacuaaagcaaguaaaggggggaaaucagaaaauucugccaagucuggaucagcugggaaaaaagcgaaacaaaguaauucuucacagccaaagguuuuagaauaugaaaugacucaguuugauagaagaggaccuauagccaaauccgggacugcugcaccaccuaaacaaaugccagcagaaucucaaugcaaaauuaugauaccuucagcucagcaggaaauuggucgaucucaacagcaguuucuuauucaccaacaaaguggggaacagaagaagagaaauggaauaaugacaaauccaaauuaucaucuucagagcaaccagguuuuucuugguaggguuucagucccacgaacaaugcaagauagagggcaucaggaaguguuggagggauacccuuccucagagacagaauuaagccuuaaacaagcucugaagcuucagauugaagguucugacccuagcuucaacuauaaaaaggaaacaccauuauaaaaguuuccuauucugugaaacagaagacauugugauggagugguucuucagcuacuggauggaaacauaugccuguugauuugcugaaaaaacaaaaaaaaugaagaaugugaucucugcaguacaguuaccuuaauuacuguaaugugccuaaauaguaaggcugccuucucaauguaacccucugugcuuaaaaaauuucauuuugugugcuuuguauucacuacacaggaauaagcacuuuuuaaaaaugcagauacauacugcaguucccugauaaaagcugaaaagaaaauuugaguauuuuaaguuaagaugugauaaaaaaugugcaugugccauaaucaaauauauaugaaaaggcaguguuccuuguauuuauuuuuuuuucuuuuuguggcaaaagaaacuuaaacauacuguuucagucacauugcauuguaguguauggccuguuucuuguaucuuuaaagacguugcucaauaaaacaaaucuugcaacuguucuauguucacuacaccuucagcauuggauaaaaaucauuuucuauauaaauaucacauugaaaugaaaaaaugauuucuuggcaguuuaaaaaaaauauuuuauaguaguuuagggagcugcuuuaaguaguuuaaaucuggauuuucccaguagaauucuucucaucucuggcuaaacaugucagaacaaacaaccaaccagucuguaggcagaacaaaguccuauuucauccgcugggauacaauuucaucuuccauucacuuugucauuccaccucuaagaagacagacuaucauuccugaggcaugaaaauucucagggacaaagccaugccucagucacaugugugugcagagagaaaugcaccugucuaucuaaggguagauuuuugaucccugaauaauucauugacuaaacugaccucuuccuccuggcuaaauaaauuaauuuugcuggcuucucucucagcgguuucuauuuuguaaauugcugcaugaccaaaauagccccacucaaaaucaauuggauuaauuuuaaugguuugguuggaugaauauucuggaugaauauaaaaugugcugcccuucacagaugacaccacuccccugucaaucauagcacauguguacuuuuuauuguuacuuaauagugauggauuugcacuuuucuauccucauacucuuuccuguuuucuucuuuguacaauugcaugcaggagggcuggaugccaggguuaagagagaaauucaugacaaggaagguaaaauugguucaaaugagcaugugucccacagccuuagucuccuuacucuuaaaucaguggagcuguagcuuagaugggucguuuauaugucuggaaaaguugucauaacaguuuagaagccaagguuguggauuugaucuuagaaugggccuguuaaucuuauagaacccagaaauucuguucuuuucauguacuguugaugaggaaugaggaaagagaauuuggagauucagcacaaaaccauugcuacuucuagaacaaaaucuuuagaauauguccuaauaacaaaggucaguaaugucaucuucauauaugaaggacacaugugauacauuguucguggaaauagaaauguauaauuaugauaaauguuucacuugaaucuuauuguaaggcuuuucuugcuuuuauuuuuuaaagucagcaaaacucauuuugucugucaucuauaagucauagugaggacuacgagauaaguugauaaguucaauugauauuaaggugacauggcaauauuaauaacucaaaugugaauguuucaaguauugaauucuugucccuaugggacauuuauuaaauaaaauuaaugggacucuugcaaaguagccuuaaaaguguuaaugagucuauuaauaaauaugaacacauacuauuauuagaaccaacuuuacucauaucucaaauacaguacauuuacauuacuguagaggaugaagcucuaauuucuauuacauguaauuuucuuuagaaagagaacccugaaagcugccaguuuuucuauuaacuuugaauuauugaaauuguauuuauuuaauuuuauuguuuuuacaaaauugcaccuuguguccaaagggcgaagauaugacauugcauaagggauuuauguuuuucaaagagcuaacuguuuucauauccauacuauauacacuugaagcaauugguaggaagagaaccuauuggaaaaauacgauuuucaaaaguaaguauuccucgggauguuuuuauauaaauuauguuuuggaauagaacauaaaugacuuugaguuaggauaaggaugauaggaugggugcuggagaugcccugccuugcuuauuuguuucugugggggauuuaauacuauaaaugaaaauggcuucugcuccauuaaaaaguaaaaauuguccuccaaauauaaaacuccuuaauagauauuuuugaaauuaaaaucuuuaaauuuuauaaaucagcuguugccacuacacaacuaugauggcaugugcuuauaacauuuuuauaacauuccgucugugucuauucccuaaauaucaugaguuuauaauaaggaaagugauaaaaauacaguaaugaaauaaaaaucugaauguuucuaagaaagguuuuggaaggaaaaaugaccugaaaucagugcguacugcaaaguacagccaauaauuuuuguucuuuguuuucacccccacccucacuggaauucucaccaaaaauaguuugauacuuaaaaaacagaaguaaauacuuuucucaauauuguuuuggcuaugcaaauauuuguuuugcuuaauguccuccauuuacacuucucagcaaauguaguugcaaacaaaugcuuucuuuuuauuuuucccuugguuugagguauguaaauagccaaaaauguacauugaauuucacauuguaaaaguuuuauuuuaucccuuguaugauauuacucaaaaaaucccuguguauaugaaagugcauaauaaauauauuugcuuuacagagaagaucuuguuuuaauuuuguccuugaaccaguagaacaugcaugauaugcauauagcauaaacaacuguuaguuguuuuaaguuauuaucuuaaauaaauccugagcaaaugaauuuggaaacauuuugcaaagaagaaagugaaauauaacacuguccaaaggaagguagaa

SEQ ID NO: 367 - RNA, 2937 nt, Homo Sapiens
ccgaaagagaaaacaggccgcgcgggcggcagaggagccgggcgccgcaauggacgugcgggcgcugccguggcugccguggcugcuguggcugcugugccggggcggcggcgaugcggacucccgcgcccccuucaccccgaccuggccgcggagccgcgagcgugaagccgccgccuuccgggaaagucuuaauagacaucgauacuugaauucuuuauuucccagugaaaacuccaccgccuucuauggaauaaaucaguuuuccuauuuguuuccugaagaguuuaaagccauuuauuuaagaagcaaaccuuccaaguuucccagauacucagcagaaguacauauguccauccccaaugugucuuugccguuaagauuugacuggagggacaagcagguugugacacaagugagaaaccagcagauguguggaggaugcugggccuucagcguggugggggcaguggaaucugcuuaugcaauaaaggggaagccccuggaagaccuaaguguccagcaggucauugacuguucguauaauaauuauggcugcaauggaggcucuacucucaaugcuuugaacugguuaaacaagaugcaaguaaaacuggugaaagauucagaauauccuuuuaaagcacaaaauggucugugccauuacuuuucugguucacauucuggauuuucaaucaaagguuauucugcauaugacuucagugaccaagaagaugaaauggcaaaagcacuucuuaccuuuggcccuuugguagucauaguagaugcagugagcuggcaagauuaucugggaggcauuauacagcaucacugcucuaguggagaagcaaaucaugcaguucucauaacuggguuugauaaaacagguaagaagcacuccauauuggauugugcggaauuccuggggaaguucuuggggaguagaugguuaugcccaugucaaaaugggaaguaauguuugugguauugcagauuccguuucuucuauauuugugugacauguugggcagaucaagagacagcuacaaaaaugaagguuuucauaaugcaauguaacauaguacuucaaaguauuauucaacuucaaguuucagcaacuaccuacaaaagauucuaaggccuaguaguauuuaaacuaaguuucagaauguucccuucuuguagagagauggacaaccaaagucagugggacaaacuccagcacagaagccugcgaggaagccuauggaauaguuuccuguccugagacgaaauucagauuaggagauauuuuaggccccugcaacuggggaaggcuacuguuuguuuuuguuugcuuauuauuuauuuguuuguuuauugugagauauuucaggugggaucaaagaggucauaagaauuuauuuucuuuugugggguguaacuacuagcuuuagauuaccccuauacacaagaauggccaaccuaaaauuaugugugucuuguacaguuaguuauauuagcagcccucugagauggcguaucuaucggaaggauuucaaacaccaauugcuuuaccugaacaaauggugcuuacccuuugaacagcagagugaccacguagaaggaaggaaaagggcaaaaucgcuucaguuaaacugaaauuaaaugaacaauaaggcaacuauauaaguaacuucuaguagcauugccugagagacaaauuauuguuugauaauuuucauugugaauaggaauccaauagaucauauugcuuacuuuguucuuuuuauacuauagaauaauauuuuguucucuaguauaucaaaauaccaaaauauuaucucauauuuucucccucuuucucuuacucuuuaccaaguuuuccugguggcuuggcuucccugacuaaagaauuaagucucauuuuuacuuuccauuucuauuuucuuaccacuugguuggcucccuuugucucuguaccuuuaccaacauuaggaucucaccucuuucuuccucccuuaauucauaagcaccacuccuaucaaagucccaucucuuaacccuggguaucaaacaaacugugaguuuuccagaaucuguuucccaguuuuccccucagcuuuccuggucucccauccgaacugcuucuuugugcaccucuuguucuuucucuuggcucccagucuugauuccugugaucacucuugcaucacuaauugcacaagugauuucaggugcaauucugauuagccugcguccacacagugaucgaugauccuaugugccuagaaaggacacugugugcugcucaugaccugcaacaggaaaaaagccauuucuuguuagcaguguaagaaccuuagagcaaaggaguugaccuucugauugaauauaagcacaaccauauuaaaugaaucaauacaagaaaauuauuucugauacuauguauguacauauuucuucucuaaaauguaucauucuuuucuaauguauaugaucuaacaaaaaugaaacaugaaaugcaguagcaaccacuaaaaaaaaaaauucaaggacaucuaacuuuuucucucacuuuugcccuuuguuuauccuucccugugauuagauaaacaaaauaaaaaacaaaaugcuguauuucucuucuuacgccagucagaaccaauccgaaaagaauguguguugacucagguuuggaguuauuucaggaagacagauauugaccuuuuaauugauaaauauucuuauuauccuggaaugccagaaaagaacuauguccugcuugucuaguuuguauucgcugacuuucuaugugauauagaugcauuuguaauacucuuuuucaagugcuaaaggauuucuaaaauuucaaacugauuaauauguuucugcuguucuggauuuugaugacauuuacaauaaaacaaccuacauuugacuuugguuuaaaaagaa

SEQ ID NO: 368 - RNA, 2564 nt, Homo Sapiens
agcucgcccaccgcccgccccagcaguggcugcaccaugcacgugaacggcaaaguggcgcuggugaccggcgcggcucagggcauaggcagagccuuugcagaggcgcugcugcuuaagggcgccaagguagcgcugguggauuggaaucuugaagcagguguacaguguaaagcugcccuggaugagcaguuugaaccucagaagacucuguucauccagugcgauguggcugaccagcaacaacugagagacacuuuuagaaaaguuguagaccacuuuggaagacuggacauuuuggucaauaaugcuggagugaauaaugagaaaaacugggaaaaaacucugcaaauuaauuugguuucuguuaucaguggaaccuaucuugguuuggauuacaugaguaagcaaaauggaggugaaggcggcaucauuaucaauaugucaucuuuagcaggacucaugcccguugcacagcagccgguuuauugugcuucaaagcauggcauaguuggauucacacgcucagcagcguuggcugcuaaucuuaugaacaguggugugagacugaaugccauuuguccaggcuuuguuaacacagccauccuugaaucaauugaaaaagaagaaaacaugggacaauauauagaauauaaggaucauaucaaggauaugauuaaauacuauggaauuuuggacccaccauugauugccaauggauugauaacacucauugaagaugaugcuuuaaauggugcuauuaugaagaucacaacuucuaagggaauucauuuucaagacuaugauacaacuccauuucaagcaaaaacccaaugaacagcuuauguguuagccauagcugaaaauaagcacaaauagcuuauauucagauccuaucuucauuugaauauagcuuuuaaaugaaauguuacaguuugaaguuuuccuucaugcacuuggugauaaacguuuucuaaauuuuuaguuaaguauauggauaaaaaguuaugaacuauuaaaaaugugauguggaccaaaggcuagguuguaaucuugauagucuaaaaaaugaucaaaacaaaugauuuucaaggaauauucaauauucugccuuucagaaaguguauuuauaucugugcuucauaaauauuaauguucuucagaacaucauuuuaaaggagauacuugaauuguuauuuaaaucaaaccagauguaaaacacucacauacaaguucauacuuuaaaagaggaaagcuacuuaacaaugacaaauauuucacaauaauaauuuuuacuuauauaccaucuuucaacugaacauuucaguucuuccaagagcuucuuagaguaguauauuuugggggcagucaaggaauaaacuacaguguaaacauaucccagaugaaaacugcuguauggaaaaaugacagaaaguaacugauugacacuguugauucacaguucagccuccuaucugggaaagacauuucuuuccucugcucacuuuaagaacuuuuaccgacuccaaaaaucucaggaauuaaacuuuuaacaguuacagcaauaaagaauaguuaguacuccaaaaauauuauauuuaagaugcucaacaagaaaaaaaugcaaauguaauauuuuuuucaaauuacuucuuuauugacuuguccaaauuucaaaagugccuacccuucaauaaaacuuuuuuauucugaucuccauaaauuacuuagucuucuauguauagcuaucaaggaaauaaaaccaauuuugccacagccacaacuguaaauguuuuuguacccaugcugaaacucauaacaacacagacauaaaaauagcugugagguuuugcuuuuuuuguugucagcuaucuuaagaaucauuaaauacaccugcuuuggguaaaacucuuugcaagcaguaauuaacacuaguaacagugaaagcacaagauuuccaaaucagucguuuucucaaaaaaauaucguauaagugacucauccugucugcuaacuccagaccucccagcuugaagccaaaucuuuccaugugagauugauauggauuuccuagaaguacuggaauguugucauaucuugcccuauuuuaauucugcuauagaaaacaauugccuucacuuuuaaggaguaauuugaauauuaauaacucuggucuagauuuucauauaauguauuaaagacaaaguagugaacaucaaugaacaucugauagagauaaacuguaaucaggcauaagcuuguuuguauguucuggcagugacuaaucaguaaaugaugucgguuugcccaguaucacuuaucuucuguauuuuuccucugucguguaaauaguauaaccuuuucauuuauggacaauuuuuuggacuaguagccuucaauauacauucugcuuugaauuaauuuuuucaaaucaauaaauuauguagacauuuaaaaucaaauaucaaguagaauugaaaaaugugaguuacauaaguuaaaaacuuacuuuaaaucuuaccuucuauagguagcucuaaauaaauucauaugguuauauggca

SEQ ID NO: 369 - RNA, 3911 nt, Homo Sapiens
uggcucagccgcggcgguggcgggggcgcaaccagcgggccgaggcggcggcgccagcggcgccuuaaauagcauccagagccggcgcggggcagggagugggcugcagugacagccggcggcggagcggccgguccacggaggaggggacuguguuaagaaccaagggcauauaaagacagaugggaggagacccuggccggggagaggaagaagcaucuacauagguacuaaguaccauucgcuagaauucagcuuagagaacuaucaacacaggacaaugcaagcccaugagcuguuccgguauuuucgaaugccagagcugguugacuuccgacaguacgugcguacucuuccgaccaacacgcuuaugggcuucggagcuuuugcagcacucaccaccuucugguacgccacgagacccaaaccccugaagccgccaugcgaccucuccaugcagucaguggaaguggcggguagugguggugcacgaagauccgcacuacuugacagcgacgagcccuugguguauuucuaugaugaugucacaacauuauacgaagguuuccagaggggaauacaggugucaaauaauggcccuuguuuaggcucucggaaaccagaccaacccuaugaauggcuuucauauaaacagguugcagaauugucggagugcauaggcucagcacugauccagaagggcuucaagacugccccagaucaguucauuggcaucuuugcucaaaauagaccugagugggugauuauugaacaaggaugcuuugcuuauucgauggugaucguuccacuuuaugauacccuuggaaaugaagccaucacguacauagucaacaaagcugaacucucucugguuuuuguugacaagccagagaaggccaaacucuuauuagaggguguagaaaauaaguuaauaccaggccuuaaaaucauaguugucauggaugccuacggcagugaacugguggaacgaggccagaggugugggguggaagucaccagcaugaaggcgauggaggaccugggaagagccaacagacggaagcccaagccuccagcaccugaagaucuugcaguaauuuguuucacaaguggaacuacaggcaaccccaaaggagcaauggucacucaccgaaacauagugagcgauuguucagcuuuugugaaagcaacagagaauacagucaauccuugcccagaugauacuuugauaucuuucuugccucucgcccauauguuugagagaguuguagaguguguaaugcugugucauggagcuaaaaucggauuuuuccaaggagauaucaggcugcucauggaugaccucaaggugcuucaacccacugucuuccccgugguuccaagacugcugaaccggauguuugaccgaauuuucggacaagcaaacaccacgcugaagcgauggcucuuggacuuugccuccaagaggaaagaagcagagcuucgcagcggcaucaucagaaacaacagccugugggaccggcugaucuuccacaaaguacagucgagccugggcggaagaguccggcugauggugacaggagccgccccggugucugccacugugcugacguuccucagagcagcccugggcugucaguuuuaugaaggauacggacagacagagugcacugccgggugcugccugaccaugccuggagacuggaccgcagacaggccauguuggggccccgaugccgugcaauuugauaaaacuuguugauguggaagaaaugaauuacauggcugccgagggcgagggcgaggugugugugaaagggccaaauguauuucagggcuacuugaaggacccagcgaaaacagcagaagcuuuggacaaagacggcugguuacacacaggggacauuggaaaaugguuaccaaauggcaccuugaaaauuaucgaccggaaaaagcacauauuuaagcuggcacaaggagaauacauagccccugaaaagauugaaaauaucuacaugcgaagugagccuguugcucagguguuuguccacggagaaagccugcaggcauuucucauugcaauugugguaccagauguugagacauuauguuccugggcccaaaagagaggauuugaagggucguuugaggaacugugcagaaauaaggaugucaaaaaagcuauccucgaagauauggugagacuugggaaggauucuggucugaaaccauuugaacaggucaaaggcaucacauugcacccugaauuauuuucuaucgacaauggccuucugacuccaacaaugaaggcgaaaaggccagagcugcggaacuauuucaggucgcagauagaugaccucuauuccacuaucaagguuuagugugaagaagaaagcucagaggaaauggcacaguuccacaaucucuucuccugcugauggccuucauguuguuaauuuugaauacagcaaguguagggaaggaagcguucguguuugacuuguccauucgggguucuucucauaggaaugcuagaggaaagagaacacugccuuacagucaccucauguugcagaccauguuuaugguaauacacacuuuccaaaaugagccuuaaaaauuguaaaggggauacuauaaaugugcuaaguuauuugagacuuccucaguuuaaaaaguggguuuuaaaucuucugucucccuguuucucuaaucaagggguuaggacuuugcuaucucugagaugucugcuacuugcugcaaauucugcagcugucugcugcucuaaagaguacagugcacuagagggaaguguucccuuuaaaaauaagaacaacuguccuggcuggagaaucucacaagcggaccagagaucuuuuuaaaucccugcuacugucccuucucacaggcauucacagaacccuucugauucguaaggguuacgaaacucauguucuucuccaguccccugugguuucuguuggagcauaagguuuccaguaagcgggagggcagauccaacucagaaccaugcagauaaggagccucuggcaaaugggugcucaucagaacgcguggauucucuuucauggcagaaugcucuuggacucgguucuccaggccugauuccccgacuccauccuuuuucagggguuauuuaaaaaucugccuuagauucuauagugaagacaagcauuucaagaaagaguuaccuggaucagccaugcucagcugugacgccugaauaacugucuacuuuaucuucacugaaccacucacucuguguaaaggccaacagauuuuuaaugugguuuucauaucaaaagaucauguugggauuaacuugccuuuuuccccaaaaaauaaacucucaggcaagcauuucuuuaaagcuauuaagggaguauauacuugaguacuuauugaaauggacaguaauaagcaaauguucuuauaaugcuaccugauuucuaugaaauguguuugacaagccaaaauucuaggauguagaaaucuggaaaguucauuuccugggauucacuucuccagggauuuuuuaaaguuaauuugggaaauuaacagcaguucacuuuauugugagucuuugccacauuugacugaauugagcugucauuuguacauuuaaagcagcuguuuuggggucugugagaguacauguauuauauacaagcacaacagggcuugcacuaaagaauugucauuguaauaacacuacuugguagccuaacuucauauauguauucuuaauugcacaaaaagucaauaauuugucaccuugggguuuugaauguuugcuuuaaguguuggcuauuucuauguuuuauaaaccaaaacaaaauuuccaaaaacaaugaaggaaaccaaaauaaauauuucugcauuucagguga

SEQ ID NO: 370 - RNA, 751 nt, Homo Sapiens
cccucauccucuaucccugaaccaggucagacauagauggaaucagagcaggaguugguguugaugugguuucagguccaccuaucagaguuugagagauuuaggccaugaaccauuaugaauauagaugagaaccuuuguaauugcugaaggagguaguagugcaggcaaguccugugugcaagaccugcugcucccaguuaguacggaccccugugacauucacagaaguucagaaugucugagaugcucugcaggcuaccuuaucuccgucugcagcuacaccuccagugaucacaaucagugcuacgcuggcacagccagccuggcccugcucuggauuggaggcauccucaagggcugcuugcuguggaagcaguuucgcuggaccgagaggagccacuggaauuuuggguacugggccuuagggucacccgggaaugggaauggcugcuguguggcccuguuugccagagggggccauuggugaugagccccaugcaaguggcaucugcccuucaccugcuccuucuaagccagcgggauggagacccuccagagagaauaugugaguuccucuccuuaugagagccgugguaugggcauugagaugacugacuugucaaauuaguucggaaagauuuuugacaacuacuacaagaucauaauguacuugaacaaaaaccugugauauguguuauuuguuuguuuuuagauauuggagaagggaauaaauuuuagcaaguaaaaa

SEQ ID NO: 371 - RNA, 1066 nt, Homo Sapiens
cucgcgucccgggugccuggauaccgagcgcguccguaguggcggcuggcgcuagggaacugcagggucuaggguguugucggaguggcaguugguccgaauuucucccgaagcccgcggaggagcggguaagagccccgcgaauccggccccaaccucgggaacgggaugggaggcggcccuggccgcaagccccgcgcugcuagcggguccaccgcgucguagccgacagccgcccuucuuccucgcagcgcgccgcgauucaccagccuggucccuucugcggagagcgaugccgcuucccgacaccauguucugcgcucagcagauccacauucccccggagcugccggacauccugaagcaauucaccaaggcugccauccgcacccagccggccgacgugcugcggugguccgcgggcuauuuuucagcucugucgagaggagauccacuuccuguaaaggacagaauggaaaugcccacggcaacccagaaaacagacacaggccugacucaaggacuccugaaaguuuugcacaagcagugucaccacaagcgguauguggaauuaacagaucuugagcagaaguggaagaacuugugccugccgaaggaaaaauucaaagcgcucuuacaacuggauccuugugaaaacaaaaucaaguggauaaacuuuuuagcgcuuggaugcagcaugcuugguggguccuugaacacugcgcugaagcaccugugcgagauccucacggacgauccggagggcgggcccgcucgcauccccuucaagacguuuuccuacguuuaccgcuacuuggccagauuagacucagaugugucucccuuggagacggaauccuaccuugccucucuaaaggaaaauauagacgccaggaagaacggcaugauaggucuuucagauuucuucuuuccaaagaggaaacuuuuagaaagcauugaaaacucugaagauguaggccauuaauacagagaagaauacauuuuaaugucaaaauagugcucuuuaaaauucuggcaccaaauacaacuuacccugaaucacaca

SEQ ID NO: 372 - RNA, 101 nt, Homo Sapiens
agcuagucugagugcagucguguuuacaacuaauugaucacaaccaguuacauauuuauuuguucuuuuucuauucccacuguuucauucuacuagccuuu

SEQ ID NO: 373 - RNA, 4586 nt, Homo Sapiens
gucuuccucccucccucccuuccucuuacucucauucauuucauacacacuggcucacacaucuacucucucucucuaucucucucagaaugacaauucuagguacaacuuuuggcaugguuuuuucuuuacuucaagucguuucuggagaaaguggcuaugcucaaaauggagacuuggaagaugcagaacuggaugacuacucauucucaugcuauagccaguuggaagugaauggaucgcagcacucacugaccugugcuuuugaggacccagaugucaacaucaccaaucuggaauuugaaauauguggggcccucguggagguaaagugccugaauuucaggaaacuacaagagauauauuucaucgagacaaagaaauucuuacugauuggaaagagcaauauaugugugaagguuggagaaaagagucuaaccugcaaaaaaauagaccuaaccacuauaguuaaaccugaggcuccuuuugaccugagugucgucuaucgggaaggagccaaugacuuuguggugacauuuaauacaucacacuugcaaaagaaguauguaaaaguuuuaaugcacgauguagcuuaccgccaggaaaaggaugaaaacaaauggacgcaugugaauuuauccagcacaaagcugacacuccugcagagaaagcuccaaccggcagcaauguaugagauuaaaguucgauccaucccugaucacuauuuuaaaggcuucuggagugaauggaguccaaguuauuacuucagaacuccagagaucaauaauagcucaggggagauggauccuaucuuacuaaccaucagcauuuugaguuuuuucucugucgcucuguuggucaucuuggccuguguguuauggaaaaaaaggauuaagccuaucguauggcccagucuccccgaucauaagaagacucuggaacaucuuuguaagaaaccaagaaaaaauuuaaaugugaguuucaauccugaaaguuuccuggacugccagauucauaggguggaugacauucaagcuagagaugaaguggaagguuuucugcaagauacguuuccucagcaacuagaagaaucugagaagcagaggcuuggaggggaugugcagagccccaacugcccaucugaggauguagucaucacuccagaaagcuuuggaagagauucaucccucacaugccuggcugggaaugucagugcaugugacgccccuauucucuccucuuccaggucccuagacugcagggagaguggcaagaaugggccucauguguaccaggaccuccugcuuagccuugggacuacaaacagcacgcugcccccuccauuuucucuccaaucuggaauccugacauugaacccaguugcucagggucagcccauucuuacuucccugggaucaaaucaagaagaagcauaugucaccauguccagcuucuaccaaaaccagugaaguguaagaaacccagacugaacuuaccgugagcgacaaagaugauuuaaaagggaagucuagaguuccuagucucccucacagcacagagaagacaaaauuagcaaaaccccacuacacagucugcaagauucugaaacauugcuuugaccacucuuccugaguucaguggcacucaacaugagucaagagcauccugcuucuaccauguggauuuggucacaagguuuaaggugacccaaugauucagcuauuuaaaaaaaaaagaggaaagaaugaaagaguaaaggaaaugauugaggagugaggaaggcaggaagagagcaugagaggaaagaaagaaaggaaaauaaaaaaugauaguugccauuauuaggauuuaauauauauccagugcuuugcaagugcucugcgcaccuugucucacuccauccugacaauaauccugggaggugugugcaauuacuacgacuacucucuuuuuuauagaucauuaaauucagaacuaaggaguuaaguaacuuguccaaguuguucacacagugaagggaggggccaagauaugauggcugggagucuaauugcaguucccugagccaugugccuuucucuucacugaggacugccccauucuugagugccaaacgucacuaguaacagggugugccuagauaauuuaugauccaaacugagucaguuuggaaagugaaagggaaacuuacauauaaucccuccgggacaaugagcaaaaacuaggacuguccccagacaaaugugaacauacauaucaucacuuaaauuaaaauggcuaugagaaagaaagagggggagaaacagucuugcgggugugaagucccaugaccagccaugucaaaagaagguaaagaagucaagaaaaagccaugaagcccauuugguuucauuuuucugaaaauaggcucaagagggaauaaauuagaaacucacaauuucucuuguuuguuaccaagacagugauucucuugcugcuaccacccaacugcauccguccaugaucucagaggaaacugucgcugacccuggacauggguacguuugacgagugagaggaggcaugaccccucccauguguauagacacuaccccaaccuaaauucaucccuaaauugucccaaguucuccagcaauagaggcugccacaaacuucagggagaaagaguuacaaguacaugcaaugagugaacugacuguggcuacaaucuugaagauauacggaagagacguauuauuaaugcuugacauauaucaucuugccuuucuuggucuagacugacuucuaaugacuaacucaaagucaaggcaacugaguaaugucagcucagcaaagugcagcaaacccaucucccacaggccuccaaacccuggcuguucacagaaccacaaagggcagaugcugcacagaaaacuagagaaggggucauagguucaugguuuuguuugagauuuguugcuacuguuuuucuguuuugaauuuucuucuuuguucuguuuuuacuuuauuuagggggacuagguguuucugauauuuuaguuuucuuguuuguuuuguuuuguguugucugugaaugggguuuuaacuguggaugaauggaccuuaucuguuggcuuaaaggacugguaagaucagaccaucuuauucuucaggugaauguuuuacuuuccaaagugcucuccucugcaccagcaguaauaaauacaaugccauaaucccuuagguuugccuagugcuuuugcaauuuucaaagcacuuccauaagcauuccuuccaccuccuugauaggcauuuauggaaagccugcuacaugucaaucauacuguuaggcacaggggaccuaaagacacauaaaaggauggcauucugccucauaaauugcaaaaccuaaugaaagugacugcuugguaaacaaauuauuauuauauuauaaaaugcuauaaaagagccauauugaaagugcccuguuggagacagggcaaaugccacaaaaaugauguaaauuuacauggaggaaaaguagaaucugccugguuuguaggcagcagaagacauuuuucaucagugggcagguguucuuuaccuuuuguagaaaugggagucaagucucaaauaggaggcuccacaaaaucucaugccaggucucugauaccuuauucacagaaguucuuugaaguauuuauuguuauuuucuuugacuuaugggaaaacugggacacaggaagacagguaaauuacccaaccucacacguuaagucagaacugggagccauaauuuuguaucccugguauaaauagacaaucucuugaagaaaugaagagaugaccauagaaaaacaucgagauaucuccagcucuaaaauccuuuguuucaauguuguuuggcauauguuaucuuuggaauuuagugucugagccucugucuguuacuguaguauuuaaaaugcauguauuauaaucauauaaucauaacugcuguuaauucuugauuauauaccuagggacaauguguaauguaagauuacuaauugguucugcccaaucuccuuucagauuuuauuaggaaaaaaaaauaaaccuccugaucggagacaauguauuaaucagaaguguaaacugccaguucuauauagcaugaaaugaaaagacagcuaauuugguccaacaaacaugacugggucuagggcacccaggcugauucagcugauuuccuaccagccuuugccucuuccuucaaugugguuuccaugggaauuugcuucagaaaagccaaguaugggcuguucagaggugcacaccugcauuuucuuagcucuucuagaggggcuaagagacuugguacgggccaggaagaauauguggcagagcuccuggaaaugaugcagauuagguggcauuuuugucagcucugugguuuauuguugggacuauucuuuaaaauauccauuguucacuacagugaagaucucugauuuaaccguguacuauccacaugcauuacaaacauuucgcagagcugcuuaguauauaagcguacaauguauguaauaaccaucucauauuuaauuaaaugguauagaagaaca

SEQ ID NO: 374 - RNA, 1993 nt, Homo Sapiens
ccauugaagguauuauuuauuugcagcucaucuuaagugacaaaauuccauacagaagacuauaacagaaaucauauuuaauauauuaaaauuaauacuucaaauaucuuucacauuaagaugauuaucuauuguguaaaucuuuccuagguaugugugucuguuucuugauguguaaaccaaaacucugaaauauucucuugaucuaacuuugacuuuuaaaaacugacauuguacugaauuuacauaauucucaaucagaaaaaaaauuacugucagacugcaaugcaagucugccccaaugaaggcaggaggagggauggcuggaagugucucagggcacucugaaaguuuagcaagcuuaucaaggaguccucaaacuaaagcuggccaaaaacuucagcauaaaaacuauccugucuguguauuauauauauuuauuaccaaauuuaauaaacaaaaaccacuuuugaaccagguaauuuuaucuagugugaaaagaaauuaaucacauggucauauacuggcuagugcucucuaaaaguagacauuaaaauauuucauaauuggagggaaucuuuggagauuaguggcaucuaaucuuggggccucagacacccaaaaucuauauauugaccaguggaaguugaugauuuguuaucaaauuucaaagcaccuaauggaaaccccacuucaucucugugaagauuuucaguuccuuuacaguuauuugaaauuauuucaauucuguggagccacuucagaaacuccaaugggccuuugcaauauuaaaauguggagaaugcauuaaucauuauuuaaucaaugaguuuaaaaaauagacaaaagcuucugaaacaugggacugaaguaggcggagcauuauaaaagccuaagguaauugguagugaagaguuggaaaaacuuacuuagucuaauauuguaauuuacagauaaggaaacugagaagauaaauaauuuauucaauaucacucgaugguucauuaguagaagagccagcauuaugauguacucauuuuguacucuaggaguuguuaaaaagcacuuaauaucuucuuuucuuggguguuagcauuuuucauuuuuuaaaucaugcuauuuaguguucuuaacauuugaaacccaaaugguucacauuuuguuuuuggauugcuuugggaaugaguauguacuguuagagaagggcccaauccaaacacuagaauuuuaauaauuucuacucccucugcuggccaacuuuccaguaaaauggauuuuaaaaaaagagaaaaaaaaaucuagcgguaauugaaacaaaaacaaaaacuuuaaaaagugucuucauuauaaagaggugccaugcauaaaagccuagguaguuucaagguccauucuuccauuccucaugauuuuaggguuauccucauucagaucuacucuaguuauaauaguacuuuaaacagagcacagaauuaaaccauuaguaugugaaucugcaaaaagagaacuuguuuuagacucuucuacaguuuagacuucaaugugcauacuaaaugcauaacauucguaucaaauaauuaacauuuauauacaauuaacaaauaaggacaaauuuuauacaaaacuucuacuacugcuauaauuuuugaaaacauuuaacccacuagcaagagguaagacagcacugccuuuuuaaaagacaggucacuugaauagagaauauaagauauaaccauaaguagaaguauaaacaauaauuuuucuucuuguggaauguuuuuaaauuuccuuucuuauauuauuauucuuccuuagguuuuuuuagacaggucauuucuuccugaaugauuuuccuuuuucuuuuauuuuuauuuuuugaaggaggauuauuuacugguggucuaaaagaaguaccuucaacuucuucauaauuguagccaaagcggaaauggaauauuuaauaauucuuacaucucacuaauguagucuucug

SEQ ID NO: 375 - RNA, 6891 nt, Homo Sapiens
cugauuuuuccuagcgagcuggaggaaaggcagguacccggaguggaguuauauuaccuguuucuuuguucugaugggaccccagagaggacaucacgcuuuguaacugguucuucaaggggagaagcaaaugugucccugaaaacuucagcugccgcguuuggcaccagguuugauugacaaggacuggcggagggaaagcgcggaggcugggcugggggccgcaggccgaggcagagacaaagagguuucgccuguccccgagaguggaagggccccuggggguaacuagccuuugagcucaaaggggcauuucgugaggucgccuuuugguucggagagcgcgcggcgaucggguggagggggccuggcgggaagaaagcuggggcggggaaggggcgcgggccgaggugggagcggagcugcagucacguggccgcccgccgccgcggaguuggggcuguucuuccggguuggaggcgcagcgccgcggggcccaagcccgggucugccagcgcgacguccucucgcggcccucagggcacagcccaaggcugucagccucccggcccagagugauuugccuucaaggaaacuggggagucagaaaauugggaacucauaucaacauggcaaaccuauugaaaacaguggugacuggcugcucguguccucuacuuagcaauuugggguccuguaagggucuacgugugaagaaggauuuuuuacgaacauuuuauacucaccaagaacugugguguaaagcgccuguaaaaccaggaauuccauauaagcaacugacuguuggaguccccaaagagauauuccaaaaugagaagcgaguggcauugucuccugcugguguucagaacuuggucaagcaggguuuuaauguugucguggaaucgggugcgggcgaagcuuccaaguucucagaugaucacuauagaguggcaggugcccaaauccaaggggcaaaggaagugcuggcuucugauuugguggucaaagugcgagccccuaugguuaauccaacauuagguguucaugaagcugaccuuuuaaagacaucaggaacgcugauuaguuuuauuuacccagcccaaaauccagaguugcuaaauaaacuuucccaaagaaaaacuacaguucuggcaauggaccagguuccaagagucacaauugcucagggauaugaugcgcuaagcuccauggccaacauugcggguuauaaggcuguuguccuagcagcaaaucauuuuggacguuuuuuuacuggucagaucacagcugcuggaaaaguuccuccagcuaagauucugauaguugguggugguguugcugggcuugcuucugcaggcgcagcaaagucgaugggugcaauuguucgaggauuugacacaagagcugcagcuuuggaacaguucaagucucuuggugcugagcccuuggagguggacuugaaggaaucuggugagggacaaggaggauaugcaaaagagauguccaaagaguucauugaagcugaaaugaaacucuuugcucaacaaugcaaggagguagacauccuuaucagcacagcacuuauuccagguaaaaaagcuccaguuuuauuuaauaaagaaaugauugagucaaugaaggaagguucaguuguuguggauuuagcugcugaggcugguggaaacuuugaaaccacuaagccaggagaacucuacauucauaagggaauuacucacauaggcuacacagaccugcccagccgaauggccacucaggccagcacccuauauuccaacaacaucaccaaacuccugaaggccaucagcccggacaaagauaauuuuuauuuugaugugaaagaugacuuugacuuugguacgaugggucaugucauuagaggaacuguagugaugaaagaugguaaagugauuuucccagcucccacaccgaaaaauauuccucaaggugccccaguaaaacagaagacaguggcugagcuggaagcugaaaaagcagcuaccauuacacccuucaggaagacaaugucaacggcuucugcauauacagcaggucucacagggauacuggguuugggcauugcggcucccaaucuagccuuuucucagauggugaccacuuuuggcuuggcuggcauugugggguaucauaccgucuggggagugaccccugcucuccacucaccacugaugucugugacaaaugcaaucucagggcugacugcaguugguggguuggcacugaugggaggacauuuguauccuuccacaacuucucagggccuugcugcucuugcugcauucauauccucugucaacauugcagguggcuuucuggugacucagagaaugcuggacauguucaagcgucccacugaccccccagaauacaacuaccuguaccugcucccugccggcaccuuuguugguggauauuuagcugcccucuacagugguuauaacauugaacagaucauguaccuaggcucggguuugugcugugucggugccuuggcuggccucuccacccagggaacagcacgucuuggcaaugcacugggcaugauugggguugcuggaggacuggcagccacccucggaguccuaaaaccgggcccagaauuacuagcucagaugucuggagcgauggcuuugggugguaccauuggauugacaauugccaaacgcauccagauuucugauuuaccucaauuaguugcugcuuuucacaguuuaguggguuuggcagcuguacuuacuugcauagcugaguacauuauagaauauccacauuuugcuacggaugcagcagcaaaucucaccaagauuguggccuaccucggcacuuacauugguggcgucaccuuuagugggucucucauugccuauggaaaauugcagggucuccugaaaucugccccucuccuacugccuggaaggcacuuacucaaugcaggcuuacuggcugcuagugugggcgggauaaucccauucaugguggacccaagcuuuacuacuggcaucaccugucuggguucagugucugcucucucugcugucaugggugugacuuugacagcugcuauugggggugcugacaugcccgucguuaucacugugcugaacagcuacucaggcugggcccugugugcagagggcuuccugcucaacaacaaucugcugaccaucgugggugcacucauaggcucgucuggugcuauccugucauacaucauguguguggcaaugaaucgcucccuggcuaaugugauucuuggaggcuauggcaccacuucaacagcugguggaaaacccauggaaauuucuggcacacauacggaaaucaaccuugacaaugcaauugacaugauucgagaagcuaauagcauuauuauuacaccaggcuauggucucugugcagccaaagcucaauaccccauugcugauuugguaaagaugcucacugagcaaggcaaaaaagucagguuuggaauucacccaguugcaggccgaaugccuggucagcuuaaugugcugcuggcugaggcuggugugccauaugacauuguguuggaaauggaugagaucaaccaugauuuuccagauacugauuugguccuuguaauuggagcuaaugacacuguuaauucagcagcucaagaagaucccaacucuauuauugcaggcaugccaguccuugaggucuggaaaucaaagcaggugauuguuaugaagaggucuuuggguguuggcuaugcugcaguggacaauccaaucuucuacaaaccuaacacggccaugcuucuaggugaugccaagaaaacaugugacgcgcuccaggcgaaaguuagagaauccuaucagaaguaaauauuaaggaucaagcuguuagcuaauaaugccaccucugcaguuuugggaacaggcaaauaaaguaucaguauacauggugauguacaucuguagcaaagcucuuggagaaaaugaagacugaagaaagcaaagcaaaaacuguauagagagauuuuucaaaagcaguaaucccucaauuuuaaaaaaggauugaaaauucuaaaugucuuucugugcauauuuuuuguguuaggaaucaaaaguauuuuauaaaaggagaaagaacagccucauuuuagauguaguccuguuggauuuuuuaugccuccucaguaaccagaaauguuuuaaaaaacuaaguguuuaggauuucaagacaacauuauacauggcucugaaauaucugacacaauguaaacauugcaggcaccugcauuuuauguuuuuuuuuucaacaaaugugacuaauuugaaacuuuuaugaacuucugagcuguccccuugcaauucaaccgcaguuugaauuaaucauaucaaaucaguuuuaauuuuuuaaauuguacuucagagucuauauuucaagggcacauuuucucacuacuauuuuaauacauuaaaggacuaaauaaucuuucagagaugcuggaaacaaaucauuugcuuuauauguuucauuagaauaccaaugaaacauacaacuugaaaauuaguaauaguauuuuugaagaucccauuucuaauuggagaucucuuuaauuucgaucaacuuauaauguguaguacuauauuaagugcacuugaguggaauucaacauuugacuaauaaaaugaguucaucauguuggcaagugauguggcaauuaucucuggugacaaaagaguaaaaucaaauauuucugccuguuacaaauaucaaggaagaccugcuacuaugaaauagaugacauuaaucugucuucacuguuuauaauacggauggauuuuuuuucaaaucaguguguguuuugaggucuuauguaauugaugacauuugagagaaaugguggcuuuuuuuagcuaccucuuuguucauuuaagcaccaguaaagaucaugucuuuuuauagaaguguagauuuucuuugugacuuugcuaucgugccuaaagcucuaaauauaggugaaugugugaugaauacucagauuauuugucucucuauauaauuaguuugguacuaaguuucucaaaaaauuauuaacacaugaaagacaaucucuaaaccagaaaaagaaguaguacaaauuuuguuacuguaaugcucgcguuuagugaguuuaaaacacacaguaucuuuugguuuuauaaucaguuucuauuuugcugugccugagauuaagaucuguguaugugugugugugugugugugcguuuguguguuaaagcagaaaagacuuuuuuaaaaguuuuaagugauaaaugcaauuuguuaauugaucuuagaucacuaguaaacucagggcugaauuauaccauguauauucuauuagaagaaaguaaacaccaucuuuauuccugcccuuuuucuucucucaaaguaguuguaguuauaucuagaaagaagcaauuuugauuucuugaaaagguaguuccugcacucaguuuaaacuaaaaauaaucauacuuggauuuuauuuauuuuugucauaguaaaaauuuuaauuuauauauauuuuuauuuaguauuaucuuauucuuugcuauuugccaauccuuugucaucaauuguguuaaaugaauugaaaauucaugcccuguucauuuuauuuuacuuuauugguuaggauauuuaaaggauuuuuguauauauaauuucuuaaauuaauauuccaaaagguuaguggacuuagauuauaaauuauggcaaaaaucuaaaaacaacaaaaaugauuuuuauacauucuauuucauuauuccucuuuuuccaauaagucauacaauugguagauaugacuuauuuuauuuuuguauuauucacuauaucuuuaugauauuuaaguauaaauaauuaaaaaaauuuauuguaccuuauagucugucaccaaaaaaaaaaaauuaucuguagguagugaaaugcuaauguugauuugucuuuaagggcuuguuaacuauccuuuauuuucucauuugucuuaaauuaggaguuuguguuuaaauuacucaucuaagcaaaaaauguauauaaaucccauuacuggguauauacccaaaggauuauaaaucaugcugcuauaaagacacaugcacacguauguuuauugcagcacuauucacaauagcaaagacuuggaaccaacccaaauguccaucaaugauagacuugauuaagaaaaugugcacauauacaccauggaauacuaugcagccauaaaaaaggaugaguucauguccuuuguagggacauggauaaagcuggaaaccaucauucugagcaaacuauugcaaggacagaaaaccaaacacugcauguucucacucauaggugggaauugaacaaugagaacacuuggacacaagguggggaacaccacacaccagggccugucaugggguggggggaguggggagggauagcauuaggagauauaccuaauguaaaugaugaguuaaugggugcagcacaccaacauggcacauguauacauauguagcaaaccugcacguugugcacauguacccuagaacuuaaaguauaauuaaaaaaaaaaagaaaacagaagcuauuuauaaagaaguuauuugcugaaauaaaugugaucuuucccauuaaaaaaauaaagaaauuuugggguaaaaaaacacaauauauuguauucuugaaaaauucuaagagaguggaugugaaguguucucaccacaaaagugauaacuaauugagguaaugcacauauuaauuagaaagauuuugucauuccacaauguauauauacuuaaaaauauguuauacacaauaaauacauacauuaaaaaauaaguaaaugua

SEQ ID NO: 376 - RNA, 9039 nt, Homo Sapiens
gauuuggcccggagaacgagaucacccucucaaugaaaggcagaugucccuuuaagguuugcuucuacagcccguggacuuuagccuaaacacggacccgcgaagcuggcuuuauuuguccaugucucggacagagccugggaagcugccagugagauuucagagaccaagagcgcgaaggggcgggcgauguggcaauccgucugggaugugaaaagcguggagcgcauuuagaggaauucgacgaaaacacaggaaaucacuccucucccgcuccugggcgccgcugccacuggggcagaggacugggaaccgcggcagcgggauaaguggcccagccagagagcgcagcucccgcgcccgguccugcccugcgaaccagcgcggcccccuggcgcugaggcugcuccggccauggccccucggccccgcgcccgcccaggggucgcugucgccugcugcuggcuccucacugacagggauggaagagaaaacuuaggaaguugaaguuuggcauuaaaauaaaggacucgccaccacucugugcaccuucuugagggaguucauucguccggagcgccucacagcuuagugcgccugcgcacgcgcgaacugcggccccgccucuccuuuggggacgggagacgugcgucgggucgcgggacgggggcugcgcaugcgccuucauuucgucagcccgcuguugcgugcugccagcgggaacuguguagggguagauuuucgcugcaguguuccccgagccuguuagacgcagcgcgccgggagacugagagaggaaaggauagaggaagugcugcccuaggcugcaugagucgaagcaagcguguuuccuucccgccaggcaagugcccuuagaaaccgggccccgcccccuuccuggccugcauucccauccccucucccggggcggaggugaggaccuccuugguuccuuugguucugucagugagccccuuccuuggccaugaagcucgugaggaagaacaucgagaaggacaaugcgggccaggugacccugguccccgaggagccugaggacauguggcacacuuacaaccucgugcaggugggcgacagccugcgcgccuccaccauccgcaagguacagacagaguccuccacgggcagcgugggcagcaaccggguccgcacuacccucacucucugcguggaggccaucgacuucgacucucaagccugccagcugcggguuaaggggaccaacauccaagagaaugaguaugucaagaugggggcuuaccacaccaucgagcuggagcccaaccgccaguucacccuggccaagaagcagugggauagugugguacuggagcgcaucgagcaggccugugacccagccuggagcgcugauguggcggcuguggucaugcaggaaggccucgcccauaucugcuuagucacucccagcaugacccucacucgggccaagguggaggugaacaucccuaggaaaaggaaaggcaauugcucucagcaugaccgggccuuggagcgguucuaugaacaggugguccaggcuauccagcgccacauacacuuugauguuguaaagugcauccugguggccagcccaggauuugugagggagcaguucugcgacuaccuguuucaacaagcagugaagaccgacaacaaacugcuccuggaaaaccgguccaaauuucuucagguacaugccuccuccggacacaaguacucccugaaagaggcccuuugugacccuacuguggcuagccgccuuucagacacuaaagcugcuggggaagucaaagccuuggaugacuucuauaaaauguuacagcaugaaccggaucgagcuuucuauggacucaagcagguggagaaggccaaugaagccauggcaauugacacauugcucaucagcgaugagcucuucaggcaucaggauguagccacacggagccgguaugugaggcugguggacagugugaaagagaaugcaggcaccguuaggauauucucuagucuucacguuucuggggaacagcucagccaguugacugggguagcugccauucuccgcuucccuguucccgaacuuucugaccaagagggugauuccaguucugaagaggauuaaugauugaaacuuaaaauugagacaaucuuguguuuccuaaacuguuacaguacauuucucagcauccuugugacagaaagcugcaagaauggcacuuuuugauucauacagggauuucuuaugucuuuggcuacacuagauauuuugugauuggcaagacauguauuuaaacaauaaacuaaaaggaaauaaucuccacguacuaccaucuugauuaaauuguguaauuuuuuauaggaauuaugaguuaucuguaguacuuggaaacagaaaauguguguauuuaaagacgaugccuaugcaguauauuguuugggauagauugcaaaauuucacacugcaugcuuugaaacaguuuuccuuagaaaaagcuuuugcuaucuuauccuguuuacauuauuucuuuauuuuaauucugcuugguguucuugcauugcauuuaaugaucccuuuucuccccaccuccacacacuacauuuuuuuuagauuuaaauaguuuuacuauuuuaaaugauugccguacaauuaguagacuugaagacaaguuuuaaauauuuuucuucaaaggcuuguuaaaccaaucauguuaaaaggaaauucuugguuuugguuuguuguuguuagcauuagucauauuugauuuagaggguaacuuaaaucaguuauuuuuagcuuuuuagaacuuugaucugcuagggauugucaaaauaaucuccuugaggcaucuuuauuuuuaaaaugagauuaaaguaugugauuugcuuguuauguggcuaauuaguggcaaagcuggaagucauucccagucuggacuuuaguucuuugcgccaaaacaugcuauauuauuuauuuauuuuuuugcuugucaaaguuauacuuaauucuguuuuauauuuguauguggcauuaauuuggguuugcacauuuuuauuggacuauuuuaguugugaagaagccuguucuaaaguuuaagucacaugacuaguauguggcaguugacuuaaacuccaauacucuuuacuaucauugacuuaaacucugauacucuuuacuauaauuauggaauugugcaaauaccucugaguuuaaaauauuauuuuuauuauuuuuggugcacauuccuaaaaguuaaggaaggagccucaguaauggaauugcuucuugaccuuuugcaaaccucaauuuagcaaaauaauuaggaacgaucuaauagugaugauacaguuuuuaacugcuggaucagcgacgccuauuucaaguagugauacuaacuaaacuuucgccggucuuuccugugucugugggccuuccuccuggugugacagacuuggggauuucuuguaaacuuccuaacuagucugaaccuuuuuauuucuuauugggaacugacacuucccuauacuuuaaaacucacauauguauauuuuuguacaucuaucuccuaauucaaaaguaauugagauugucauuucauuauaauuccgugaguaucuuuaaauuacuaucaaauauguuacuaaauaauuuaauaagaauauagaaaugaagccacugagauccuuaaaguugaaaccugauuguuauuauauuuucaguaaggauuuggagauuuuuggacauuuuuacucucauaaucuaugcaguacugaaaugaggucuaauaaauauaaccaauacauguuaggccauagguucuuaaauuuagcuaccuguucaccucaacuugagagcucuuaaaacccucaguguccagguugcagcucagacuaguuaaauaacguuuuaucccuagaaauguuuuuuuuaaagcuacccagaugauuccaauaggcgucaaggcuaauagccacugauucaggccuugcuauucaaaaguaugguccguaaaccagcagcaucccugagagcuuguuggaaacuagaauucagggaucuuuuguagaccuacugagacaggcgcuaccuguaccaacaucucuagaugauuccugugcauaauaaaaucugauaaacaaaggcaauagguuauucuuccugugcugguaaaucucuggcagggguccccagucaggaaaaagauuugaguauuaaggucuuucaaaaaaguuaacuggccauacucaacugucuauaaaaccucuauaaauuucuguuuuuaugucuaugaauuauuaaauaaaauuuaacucauuuuuaagaaauuacauuguucuacgcugcugcguaucauucaauguugaugugaaaaauucaaugacuuucagcggcccgguggaagacauguuuggauauacuguucaacaauaugaaaaugaagaaggaaaaugggugcuuauugguucuccguuaguuggccaacccaaaaacagaacuggagaugucuauaaguguccaguugggagaggugaaucauuaccuuguguaaaguuggaucuaccaguuaauacaucaauucccaaugucacagaaguaaaggagaacaugacauuuggaucaacuuuagucaccaacccaaauggaggauuucuggcuugugggcccuuauaugccuauagauguggacauuugcauuacacaacuggaaucuguucugacgucagccccacauuucaagucgugaauuccauugccccuguacaagaaugcagcacucaacuggacauagucauagugcuggaugguuccaacaguauuuacccaugggacaguguuacagcuuuuuuaaaugaccuucuugaaagaauggauauugguccuaaacagacacagguuggaauuguacaguauggagaaaacgugacccaugaguucaaccucaauaaguauucuuccaccgaagagguacuuguugcagcaaagaaaauaguccagagagguggccgccagacuaugacagcucuuggaauagacacagcaagaaaggaggcauucacggaagcccggggugcccgaagaggaguuaaaaaagucaugguuauugugacagauggagagucucaugacaaucaucgacugaagaaggucauccaagacugugaagaugaaaacauucaacgguuuuccauagcuauucuuggcagcuauaaccgaggaaauuuaagcacugaaaaauuuguggaggaaauaaaaucaauugcaagugaacccacugaaaagcauuucuucaaugucucugaugaauuggcucuagucaccauuguuaaaacucugggagaaagaauauuugcccuggaagccacagcugaccagucagcagcuucauuugaaauggaaaugucucagacuggcuucagugcucauuauucacaggacugggucaugcuuggagcaguaggagccuaugauuggaauggaacaguugucaugcagaaggcuagucaaaucauaaucccucgaaacacaaccuuuaauguugagucuaccaaaaagaaugaaccgcuugcuucuuauuuagguuacacuguaaacucugcuacugcuucuucuggagaugugcucuauauugcuggacagccucgguacaaucauacaggccaggucauuaucuacaggauggaagauggaaacaucaaaauucuccagacgcucaguggagaacagauugguuccuacuuuggcaguauuuuaacaacaacugacauugacaaggauucuaauacugacauucuucuagucggagccccuauguacaugggaacagagaaggaggagcaaggaaaaguguauguguaugcucucaaucagacaagguuugaauaucaaaugagccuggaaccuauuaagcagacgugcuguucaucucggcagcacaauucaugcacaacagaaaacaaaaaugagccaugcggggcucguuuuggaacugcaauugcugcuguaaaagaccucaaucuugauggauuuaaugacaucgugauaggagcuccgcuggaagaugaucacgggggagcuguguacauuuaucauggaaguggcaagacuauaaggaaagaguaugcacaacguauuccaucagguggggaugguaagacacugaaauuuuuuggccagucuauccacggagaaauggauuuaaauggugacggucugacagaugugacuauugggggccuugguggugcugcccucuucuggucccgagauguggccguaguuaaagugaccaugaauuuugagccaaauaaagugaauauucaaaagaaaaacugccauauggagggaaaggaaacaguaugcauaaaugcuacaguguguuuugaugugaaauuaaagucuaaagaagacacgauuuaugaagcugauuugcaguaccgugucacccuagauucacuaagacaaauaucacgaaguuuuuucucuggaacucaagagagaaagguucaaaggaacaucacaguucgaaaaucagaaugcacuaagcacuccuucuacauguuguagagaugacaagcaugacuuucaggacucugugagaauaacguuggacuuuaaucuuaccgauccagaaaaugggccuguucuugaugauucucuaccaaacucaguacaugaauauauucccuuugccaaagauuguggaaauaaggaaaaauguaucucagaccucagccugcaugucgccaccacugaaaaggaccugcugauuguccgaucccagaaugauaaguucaacguuagccucacagucaaaaauacaaaggacagugccuauaacaccaggacaauagugcauuauucuccaaaucuaguuuuuucaggaauugaggcuauccaaaaagacaguugugaaucuaaucauaauaucacauguaaaguuggauaucccuuccugagaagaggagagaugguaacuuucaaaauauuguuucaguuuaacacauccuaucucauggaaaaugugaccauuuauuuaagugcaacaagugacagcgaagaaccuccugaaacccuuucugauaauguaguaaacauuucuaucccgguaaaauaugaaguuggacuacaguuuuacagcucugcaagugaauaccacauuucaauugcugccaaugagacagucccugaaguuauuaauucuacugaggacauuggaaaugaaauuaauaucuucuacuugauuagaaaaaguggaucuuuuccaaugccagagcuuaagcugucaauuucauuccccaauaugacaucaaaugguuacccugugcuguacccaacuggauugucaucuucugagaaugcaaacugcagaccccauaucuuugaggauccuuucaguaucaacucuggaaagaaaaugacuacaucaacugaccaucucaaacgaggcacaauucuggacugcaauacauguaaauuugcuaccaucacauguaaucucacuucuucugacaucagccaagucaauguuucgcuuaucuuguggaaaccaacuuuuauaaaaucauauuuuuccagcuuaaaucuuacuauaaggggagaacuucggagugaaaaugcaucucugguuuuaaguagcagcaaucaaaaaagagagcuugcuauucaaauauccaaagaugggcuaccgggcagagugccauuaugggucauccugcugagugcuuuugccggauuguugcuguuaaugcugcucauuuuagcacuguggaagauuggauucuucaaaagaccacugaaaaagaaaauggagaaaugaaauauuuuaugaaagaaaauaauaacaauuauucaauaaucuauccucagguuugccucaaauaugugacaagaaauguauaauucaugacauagucauguaacuauguaauccaucagggauucauuacuuggaaaaugacaggucaugcauuauccaaaaacaauaccaaaaagacauauuuuauaaaaugacaaaaaauauuuuacauaauuacucauuuuuguugaguaagcaaaauuacaaaguguuuuuaaaaaaaccuguacaaauauguuuauguauuaaaucaccauccaaaauauuuaaggaauauauaaaaagauuuuuaugaucauagaaacaucuauuuucaaaacaauauaaauuaagcuuuuccccuugauuccuguuggauauccauguucagcaugacagucagcacucguaaaugccaagaaaagaauuaccugaaaaagaucauuucucccuauucaaaugagaauauuuucccuugguagaauccauauacaauauggauugaaaauuaagucaccaagaauacauuuagcaucuuuguguuggguucuauaccuaaaaauuuucccucccugcccaaggugauuggaaaguacugcaauugagcuaaaauuuuaucuaggauggaaaaucaggauagacucguuuaaaaacaaguauauuaaauggguuaaauuaagcuuuuacagaacaugcuuaauuuugauauugagcucuaaaugcaaaacucuuuuauacugaaaaaacacuuaaaguaguuuuguguggcaucacagugauuugucaugaaaagccauauaugggggacaugcuaaaauggcuucugaaugaaauacgacagcagagaaagaugccacugaaaugcugaaauuaucuuugcugagcagcuuuugaaugcuaaggguuccaguaugugacccaaagaaagaguugucucaacuccuugguacaggguucauucaaacccccaagcugugagaguguguuuauuuuuaauuuuuuaaaagguauuuaauuuccaaccacacuucuuauuuuuuugaaaagacaauuuuccauuucaguauuacauuuuaccaagaagucacugcuuuuuagguguguugcaucaauauuuaaauaaaaucccagaaauguauuuuaaagaauuucagguuugaaaacucaaaccaacaggaagauauca

SEQ ID NO: 377 - RNA, 2245 nt, Homo Sapiens
acauugacuguaaaggaaccaaugugaagagugguguuuccugagcaaacggugacuuaaaaaaaaaaaaaaaaaaguggugggguggaggucagcagugccacagaacaaacuggaguuaagaaaugucguucuucagauuuaaaaagaaaaccuuuacugaaucagcugaguguuaauaauacgaauuuccuuuucuugccaauucugaucugaacagaaaauccaagaacagggauauguguggauuacaguuuucucugccuugccuacgacuguuucugguuguuaccuguuaucuuuuauuauuacuccacaaagaaauacuuggauguucgucuguuugucagcucugcacugggagacaaauuaacugccguaacuuaggccuuucgaguauuccuaagaauuuuccugaaaguacaguuuuucuguaucugacugggaauaauauaucuuauauaaaugaaagugaauuaacaggacuucauucucuuguagcauuguauuuggauaauucuaacauucuguauguauauccaaaagccuuuguucaauugaggcaucuauauuuucuauuucuaaauaauaauuucaucaaacgcuuagauccuggaauauuuaagggacuuuuaaaucuucguaauuuauauuuacaguauaaucagguaucuuuuguuccgagaggaguauuuaaugaucuaguuucaguucaguacuuaaaucuacaaaggaaucgccucacuguccuugggagugguaccuuuguugguaugguugcucuucggauacuugauuuaucaaacaauaacauuuugaggauaucagaaucaggcuuucaacaucuugaaaaccuugcuuguuuguauuuaggaaguaauaauuuaacaaaaguaccaucaaaugccuuugaaguacuuaaaagucuuagaagacuuucuuugucucauaauccuauugaagcaauacagcccuuugcauuuaaaggacuugccaaucuggaauaccuccuccugaaaaauucaagaauuaggaauguuacuagggauggguuuaguggaauuaauaaucuuaaacauuugaucuuaagucauaaugauuuagagaauuuaaauucugacacauucaguuuguuaaagaauuuaauuuaccuuaaguuagauagaaacagaauaauuagcauugauaaugauacauuugaaaauaugggagcaucuuugaagauccuuaaucugucauuuaauaaucuuacagccuugcauccaaggguccuuaagccguugucuucauugauucaucuucaggcaaauucuaauccuugggaauguaacugcaaacuuuugggccuucgagacuggcuagcaucuucagccauuacucuaaacaucuauugucagaaucccccauccaugcguggcagagcauuacguuauauuaacauuacaaauuguguuacaucuucaauaaauguauccagagcuugggcuguuguaaaaucuccucauauucaucacaagacuacugcgcuaaugauggccuggcauaaaguaaccacaaauggcaguccucuggaaaauacugagacugagaacauuacuuucugggaacgaauuccuacuucaccugcugguagauuuuuucaagagaaugccuuugguaauccauuagagacuacagcaguguuaccugugcaaauacaacuuacuacuucuguuaccuugaacuuggaaaaaaacagugcucuaccgaaugaugcugcuucaaugucagggaaaacaucucuaauuuguacacaagaaguugagaaguugaaugaggcuuuugacauuuugcuagcuuuuuucaucuuagcuuguguuuuaaucauuuuuuugaucuacaaaguuguucaguuuaaacaaaaacuaaaggcaucagaaaacucaagggaaaauagacuugaauacuacagcuuuuaucagucagcaagguauaauguaacugccucaauuuguaacacuuccccaaauucucuagaaaguccuggcuuggagcagauucgacuucauaaacaaauuguuccugaaaaugaggcacaggucauucuuuuugaacauucugcuuuauaacucaacuaaauauugucuauaagaaacuucagugccauggacaugauuuaaacugaaaccuccuuauauaauuauauacuuuaguuggaaauauaaugaauuauaugagguuagcauuauuaaaauauguuuuuaau

SEQ ID NO: 378 - RNA, 110 nt, Homo Sapiens
augaguguucagcaucacauacacuaaaauugaaaugauacagaaaagauuagcauggccccuaagcaaggaugacaugcaaauuugugaagcauuauauuuauauuguu

SEQ ID NO: 379 - RNA, 7855 nt, Homo Sapiens
gguggggcggggaaagaagcccugagccgggaucuggcacucccaggacucccggccgggguagcucuucacuccucagcgcgacgucgugucgaguucccaaaaagcuccgcaggggcuguagggaggcauacaagaauuaaauucugaauaagucugcagguaggauggacaguuauuuuaaagcagcugucagugacuuggacaaacuccuugaugauuuugaacagaacccagaugaacaagauuaucuccaagauguacaaaaugcauaugauucuaaccacugcucaguuucuucagaguuggcuuccucacagcgaacuucauugcucccaaaagaccaagagugcguuaauaguugugccucaucagaaacaagcuauggaacaaaugagaguucccugaaugaaaaaacacucaagggacuuacuucuauacaaaaugaaaaaaauguaacaggacuugaucuucuuucuucuguggauggugguacuucagaugaaauccagccguuauauaugggacgauguaguaaaccuaucugugaucugauaagugacauggguaacuuaguucaugcaaccaauagugaagaagauauuaaaaaauuauugccagaugauuuuaagucuaaugcagauuccuugauuggauuggauuuaucuucagugucagauacucccuguguuucuucaacagaccaugauagugauacugucagagaacaacagaaugauaucaguucugaauuacaaaauagagaaaucggaggaaucaaagaauuggguauaaaaguagauacaacacuuucagauuccuauaauuacaguggaacagaaaauuuaaaagauaaaaagaucuuuaaucaguuagaaucaauuguugauuuuaacaugucaucugcuuugacucgacaaaguuccaaaauguuucaugccaaagacaagcuacaacacaagagccagccauguggauuacuaaaagauguuggcuuaguaaaagaggaaguagauguggcagucauaacugccgcagaauguuuaaaagaagagggcaagacaagugcuuugaccugcagccuuccgaaaaaugaagauuuaugcuuaaaugauucaaauucaagagaugaaaauuucaaauuaccugacuuuuccuuucaggaagauaagacuguuauaaaacaaucugcacaagaagacucaaaaaguuuagaccuuaaggauaaugauguaauccaagauuccucuucagcuuuacauguuuccaguaaagaugugccguccucauuguccugucuuccugcgucugggucuauguguggaucauuaauugaaaguaaagcacggggugauuuuuuaccucagcaugaacauaaagauaauauacaagaugcagugacuauacaugaagaaauacagaacaguguuguucuagguggggaaccauucaaagagaaugaucuuuugaaacaggaaaaauguaaaagcauacuccuucagucauuaauugaagggauggaagacagaaagauagauccugaccagacaguaaucagagcugagucuuuggaugguggugacaccaguucuacaguuguagaaucucaagaggggcuuucuggcacucaugucccagagucuucugauuguugugaagguuuuauuaauacuuuuucaagcaaugauauggaugggcaagacuuagauuacuuuaauauugaugaaggcgcaaaaaguggcccacuaauuagugaugcugaacuugaugccuuucugacagaacaguaucuucagaccacuaacauaaagucuuuugaagaaaauguaaaugacucuaaaucgcaaaugaaucagauagauaugaaaggcuuagaugauggaaacaucaauaauauauauuucaaugcagaagcaggagcuauuggggaaagucaugguauuaauauaauuugugaaauaguugauaaacaaaauacaauagaaaauggccuuucuuuaggagaaaaaagcacuauuccaguucaacaaggguuaccuaccaguaagucugagauuacaaaucaauuaucggucucugauauuaacagucaaucuguuggaggggccagaccuaagcaauuguuuagccuuccaucaagaacaaggaguucaaaggaccugaauaagccagauguuccagauacaauagaaagugaacccagcacagcagauaccguuguuccaaucacuugugcuauagauucuacagcugauccacagguuagcuucaacucuaauuacauugauauagaaaguaauucugaagguggaucuaguuucguaacugcaaaugaagauucuguaccugaaaacacuugcaaagaaggcuugguuuugggccagaaacagccuacuuggguuccugauucagaagcuccaaacuguaugaacugccaagucaaauuuacuuuuaccaaacggcgacaccauugccgagcaugugggaaaguauuuuguggugucuguuguaauaggaaguguaaacugcaauaucuagaaaaggaagcaagaguauguguagucugcuaugaaacuauuaguaaaggugaguauuaacuugauauauuuucuuccaguaauugaauauaucuuaaaauuaauuggauugugacaaagauaaacuucuuuauuuucuuaaggcaaggaccuaguguugaauuaucuggcuuaggugggacaucccaaggcuugguuucucuucuuuuuguuccacucucacaauuaauacuaccaaucuggaaaggaagcauucaguuucuggaguggcaguucauuaacuuuuaacagguaccaagucccuaaaugcugcauuucaucugccuauuuguuuuugucaucaucauugucauguuaaucaucuuaaucuaaauaaacacuuacagauaccuacucaggcauuugaaaggaugaugaguccaacugguucuaaucuuaagucuaaucauucugaugaauguacuacuguccagccuccucaggagaaccaaacauccaguauaccuucaccagcaacuuugccagucucagcacuuaaacaaccagguguugaaggacuauguuccaaagaacagaagagaguaugguuugcagaugguauauugcccaauggugaaguugcagauacaacaaaauuaucaucuggaaguaaaagauguucugaagacuuuaguccucucucaccugaugugccuaugacaguaaacacaguggaucauucccauucuacuacaguggaaaagccaaacaaugagacaggagauauuacaagaaaugagauaauucagaguccuauuucucagguuccaucaguggaaaaauugucuaugaacacaggaaaugagggguuaccuacuucugguucauuuacacuagaugaugauguuuuugcagaaacugaagaaccaucuaguccuacuggugucuuaguuaacagcaauuuaccuauugcuaguauuucagauuauagguuacugugugauauuaacaaguaugucugcaauaagauuagucuucuaccuaaugaugaggacaguuugcccccacuucugguugcaucuggagaaaagggaucagugccuguaguagaagaacauccaucucaugagcagaucauuuugcuucuugaaggugaaagcuuucauccuguuacauuuguccuaaaugcuaaucuacucgugaaugucaaauucauauuuuauuccucagacaaauauugguacuuuucaaccaauggauugcauggcuugggacaggcagaaauuauuauucuauuguuauguuugccaaaugaagauacuauuccuaaggacaucuucagacuauuuaucaccauauauaaggaugcucuaaaaggaaaauacauagaaaacuuggacaauauuaccuuuacugagaguuuucucaguagcaaggaucacggaggauuccuguuuauuacaccuacuuuucagaaacuugaugaucucucauuaccaaguaauccuuuucuuuguggaauucuuauccagaagcuugagauucccugggcaaagguuuuuccuaugcguuuaauguugagauugggugcagaauauaaagguaaguuuuagaguaauaaguuaaauugcauauuuucaaauauacugaauguaaagacuuucagggaaucauuaaaaucaauuuuaauggauuaauggaacuacuuuuguuuugcuaugcuuuuaaaguucuaagacaacccucuucuacuaccagguuggucuagauaacugugguaugucuucaaguuucuagauguucauaaguucuuuuauuaccuaaaacuuuucuucuuaaauuucagaacaaaacagaaaacuuucacagugcagguugaguaugccauaucugaaauguauuggaucaguuuuuuggauuuuggacuuuuucagauuuuggaauauucacagaguacauaccaguugagcaucccaaauucaaaaucugaaaugcuccagugagcauuucuuuugagcaucacguuggcauuugaaaaaguuauagaccgggcaugguggcucacgccuguacucccagcacuuugggaggccaaggcgggcagaucacaugaggucaggaguucgagaccagccuggccaacauggugaaacccugucucuacuaaaaauacaaaaauuagcugggugagguggcaggcgccuguaauugcagcuacucaggaggcugaggcaggagaaucaccugaacccaggaggcagauuugcagugagcuaagaucaugccucugcauuccagccagggugacagagcaagacuacgucucaaaaaaaaaaaaaaaaaaaaaaaaaaacauauccugcuccucuaacaagcaucagaggccgaaaaccucuuuuuggagaaauaggacacacuauuaugaacuuacuuguugaccuucgaaauuaccaguauaccuugcauaauauagaucaacuguugauucauauggaaaugggaaaaagcugcauaaaaauaccacggaaaaaguacagugauguaaugaaaguacuaaauucuuccaaugagcaugucauuagcauuggagcaaguuucaguacagaagcagauucucaucuagucuguauacagaaugauggaauuuaugaaacacaggccaacagugccacuggccauccuagaaaagugacaggugcaaguuuugugguauucaauggagcucuaaaaacaucuucaggauuucuugcuaaguccagcauaguugaagauggcuuaaugguacaaauaacuccagagaccaugaauggcuugcggcuagcuuuacgagaacagaaagacuuuaaaauuacaugugggaaaguugaugcaguagaccugagagaauacguggauaucugcuggguagaugcugaagaaaaaggaaacaaaggaguuaucaguucaguggauggaauaucauuacaaggauuuccaagugaaaaaauaaaacuggaagcagauuuugaaaccgaugagaagauuguaaaauguaccgagguguucuacuuucuaaaggaccaggauuuaucuauuuuaucaacuucuuaucaguuugcaaaagaaauagccauggcuuguagugcugcgcugugcccucaccugaaaacucuaaaaaguaaugggaugaauaaaauuggacucagaguuuccauugacacugauaugguugaauuucaggcaggaucugaaggccaacuucugccucagcauuaucuaaaugaucuugauagugcucugauaccugugauccauggugggaccuccaacucuaguuuaccauuagaaauagaauuaguguuuuucauuauagaacaucuuuuuuagugaaagaaugugccauauuacauauugcaaccuaauuuguuaaaacuaacuccagcacuaaagcugaaaugccacaaacacuaaaaguauaaauaugucugauuuuugaaacacauaagcuuugcucuuuaggcaggaaugaucuuuucaaaucauuagcacaauauuuaaauaucuaaaaauuuaagagauccauacuuucuguagcuuuacaauuaauuuaaguacuaaaaagacaaggauuucuuuuaagaaauuuauagcauuuacuguguuauuuaaaugcuaagccaaaguaucugcacuuagguauaccucuuuaugccaauaaugauuuuaaugaaggcucuuuucagauguaaccuuaugaaggaaauaucugcuuuguguauaugccaguuagaauacugguuucuaaagucugucaaauuguauuucaguggcacaaaaaccaguuuugaggucuuagacuuauaauucuuugaauaaaacugauaacuuauuuguauaauuggaguggagaccuaccuccauaauuagauaaacucuuuuuggauuauaaucagaauuuugccuuuuuucuucucaaauuauuacauauguauguauuauauauccacauauauaguuuucccugauuaaauggauauuaaaauaauugcgggugcuucaggacuuuuugcuucuauauuuaaguauauuguuuuuauagcaagaacauauucugaauguuuuauaaaucuuuaauaauuuauauguagguaauauuuuuguaucacaaugcauuauuuuuuuccuccuuuccuuccaaacuauaccacuguauuuaccacuucuaagagugacugacgacgggccagaugacccuugaaguagucauuauguagcaauaaaugaagccugaaacagguuuuuuuacuuccacuuuaauccuuagaaauuucuuggcaacuucgcauauuuucauugacaccaguguauaaguauaaauuuaaaugaacuaauuacuuuugcauauuuuaaauucuuuauaugguaguuauuuuuuauaacaggauauuaacauaaguuaaauccuauguauuugaaauuguuacagagcuuuccucuuuacuucaaacagcaaaaaaguggggggcauauuguaguccugucauuuaaguuauguaaaaaauuuaaucauuauuuugaugcuuuaaacauucucauguguaauauauguuuuuguaucaaaaacacucauauauuucaagaaaaagaaauuauguuaaauagcccuguuuuaagaaaaauauuuaugaagcaucucaacuugaagaucaagucaaaguuauaacucaggaucugaggucucaagcuaggagagacugagaauuuuaaucaguuugggcauauaguuuggacugaaucacaucuguaguacuuagccaaagacaauuuggaggagaauaucagccuucuggaaguagcuacuuccugaacaauguaaagugucgcagauauucaauaaaauggcaaccuguuauaauuugugaaauuuauugaaaugguguaagaugaaaacaauugcauaucaaacccaauuuauguuuucuaaauauaguguauguauucugccauguaaguaauugaacagucuuaaaauaaccaaaugguagagggcuguuccaugaugggacagcuuuggauuuguuuucauaaaaucucuauauucaauaaaaauuggaauuaugugccugaaguuuggaggcacauuuugaaguauucuuuguagacauauaguauguuucugaauguguuuguuacuuauuuggucauugguacuuaauuugaaauuuuaauuuuuuaagagaagaaauagaaugguucuuuguacucagucugcaaugaucuauuuuuggcuuaugucuuuuaauacuacucucuuucucugaauuuugaaauaugaaguaaaaucuagcccauuuguuuua

SEQ ID NO: 380 - RNA, 1532 nt, Homo Sapiens
cuccguuugguuccgcuucgcuggcgcccgccgggcucuucccccgccgaggccugugguuuguggagucgaauuucccugccaccagugcccgguuagcaggggcgccagccugggcgccugcgcggacggcgggcgucgucaccauggcagcauccgcuggaggcccaggaucuuggagugaaaauauacuggaauauuuucugagaaauagccagauuacagcagaagacggugcugagaucaccugguaucaugcagcuaaccacaaggcacaaacaaaugaggcacugaaaaguacugcucacaugauagaggcugauguccuucuuccaagugauggaucagaacacagccagccaauuauggcccaucccccugaaacaaacagugauaauacucuacaggaguggcugacugaaguuaugaaaagcaauaaaggcaucaagcuggauuucaaaagucuggcaguuguagaaccauccaugaugcucuuggaaaaugugaagaggcaucugaagcguccuguauggauuaaugccgauauucuuccugguccaaauggaaauagcaaaguaauagaugcaaaaccauuuuuagacaccgugauauccuucuuuccagacgugacguuuucccuggguuggacaacaggauggcauccugagaaagucaaugaaggguacaguuggacaauggugaaagagauggaauauauauguaaugaacuaagucagccuguaacguucccugucagagcagcauuagucaggcagucuuguucucaguuacuuuggcuguuaaagaaaucaaacagguacagccugacuauuuggacuggaaaaaaugauaacuauuccguugaagauuuacuuuacauuagagaccauuuugacaaaaaacaaguuuucuaugacaucuuggaaccacaaaaccaugaauuuaaacaagccauuggaaucaaaguuaaucucuaagaagaagauucucaauuauuuccuguguuuugguuucauaauccuucucuccauuggucugaauuaauuaccauauaaauuaugguuauugauugacguuccaagucaucuaaucaagaaacguuuauuguaugcuuacucugugggcauauguccuuauaauagugcacuuacauaaaagauuuggaaagaagagauuuauuuacacacguggccuagucuaauaauaauucaggaaaaugauacucugcaccccuucauaaaaauaguuuugauaaacuaaagaugauuggcagaauccauaugucauaaaacagguauaaaucacaugugcuuggcacuugcauuacagagauuaugaaaaauaugguacucuuuuccuuuuuccuagaaaacugguuauuuuagagauaacaaaaaaggaagagggcuuuuaaaauguuuuuaauuuucacaggggucagcagcugucucauaucaagaucuauuaauccauuuccugaaacuguagauuaaauuagauagaucuagaauuuccaugugauugagaagcau

SEQ ID NO: 381 - RNA, 2095 nt, Homo Sapiens
cgggauuuagaucacgucccgcaggccggcggaaguagcugauacucucauugguugcaaaaccuugaucugugaaagcgggcguuuuggaagauaccggaaguagagucacggagagguaggauccggaaguggggcugccucuuuaaauaacaaaaaucugagguauuaagaaauggagagaaaaauaagcagaauccaccuuguuucugaacccaguauaacucauuuucuacaaguaucuugggagaaaacacuggaaucugguuuuguuauuacacuuacugauggucauucagcauggacugggacaguuucugaaucagagauuucccaagaagcugaugacauggcaauggaaaaagggaaauauguuggugaacugagaaaagcauuguugucaggagcaggaccagcugauguauacacguuuaauuuuucuaaagagucuuguuauuucuucuuugagaaaaaccugaaagaugucucauucagacuugguuccuucaaccuagagaaaguugaaaacccagcugaagucauuagagaacuuauuuguuauugcuuggacaccauugcagaaaaucaagccaaaaaugagcaccugcagaaagaaaaugaaaggcuucugagagauuggaaugauguucaaggacgauuugaaaaaugugugagugcuaaggaagcuuuggagacugaucuuuauaagcgguuuauucugguguugaaugagaagaaaacaaaaaucagaaguuugcauaauaaauuauuaaaugcagcucaagaacgagaaaaggacaucaaacaagaaggggaaacugcaaucuguucugaaaugacugcugaccgagauccagucuaugaugagaguacugaugaggaaagugaaaaccaaacugaucucucuggguuggcuucaguggagaggcgaugagcaaggagcagauucuaggugugcuuagaggcagcaggauuugcugaugaagggguuaugacugagcaaauaagacugagaaggagcagccaggagcugcuguaaguaaagaugauuccauuauuucaagucuugaugucacugauauugcaccaaguagaaaaaggagacagcgaaugcaaagaaaucuugggacagaaccuaaaauggcuccucaggagaaucagcuucaagaaaaggaaaaagggaggaagaaggagacuucagagaaagaggccgugugauggaagcaaaaucagagagaaaagaugcuaagcugcugccuuugaauaaggaggaacgugagccaacagauccaagaacugaagcucuaggcaguggaaaagccaaggaaacugaucuucccuucgagccuccggagggaguguagcccugccaacaccuuuauuuuagccccauaacagucauuucagacuuguggccuccagaauuuuaagagaauaaauuuuuauuguauuaagccauuucuaggccugauucuucacuaccugagacgucuaaaaaggagcacaucucagcugaaaacaugucuuuagaaacucugagaaacagcagcccagaagaccucuuugaugagauuuaacagucucaaaaaauacuuugauguucacuagacuauguuuucuauucauuucuuuaaaaugaaaaaggagaauuucaagucagcagccgcuauuaccguaucuuacaauuuaauuacauacacagugaauugaaaccauugugcaaaauggauuacacauguauacaaagauacgauuugaugaugacacuggcacauuauucuaaacuauucauucagcaugccuauaauuacauaaauuguaugagacuuuuuguugcaaaggacacauuuaucauauucauucacacauauuauaugugauagcuguccaacauccugucugggaagauuuugaaaacaggacaaagaaaacaucauuuuaaaaugucuucagcuuuuuuugaauagacguauucaaacauauucugaacauugauguuugaacauuuuaauuugugugaugauguagaaaauauaauuuuaguuuguacauaaacauugugaaaaucugauaauaaaauuuuugauacauugaa

SEQ ID NO: 382 - RNA, 6314 nt, Homo Sapiens
gcugcacugggugucaagcgccacgggguuugauggggacuccuucugguuccacccucgcccacucacuucucgggcuggccauaaugcugcacagagccccggccagccauuaauaucaggcgcaggagaaaacccaguaaaaucacuuaccagucuuccaccuccggugcugaucuagcaagagccugacccgcuggccagacucaagcucugcaccagguauuaccacccuggcgacggcuccggagcgucacugacaaccacccggaaaugguacuaucgcuuccggggcugccuagcgcgcggcgggaaauuguuucccagagcccggauucgugaagcaguugagugcugcagcggcagucgucgccccugccgccgcugccaccgaaggaagcaucccagacaccgggaagauggaagaugguaccccaaagcauaucauccagaugacaggauuuaagauggaagaaaaagaagcgcuagucaaauuacuuuuaaaacuagauugcacuuuuauuaagagugagaaauacaaaaauuguacacaucuuauagcugaacgccuauguaagagugaaaaauuuuuagcagcuugugcggcaggaaaguggauacuaaccaaggacuauauaauucauagugccaaaaguggcagauggcuugaugaaacaacuuaugaauggggauauaaaauugaaaaagauucccguuauucaccucaaaugcaaucugcaccuaaaagauggcgugaagaacugaaacgcacuggugcuccaggagccuuccacagauggaaaguuguccuccuuguuagaacugauaagcgaagugauucucuuauaagaguuuuggaggcuggaaaggcaaauguuauuuuaccaaaaaguucaccaaguggaauaacucaugugauugccaguaaugcaagaauuaaagcugagaaagaaaaagauaacuuuaaggcuccauuuuauccaauucaguaucuaggggauuuucuuuuagagaaagaaauucagaaugaugaagauucccaaaccaauucuguuuggacugaacauagcaaugaagaaacaaacaaagauuucaggaaagaugcaggauuucuugaaaugaaaggugccuuaagagagaccauguauagaacccagaaagaaaugcaaaaucaugaagauguuaauguugguucuauuuugauucaacaucacaaaaaagaaaaauucagugguuccaguaaagauuugaaauuuguuaaaaugagaaauaccuuuggaagccauacauaugaaaaucagaaggaaauuaagaaaaaagaugaagauauucagaggaguuauacuuugaggagaaaacgcaagaaaggaaaagaaagcaauugcaagaaaggcguugaacaugaaaaaauaaaaaguaccuuaagaaggcacauauauaauagagaucagaaagaaaugaagaauucuauuuuugcugaauaugccaaagaaucaaaagccauggcuauuaagacagauguggauguuguugaaauaaaaaauaccuuaaggaagcacauauauagagcucaggcugucagauacaacugcauuagaauagauaaacaaccaguguacaacguagagguuaaaaaugcugaauuucccagagguguauuaaauuuaauugaaagccucauagaaggacauuuuuuuaaagaagcaauugaggaacuuuccacuuugcaggcacauuauaucccuccuguaugcguucuucaugcccuucuagagaacguucuacaggauaacauagauacauuuucuggucgauacuuucauauauugucagcucuucuucaccugcauccuccuuggaagucuccagccaugucgagauauuauuuagaguuguuucaguguccaacuuguaugaaaggagcauggucuuuaguagaaguccuuaucaggucuugccuuuucaaugaaagcuuuugucaucaaauuucagaaaauauuggcuccaaggugcuccaccugacgcuacucaaauuuuucuuuaauuuaauugaaagugaaguacaacaucugagucaaaaguuguaugacuggucagauucucagaaucugaaaauaacaggaaaggcaaugcuucuugaaauuuuuuggucaggaagugaaaccucugggcuuuugaccaaaccaguaaauaugcuuuuggaauggacuauauauucucacaaggaaaaauucaagucuaaugauaaagaauaauucuguauauaaacaguggagguagauaaaucuaucuucuuuuauaguccuaucucuccuauuuauaaaaaucuacaaaaaccagguauuuucucauuauuuuaauggaauuauuuccuaacaaacuugaugguauuggauaaaauuaaaguuuauucuaaacuguuaaguuguagguccuuggaaaauuugcuuuguuaacucuuuugucauguggagagagagagagauggaggggagagaauuaguuagcuaggguucuuaagaauaccuuuaaucauuacauacccuguauuuuuaaauagcuauguuuugccccucaaaaaguauucaaaauaaauacuaacagaaauucaauauuguaauauauuuuaguaauuuuuuuguaucuuaauguuaggucuucaaacaugaacuagcuuacuuauuggcuggaauucuuggagcagcaauagauuauuggauuuuccuuggucuuaagauggguagaaaugugaugcgacacaugucugaugacuuaggaaguuauguuucucuuucgugugaugacuuuucuucacaggaauuagagauuuucauuugcuccuuuuccuccuccuggcuucaaauguuuguugcagaggcagucuuuaaaaaguugugucuacagagcucuggcaguguuucuucugagccacucucucuucagaaaaugguauauuccuauuuaccagccuuggggaaaacuggugugcuugggucuggaaagauucaggugucaaagaaaauaggacagcggccuuguuuugacucucagagaaccuuacuaaugcugaaugguacuaaacaaaaacaagucgaagggcugccagaguuacuagaccugaaccuugcuaaauguuccucaucauuaaaaaaauugaaaaagaagucagaaggagaauugucauguuccaaggagaauugccccucuguaguuaaaaagaugaauuuucacaagacuaaucuaaaaggagaaacagcccugcauagagcuugcauaaauaaccaaguggagaaauugauucuucuucucucuuugccaggaauagacaucaauguuaaagacaaugcuggcuggacgccuuugcaugaagccuguaacuauggcaacacaguguguguccaggaaauuuugcaacguuguccagagguagaucugcucacucaaguggacggggugacuccuuugcaugaugcacugucaaacggacauguagaaauuggcaagcugcuacuacagcaugggggcccagugcuuuuacaacagaggaaugcuaagggagaauugcccuuggauuaugugguuucaccucaaaucaaagaagaacuguuugcuauuacaaaaauagaagauacaguggagaacuuucaugcacaagcagagaaacauuuucauuaccagcaacuugaauuuggcuccuuuuuacuuaguaggauguugcuaaauuuuuguucaauuuuugauuuaucuucagaguucauuuuagcuuccaaaggguuaacucaucuaaaugaacugcuuauggcuuguaaaagucauaaagaaaccaccaguguucauacugacugguuacuggaucuuuaugcuggaaauauaaagacauugcagaaacucccacacauucuuaaggaacugccugagaauuugaaaguguguccugggguacacacugaggccuugaugauaacauuggaaaugaugugucggucagucauggaguuuucaugaugaugcuagaaaguauggauugacuuucuaaaucuguucaguuugcauugguacuuacuguggacuucauagcuuacugacagauaguaauuugauuuauuuauugacagacuuugcagccuugcuaaauuuuaaaagcauuuuuaaaaaaacuucuacaaaacucuaguaugggcuucugacuuuuuccaggguguagaauuugacucaaaaguaaaaauaauuuuguuuuaguauauucuacuuucauuaauguuuuuuuguucugaaagugauauuauauuguacauguaaaauuaauuuaaauauuuuuucaaauaaaaauguaauguccuguauucuagauguucuaggucuuagaaucauggcaagcauauucauacaaaugcguaccuauaaacuuguagcuccugacucuuagggauggauuuugaggaaaaaacaagacuaaacaaaaacauguagcucccuauuucuucucucuagguuguuggacugaaauaugcauuuuagcuuuguguguuucuaaaauaaacauuucuaaaauuuacaguaauaauuaauauucuuuugguuuuuaaaugcagcaaauaugcagagucugacaguucaauuccuugaucuguuuuauuuuagcaauucauauacaaaauguaucugucgcugcccuauguaacccaguauucuguaccugaaaacauucugcugcauagguuuaugaguuuaauauuaagauauugaguggcaucuaaguaauagauuugagauuauuuaagaucuuaauauauaguaugaauuuacugaguaguaauguuuuaauuugcaguuuuuccuuauagcaguuuguaguaaaacuaaaagaaaggguguggauaauaaccacuuuugagauuggaguuucuucacuacugggaguaaguuacauuaugauacagguggaaaauaaacacuuccauuuagcuuuuauguaauucaagugaugaccuuagcaguuaaucugcuaaagcaauacacuucaguuuuauuuuggaaauagauauuuuaacaagauacaaaugcucaguaucauauuacuggguuuguaaucuaaauugaaaacugcuauaucaguaugaaaaaauauuuuaaauaaguacuuuuuccacacauacucaggaaauacuaguuucuauuuagccuucaaauuuggcaucauacaaaucucuuuauuauuaaucugccaaaguaucagacaaaaaaugauauagugaagacuaucuaagaagaguuuaaaugcuuauagagaguaaagugcuucuccagaugaugaauaagaacguuuuuuauuccaaugaguaccucuuuacuucacuuguaaaggugucugggauaguguuugcuugguaaacuaauauaaacuuguaaacauaggcuuugacaucauacacauuuucaaauccuugucuaguuucuuaauaacuaaauugcaaggcaaauucuuuucugagcuuuggcuuuccuacaugucaaauagaaaucacaccagguaucuuugucaugauagaauuguuagcauaucacaucauaugacacuuaauaaauauuauuuccuuucuaauucuuaccuccucuuuugauuauaaugaaucauuuagacaaaaggcaauauaguaauuguuuaaguugguaguaauucuaagguaauuaaggaaucaacaucaugaguuaggguuuuauacuguuaguacaaaguaguuuuccaaauuagauguucauaacguauauuuguuuaauugcaauuagcauuaauauuucauaauugacugcucugucugccaacuucuacaagcagugaugacaugaagugugaaacagaugucacugaggucucugccuuuaagaaguuuuacacuucuucgaaaguccaacguggcaaacauagguuacuguguucugugcccuggcuaacaauaccaguauaugaguaugaaucuaaauguucaggaaaaggcuucauucccaaaauuacuucuuauacuuuauuuuagaaaacauaauaauaauugccuugaauaauugcccaaaucuaucuuggagguauaggaagaagaaauucucaauaaguaaaguauaauucauagucuuaguccuagauuuucaauggcagacuuuucaaaguugcaucugaagacaagguugagaaaugcuauucuucacuguauuuugccagaugugauaucauaguucuauggaaucauauuuuuuaaauuucuguaagagaccuuauuacaauguaaauaaagcuggagaggagauuucugagcaguuaa

SEQ ID NO: 383 - RNA, 2616 nt, Homo Sapiens
cuccugucccgcagucggcguccagcggcucugcuuguucgugugugugucguugcaggccuuauucaugggcucaccgcugagguucgacgggcgggugguacuggucaccggcgcgggggcaggauugggccgagccuaugcccuggcuuuugcagaaagaggagcguuaguuguugugaaugauuugggaggggacuucaaaggaguugguaaaggcuccuuagcugcugauaagguuguugaagaaauaagaaggagagguggaaaagcaguggccaacuaugauucaguggaagaaggagagaagguugugaagacagcccuggaugcuuuuggaagaauagauguuguggucaacaaugcuggaauucugagggaucguuccuuugcuaggauaagugaugaagacugggauauaauccacagaguucauuugcgggguucauuccaagugacacgggcagcaugggaacacaugaagaaacagaaguauggaaggauuauuaugacuucaucagcuucaggaauauauggcaacuuuggccaggccaauuauagugcugcaaaguugggucuucugggccuugcaaauucucuugcaauugaaggcaggaaaagcaacauucauuguaacaccauugcuccuaaugcgggaucacggaugacucagacaguuaugccugaagaucuuguggaagcccugaagccagaguauguggcaccucuuguccuuuggcuuugucacgagaguugugaggagaaugguggcuuguuugagguuggagcaggauggauuggaaaauuacgcugggagcggacucuuggagcuauuguaagacaaaagaaucacccaaugacuccugaggcagucaaggcuaacuggaagaagaucugugacuuugagaaugccagcaagccucagaguauccaagaaucaacuggcaguauaauugaaguucugaguaaaauagauucagaaggaggaguuucagcaaaucauacuagucgugcaacgucuacagcaacaucaggauuugcuggagcuauuggccagaaacucccuccauuuucuuaugcuuauacggaacuggaagcuauuauguaugcccuuggagugggagcgucaaucaaggauccaaaagauuugaaauuuauuuaugaaggaaguucugauuucuccuguuugcccaccuucggaguuaucauaggucagaaaucuaugauggguggaggauuagcagaaauuccuggacuuucaaucaacuuugcaaagguucuucauggagagcaguacuuagaguuauauaaaccacuucccagagcaggaaaauuaaaaugugaagcaguuguugcugauguccuagauaaaggauccgguguagugauuauuauggaugucuauucuuauucugagaaggaacuuauaugccacaaucaguucucucucuuucuuguuggcucuggaggcuuugguggaaaacggacaucagacaaagucaagguagcuguagccauaccuaauagaccuccugaugcuguacuuacagauaccaccucucuuaaucaggcugcuuuguaccgccucaguggagacuggaaucccuuacacauugauccuaacuuugcuagucuagcagguuuugacaagcccauauuacauggauuauguacauuuggauuuucugccaggcguguguuacagcaguuugcagauaaugaugugucaagauucaaggcaauuaaggcucguuuugcaaaaccaguauauccaggacaaacucuacaaacugagauguggaaggaaggaaacagaauucauuuucaaaccaagguccaagaaacuggagacauugucauuucaaaugcauauguggaucuugcaccaacaucugguacuucagcuaagacacccucugagggcgggaagcuucagaguaccuuuguauuugaggaaauaggacgccgccuaaaggauauugggccugagguggugaagaaaguaaaugcuguauuugaguggcauauaaccaaaggcggaaauauuggggcuaaguggacuauugaccugaaaagugguucuggaaaaguguaccaaggcccugcaaaaggugcugcugauacaacaaucauacuuucagaugaagauuucauggaggugguccugggcaagcuugacccucagaaggcauucuuuaguggcaggcugaaggccagagggaacaucaugcugagccagaaacuucagaugauucuuaaagacuacgccaagcucugaagggcacacuacacuauuaauaaaaauggaaucauuaaauacucucuucacccaaauaugcuugauuauucugcaaaagugauuagaacuaagaugcaggggaaauugcuuaacauuuucagauaucagauaacugcagauuuucauuuucuacuaauuuuucauguaucauuauuuuuacaaggaacuauauauaagcuagcacauaauuauccuucuguucuuagaucuguaucuucauaauaaaaaauuuugcccaaguccuguuuccuuagaauuugugauagcauugauaaguugaaaggaaaauuaaaucaauaaaggccuuugauaccuuu

SEQ ID NO: 384 - RNA, 3400 nt, Homo Sapiens
ggagcgggggauaagguuaccacgcccgcgguggccggggacacucugaguuucgcguguggcuuuuagggacguuuauauuugaauuucccugaaccgccgagugugggcgguggcgcagauccgucccggaaaccuccgggcuccuucccgccuuucucaggcccggccccuccaagggguccccgcggggcggcgggagggcccugggcccagagccgcgcgggugggcagucccaggcguccuuccuuacagcccugagccugguccgggaaccgcccagccgggagggccgagcugacgguugcccaagggccagauuuuaaauuuacaggcccggcccccgaaccgccgaagcgcgcugccugcuccccauuggcccaugguagucacguggaggcgccggggcgugccggccauguuggggagugcggcgccgcggcccgcgccaccuccgccccccgcggcuugccuccagcccgccccucccggcccuccuccccccgcccgccgcuccgugcagccugagaggaaacaaagugcugcgagcaggagacggcggcggcgcgaacccugcugggccuccagucacccucgucuugcauuuucccgcgugcgugugugaguggguguguguguuuucuuacaaaggguauuucgcgaucgaucgauugauucguaguucccccccgcgcgccuuugcccuuugugcuguaaucgagcucccgccaucccaggugcuucuccguuccucuaaacgccagcgucuggacgugagcgcaggucgccgguuugugccuucgguccccgcuucgcccccugccguccccuccuuaucacggucccgcucgcggccucgccgccccgcugucuccgccgcccgccauggcgacugcgacccccgugccgccgcggaugggcagccgcgcuggcggccccaccacgccgcugagccccacgcgccugucgcggcuccaggagaaggaggagcugcgcgagcucaaugaccggcuggcgguguacaucgacaaggugcgcagccuggagacggagaacagcgcgcugcagcugcaggugacggagcgcgaggaggugcgcggccgugagcucaccggccucaaggcgcucuacgagaccgagcuggccgacgcgcgacgcgcgcucgacgacacggcccgcgagcgcgccaagcugcagaucgagcugggcaagugcaaggcggaacacgaccagcugcuccucaacuaugcuaagaaggaaucugaucuuaauggcgcccagaucaagcuucgagaauaugaagcagcacugaauucgaaagaugcagcucuugcuacugcacuuggugacaaaaaaaguuuagagggagauuuggaggaucugaaggaucagauugcccaguuggaagccuccuuagcugcagccaaaaaacaguuagcagaugaaacuuuacuuaaaguagauuuggagaaucguugucagagccuuacugaggacuuggaguuucgcaaaagcauguaugaagaggagauuaacgagaccagaaggaagcaugaaacgcgcuugguagagguggauucugggcgucaaauugaguaugaguacaagcuggcgcaagcccuucaugagaugagagagcaacaugaugcccaagugaggcuguauaaggaggagcuggagcagacuuaccaugccaaacuugagaaugccagacugucaucagagaugaauacuucuacugucaacagugccagggaagaacugauggaaagccgcaugagaauugagagccuuucaucccagcuuucuaaucuacagaaagagucuagagcauguuuggaaaggauucaagaauuagaggacuugcuugcuaaagaaaaagacaacucucgucgcaugcugacagacaaagagagagagauggcggaaauaagggaucaaaugcagcaacagcugaaugacuaugaacagcuucuugauguaaaguuagcccuggacauggaaaucagugcuuacaggaaacucuuagaaggcgaagaagagagguugaagcugucuccaagcccuucuucccgugugacaguaucccgagcauccucaagucguaguguacguacaacuagaggaaagcggaagaggguugauguggaagaaucagaggcgaguaguaguguuagcaucucucauuccgccucagccacuggaaauguuugcaucgaagaaauugauguugaugggaaauuuauccgcuugaagaacacuucugaacaggaucaaccaaugggaggcugggagaugaucagaaaaauuggagacacaucagucaguuauaaauauaccucaagauaugugcugaaggcaggccagacuguuacaauuugggcugcaaacgcuggugucacagccagccccccaacugaccucaucuggaagaaccagaacucguggggcacuggcgaagaugugaagguuauauugaaaaauucucagggagaggagguugcucaaagaaguacagucuuuaaaacaaccauaccugaagaagaggaggaggaggaagaagcagcuggagugguuguugaggaagaacuuuuccaccagcagggaaccccaagagcauccaauagaagcugugcaauuauguaaaauuuucaacugucuuccucaaaauaaagaaguaugguaaucuuuaccuguauacagugcagagccuucucagaagcacagaauauuuuuauauuuccuuuaugugaauuuuuaagcugcaaaucugauggccuuaauuuccuuuuugacacugaaaguuuuguaaaagaaaucauguccauacacuuuguugcaagaugugaauuauugacacugaacuuaauaacuguguacuguucggaagggguuccucaaauuuuuugacuuuuuuuguauguguguuuuuucuuuuuuuuuaaguucuuaugaggaggggaggguaaauaaaccacugugcgucuugguguaauuugaagauugccccaucuagacuagcaaucucuucauuauucucugcuauauauaaaacggugcugugagggaggggaaaagcauuuuucaauauauugaacuuuuguacugaauuuuuuuguaauaagcaaucaagguuauaauuuuuuuuaaaauagaaauuuuguaagaaggcaauauuaaccuaaucaccauguaagcacucuggaugauggauuccacaaaacuugguuuuaugguuacuucuucucuuagauucuuaauucaugaggagggugggggagggagguggagggagggaaggguuucucuauuaaaaugcauucguuguguuuuuuaagauaguguaacuugcuuaaauuucuuaugugacauuaacaaauaaaaaagcucuuuuaauau

SEQ ID NO: 385 - RNA, 910 nt, Homo Sapiens
gcucgugcugugacgcaagccucgccucgccccgcgccgcgcgcguugccagggugaucaggugacucccgguucgcggcgcugggagcggccgugacgucaggcgcccggcugcuccucacuugcucugagacaggugcggcaagucuacugcgggcugguccgggcuccucagguucagacccgaccguuauccagucgguucguggagaggagaggugcacuuuacagguccccgaugaaccaagagaacccuccaccauauccaggcccugguccaacggccccauacccaccuuauccaccacaaccaauggguccaggaccuauggggggacccuacccaccuccucaaggguaccccuaccaaggauacccacaguacggcuggcaggguggaccucaggagccuccuaaaaccacaguguaugugguagaagaccaaagaagagaugagcuaggaccauccaccugccucacagccugcuggacggcucucuguugcugcugucucugggacaugcucaccugaccagaccagcccagccguccuguccugccagcucugcugccaccucugacaggugugccugcccccaucucuucugauugcuguuaacaaaugacuagcuuugcacagacaccucuaccuucagcacuaugggauucuagauuaauggggguugcuacuguuuaauucagugacuugaucuuuuuaauguccaaaauccauuucuuauugaucuuuaaagaugugcuaaaugacuuuuuuggccaaaggcuuaguugugaaaaauauaauuuuuaaauuauacauucaagguaguggccaaauguaacacaucaaucauggaaugauuucucugcuaacagccgccuguauguuucaauaaauuuguccaaagcucaa

SEQ ID NO: 386 - RNA, 2779 nt, Homo Sapiens
agggugaguggcaguuauauagaccggcggcggagcacgcgugugugcggacgcaguugcgugaggguuuggacauauuugacucuuuuccccccagguugaauugaccaaagcaauggugauggagaagccuaguccccugcuggucgggcgggaauuugugagacaguauuacacacugcugaaccaggccccagacaugcugcauagauuuuauggaaagaacucuucuuauguccaugggggauuggauucaaauggaaagccagcagaugcagucuacggacagaaagaaauccacaggaaagugaugucacaaaacuucaccaacugccacaccaagauucgccauguugaugcucaugccacgcuaaaugauggugugguaguccaggugauggggcuucucucuaacaacaaccaggcuuugaggagauucaugcaaacguuuguccuugcuccugaggggucuguugcaaauaaauucuauguucacaaugauaucuucagauaccaagaugaggucuuugguggguuugucacugagccucaggaggagucugaagaagaaguagaggaaccugaagaaagacagcaaacaccugaggugguaccugaugauucuggaacuuucuaugaucaggcaguugucaguaaugacauggaagaacauuuagaggagccuguugcugaaccagagccugauccugaaccagaaccagaacaagaaccuguaucugaaauccaagaggaaaagccugagccaguauuagaagaaacugccccugaggaugcucagaagaguucuucuccagcaccugcagacauagcucagacaguacaggaagacuugaggacauuuucuugggcaucugugaccaguaagaaucuuccacccaguggagcuguuccaguuacugggauaccaccucauguuguuaaaguaccagcuucacagccccguccagagucuaagccugaaucucagauuccaccacaaagaccucagcgggaucaaagagugcgagaacaacgaauaaauauuccuccccaaaggggacccagaccaauccgugaggcuggugagcaaggugacauugaaccccgaagaauggugagacacccugacagucaccaacucuucauuggcaaccugccucaugaaguggacaaaucagagcuuaaagauuucuuucaaaguuauggaaacgugguggaguugcgcauuaacaguggugggaaauuacccaauuuugguuuuguuguguuugaugauucugagccuguucagaaaguccuuagcaacaggcccaucauguucagaggugagguccgucugaaugucgaagagaagaagacucgagcugccagggaaggcgaccgacgagauaaucgccuucggggaccuggaggcccucgaggugggcugggugguggaaugagaggcccuccccguggaggcauggugcagaaaccaggauuuggagugggaagggggcuugcgccacggcagugaaucuucauggaucuucaugcagccauacaaacccugguuccaacagaauggugaauuuucgacagccuuugguaucuuggaguaugaccccagucuguuauaaacugcuuaaguuuguauaauuuuacuuuuuuuguguguuaauggugugugcucccucucccucucuucccuuuccugaccuuuagucuuucacuuccaauuuuguggaaugauauuuuaggaauaacggacuuuuaaagaagcaaaaaaaaagacugaauuuccuugcuuacuuugcauauacagacuggauuuuuuuuuuuuuuuuacagccauuuccccaaaggaaugucuugcauauuacugacauuugguauguuucauucauuggaauauuucuuauuuucuacguguuugaaaagccuguaagaaauacaggauuugauaauauuuugaaggcaggaaaaacccaaauuguuucuucuuugagagucaugacuaccuucugguguggagaaauugccauuggaaaauuugacaauuuugauucucacugguauguuuaaaaacugaauaaaaggaauagaauuuuuuuuugauaaaggaucacaaaacaauucuaaaaccuaacuguuuuuaccauugaaauuuaaauugugauaauagguuuuaaaugucuagaaugcaacugauaggcuuuucuugaacuguuaguuuuuuugaaguaguuuuuucauguuuaauuuguauuuguaaaaaaacaaaaagcaaaaaaauucccaaaacccagauaacaaccagagcaaaacuguugugccuucuauuuaucuuugauuucagucuuggcaauuguuuaaaaaaaaaaucuagauuuguuuuauuagguucagaguauguggggaauuauagaaucccucuuucaucacuuuguguaugucuuuuguuaacauauuuguuaugccuuauucuaaaauugagucucaaacuggaaugccuuugaagacagaugcuucuauagagguucuuugaccuaaauaguucagcauuuguauuuuuauucugguaucuaaucagauuccuaaucauagcccguaagaaggaauguuacuuuaauauuggacuuugcucaugugcucguguccgcauuuuuuuuuuucuuaaaaucauagccauaugguaaauuuucuauuuuguuaugguucucuuuuauugaugggcaugcaguggguguuacuuggaaauggccaauuuuuauuaaaauauuucuggaagaaaauuuaa

SEQ ID NO: 387 - RNA, 106 nt, Homo Sapiens
aggcucacuuuggcagcucauacacuaaaacuggagccauacagaaaagauuagcauggcuccugugcaaguaugacaugcaaauucaugagaauuccauauuuua

SEQ ID NO: 388 - RNA, 339 nt, Homo Sapiens
auggcugcggaaguccuggaggcagccuccgcggaggagcagaaggaaaaggaagauaaagugacuaguccagagaaagcugaagaagcaaaauuaaaagcaagguauccucaucugggacaaaagccuggagguucagauuucuuaaggaaacgauugcagaaagggcaaaaauauuuugauucugggcauuacaacagggcuaaagcaaaaacgaagagcaagcaacuuccuacugcagcuccagauaagacggaggucacuggugaccacauuccuacuccacaggaccuuccucaacggaaaccaucccuuguugcuaacaagcuggcuggcuga

SEQ ID NO: 389 - RNA, 2453 nt, Homo Sapiens
gcagacccuccccucuccccuccagccuggacacgcccgccuccccuugacuccccccagcucugggcccccaccuccccuccccuccagcacagucacccccauuucucuccuauccgccauccugguuccucccuuccccccaccucccaacucugugccccgccaacguuuccuaaaugcccucuauucagauccccccuccgccuccccucuccucuccuccauuccugcgucccccuucccccgccgcgccgccugggcuguccguggacuucucccacucucucacucucucacucacucucucucucucucucucucucucacucucucucucucucucccccucauuuauuuggaaccguuggauaagaagugcucgggcucucgcucagacuuagggagcugccucgaggugaugaaugacacccccuggcaccagcuacccuucucagaccccaguccagcccgcucccgacgucgacuacgauuccgcuaccucggcuggcagcgagguuggggugagccccagcugcaggcgcgucugggcugcgccgcugcaaacgaguugcgcaccuugggcggcuccgcaccugcacccgcacccgcggggcucagccccgaaggcugcagcuucgggggaggcgcggucgccgagguccagcugguggggcgagagacgucgccccucggaggaugcucucggaacuugggagaggaaggagggaagagaagaggggaaaggggccgucgauguuuuugaugucugugcuuuaauggaggccaccaauauugagaagacgggguuggccgaggcagcccgcacgcugcugcuugcgagcgcucgagucaaagcuagggccaaccgcggcuuguccgggugcccuaagggggcggacacuugguuuagcaccgggacacagaauagccaccgggguaggaagaugcguucacuuugcuuaccuguuggcaagagggacauacaaaaauaacguaacgugacaucguugacaacgguagcucuuugauuacacaaaagccaauuuuaccuucccgcaaaagccaguugagugacaaacuguaaccauacuuagggaggcagacgucaaaggcaaguacaucuguauucaacuggguaaaggaagaguuuuucagccuggcgugguggcucacaccuguaaucccagcacuuugggaggccaaggaagucucuacugauucuaaauuucaccucugauccgaacccugguggucugaugauauuacuuccuacuucugggaccucuacccuacgaaacccaccucucacugaaacaaguggauaucuuugugguugcugccacgggauuuaagaguccuuuuuuuuuuuuugauacggagucuugcucugucacccaagcuggagugcaguggugugaucucagcucucugcaacccccaccuccuggguucaagcgauucuccugccucagccuccugaguagcugggauuacaggcauucaccaccaugcccagcuaauuucuguauuuucaguagagacgggguuucacuauguuggccaggauggucuugaucuccugaccuuaagagauccuccugccucggccucccaaagggcugagauuacaggcgugagccaccacgcccagccuaagaguccauuugaagcauuuuuauucuaagaaaauuuauuuccauauguaguugggaugaaaagucuaugaaauccauucaaaacaaaggugcuuucaacuauacuguuugaaguuacaguuuuguuucuucccuuauccugugcuaucuuaagccauauguuguuguaaauuaacaggaaagagggcauuuaaaacaaaugguuuaugugaauagcauuaaucccgucaagacuaguuugugacaagggcuaaagauugcacucuugccuuuuaagcucaaccaaguuaaacaucugaacuauuucugcugucuuguaaauauuaagauguaacacguuucugauguuuguugacauuuguuguacuuuugaugaacaauuagccugcaagaauauuaacaggaaauuccauucaugagauaagcagcuguuugugcaaagcuucagccagaucaugggaccaaaaaucuucuuuaugcaacuacuguuuguugaauagucagcauuccuugcauguucaaaaggaaaugcuuuggaaauaacuuuuauggcuaauuuugacuuuuauauuuucguaaggagaaaauaacuuucaugguuaauguugacucuuauacuugcagguaguaaaauaauguccuuuaucaccauguaaauuucaaacaguagucauugacaaaucccuaguaauuuccaaauuguaaugcagaauccuaaggcugguguuaagaucccugaguccacgucauaucauaaugcaugauuauuuuauugaaauaaaaaccuacaauuau

SEQ ID NO: 390 - RNA, 3558 nt, Homo Sapiens
aucgaagcuaaagggcugacagaagggcuguagcggcaagugugcgccaacacagcugcacacgcccagacaccugaggcgcugagaggaacuuccccgcgauccgccccggcugcacagagccucuucuccccgccggggccccgcccagccucacuucuuuuaaaagcagcagccagcagcgcgccgguggcgugcggcucgaaaggccgggaggacgucaucgacgcgcugucgagccuccagcccgcccggguuuccuucgcagucgcgcaccgacgcucaaacgcgcgcuccaacccgcagccuccuccugccucaccgcccgaagauggcggcucucaaacuccucuccuccgggcuucggcucugcgccucugcccgcggaucuggggcaaccugguacaagggauguguuuguuccuuuuccaccagugcucaucgccauaccaaguuuuauacagauccaguagaagcuguaaaagacaucccugauggugccacgguuuugguuggugguuuugggcuauguggaauuccagagaaucuuauagaugcuuuacugaaaacuggaguaaaaggacuaacugcagucagcaacaaugcagggguugacaauuuugguuuggggcuuuugcuucgguccaagcagauaaaacgcauggucucuucauaugugggagaaaaugcagaauuugaacgacaguacuuaucuggugaauuagaaguggagcugacaccacagggcacacuugcagagaggauccgugcaggcggggcuggaguuccugcauuuuacaccccaacaggguaugggacccugguacaagaaggaggaucgcccaucaaauacaacaaagauggcaguguugccauugccaguaagccaagagaggugagggaguucaauggucagcacuuuauuuuggaggaagcaauuacaggggauuuugcuuuggugaaagccuggaaggcggaccgagcaggaaacgugauuuucaggaaaagugcaaggaauuucaacuugccaaugugcaaagcugcagaaaccacagugguagagguugaagaaauuguggauauuggagcauuugcuccagaagacauccauauuccucagauuuauguacaucgccuuauaaagggagaaaaauaugagaaaagaauugagcguuuaucaauccggaaagagggagauggggaagccaaaucugcuaaaccuggagaugacguaagggaacgaaucaucaagagggccgcucuugaguuugaggauggcauguaugcuaauuugggcauaggaaucccucuccuggccagcaauuuuaucagcccaaauauaacuguucaucuucaaagugaaaauggaguucuggguuuggguccauauccacgacaacaugaagcugaugcagaucucaucaaugcaggcaaggaaacaguuacuauucuuccaggagccucuuuuuucuccagcgaugaaucauuugcaaugauuagagguggacacgucgaucugacaaugcuaggagcgaugcagguuuccaaauauggugaccuggcuaacuggaugauaccugggaagauggugaaaggaaugggaggugcuauggauuuaguguccagugcgaaaaccaaagugguggucaccauggagcauucugcaaagggaaaugcacauaaaaucauggagaaauguacauuaccauugacuggaaagcaaugugucaaccgcauuauuacugaaaaggcuguguuugauguggacaagaagaaaggguugacucugauugagcucugggaaggccugacaguggaugacguacagaagaguacugggugugauuuugcaguuucaccaaaacucaugccaaugcagcagaucgcaaauugaaauauggauauuuguaccaggcugcguguuuuucauuuuaaacacacaagauuuaauugaaaggacaucaauaaucauaauuguguauuuaacaggugguuuuuuauuaguuuucuuguguuucagacuuuaugcagccauauaaacuguucucuaggcaugcugugacauuuuaauaaaaagcaaaaggagcauuuauaauuaucucauuuguuaaggcugagaagguuguuuuuauaauagguaauuauauugaaugcauuuucacugaauaugguauguaugcuaaauuauaugaaccuuuccccaagaagggcccuagaaauugauguggcuuuccucuuaaauauuaauuauuaguccugaaagaaagauaacauaugugauuuuugugguuaggagaguugcugucaugauuguuuuuucuucagccuccucugacuuuucuuuuggggcuucagauuuuaugauuacaucuugucccccuagaacaucccccuuccucccauacugcuuuuaaacagaugcccaagaaggcaagcaggaaugccucuugugggggagggcagggagaaauaacuaguucaaaccaacuaucuaucuaugcuuugcaaagacuaaggcguauuauaggaagagggcuagaaaccuaacugauucuucucaguuuucucauuuuaaaacagcccaguauuccuuuguauccucaaggguccuugagaauacuucuguuauugagacccugugggcuacuuguacuguaccuccucucaagccaagaagggcugugggauaauuuaccaugaauccuuaguagcaaugacagcagaguuaaaaaauaaaagguguuuuacuuucaggcucuuguuuugguucagaggagauuuuaaauauugaaugacacuucuacagaacaacgguuuuucuucugccaaggcuacuuccuuuaacgaagugccuuuaauucagccuuauccaacuagggaaaauaauguuggacaagucuaggauuugaagagucagugaacuuuuagugucagggaauaaacaugguggguagauuagguuugaaaaaaacuuccuuagagguauuuauucucaauaccugacaggggcccaugggaaugacuucagaagcaucccggauaauagauggguaaaaagucuaggcacccugaagaacaggugagacagcuggccucuggacagagguaggcauaguacaguacgauauaucauuccucugguccuaaauauacaaacuuauucauguuuuuaggugaugauggucauugaaacucacuucuuuucagguguagcuacaauuguguaauguacaauauuagagaaaggacaggcuuuuuaugaguaacacacaccauauauaaaacagccuuucuggcugaccacaugguuaaaugcauaccuucccaguacuggggggaaaaaaugacccuucuuagaaugugcaaguuccaugagaguaauauauugauaugauuuugaaaagaauuguugauaguuacaucuucaaacuuaucauuccaguaugcaucuuuaagauaaugugauucuaaguagaugacuuuauauucuugauugaagagugcuauacauguuaagaaaugcauuaaggaauacaauaaauauucuaaagugaugua

SEQ ID NO: 391 - RNA, 1834 nt, Homo Sapiens
gcauaacugauggagggccgggcgcgguaagagcgucucgggggaguggggcaaggcggccgggccccucccauuccgccuuuucuucagcguccuacccgcggcacuggcugcgagcgccgggccaccugcgagugugcgcagggacucuggacacccgcggcggcgagcugagggagcagucuccacgaggacccaggcggacccucuggcgccaugcgcgcccuccccggccugcuggaggccagggcgcguacgccccggcugcuccuccuccagugccuucucgcugccgcgcgcccaagcucggcggacggcagugccccagauucgccuuuuacaaguccaccucucagagaagaaauaauggcaaauaacuuuuccuuggagagucauaacauaucacugacugaacauucuaguaugccaguagaaaaaaauaucacuuuagaaaggccuucuaauguaaaucucacaugccaguucacaacaucuggggauuugaaugcaguaaaugugacuuggaaaaaagauggugaacaacuugagaauaauuaucuugucagugcaacaggaagcaccuuguauacccaauacagguucaccaucauuaauagcaaacaaaugggaaguuauucuuguuucuuucgagaggaaaaggaacaaaggggaacauuuaauuucaaagucccugaacuucaugggaaaaacaagccauugaucucuuacguaggggauucuacugucuugacauguaaaugucaaaauuguuuuccuuuaaauuggaccugguacaguaguaaugggaguguaaagguuccuguugguguucaaaugaauaaauaugugaucaauggaacauaugcuaacgaaacaaagcugaagauaacacaacuuuuggaggaagauggggaaucuuacuggugccgugcacuauuccaauuaggcgagagugaagaacacauugagcuuguggugcugagcuauuuggugccccucaaaccauuucuuguaauaguggcugaggugauucuuuuaguggccaccauucugcuuugugaaaaguacacacaaaagaaaaagaagcacucagaugaggggaaagaauuugagcagauugaacagcugaaaucagaugauagcaaugguauagaaaauaauguccccaggcauagaaaaaaugagucucugggccagugaauacaaaacaucaugucgagaaucauuggaagauauacagaguucguauuucagcuuuguuuauccuuccuguuaagagccucugaguuuuuaguuuuaaaaggaugaaaagcuuaugcaacaugcucagcaggagcuucaucaacgauauaugucagaucuaaagguauauuuucauucuguaauuauguuacauaaaagcaauguaaaucagaauaaauauguuagaccagaauaaaauuaauuauauucuggucuucaaaggacacacagaacagauaucagcagaaucacuuaauacuucauagaacaaaaaucacucaaaaccuguuuauaaccaaagaauucaugaaaaagaaagccuuugccauuugucuuagaaaguuauuuuuuaaaaaaaaaucauacuuacuauuaguaucuauggaaguauauguaacaauuuuuauguaaaggucaucuuucugugauagugaaaaaauaugucuuuacuaaguugaaaugaauacuuucugccuuugcuaaugauaguuauucuacaaucuccacaagaaaaauauaccuuuuauccggaaauauugguuuaaggcaaauaaauaaaacugugcuugcucuaaagcucugcacuacaaaa

SEQ ID NO: 392 - RNA, 4156 nt, Homo Sapiens
ucacgcccuggcugguuuggauucgagaggaaaaaucauuaaaggaucuggaguuuucaccccaaaacuuuaaucguuuugucccuucuuuuuuuuucuugucuuuccuccagcagcugcagacuacauaaugaaaaauaacaaaagugcccaugcgcgaggcugugcaacuaaccacccgacgauugcggggaggaggaguaagagucggcuaagcggcgcccaguguccuacugcgccugugcgccgguggcgugcgcagaggccucuggguagguggcucaaccccgccucucaguugaggacucugaaggcuguuucuguggcgcuuccccugcgaggauggcuacccugguuguaaacaagcucggagcgggaguagacaguggccggcagggcagccgggggacagcuguagugaaggugcuagaguguggaguuugugaagaugucuuuucuuugcaaggagacaaaguuccccgucuuuugcuuuguggccauaccgucugucaugacugucucacucgccuaccucuucauggaagagcaauccguugcccauuugaucgacaaguaacagaccuaggugauucaggugucuggggauugaaaaaaaauuuugcuuuauuggagcuuuuggaacgacugcagaaugggccuauuggucaguauggagcugcagaagaauccauugggauaucuggagagagcaucauucguugugaugaagaugaagcucaccuugccucuguauauugcacugugugugcaacucauuugugcucugaguguucucaaguuacucauucuacaaagacauuagcaaagcacaggcgaguuccucuagcugauaaaccucaugagaaaacuaugugcucucagcaccaggugcaugccauugaguuuguuugcuuggaagaagguugucaaacuagcccacucaugugcugugucugcaaagaauauggaaaacaccagggucacaagcauucaguauuggaaccagaagcuaaucagauccgagcaucaauuuuagauauggcucacugcauacggaccuucacagaggaaaucucagauuauuccagaaaauuaguuggaauugugcagcacauugaaggaggagaacaaaucguggaagauggaauuggaauggcucacacagaacauguaccagggacugcagagaaugcccggucauguauucgagcuuauuuuuaugaucuacaugaaacucugugucgucaagaagaaauggcucuaaguguuguugaugcucauguucgugaaaaauugauuuggcucaggcagcaacaagaagauaugacuauuuuguugucagagguuucugcagccugccuccacugugaaaagacuuugcagcaggaugauuguagaguugucuuggcaaaacaggaaauuacaagguuacuggaaacauugcagaaacagcagcagcaguuuacagaaguugcagaucacauucaguuggaugccagcaucccugucacuuuuacaaaggauaaucgaguucacauuggaccaaaaauggaaauucgggucguuacguuaggauuggauggugcuggaaaaacuacuaucuuguuuaaguuaaaacaggaugaauucaugcagcccauuccaacaauugguuuuaacguggaaacuguagaauauaaaaaucuaaaauucacuauuugggauguagguggaaaacacaaauuaagaccauuguggaaacauuauuaccucaauacucaagcuguuguguuuguuguagauagcagucauagagacagaauuagugaagcacacagcgaacuugcaaaguuguuaacggaaaaagaacuccgagaugcucugcuccugauuuuugcuaacaaacaggauguugcuggagcacugucaguagaagaaaucacugaacuacucagucuccauaaauuaugcuguggccguagcugguauauucagggcugugaugcucgaagugguaugggacuguaugaaggguuggacuggcucucacggcaacuuguagcugcuggaguauuggauguugcuugauuuuaaaggcagcaguuguuugaaguuuugugguuaaaaguaacuuugcacauaguauguuuuaagaaauuauacaucucaaaagaugguaauuuaggaugcauauauauauauauauauauaaaggaaucuuggauugggaauucaguacuuugcuuuaaaaaaauuuuguggcagaauuaaauuucuaauugagcagauuagauugaauuaaauagaaacuuauugaauauacauucuuuuaaaaaguauauuuguuauuuaaguuuuucagauaauaugugaccaauauacugggaaagagguagucacagagaaaggguaagugaagguuuauucuuucagugaaaaaagaauagccaauugagugccuaaugagaccucugugugaagcaagugaaguauagcugcuucuuuuaaccugccuuuucacugaauguuggcagcauuuaguaguagaaaugacaguugcuuaaugaaauagaauccaaacuacauauuuggauaauaggauuacuuuauguuuauguucagaguuaacagaacaccuuuaaugcuaagaacuauaagguacagaaaauuaauacuuuauauaguguuuuauuaacuuucuccuacagcauuuuguauaaaacacaaugagggagugaaauguuacccaauuaggcuugucagguuaguaauaaacugaacaguaauaaaacuguggaaguaauuggaucugaauuuaugaaagacccauuuccaggacugaaccuaggucagagcucuaaauugguccuucuauuuuucaacaaauuuaaaguaauauuucuuucuaauauaauauugcauccuuugugggaaugacuauagguaaaauguaguaaguaacgcagaaccaggguuggcuuuauuuaaaagcuagugaccuaaauagaaagcgaacuucaagagaaguuguaaguacaguggcaaaugcuuauuacuuacuucaaacuguuucccaaaauaagugcauuuauuuugacaauaaaacuuaaggcuguucaugagaaggccuugaaaaguuacucuagaggaaaaaugucuaaagaaaaaaaaaauucaaaaaguuuacauuaauuauucaguguugugaguaaauaaaaaugugugcucuuuacuguuuuucauuuuuaaagaauauuauuauggaagcacgauuuauuuaaauagguacauugagacuuuuuuuuuuuuaauguucugauacauuaggaugaaguuaaaucuuaaaucuuauuaguugaauuguuguaaggacagugaugucugguaacaagaugugacuuuuugguagcacuguugugguucauucuuuucaaaucuauuuuuguuuaaaaacaauacaaguuuuagaaaacaaagcauuaaaaaaaaagccuaucaguauuaugggcaauauguaaauaaauaaauguaauauuucauccuuuauuuuucagguaaaaggucaugcuguuacagguguaguuugugugcauaaauaauacuuccgaauuaaauuauuuaauauuugacugauuucaauaacugugaaaaauaaaaaagguguuguauugcuugugagaacuugaacuguuuacuaguuaauugaagaaaaaguguaacacuaaggugaacuugcuucccuuuucacuaauuuugcuaaacuuuguaaugcacauucuuagcauauaacugaacacaguugaaaaauugugccugauuauaauguauguauaaugguagguguuugugugugauucauuuuuaaagaaauauuuuucucaagcuccuauuacuauuugugguuguauuauuucacuaaucauuaguuaagacugugcuagucuucccugggaaacuaagaagagagcuuuuuuauauacaguauauuagaauuuuccuaguagcugaauuucuguauuaggucuaaauauuacuguauguuauauaaagcagguaugucaaguguauagccguagucuauaauucaggaaugcuuuauaaccaucagaagccauuauuugcacuacauauaugauaaguauagacagcaauaaaauguuaagaucauuuuuaagaa

SEQ ID NO: 393 - RNA, 4506 nt, Homo Sapiens
cgccugagccccggaagggugauguggcugcggcaucgccggccucgcuaugucugccauuuucaauuuucagagucuauugacuguaaucuugcugcuuauauguaccugugcuuauauucgauccuuggcacccagccuccuggacagaaauaaaacuggauuguuggguauauuuuggaagugugccagaauuggugaacggaagaguccuuauguugcaguaugcuguauaguaauggccuucagcauccucuucauacaguagcuggggaaaaugccagaauguaguugccaucagauuugauugugaacaaggacugacugcagaaaauaauggaaaggauguuuaacucuuuuaucuccgaacauugaaugagauaaauuuccagaugcuguucucuauuuuaauguuauuggaccaauguucuguauaaacaauuaagauguaaccauuuaauagucuguaacaaucaaccucaguacugucacuacaauauuacauucugcaaauguuauucuguuguaucagauacaaaauuuuagugagguaucucuaaggcacauaguagaaaacaaaauugguuaauuacucaaguuccuuucacugugauuuggaaaugauuuaaucuuuauagaaugagaaccuuuuuuggacuagcuuuuuuauuaaaauggcucaauuuguguugauaaggauugcauuaauauuuaauagugcuugcuuuuccucugggcacaccauuuugaucauuaaccagaguaccucuacucuuagcaaacucuaguuuaugacaaguauuuaaaauauuuaaaacaagcuuaugcaguucuuaaggacgaagguaaaugagauguaacuuaaaaauaguauugggaaaauguugauaguuaacauuaguggauuuagacuagccaaaugacauaguaggcucugaaacaucuugucaaguauauguauuuugugcaugaauuuuugcuggaaagcugucuuucucugaaaaacacaacguucuuagaaugaaaagaacaauuauaaaauaauuauccuauauguguuuuucauucuuuuuagugucauggcuucaaaaaugaaacauuuauuuuaauugccguaaaggaacuguauuuuuguuuuguuuuuuaacacagcacuuuaaauccaguuuguguuuugucaacuugaacuggaaucucuuuuguuacuuuggaggugauaaauaguuuucaaaucugcugauuuguauacuguggcacaaguaucuuugaacuuugauagugaaaggagaccuucaacaauuuuuagucuaggcgagaggaauauuaggaaugugacuucuaaauuuuacaauagagcaguuauuuuaaggucaugguuaacauuucuuaagguucaacuaaaauucaguuaaaauuucagagcuacgaggaacuuaaaucuuagcuaaaaauuaccuguuguagauaguauuaauuagauuguuugcagcuauuaauucaucauaaagauaaaaugaagaaacucucccuuuuuuuaaacaaaaaaaauuauuucuagauuaauaggcuaguaguuauuucugcagaaacaacguauggaacugaaagccaccuauuuuuauuuuagacuaauuuaaaccacuuggaauggauucuaggaaacaucuuaagcuuguguguugccuguggugguuuuuuguuuggggguguuuuuugguuuugguuugauuuucuguauuuuguuaucuggggauuuuuuguuuguuuguuuugguuugguuuugguuuuauauuuuuggcaugucuauggcaguuaaaagugguauauuuugcuuuagauagggaaucagguuauaaucauuguucuuccucuaaacugccucuugggcuuuacaucaggucaaggauuuuuaggguuucucaaaaauaggauucuugucaguguaugcaugcugaguaagucaccuuucuggcucuaauuucuggguggccaucuguuguccagcucugcugccaacuggacuuuccgaaagccaugucaacuaauuuuuuauaugcuaagacaaaucgaauaugaaaagaggaagaauauucuagauauucuaagacauuucuuaauuuggcaucucagaggagguagguggaaaguaaaggaagagauaauuuugggggaaaauuuguggaaacauacaaaacguuuugcuuuguauagaugcuaaacagagugggaggcagcauauuuguaacaacaaccauucugaccuuuugaaacacaagcuuuuggagaagucagggagagacacaguaugaauaaaagcaauuaacauuuucuuuaauguauauuuuucaaagaggaccacggaauccuguucucuaacccaaggggcaguguaggugguuuuaagcccacagaauauugagauauuucucuugugguuuuggugggguggugggaugcagaagguuauuaaagaucaauuuaagcaucagauagacuaucccuuuuauuuuuuuaacuuuuagguucagggguacaugugcagguuguuauauagguaaacucaugucaagugguuuuguuguacagauuauuuugucacccaggugcuaagccuaguacccaguaguuauuuucccugcucuucucccuccucccacccuccacccucaaguaggccccagugucuguuguuccuuucuuuguguccuugaguucucaucauuuagcuccuacuucuaaaugagaacauguauuugguuuucuguucuguguuaguuugcuaaggauaauggccuccagcucagauggaauaucucuaucauauagaccuguuguuacagggcaggaucggaugauggacacugaaguccucagcuugcuaaguucaguugcucucccuagccuccuuuuggcuucagagucuuuugauuccaucuauccugguauuuuuugugugcugauguuuaguucuggauuggcuucagcugugcuaauaggaagggcguugucuuuucaagcaaucuuaaaagguggucaaucaaaaggccagagucugaaucccuucuguggcuuaaauaauuugaggaucaaguccagugucuuguuaaucccuguucuacugugccagacacuaucuugaaugcuuuuauauguucagguucaaaaucgcucuuucauaccaggggaugauaguaacguguaacuugcaauagauuccuucaucuuaguaauaagaugaucagucuaguuaggacaaaauagagauugaauaaauuaacuuuuccaaguuuacagaguaaaaaugagcagaucucugccugguuuugugaaaaagaguuagcacugguaaauagaauauuucuacuccuacaccauucuuucaguauaucaucacugaagacaggaagauaggcacacagauucuuccucguaguaauucauagugcacuaggugaaagagaugaaguauguauuaaaaguacaaugugauggcauuuauuauucagauaaucccaggauucuagaagaaaauaaagaagagugacaguucaguuagggugugaacuuccagaggagcacugcuuaagcugaacuugagagcauugugcaaaagcacaguagucuguuaagaacuagaaauaaccuagcuugugccacuucgggaguauuaagacauaagccuagaaagguaggcaaagguuagaucuuagacugucuuguauuuuucucauuccuguugauuaccuaccucaaaauugaauauguuuuuccuccugccuaacacaaaacuacucaagggcagaaauuuaaauucuuccuugguguaugugcaaagaagguugaauauauucaugccuaccuuauuuuggacuaggaauacaguaguauacuuuccgaagacuugccugaauaguauauaagguggaggcaacugacuaguuaggucaguauuuuuagaaacucuuaauagcucauacucuugauaccaaaagcagcccugauuguuaaagcacacaccugcacaagaagcagugaugguugcauuuacauuuccugggugcacaaaaaaaaauucucaaaaagcaaggacuuacgcuuuuugcaaagccuuugagaaguuacuggaucauaggaagcuuauaacaagaauggaagauucuuaaauaacucacuuucuuugguauccaguaacaguagauguucaaaauauguagcugauuaauaccagcauugugaacgcuguacaaccuugugguuauuacuaagcaaguuacuacuagcuucugaaaaguagcuucauaauuaauguuauuuauacacugccuuccaugacuuuuacuuugcccuaagcuaaucuccaaaaucugaaaugcuacuccaauaucagaaaaaaagggggagguggaauuauauuuccugugauuuuaagaguacagagaaucaugcacaucucugauuaguucauauaugucuaguguguaauaaaagucaagaugaacucucaa

SEQ ID NO: 394 - RNA, 2246 nt, Homo Sapiens
cuccggagccgucgccagggugguaauaccuggugcagagcuugagucuggccagcgggucaggcucuugcuagaucagcaccggagguggaagacugguacauuuuacauacuuugggaaaaaaaaacguugcugaaguuacuagaaaagagacaguucuucugcugacaacucuucaggaaauaauuuucuaccuccuuaggauucgaagaccaguucauucuuagugucuucugaaauaaaauuagaauggauugggaugaugaauauucucauaauucuuuugaccuacauuguuuguuaaacucauuuccuggagacuuggaguuugagcagaucuucagugacauugaugaaaagauugaacaaaaugcugcaagcauaaaacauugcauuaaagagauacaguccgaaauuaacaaacaauguccaggugugcagcugcaaacaacaacugacugcuuugaauggcuaacuaacuauaauuacaguacaucugaaucaucuuucauuucucauggagacuugauaaaauuuuucaaaacacugcaagauuuguugaagaaugaacaaaaucaagaagaaaugacauuggauuuacuuugggaccucuccugccacagcagcguuucauucccaucaacccuaaguggaacaucuuuccauuuccucucuaggacgucucuucauucuguugaagauaauuccucuauggaugucaagucuaugugggaugauauaagacugcaucuucgacgcuucuuagugagcaaauuacaaagccauaaugaaauaaacaauucacagcaaaaaauuuuauugaaaaagcagugcuuacaacaacucuuguuucuuuauccagaaucagaaguuauaaucaaauaccaaaacauacagaauaaacuguuggcuaaucuucuguggaacugcuuuccuucuuacaacagagauucaaauuuagauguaauagcucauggauaucaaaguacaaugcuuaaguuauacucaguaauaaaagaggauuuuaacacacuaugugaaauuuuagcuccaucuucaauggugaaauucauuaaagaaacuuaccuggauacuguuacagaagaaauggcaaaauuucuugaaaauuuuugugagcugcaguucagagaaaaugcuguucgugugguuaaaacaagcaagagcuccagcaagcauagaggagcagugcaugcuuuggguuagugacauuuaaaauuuuuguuugguuuaacuuaagucuuuuaauauguuuaauuuucuaagauguuuucuauuugguuaaaucucacugcaaacaugaaaauuagaaaaugaauguaaugaaauuuugcaguauacauuucucaugcauuuuuuucuauaauuguaguuauaaaaguauuuucuuucuuauuaaauuguuaaagauauuggaaauauaagccaaaaauacuuuaaauaagaguuuaauuucucuugauugcauaugacaaacaguauuugugaaacuguguguauacacacauauauauaaaugaguauauaugcuuauacacauauaagcuccuuuaucuguuuauuaaauauacgcauauauauaagcacauauacucaguuauauauauguacauuuaguuauauacauaacagaaaaguaugauuuuuaauccauuguaucuuccaaagcuaaagcauuauuagguaaaaagaauuuuugaaaauuuguugaaauuugcaguaaaauuggauauuuaaaaguuguaauauuuuagucagucaauucuaauaaugagcaacuaugaaauacuauaauuauaaaauucuguauuguaguugauuaggaagguauaacauuuuacuauagcuauuuuuaaaguuucucuacuauuuuuucuauaaggauguauacaaauaaaagaugauuugaaaauuucuauuuuauucauaagauaaaggaaaaaaggaaagaaguuauugugauauaauaaacuuuucuuauugugguuguacuuuccuaccaguggagaaaaaucaggguaaaaauaggauuauuucuaaaauuaucauuaguuaugcuuuuauauaaaaucugagguguauuucugaauaaguucauaaacuauauggcuuaaguauuugaaaauuauuauuuggugaauuauggaucuuugaauuuaugaucaucuuuuuaaaauuccuauagcucacuauacuugugcguaucuucauuaauaaaauuucaguu

SEQ ID NO: 395 - RNA, 5335 nt, Homo Sapiens
cccacgccgcgccuuccgguugguccuugaggcgacgggugaggcacagcugagcgccaaagccacaggcuggggcgcuaacgcccccgcucagcgcucugcgcuccagacagcugcgagcuggaguaggaagguucaggcgguggcggagagugcgcuggaggcuggagggccaggaggcgggaagcuucccgcacgggggcgcugucaccugccugugggaggagccagagagggaccuggcucugcugcucugaagcaccggagucgggagaacccauccagacaugaagagcgccaaagguauugagaacuuggcuuuuguccccuccagcccagacauccugcgccgcuugucugcgucgcccucccaaaucgaagucucugccuuguccucugacccccaaagagagaauucucagccacaggagcuucagaagccccaggagccccagaagucaccagagccaucucugccuucagccccucccaaugucuccgaagagaagcuccggucacugucgcuguccgaguuugaggaggggucuuacggcuggaggaacuuccauccucaaugucuccagcgcugcaacacaccuggaggcuuucugcuucacuacugccucuuggccgucacgcaagguauuguaguuaauggccuaguaaauauuagcauuuccacuguugagaagcguuaugaaaugaagaguucccugacuggccugauuucaucaagcuacgauauuucauucuguuuguugucuuuauuuguaucauucuuuggugaaagaggacauaagccgagauggcuugcauuugcagccuuuaugauuggacugggagcacuuguauucucauugccacaauuuuucaguggagaauauaaauuggggucucuuuuugaagacacuuguguaacaacaaggaauagcaccaguuguacaucuucaacuucuucacuuucuaacuacuuguaugucuucaucuugggacaacuauugcugggggcaggaggaacuccucuuuauacucugggaacagccuuucuugaugauucugugcccacacacaagucuucucucuauauaggaaccgguuaugcuaugucaaucuuaggcccugcuauuggcuauguauugggaggacaacugcuaaccauauacauugauguugcuaugggagaaaggcacugaugucacugaggaugauccgcgaugguugggagcuugguggauuggguuucuucuaucauggaucuuugcuuggucuuuaauaauaccuuuuucuugcuuuccaaaacauuuaccagguacagcagaaauucaagcuggaaaaacuucccaggcucaucagaguaauaguaaugcagaugugaaauuuggaaaaaguauuaaagauuuuccagcugcucuaaagaauuugaugaagaaugcugucuuuauguguuuaguucuaucaacuucuucagaagccuuaauuacuacuggauuugcuacauuuuuaccuaaauuuauagaaaaucaauucggauugacauccagcuucgcagcuacucuuggaggggcuguuuuaauuccuggagcugcucucggucaaauuuuagguggcuuccuuguuucaaaauucagaaugacauguaaaaacacaaugaaguuugcacuguucacaucuggaguugcacuuacgcugaguuuuguauuuauguaugccaaaugugaaaaugagccauuugcugguguaucugaaucauauaaugggacuggagaauugggaaacuugauagccccuuguaaugccaauuguaacuguucgcgaucauauuauuauccugucuguggagauggaguccaauauuuuucucccugcuuugcaggcuguucaaacccaguugcacacaggaagccaaagguauauuacaacuguuccuguauugaaaggaaaacagaaauaacauccacugcagaaacuuuugguuuugaagcuaaagcuggaaaaugugaaacucauugugcgaaacugcccauauuccuuugcauuuucuuuauuguaauuauuuuuaccuuuauggccgguacuccuauaacugugucuauccuaagguguguuaaucacagacaacggucccuagccuugggaauacaauuuaugguccuucgauuauuagggacaauuccuggaccaauuauauuugguuucacaauagacagcacauguauucuuugggauauaaaugauuguggaauuaaaggagcuugcuggauuuaugauaacaucaagauggcccauaugcuaguagccauaaguguuacuuguaaaguuaucaccauguucuucaauggauuugcaaucuuuuuguauaaaccaccuccaucagccacagaugugucauuucauaaagagaaugcaguugugacuaauguuuuagcagaacaggaucucaacaaaauaguaaaagaagggugaaaugggaaaagagaagacuguuuuacaccuggaaaauuuaccucgauuuuuaagaacacacauugccauggcaggauuaucuauccaauauggacaaucauauuuacaaaauugauguuuuuauaaucaaauguauuuuuuuacuuauguaguuuuuguuuuaugcaagaaacagaccugugccuucaaagcccacguaaagccucaaaacacagcacacacacacacgagcacacacacacacacacacacgaacacacacacacacacacacacgcacacauacacacuuauuuccuauucccauugucuagguaugaaauccucaagcaauaacaagaaaaaaggcccacaauuagaaaaauuuacauuuaaaaaaaauguuguuucuauccccauuacaacuuguuuaauuuuaauuuucauugucaauauuuugagcuuagaacauuuaugguauaaaaauuuaaacuaaucaaaguugugugaugauuuccgggaauuauuauugaaagccuaugaauuuaaaaccagguuuaccauguaauuuguuuuuaaauuuauguauacuagccuggccuuucuccaagcaaauuauugaacuauuagaauauguuaguuaucauccuugugucuuaguauauagugaauacagaaacaucagcauuguauacacauauuuucacuuuaacucaagaauuccaggagguaauuuguugauauuacaauuuuuaacacauuuaugauucugugauaauauuauucaauugcauauauuucagaggaaaguaccagucaguaaagaaaaaugccaacuaaacaugaaacuauugaucaauacuuauauaccuuuaauuuuuccuauuugaaaagccaaccacuuaacacauuacucauagcaccuaagacagugccuugcauaguguagucaucuauuauuauuguuuaauuagaauauuaaacccuacccuuuaacucagcaguccccaaccuuuuuugcaucagggaccauuuuuguggaagacaauuuuuccaugggggaagaagguaugguuuugagaugaaacugcuccaccucagaccaucaggcauuaguuagauucucauaaggagagugcaaccuagaucccuugcaugugcaguucccaauggagugugcacuccuaugagaaucuaaugccacuacugaucuaacaagagguggagcucaggcaguaaugcucacucaccugccucucagcucaccaacuguguggcccgauuccuaacaggccacacacagcccagggcuggggaccccugcuuuaacugaugcauugauuugauaaaguauuuuacaagccugauaauguuauaacccuguuuauucaggucagauuuaugccaacuuugcugagaauauggaggguauagaugagugaacaucaacaaacauaacuucuaccaugguuaagaauuuuacuuaggaaaaguauugaaguucaaauccagauaguauuacauuugaaauuguuauaaggguuauuaauuuaauaaaauucaucaucagguuuccccuauaagcuuucuccuagguuaauuuuccacaagcauuguuuuauauacacuguaaucaggauaacacaagcuuaguguuagaucuuguaggaaaccaagauuagaaacauuagaaauuugcagaauuuaagaaauuauguuuugugguaaucuauggccaacgauguuagaaccuagcgcaauuguaaagugaaauucaaggagaaggaaugaggaguuagggaagcagcauacuugaauauuagagaaggagaggagcugugggucaggaaucagagagaccugcuaaaaccagacagauauaaacaccaaagacggaagccaaauagguagccaaaaauccagauauuugagaagcaggaaauuuauagcaaccaaagaaauagggcaagagaggcaggugaacacacaugauaccucaauugacaaucuuccucccaccaagccagacacguuguaaaugcugcuuccuauuggagcccagaaaaaaggaaaaggaaaguuuaggcuuucuuuguccuuuguguggaagcagggaauuggauugaagacuuucauaguuguaacauaaaggcaaauccugaggaacucacugauggagaugugaaauggcaguaaggaagaaaacagaauaacugaacaaauauauuagucuagggccacuuaauuuagaggaagaaaaaaaaucaacccauccauagaaauaguuugauaaacaggucacuaaaucauuggcguuuauaaagauucuuagcuaucaagggcugcauuguauuuuauauacucaguuuuauaaggugauacuuuuuaaauaagcgcuuuaaugaaaaugguuagacugaaaauaauuuugguccuuaaaaggagucaggagcuuuuauauauaagguacauauuuuaaaagaauaccuccuuuauaacaggguuuuacagacacuaccauaauuuauaaucauuauuuuuuacuuuuggguucaccuagaucauaugaguugaugugauacuucuagaacaaaauuauucauagugcguuuuuuguaauuuaugauuguuaaguaagcuugacuuauaaauugacauuguaauuguguacauaauuggauauauguguuaaaauuuaacauuuagauuuacuuaauuguagaaaauacaaauguaaaacuuacacauggaaagaacuguaugcaguugacuuuacuauguaaauuggagggaaacaaaguuuuagauccauuuucuuucaaaauuuucuuuauuguaaaguaugcaaaauauauauucauaccauuuauuaaaucagaauguuuauacaaaa

SEQ ID NO: 396 - RNA, 4889 nt, Homo Sapiens
ccucugcuuccgccgccgccaccgccgccgccgccgccacagccgccagccgcuucgcguucggcgggggaggaguuggaggcggagaagaaggcggugguggcggguggagguucgagcgcuguucucgcuccggagccgcugcacauuucggaaucuucugcggcuuguccauagugugaauaaaaacuaaaucacaucuauaauucuacugaacuggucacacagacgcugccauauaugucacaguacacugaaaaggagccagcagcaauggaccaagaaucugguaaggcugucuggcccaaaccagcaggaggguaucagacaauuacaggcaggagauauggaagaagacaugcuuaugucaguuuuaaaccauguaugaccagacaugaaagaagcuuaggucgggcuggugaugacuaugaaguguuggaacuagaugauguuccaaaggaaaauuccucagguuccaguccuuuggaucaaguugauucuucuuuacccagugaaccuauauuugaaaaaagugaaacagaaauucccacuugugguucagcauugaaucaaaccacugagagcagucaauccuuuguugcaguacaucacagugaggaaggcagggauaccuuaggaagcaguacaaaucuucauaaucacucugagggagaguauauuccaggagcuuguagugcuucaaguguccaaaauggaauugcauugguucauacagacucuuaugauccagauggcaaacauggagaagauaaugaccaucuucaacuuucugcagaagucguggaagguaguagauaccaggaaucauuaggcaauacaguauuugaguuggaaaacagagaggcagaggcauacacuggucuuucaccaccaguucccucauuuaacugugaaguaagagaugaguuugaagaguuagauucuguaccauuagugaaaaguucugcuggugauacugaguuuguccaucagaauagccaggaaauucagaggucuucucaagaugaaaugguuaguacgaaacaacaaaauaauacuagccaggaaagacagacagaacauucaccugaagaugcagccugugguccagggcauauuuguagugaacaaaauaccaaugauagggaaaagaaccauggaaguucuccugaacagguagugaggccaaaaguuagaaaacugauaaguucaagccagguggaccaagaaacagguuuuaauaggcaugaggcgaaacaaagaaguguucaaagauggagagaggcuuuggaaguugaggaaaguggcucagaugaccucuuaauaaaaugugaagaauaugauggagagcaugacuguauguucuuggauccaccauacucaagaguuauuacacaaagggaaacagaaaauaaccaaaugacaucagaaaguggagccacagcaggaaggcaagagguggauaacaccuuuuggaauggcuguggagauuauuaccaacucuaugacaaagaugaagauaguucugaaugcagugauggggaauggucugcuucuuugccucaucgauuuucugguacagaaaaagaucaauccucaagugaugaaagcugggagacucugccaggaaaagaugagaaugaaccugagcuacaaagugauagcaguggcccugaagaagaaaaccaagaauuaucucuucaggaaggggaacagacauccuuggaagagggagaaauuccuugguuacaguacaaugaagucaaugaaagcagcagugaugagggaaaugaaccugccaaugaauuugcacagccagcuuucauguuggaugguaacaauaaccuggaggaugacuccagugugagugaagacuuagauguggauuggagccuauuugauggcuuugcagauggacuaggaguugcugaagcuauuucauauguggauccucaguuccuuaccuacauggcacuagaagaacgcuuagcccaggcuauggagacugcucuggcccauuuagagucucuugcaguggauguugagguggccaauccaccagcuaguaaggaaagcauugauggucuuccagagacccuuguucuugaagaucacacugcuauuggucaggaacaaugcuguccaaucuguugcagugaguauauuaaggaugauauagcaacagaguugcccugucaccauuucuuucacaaaccuugugucucaauuuggcuacaaaagucgggaacaugcccugugugccgccgucauuucccaccugcgguuauugaagcaucugcagcuccuuccucugagccugauccugaugccccaccuucaaaugacaguauugcagaagcacccuaaaccuugacaguugaaaugagaucaguguaucaaaguaaaucugcaaauuccuucuaaauuucaugugcaaauaauuauauauaaauauauuuaaaaaugcuauauauaguauaugccauaguuuagaaagaauauuaaccuuucuaaacuaaauuuagguuugcagaaaguauuaaacauuuuuaagcugaauguugagacagugcauccauuuucuuuaguugaauauguuuguauuaauuguaaagccaagcuuaucaguugacucucuccagaauaaauaaucaucuguguggcauacguuauuggcuuugucuguaauacugccacuaagugauuauaauuaagcuguccuguuugcaucaaauguaaagacuguguucacaaccguaguaaaauuugguuucauuggaaaugaaacaaauucuaaaguaugcuuuuucacuagucccuuugauuuugcuauaucauaaccucuugguucauaugcugagaaauuuuucagaaaguccauuuuuguuuaaaauuagaacuuuucagaaugccaaaugaaggcuaaaauuuuggccagaacauuacaaaaguuuuaaaucguagacguaacucccccugaaauaaaguuagguaguaaaauccuuaaugaaaccaguggaugugcuuaacguaagguuaguaaagcauacaaagaaucuagugugcucagggcuugguacaaugagcugaauuagauggccuuaugaaacucuuucuaaccucuuacccaaccuguuucuccuugguuaaaauuauacuugaaggcccagaacacucauggcacauuuguuuaauauugcuuauaguuaguuuaagguaauuuugcuucuacaguauuuuggaaggucugaaaacuugcacagggucaucuuuguaauuauauaaccccaaacuaagaugcacaaugucuccuucaggugaucacacacaguggacgaguaugugcaaacauggacauaauaguucacuuacaaaugugauuugauguuaacacuagagaaugaugacuguagaacauuugagcaaguaaaauaguaaagcacauagugaguguauguccgucuaacugguacauugauaauuuaguuugggcacauaaaaggaauauuuauauggcuucccaaaugcagaguuacaucuuauucguguauuucucugaguauuuauaucccgucuccuuuuuucauucuuaaaaauaaaugaauuuucacuguuggcacauaugaggcuuaaauauaaggaacauaacacuugcauucuaauuuuugcauauauuguaaaugugucugguauuuacagcaaaauacuguguauccuuuuauggguaaaacaaaagugaacauugcaugcauguaaugugaugaauuuguaauuuaggaguucuuuggggcuucugugacuugggaaaugcuuacauucaggccuuaauguugcauuagcuagcauguuuucccucugauguauauagucacuguuguauaaacuaaucuuugcuuguuuucuacucugugaucuuuccauaucauauuucauuaaugaucaguuagugucaaggagucaaaacagauuaaaauuaauuucauguguauaugguggaaauuuguggcuagugugauuuuuguuuguuuccuuuuaaguacuguugaucaguugugacacuuacugguuaaacuuacguugcuaaagauuucucuauaauaagccacacauuauauuuagacuauauuaagggaccuugguuuucuucuagauagcagcugucccaaagaaaauauuucuucuuugucuguuaagauuuagcuauuaucugccaguuguuaagagguuuugguuccaaacucaaccagcaauguugagagcugaacuuaagauagcuguuguacuuuuugcuuuccaucuguuacuguccuucauucuuggcucccuacuaucuauaaacagcugcugugaagaagaaaaguugaauaagaguuggcuuaaauuuuaaaaaagaaaaagaaaauugagguuuuaggauuuucaugguaacaagcucugguauaagcuaaggcuggcaaguucagauacuaaaauauuauuugaucauaucuuggauccuuuugaaaaaguuaagacuauaugaagguaaauuagaaauaaguaugaauauuaauaaaauagcauuuaucuuauuucucuauuuuauguugugacuuaaccuaauuuuauuuuuuuaacauuuucuuauuucuuauaauaugaaugcugauauuuaaagguagaucuaugugguauucuuuguguuucuuaauuguuuaacucuuaagauuauuugugaucuggauuuauguauuuguuagauacauacgaauuguuaaaauggaaugcaaguuuuucaaaagcccaggucuaaauguaaugguugguuuauuguucuauaaccccagcccaucauuuucuguguaaaucauaaacaauaaacagaauauacucgguggucauuucuaaua

SEQ ID NO: 397 - RNA, 675 nt, Homo Sapiens
gcacgcgcaagauuagguggggcgccagagccggggcaccugcgcaggcuuggcugcgcccucucgcgccgcacgcucugcggguuccucccuucuuccgagccucuccucuggccgccgcgcgggagagaggccgagauggcagaugagauugccaaggcucaggucgcucggccugguggcgacacgaucuuugggaagaucauccgcaaggaaauaccagccaaaaucauuuuugaggaugaccggugccuugcuuuccaugacauuuccccucaagcaccaacacauuuucuggugauacccaagaaacauauaucccagauuucuguggcagaagaugaugaugaaagucuucuuggacacuuaaugauuguuggcaagaaaugugcugcugaucugggccugaauaaggguuaucgaaugguggugaaugaagguucagaugguggacagucugucuaucacguucaucuccauguucuuggaggucggcaaaugcauuggccuccugguuaagcacguuuuggggauaauuuucucuucuuuaggcaaugauuaaguuaggcaauuuccaguauguuaaguaacacacuuauuuuugccuguguauggagagauucaagaaauaauuuuaaaaccgcauacauaauaaaagacauuguugcauggcuu

SEQ ID NO: 398 - RNA, 314 nt, Homo Sapiens
auggagaagaucuggcaccacaccuucuacaaugagcugcauguggcucccaaggagcaccguaugcugcugacugaggucccccugaauccaaggccaaccacaagaagaugacucagaucauguuugagaccuucaacaccccagccguguauauggccauccaggccauguugucccuguacaccuauggcuguaccacuggcauugugauggacuccagcgauggagucacccacacagugcccaucuacgaggguuacgcccucccccgugccauccugugucuggacguggcuggccgggaccuuacu

SEQ ID NO: 399 - RNA, 3815 nt, Homo Sapiens
guggcccgagucgggaaaauggcugcgaguaccuccauggucccgguggcugugacggcggcaguggcgccuguccuguccauaaacagcgauuucucagauuugcgggaaauuaaaaagcaacugcugcuuauugcgggccuuacccgggagcggggccuacuacacaguagcaaauggucggcggaguuggcuuucucucucccugcauugccucuggccgagcugcaaccgccuccgccuauuacagaggaagaugcccaggauauggaugccuauacccuggccaaggccuacuuugacguuaaagaguaugaucgggcagcacauuuccugcauggcugcaauagcaagaaagccuauuuucuguauauguauuccagauaucuggugagggccauuuuaaaaugucauucugccuuuagugaaacauccauauuuagaaccaauggaaaaguuaaaucuuuuaaauagcuuagcagugggccacugaaugaauguacuuuauacauagcaauaauaaaaaaaagauaucauaaauaaaguuaaaaaggaugguagagaagaaaauauucuuaggaaugacuaacaggauaaguaacaaccugauuauuuauuuacuuuagguuauauaagguucuucaugccugugaauuaauauuauuguguaagaauuaaguuaaaaagccugggcugacuuuuaaauuuauaaauucauuuaucauguuuauaguauauuuauuguuuuucuuucauggcuauuaaaaaguaugacuguaaaggacaaugcaaguaaaccaacuuaauacuguauugaauaauaaguacaauuuauuauuuuacuuugaaacauuaugaauuuacuuuccuacuuuuucuuaguuguuaucuauauaaauugauuaaaaaaacauuuuauguacuucucauuuccuaguacagguugaguaucccuuauuugaagugcuugggaccaaaaguguuucagauuucagauuuuuuucagauuuugguauauuugcauuauacuuacugguugaaauaaaaaaugcugcagugagugucuggagaaaaaaagaaggacgaugaaacaguugauagcuuaggcccccuggaaaaaggacaagugaaaaaugaggcgcuuagagaauugagaguggagcucagcaaaaaacaccaagcucgagaacuugauggauuuggacuuuaucuguaugguguggugcuucgaaaacuggacuugguuaaagaggccauugauguguuuguggaagcuacucauguuuugcccuugcauuggggagccugguuagaacucuguaaccugaucacagacaaagagaugcugaaguuccugucuuugccagacaccuggaugaaagaguuuuuucuggcucauauauacacagaguugcaguugauagaggaggcccugcaaaaguaucagaaucucauugaugugggcuucucuaagagcucguauauuguuucccaaauugcaguugccuaucacaauaucagagauauugacaaagcccucuccauuuuuaaugagcuaaggaaacaagacccuuacaggauugaaaauauggacacauucuccaaccuucuuuaugucaggagcaugaaaucggaguugaguuaucuggcucauaaccucugugagauugauaaauaucguguagaaacgugcuguguaauuggcaauuauuacaguuuacguucucagcaugagaaagcagccuuauauuuccagagagcccugaaauuaaauccucgguaucuuggugccuggacacuaaugggacaugaguacauggagaugaagaacacgucugcugcuauccaggcuuauagacaugccauugaggucaacaaacgggacuacagagcuugguauggccucgggcagaccuaugaaauccuuaagaugccauuuuacugccuuuauuauuauagacgggcccaccagcuucgacccaaugauucucgcaugcugguugcuuuaggagaauguuacgagaaacucaaucaacuaguggaagccaaaaaguguuauuggagagcuuacgccgugggagauguggagaaaauggcucuggugaaacuggcaaagcuucaugaacaguugacugagucagaacaggcugcccaguguuacaucaaauauauccaagauaucuauuccuguggggaaauaguagaacacuuggaggaaagcacugccuuucgcuaucuggcccaguacuauuuuaagugcaaacugugggaugaagcuucaacuugugcacaaaaguguugugcauuuaaugauacccgggaagaagguaaggccuuacuccggcaaauccuacagcuucggaaccaaggcgagacuccuaccaccgaggugccugcucccuuuuuccuaccugcuucacucucugcuaacaauacccccacacgcagaguuucuccacucaacuugucuucugucacgccauaguuggcuacucucaagccagcacauuguuagacccaucuuaauuaagccuuaccuccauguaaagaacagcacgucuguuccaaggaccucagcucuucuuguuucuacagauggcaacagcuccauagggacagcuuguauaauuaccuucagaggccaacugacagaauccuggcaggaacagacauuaucuugccaguuagaaguacuucugucucacuuauguccaaagaguggcuauagaucuuggccuucuucccugaaugcuuuuuuuuuuuggcccccaagaaagucccuuuuauagcacuuuagcacaggcaaugcuacaggaacaaaguuucaaugcugcugagagugaaagaaaggaggaaagucugccacucuacccugagcuggcaguagggcacugaguacccuaggaagaagucagagcaauggauacaaaugaccuugcucuuggauuugcugagcaugaucccuauucugaugucagagauuagguuuaaauggaauagagcuauccauuuguucuuacucucuagggagacaaucuuccaaaacaguuuugggggggucuucuaaagcuuucaaauuggaaguaacuuuauucaacuagaguugaauaaaagaagggcaaaaauaaucucacagagcuuggaacugcugauagcccuuacugagggcaaaagauggcuauauuguuagcuauacuccuaccaaagcaagcaaggagauaggauuauagauaauuucacggacauuuggaaauaacauuggugauuauacagacaagaauaaacucacuucaagcuggucuguuuuaauaaauuuucaacguaauugucuauuuuuuucccucccaucugcaacagaauacauuuuuuucagccuuuaucuagaugagguaaagggaaucauucuuauggugcucuuggagaguuucaggccugugcauguguguacagcaggagguaauaugcuauaaugucugcuguaauauauuugcacaguagaugcuauggaucauucugagcucaggguccagacuuuauucuuauucccagaauuuuguguuacguuuuuaccuccuaacauaugacacuucaucuuauauuaaggaagguuuagaauaucuaauacgacuugaauucauuuguuacuaagccuucucaggcaagcuguauacuaguuacuggucuccacugccaugccuuuucaagguucccaugguccagaaugauguuugauucuuaauuuuucugucccuuuuauaauuuguuuuaaugauuuugcuacauuuggaauucaauaaaaaaugugaacaauaaua

SEQ ID NO: 400 - RNA, 2850 nt, Homo Sapiens
ucaccccacgugguuggagguuuccagaagcgcugccgccaccgcaucgcgcagcucuuugccgucggagcgcuuguuugcugccucguacuccuccauuuauccgccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaauaauagcagaaauuuugaagccagaaggacaacauaugaagcuuaggagugaagagacuuccugagcagaaaugggcgaacuucagucuuuuuacuguguuuuugcaguauucuauauauaauuuccuuaauuuguaaauuuagugaccauuagcuagugaucauuuaauggacagugauucuaacaguauaaaguucacaauauucuaugucccuagccugucauuuuucagcugcauguaaaaggagguaggaugaauugaucauuauaaagauuuaacuauuuuaugcugaagugaccauauuuucaaggggugaaaccaucucgcacacagcaaugaagguagucauccauagacuugaaaugagaccacauauggggaugagauccuucuaguuagccuaguacugcuguacuggccuguauguacaugggguccuucaacugaggccuugcaagucaagcuggcugugccauguuuguagauggggcagaggaaucuagaacaaugggaaacuuagcuauuuauauuagguacagcuauuaaaacaagguaggaaugaggcuagaccuuuaacuucccuaaggcauacuuuucuagcuaccuucugcccugugucuggcaccuacauccuugaugauuguucucuuacccauucuggaauuuuuuuuuuuuuaaauaaauacagaaagcaucuuga

SEQ ID NO: 401 - RNA, 592 nt, Homo Sapiens
aggguccgcgguuggucagaccggagcacuuggccugaagaccuggaauuggcgacuucgauauuaacaaggauggcggcggccgcagcaagucgaggagucggggcaaagcugggccugcgugagauucgcauccacuuaugucagcgcucgcccggcagccagggcgucagggacuucauugagaaacgcuacguggagcugaagaaggcgaaucccgaccuacccauccuaauccgcgaaugcuccgaugugcagcccaagcucugggcccgcuacgcauuuggccaagagacgaaugucccuuugaacaacuucagugcugaucagguaaccagagcccuggagaacguucuaagugguaaagccugaagccuccacugaggauuaagagcaacagccccagagccugggcucugcuggacuuaguauaaugugaaaaaaauguguucuccuauuccucauaaagcuugugcuguaaaauacuuucucaggguguucuuguccucaucuacccucuaccccuuacugugcaaccacugaggcaaaguagcuuaauauaaaaauaaaacuuuauucugucucaucaaaa

SEQ ID NO: 402 - RNA, 1212 nt, Homo Sapiens
ggcugcagaggggaaggcggcuaccaguguaaagccagagcugagguucuugauaguccacaaugggugaaccacagcaagugagugcacuuccaccaccuccaaugcaauauaucaaggaauauacggaugaaaauauucaagaaggcuuagcucccaagccucccccuccaauaaaagacaguuacaugauguuuggcaaucaguuccaaugugaugaucuuaucauccgcccuuuggaaagucagggcaucgaacggcuucauccuaugcaguuugaucacaagaaagaacugagaaaacuuaauaugucuauccuuauuaauuucuuggaccuuuuagauauuuuaauaaggagcccugggaguauaaaacgagaagagaaacuagaagaucuuaagcugcuuuuuguacacgugcaucaucuuauaaaugaauaccgaccccaccaagcaagagagaccuugagagucaugauggagguccagaaacgucaacggcuugaaacagcugagagauuucaaaagcaccuggaacgaguaauugaaaugauucagaauugcuuggcuucuuugccugaugauuugccucauucagaagcaggaaugagaguaaaaacugaaccaauggaugcugaugauagcaacaauuguacuggacagaaugaacaucaaagagaaaauucaggucauaggagagaucagauuauagagaaagaugcugccuuguguguccuaauugaugagaugaaugaaagaccaugaaagauguuucuuuuucuuuuuuuccuuuugauaauagcaucauauauuaguucauuuucuuuuggacagucuuaagagaaguuucacuaaaaauguaaacagcuuuaaucuugacuccaaauuuuucaauuaugagaugucauaggcaguaauuucgcuguauaacaagcauagacaaaugagugucccugcacuaagaagaaucacuuuaaaaagcaaaguguuagcugcuguuguaugggacauuccuauguuuuagaguugcaguaaaacuuugaugauaaccucaauaauagcaaagugggguaugggcuggguacgguggcucacacuuauaauccuagugcuuugggagguugaugugagaggaucacuugagcucaggaauuugagaccaaugggggcaacauagugagaccuucucucucuuacaauuuaauuaaaaaaa

SEQ ID NO: 403 - RNA, 104 nt, Homo Sapiens
auccuuucagcagcacauauacuaaaauuggaaugauacagagaagauuagcauggccuguaugcaaguaugacacagaaauuugugaagcauuccauauuuuu

SEQ ID NO: 404 - RNA, 2584 nt, Homo Sapiens
gaagcgaaaaccaaguuaagaaguccuguuauuugggucauggucuacgugaaacaucaaagaaaccuguaacggaaaacgacuuguuugaaagagccaguucucuauccaaauuuaccaaucagaaucuugcacugaaaaaauaaaccaaucgugaaucucuacggccacuuccggaauuuagcaaccgaucacuaacagggaucguccacaauccaaucagagugauucuguuccuauauagaggggcaaaccaaucuuccuaacucauuuacuuugcagaugaacuauggcgcguacuaagcagacggcucguaaauccacaggcgguaaagcaccgcgcaaacagcuggccacuaaggcagcucgcaagagcgcuccggccacgggcggcgugaagaagccccaucgcuaccgcccuggcaccguggcucugcgcgagauccgucgcuaccagaagucuaccgagcuucuaauccggaagcugccguuucagcgccuggugcgagaaauagcucaggacuucaagaccgaccugcgcuuccagaguuccgcggugauggcgcugcaggaggccugcgaggccuacuugguggggcuuuucgaggacaccaaccugugcgcuauucaugccaaacgcgugaccaucaugccuaaagacauccagcuugcccgccgcauucguggggagagggcgugaauuguuuugaguacaaaccuuaaauccaaaggcucuucucagagccaaccacuuuguccgugaaaagggcuguaauccuuugagacgcauuagaccacuaaacugcacugauccaaauagacauuugaaauaguggcauucaguucccucgaugcuucauuuaaauuuccaaauuuaagcgcucccucagguuuucgccuagggcugggccucccuacgcuguucuccauugguuuagcuggcuuuguuuugcuguucaggcccucugcugcuuucuuguacauuguucucguuuucuaaacuccuggccacuuaauuguacccugcuuaacccauccucuuguuuucuggcucaacgcucuuucaugugguggccugcauuuuaggucuuaacugcauaggcuuucaacgccuugguuuugccuuuccuugauguuuauuugaccuugcccgaggggccagcgcuuuugaucugcaucaggcugccuuacuccacuaguguuuugagacccagcuacuugccggcgacggucggugccuugggugcggucaacguuacucucugugcgccugauacuggucuaaggcuaagguuauuagcuggaacaccuagacccguggcacuaacacacagcucuugcagacuugacagccuugcauagguucuaaacugcaggagucaaagcaacgaaggugcagaugggugugucucaaaccugagugcgaaaggaaaaugcagaaaucaugagccuuuucaacuuuccaguugauaucuuuuguuugcuuuuuucuuuucuuauuuauuuauuuauuuauuuugagacggaguuucgcccuuguugcccaggcuggagugcauuggcgcgaucucggcucaccgcaaccuccgccucccggguucaagcgauucuccugccucagccuuccgaguagcugggauuacaggcaugagccaccucgcccggccuuccggcugauaucuuaaaagaacuuuucaacuuuaguaaauacccugucuuaaucaaaucucauuaaaaguaccccauauuuaucaacaaaacaugaaaauccuuggacggcuucaaaguucuuacagaaaauauucugccuuuccuuuccauacaaaggcacagcuucgaaacugguaggugaagggaaggaaaauaaggaauucuguuacgaaaucauacaggcuguuauuuggaaauacagaaggguguauguacuauaugggauacugcaugcuauuuggaagaauuuuguuuauuuaaacauuucagcaaauuccucaguuuugauauggggugcaguauuuuuaacucauugagaaauuucuacuaacuuuuuugaaugugcucuuuucccacuaguugcacuaaggaaagagguuagucaugugguaaaauuaauagugacaaagcuguaaauagcucugcaggccaagguagccauaguaagaaguccuggagauuuauggaagaaauuuuuguucauggaagccugucagacaugaagaugugggucuugugaauuggagauucagugcgugaggaaaacagccuaacuauccauaauuaagguaacuacugucagauauuuguaacauagugaacauccuauuaugcuagauagaagcauucucuauuugaauguuguuuccuguauccuguacuuucuuuaagauucuagcucaacaaguuuuaaccuguauuucucuuacagcuacuggaauucaguacgugaggacuuggacuuggugggcacagaaugcaucuuuuuauaucauuaaauccaccagaacaucuagcauggucauuugccuaaaacaaagccucuggaaauuuagucaaguugagauguaaaauaaaagauuacugaacagaa

SEQ ID NO: 405 - RNA, 2654 nt, Homo Sapiens
gauaauaggccuuuugccaugucugggcguggcaagcagggaggcaaagcucgcgccaaggccaagacccgcucuucucgggccgggcuucaguuucccguaggccgagugcaucgccugcuccgcaaaggcaacuaugcggagcgggucggugcuggagcgccgguguaccuggcggcggugcuggaguaccugaccgccgagauccuggagcuggcuggcaacgcggcccgcgacaacaagaagacucgcaucaucccgcgucaccuccagcuggccauccgcaacgaugaggagcucaacaagcuucugggcaaagucaccaucgcacaggguggcguccugcccaacauccaggccgugcuacugcccaagaagaccgagagccaccacaaggcgaagggcaaguagaagccuggauuaguuugcagcaacucaaucccaaaggaaccaaaggcucuuuucagagccaccuacaauuuuguggaagaacugagcacuauguuuaauguaauuucucgucuuugccuacuucuaaaccacuccaaagguuacguagaucagucuucggugucuugguuagguagugacaaucucguuagcuuuauaaaaagccuggauaacauuaaaaguauuaaacacgccuucaucuuaagcuuaguggaagaaaauuuaguuuuuccuaagcuggcauuauccaaguauguugaauucuguaugguucaccgucggguuuuacuuuuagucuguugaagcaaacaugucugcuuuggggccagauguuuucugggucuugguaaauaacaaaccgggcauucgacguucaauccaaaucuagaucaacgacuuggauucuucauuucugagaaauaucucucgaaucuguauaauuaauugcauuugaacauuaaugauugaguugagaauaauuauuagacuaauuagaacaguuacuuauggugccagguaguucucuuugaagcauuuucugaaaauucauugaaauuaaaauuucccgagcuuucccacccccagccacacaaauugauuucuuaguacagagaugacuuaauuuguuucagcaugguaaauuccacuuuuaaaauaucugacuugauguuuuuaaucugaaucagaucuggauguacgaauggaauagauucuuaaaagaaaaugaauuacauuucuagaguauuggaaaaauaagcugcaauggaauuacuuuaaucuaaaagugaaaaguucacauaaaguuguuucuuugacauuuuuuggccuugaauuucucacaugcgaaccagcuuuucuugguuauaaaaauagaaguuuuuuaaauuuaaguggucaaaagauagaaaauugaggggacagguguauaaggcuguccuguccaguauugcagccacuagccaauuguggauagugaucauuggaaauuccauagcaugaauuuuauauaaaauacacauugcauuuggaaaagucagugccaaaaaguguaaaauaccuaacaauuuuaauuucgauaacauugaaauauguuggcuauauuggauuaagcaaaauauuaaaaauuaauuuuuccuuguuuuguuacaauguucuccuagauaaguguaaauuacuuauauugcucucauuuccacuggaaaucgcuaguauagugaacaacuguauagcgaaaauagaaaauaaaauauggagaccaugaacugcuaagucugucagaggaauaggugaacaacaaaaauuugaguccuucgccaauccgguuacuguuggguaggccuucagcauacuuuuguccaaucagcuucagacucucacuauaaauaagcggcuagcuuucucuuucuccugaagugaaucuagcucugaaggcauggcgcguacgaagcagacugcucgcaaguccaccggcggcaaggcuccgcgcaagcagcuggccaccaaggcggcucggaagagcgcuccggccaccggcggugucaagaagccccaucgcuaucggccugguacaguggcucuccgcgagauucgccgcuaccagaaguccaccgagcugcugaucagaaagcugccuuuucagcgucuggugcgugagaucgcgcaggacuucaagaccgacuugcgcuuccagagcuccgcggugauggcgcugcaagaggcaugcgaggccuaccugguggggcucuuugaggacaccaaccugugcgccauccacgccaagcgggugacuaucaugcccaaggacauccagcucgcacgucguauccgcggcgagagggcuugagucucaaggacucacugauuacauacccaaaggcucuuuucagagccacccacaugcgcgcugaaaagaucuguuucucucaggaauucuuccugguacuuguuuugccuguaguagauagggcccauuuccagacguuauacaaucuguuucguaagacucagccuaucccuuuuugaaugcuaauuuugggagucuuaacaucuaauaauguccggcauuuuuccguaagcauugaguguagccaaaaguuccuucguguauugcucucccaucuccgcagcccgguuuugaccggauggugcuucuaauuuucugcuaaccuguacugugguguguguauauuucuugccaacacgcc

SEQ ID NO: 406 - RNA, 1365 nt, Homo Sapiens
caaaaauuugaguccuucgccaauccgguuacuguuggguaggccuucagcauacuuuuguccaaucagcuucagacucucacuauaaauaagcggcuagcuuucucuuucuccugaagugaaucuagcucugaaggcauggcgcguacgaagcagacugcucgcaaguccaccggcggcaaggcuccgcgcaagcagcuggccaccaaggcggcucggaagagcgcuccggccaccggcggugucaagaagccccaucgcuaucggccugguacaguggcucuccgcgagauucgccgcuaccagaaguccaccgagcugcugaucagaaagcugccuuuucagcgucuggugcgugagaucgcgcaggacuucaagaccgacuugcgcuuccagagcuccgcggugauggcgcugcaagaggcaugcgaggccuaccugguggggcucuuugaggacaccaaccugugcgccauccacgccaagcgggugacuaucaugcccaaggacauccagcucgcacgucguauccgcggcgagagggcuugagucucaaggacucacugauuacauacccaaaggcucuuuucagagccacccacaugcgcgcugaaaagaucuguuucucucaggaauucuuccugguacuuguuuugccuguaguagauagggcccauuuccagacguuauacaaucuguuucguaagacucagccuaucccuuuuugaaugcuaauuuugggagucuuaacaucuaauaauguccggcauuuuuccguaagcauugaguguagccaaaaguuccuucguguauugcucucccaucuccgcagcccgguuuugaccggauggugcuucuaauuuucugcuaaccuguacugugguguguguauauuucuugccaacacgccagaaauaaaacuaagguuguacugaaguuggaaaaauucagguuaauguagcucaugcuggcuaaagugaaacguucucuccccgccccccguuccuaagcaguguuaaguuuucuuugaauuuuuucaagccggauuuugggccugcuuaaaccacuuaaauguaguuaaugacagaugguuugagguuuaaaagucuucuggagaaagcccgccagagaacauucccuuugaagccccauguaaaaauacgugugggagagaaaguguuuucucugacuucugcugacaguggcuaaaacucugaacugucaggaguauucaaaauaagacugccuuguagguaagccugugguaguuuuuuugagcacaggauaaaauacuugagucuuugcuuaaauguuacuuucucaaugaggcuuuguaugacuaaauaaaaucuguauaauccccac

SEQ ID NO: 407 - RNA, 330 nt, Homo Sapiens
auggcugcgcagggacagccccagguccaguucaaacuuguauugguuggugauggugguacuggaaaaacgacuuucgugaaacaucauuugacuggugaauuugagaagaaguauguagccaccuuggguguugagguucauccccuaguguuccauaccaacagaggaccuguuaaguucaauguaugggacacagccggccuggagaaauucaguggacugagagauggcuauuauauccaagcccagaguaccaucauaguguuugauguaacaucgagaguuacuuacaagaaugugccuaacuggcauagagaucugguauga

SEQ ID NO: 408 - RNA, 1547 nt, Homo Sapiens
ggaggaaggcuucugagaagacuggugggagagaaggagagccugcagacagaggccuccagcuuggucugucuccccaccucuaccagcaucugcugagcuaugagccaaaccagggauuuacagggaggaaaagcuuucggacugcugaaggcccagcaggaagagaggcuggaugagaucaacaagggcaauuccuagacgaucccaaauauagcagugaugaggaucugcccuccaaacuggaaggcuucaaaggugagggggaaacuguaggcgguggagacagggcuggggguaggaggguuaggauuuccacaagaacaaggcaggaacagcagagauaaaaaguuuacuuuugugguagcaaaaggggaaccugccuuuauugcccuccugccacacugcggucccuuucccgggccugccucucucagcauccccucuagcuccuuacacccuagcggggccccucaacuccccaaccccacuuccucugccugccccuccuccuccuuccacguugucuccuccaccuagcaguugguuggcaaccccuuccucaguccccugcugaaaacccuccagucagcgcuuaucccuucugcucucuccccucacccagagaaauacauggaguuugaccuuaauggaaauggcgauauuggugagaaacgggugauuugcgggggcaggguggugugcaggccuaagaagacagaggucucuccuacaugcuccauuccucaugauuugggagggggcccaccuaccacagugggaggaaggagaauggggaugcggaagugggagaggagagagagggucuccccaccuucuccccauccccauccucugcccccagauaucaugucccugaaacgaaugcuggagaaacuuggaguccccaagacucaccuagagcuaaagaaauuaauuggagagguguccaguggcuccggggagacguucagcuacccugacuuucucaggaugaugcugggcaagagaucugccauccuaaaaaugugagugucaauuuccaaccuccccuguacuuaccuguuuucuccucccccaucccuacccuuguccacaggcucaacauuucuacacguugcccaucaucccuucuuccauccuuagagggacccuuccaaggucccgaccccaucccuauccauaguccugguccccagaaacuccaaccccugcccuuccucuucccccuuccacccucacauccccauccccuucuagccuuuccuagcacccuaugauuuauucccuugagaggaguguucccugaucccugugccucuucccaucucaaccaggauccugauguaugaggaaaaagcgagagaaaaggaaaagccaacaggccccccagccaagaaagcuaucucugaguugcccugauuugaagggaaaagggaugaugggauugaaggggcuucuaaugacccagauauggaaacagaagacaaaauuguaagccagagucaacaaauuaaauaaauuacccccuccuccagaucaaguca

SEQ ID NO: 409 - RNA, 3945 nt, Homo Sapiens
ggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucuauauuaaccagcuucagcagauuaugcgucugacaggaacaccccccgcuuaucucauuaacaggaugccaagccaugaggcaagaaacuauauucagucuuugacucagaugccgaagaugaacuuugcgaauguauuuauuggugccaauccccuggguaaguugaccauauauccucaccucauggauauugaauugguuaugauauaaauuggggauuugaagaagaguuucuccuuuugaccaaauaaaguaccauuaguugacugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuu

SEQ ID NO: 410 - RNA, 2476 nt, Homo Sapiens
aaugcgccucaccccuggcgaccccggaagugggucgggggcuuggccucugcccggccacagagccggagcuggaggugcugucccgucuggcggcgauccccgggcagggcccggggccgggguuugaagaugcugaacgucccuucccagucuuucccggcccccaggucgcagcagcgugucgccuccggggggcguagcaagguaccuuuaaaacagggcagaagccuuauggauuggauucgacugaccaaaaguggaaaggaucuaacgggauuaaaaggcagguuaauugaaguaacugaagaagaacuuaagaaacacaacaaaaaagaugauuguuggauaugcauaagagguuucguuuauaaugucagcccuuauauggaguaucauccugguggagaagaugaacuaaugagagcagcaggaucagaugguacugaacuuuuugaucagguucaucguugggucaauuaugaauccaugcugaaagaaugccugguuggcagaauggccauuaaaccugcuguucugaaaggcaaacucuggcaccuguagagcugaggauggagauagacaccaggaccuauagugggcugagacauuacuuucaaagauuucuuuuacugucacagcacugugagcaaggacaagacaucuauugaaugggcugccugccaguuggaaguucaacuuuuguaaagucagucaaaguucuuucuucuagaagccucaguuuccucauugguaaaauggagacaauuuagacuaucgugaggaggaaaagaaagucuuaaauggcaugcuucccaagagccaagugacagauacacuugccaaagaagguccuaguuauccaagcuaugauugguuccaaacagacucuuuagucaccauugccauauauacuaaacagaaggauaucaauuuagacucaauaauaguugaucaucagaaugauuccuuuagagcagaaacaauuauuaaggauuguuuauaucuuauacauauugggcuaagccaugagguucaggaagauuuuucugugcggguuguugagagugugggaaaaauagagauuguucuacaaaaaaaagagaauacuucuugggacuuucuuggccauccccugaagaaucauaauucacuuauuccaaggaaagauacagguuuguacuacagaaagugccaguuaauuuccaaggaagauguuacucaugauacgaggcuuuucuguuugaugcugccaccaagcacucaucuucaagugcccauugggcaacauguuuaccucaagcuaccuauuacagguacagaaauaguaaagccauauacaccuguaucugguuccuuacucucagaguucaaggaaccaguucuucccaacaauaaauacaucuacuuuuugauaaaaaucuaucccacuggacucuucacaccagagcuugaucgucuucagauuggagauuuuguuucuguaagcaguccugagggcaauuuuaaaauauccaaguuccaagaauuagaagaucucuuuuuguuggcagcuggaacaggcuucacaccaaugguuaaaauacugaauuaugcuuugacugauauacccagucucaggaaagugaagcugauguucuucaauaaaacagaagaugauauaauuuggagaagccaauuggagaaauuagcauuuaaagauaaaagacuggauguugaauuuguucucucagcaccuauuucugaauggaauggcaaacagggacauauuucaccagcucuucuuucugaauuuuugaaaagaaauuuggacaaauccaaaguucucgucugcauuuguggaccagugccauuuacagaacaaggaguaagguugcugcaugaucucaacuuuuccaaaaaugagauccauaguuuuacagcauaaugaagagcugucauuguccuuuauucaacuaguuuaucuaaauuugugauugcuuaggguuuuuuaagagaacauuuuuguacauaacaaaagguuaacuagaauccagccuucaguuucuuaaaugaaaucaaauguuccuucaguacagguaacuucuuggcuuucuuuuguaccacaacuuauuuuacuacugauauuugaccuggaaaguuaaucauggcaacaaauacauacaggauucuuuguuaugaaucacaaauuuccuugccauuuaaauuauaucacuguucuacaauaagcacuuguguuuuaugacaugauaaaguaaaugaucacuucgaucauguuucuaugcuguaaaaugucuuauuagcaauacagauuaaauuuuaccuugcacuguuaacucaggaaaugaucauuuauguccuuguuauuaauguuaaaacauagaauguuauaacuuauuaagugauccaaacauuuuuuuguguguguauggcauugaugcagaauagaauaaaauuauacuuaaguucuuuuuaa

SEQ ID NO: 411 - RNA, 1851 nt, Homo Sapiens
aguuccgcggggggcugucggggaaccauggcugccccgagagacaaugucacuuuauuauucaaguuauacugcuuggcagugaugacccugauggcugcagucuauaccauagcuuuaagauacacaaggacaucagacaaagaacucuacuuuucaaccacagccguguguaucacagaaguuauaaaguuauugcuaagugugggaauuuuagcuaaagaaacugguagucuggguagauucaaagcaucuuuaagagaaaaugucuuggggagccccaaggaacuguugaaguuaagugugccaucguuaguguaugcuguucagaacaacauggcuuuccuagcucuuagcaaucuggaugcagcaguguaccaggugaccuaccaguugaagauuccguguacugcuuuaugcacuguuuuaauguuaaaccggacacucagcaaauuacaguggguuucaguuuuuaugcugugugcuggaguuacgcuuguacaguggaaaccagcccaagcuacaaaaguggugguggaacaaaauccauuauuaggguuuggcgcuauagcuauugcuguauugugcucaggauuugcaggaguauauuuugaaaaaguuuuaaagaguucagauacuucucuuugggugagaaacauucaaauguaucuaucagggauuauugugacauuagcuggcgucuacuugucagauggagcugaaauuaaagaaaaaggauuuuucuaugguuacacauauuaugucugguuugucaucuuucuugcaaguguugguggccucuacacuucuguugugguuaaguacacagacaacaucaugaaaggcuuuucugcagcagcggccauuguccuuuccaccauugcuucaguaaugcuguuuggauuacagauaacacucaccuuugcccuggguacucuucuuguauguguuuccauauaucucuauggauuacccagacaagacacuacauccauccaacaaggagaaacagcuucaaaggagagaguuauuggugugugauuuuagccucacgugagacuccuuuuaagacuaaaccauuugcauuaaacuagagccuuaagucaaucucagaagguagcauaaacaaauaaaaauuaacuguauggcaugaucagugcgguuauguggaaacaacaacaaacaaacgaagcuaucugagugaacugcuaauacagaaacuuaauguagaccuguuuggggucuacuauuguuuuagaaugaaggaauuguauuauuguguguauauauaauuuguaaauaaaaaguauggagaugauacgguguuaaaaaaaaucaugguaaggcuacaauacucaaguaacaagguuugggacaaugucuaaggguuaaagugccaaagccauuucuguacuaacuguucucuuguuccgguaccggggagaaggaugaccccuccuuauucuccaauucauguacaguauuuuguccuagcagcauaaagaccuagcucuuuucuuacaagaggcagaaacaagacaggcuaguucauaaacaaacuguguaacuucucaaaaugaaucuauuucauaacucggacaauuucuggguggugacugaguaccccuuuagugaguaccccuuuagugcuauauuugugccauucauuaucugguucauauuucuuuucuguuagaugauacacauuucuucaaaaaaauuucuaaugucacuuuuguacuuuuuuaaauaaaguauguuuaacuguugggcucucaauaauuugugaaauuucaguguuuucuauaauguuaauggggaaauucagcaauaaacuuuauuuguaagaaa

SEQ ID NO: 412 - RNA, 1851 nt, Homo Sapiens
cgcuaaacagcagcugaaggucaggcgaacugacucgcugcggaaucugccuuugcacgugaucagucggacgucuacacccgcagccgucuucugucuccgccucacccucaggccugacgguccgaguggagcugcgggacagcccgaaccuccaggucagccccgcggcccuccauggcgcuggugcgcgcacucgucugcugccugcugacugccuggcacugccgcuccggccucgggcugcccguggcgcccgcaggcggcaggaauccuccuccggcgauaggacaguuuuggcaugugacugacuuacacuuagacccuacuuaccacaucacagaugaccacacaaaagugugugcuucaucuaaaggugcaaaugccuccaacccuggcccuuuuggagauguucugugugauucuccauaucaacuuauuuugucagcauuugauuuuauuaaaaauucuggacaagaagcaucuuucaugauauggacaggggauagcccaccucauguuccuguaccugaacucucaacagacacuguuauaaaugugaucacuaauaugacaaccaccauccagagucucuuuccaaaucuccagguuuucccugcgcuggguaaucaugacuauuggccacaggaucaacugccuguagucaccaguaaaguguacaaugcaguagcaaaccucuggaaaccauggcuagaugaagaagcuauuaguacuuuaaggaaaggugguuuuuauucacagaaaguuacaacuaauccaaaccuuaggaucaucagucuaaacacaaacuuguacuacggcccaaauauaaugacacugaacaagacugacccagccaaccaguuugaauggcuagaaaguacauugaacaacucucagcagaauaaggagaagguguauaucauagcacauguuccagugggguaucugccaucuucacagaacaucacagcaaugagagaauacuauaaugagaaauugauagauauuuuucaaaaauacagugaugucauugcaggacaauuuuauggacacacucacagagacagcauuaugguucuuucagauaaaaaaggaaguccaguaaauucuuuguuuguggcuccugcuguuacaccagugaagaguguuuuagaaaaacagaccaacaauccugguaucagacuguuucaguaugauccucgugauuauaaauuauuggauauguugcaguauuacuugaaucugacagaggcgaaucuaaagggagaguccaucuggaagcuggaguauauccugacccagaccuacgacauugaagauuugcagccggaaaguuuauauggauuagcuaaacaauuuacaauccuagacaguaagcaguuuauaaaauacuacaauuacuucuuugugaguuaugacagcaguguaacaugugauaagacauguaaggccuuucagauuugugcaauuaugaaucuugauaauauuuccuaugcagauugccucaaacagcuuuauauaaagcacaauuacuaguauuucacaguuuuugcuaauagaaaaugcugauucugauucugagaucaauuugugggaauuuuacauaaaucuuuguuaauuacugagugggcaaguagacuuccugucuuugcuuucuuuuuuuuuuucuuuuugaugccuuaauguagauaucuuuaucauucugaauuguauuauauauuuaaagugcucauuaauagaaugauggauguaaauuggauguaaauauucaguuuauauaauuauaucuaauuuguacccuuguugaaauugucauuuauacaauaaagcgaauucuuuaucucuaaa

SEQ ID NO: 413 - RNA, 1556 nt, Homo Sapiens
aguggguggagccagcuguccucauuagauaaagguuguuuauucaacccaaguauaaauggaaaaaaaagaugcgcccucugucacugaggguugacugacuggagagcucaagugcagcaaagagaagugucagagcaugagcgccaaguccagaaccauagggauuauuggagcuccuuucucaaagggacagccacgaggagggguggaagaaggcccuacaguauugagaaaggcuggucugcuugagaaacuuaaagaacaaguaacucaaaacuuuuuaauuuuagagugugaugugaaggauuauggggaccugcccuuugcugacaucccuaaugacagucccuuucaaauugugaagaauccaaggucugugggaaaagcaagcgagcagcuggcuggcaagguggcagaagucaagaagaacggaagaaucagccuggugcugggcggagaccacaguuuggcaauuggaagcaucucuggccaugccaggguccacccugaucuuggagucaucuggguggaugcucacacugauaucaacacuccacugacaaccacaaguggaaacuugcauggacaaccuguaucuuuccuccugaaggaacuaaaaggaaagauucccgaugugccaggauucuccugggugacucccuguauaucugccaaggauauuguguauauuggcuugagagacguggacccuggggaacacuacauuuugaaaacucuaggcauuaaauacuuuucaaugacugaaguggacagacuaggaauuggcaaggugauggaagaaacacucagcuaucuacuaggaagaaagaaaaggccaauucaucuaaguuuugauguugacggacuggacccaucuuucacaccagcuacuggcacaccagucgugggaggucugacauacagagaaggucucuacaucacagaagaaaucuacaaaacagggcuacucucaggauuagauauaauggaagugaacccaucccuggggaagacaccagaagaaguaacucgaacagugaacacagcaguugcaauaaccuuggcuuguuucggacuugcucgggaggguaaucacaagccuauugacuaccuuaacccaccuaaguaaauguggaaacauccgauauaaaucucauaguuaauggcauaauuagaaagcuaaucauuuucuuaagcauagaguuauccuucuaaagacuuguucuuucagaaaaauguuuuuccaauuaguauaaacucuacaaauucccucuugguguaaaauucaagauguggaaauucuaacuuuuuugaaauuuaaaagcuuauauuuucuaacuuggcaaaagacuuauccuuagaaagagaaguguacauugauuuccaauuaaaaauuugcuggcauuaaaaauaagcacacuuacauaagcccccauacauagagugggacucuuggaaucaggagacaaagcuaccacauguggaaagguacuauguguccaugucauucaaaaaaugugauuuuuuauaauaaacucuuuauaacaagauua

SEQ ID NO: 414 - RNA, 1308 nt, Homo Sapiens
gcacugucucuaugcuccccagcgucuagucuauuuauugucgcggggaagcugcggccgccucgcacccggaacaacaaagcaaggaagagcgagguuucaccaggcuggucuccaacuccugaccucaaaugauccacccaucuuggccucccagagugcugagauuacaggcgugaggcaccacuccuggaugugaucuucgugguggaaagcuaaauuuuaaaaccaccccaauggaugcagacagugauguugcauuggacauucuaauuacaaauguagucuguguuuuuagaacaagaugucauuuaaacuuaaggaagauugcuuuggaaggagcaaauguaauuuauaaacgugauguuggaaaaguauuaaugaagcuuagaaaaccuagaauuacagcuacaauuugguccucaggaaaaauuauuugcacuggagcaacaagugaagaagaagcuaaauuuggugccagacgcuuagcccguagucugcagaaacuagguuuucagguaauauuuacagauuuuaagguuguuaacguucuggcaguguguaacaugccauuugaaauccguuugccagaauucacaaagaacaauagaccucaugccaguuacgaaccugaacuucauccugcugugugcuaucggauaaaaucucuaagagcuacauuacagauuuuuucaacaggaaguaucacaguaacagguauucuaugauauugaaaccacacuuaucaauuauggauugaaugauacaaggcccaauguaaaggcuguugcuacugcuguggaacagauuuacccauuuguguuugaaagcaggaaagaaauuuuauaauucaccacuuaauugguuagaaucucuaacugagcaccuuuuaaaccugcugcacauuggacucaaaaggaaaacuggaccaacaauaauugaggaaauagacucuuuuauucauucacggcuacaguguaagcuccagucccuuuggauuuuauuccaaaccuugcuguaauauaaaaggaaguuuacaagacaugauauugcugcuuuuacaaaaggacauucuauuuauuuucgcaguaauucucauguccccauaagcagagcugucacagugugcacuaccuuagauuguuuuauugucgucauuguuauuuuuuuccauuuugagcuaauguguuuuauuugugaauagucuuuuacauuuuuguaugcugaauaugggcaccaaagaaccuguaaaaguuaucuuuuucaauugaaugugcacaaauaaaaguuuggaaaagaucucucuuc

SEQ ID NO: 415 - RNA, 1020 nt, Homo Sapiens
ggcgggccgaagcgaggugcggcucccugucgccgcggaggggcgggggcaggacgcgcaacuccggccggagcuguccggggucgugagccggccccgccuugguggcggcgcccccucgcgguccagaggcagaccccggaaguuaugagauccgacacuauggaccagccaagugggucagcacguccguggagucuauggacugggauucagccauccagacgggcuuuacgaaacugaacagcuacauucaaggcaaaaacgagaaagagaugaaaauaaagaugacagcuccagugacaagcuacguggagccugguucagguccuuuuagugagucuaccauuaccauuucccuguauauucccucugaacagcaauuugauccacccaggccuuuagagucagaugucuucauugaagauagagccgaaaugacuguguuuguacggucuuucgauggauuuucuagugcccaaaagaaucaagaacaacuuuugacauuagcaagcauuuuaagggaagauggaaaaguuuucgaugagaagguuuacuacacugcaggcuacaacaguccugucaaauugcuuaauagaaauaaugaagugugguugauucaaaaaaaugaacccaccaaagaaaacgaaugagaaaaaugaaaggaaguucugcugucagaggcaaaacaucuguuuaucauagacaucaacaugaccuauaaguaaagugcgugucuagugucuucuauugagaguacuacuauuaauuaagcuuauuuccaaugugccuuuuuaaugcuugaaguuuuaucuacauacacagguaacagaggacaguagucuguaaacauauaaaucggucauaacuaucguggucuuuauuucugugaggaucuagggaaauuucaugucacuucccuccuucacugcaucacaaucauauucccuuuuuuuuuucuuggauuugugucaguuggaugauauccccuccagauaguaucaauaaaauguuaaaauu

SEQ ID NO: 416 - RNA, 1066 nt, Homo Sapiens
cuggcgcacacagcgggaggggagggagcccaggaugugcacgcacccucucccucauccaccgcugucaccuccugcugcucuuccugcugcucguguacucguuaggugcggacccgccaccucuuuugugaagcagcagcugaggagacuccgguguucaccauggccaacgaaaagcccacagaagaagucaagacugagaacaacaaucauauuaauuugaagguggcgggacaggaugguucuguggugcaguuuaagauuaagaggcagacaccacuuaguaaacuaaugaaagccuauugugaaccacggggauugucagugaagcagaucagauuccgauuuggugggcaaccaaucaguggaacagacaaaccugcacaguuggaaauggaagaugaagauacaauugauguguuucaacagccuacgggaggugucuacugaaaagggaaccugcuucuuuacuccagaacgcuguucuuuaaagaccaagauuacugcauucucaauuagaaaacugcaauuugguuccaccacauucugacuacuacaguauaguuuucucuauucuuuuguuucccccuuccacauucuuuuauuauacaugaaguaacugguauguguacacaagcauauugcuuuuuucuucaaaccaaacagccaaugguauguuuugauugacaucaaguggagacaggaugggaaaaaauacugauucugugaaaauacccccuuuauccauuaguggcauguucauucaggucuuaucuuuauauucuaguaaguuauuuugcucucacuguuuuaacaacaacaaaaaaaaauucucacauaccuuguucaauuggaggauuuucauguuuuucauuuaucauuguaaaaccaaggacaauuuuauaacuuuuguguacauagcuguuacauguagggcaaucugucuuuaaguagggauaaauuacucuaaaaaaaaaagaaagaauccuagaaaguuuuuccuucaagucaggcuucuuauuuaaauaaacuuuuuguuuaaaaugaaauaaaaauaaaaaca

SEQ ID NO: 417 - RNA, 1349 nt, Homo Sapiens
aaaaccuugaggugauucaucuuccaggcucuccuuccaucaagucucucaucccuagcgcucuggguccuuaauggcagcagccgccgcuaccaagauccuucugugccucccgcuucugcuccugcuguccggcuggucccgggcugggcgagccgacccucacucucuuugcuaugacaucaccgucaucccuaaguucagaccuggaccacgguggugugcgguucaaggccagguggaugaaaagacuuuucuucacuaugacuguggcaacaagacagucacaccugucaguccccuggggaagaaacuaaaugucacaacggccuggaaagcacagaacccaguacugagagaggugguggacauacuuacagagcaacugcgugacauucagcuggagaauuacacacccaaggaaccccucacccugcaggcaaggaugucuugugagcagaaagcugaaggacacagcaguggaucuuggcaguucaguuucgaugggcagaucuuccuccucuuugacucagagaagagaauguggacaacgguucauccuggagccagaaagaugaaagaaaagugggagaaugacaagguuguggccauguccuuccauuacuucucaaugggagacuguauaggauggcuugaggacuucuugaugggcauggacagcacccuggagccaagugcaggagcaccacucgccauguccucaggcacaacccaacucagggccacagccaccacccucauccuuugcugccuccucaucauccuccccugcuucauccucccuggcaucugaggagaguccuuuagagugacagguuaaagcugauaccaaaaggcuccugugagcacggucuugaucaaacucgcccuucugucuggccagcugcccacgaccuacgguguauguccaguggccuccagcagaucaugaugacaucauggacccaauagcucauucacugccuugauuccuuuugccaacaauuuuaccagcaguuauaccuaacauauuaugcaauuuucucuuggugcuaccugauggaauuccugcacuuaaaguucuggcugacuaaacaagauauaucauuuucuuucuucucuuuuuguuuggaaaaucaaguacuucuuugaaugaugaucucuuucuugcaaaugauauugucaguaaaauaaucacguuagacuucagaccucuggggauucuuuccguguccugaaagagaauuuuuaaauuauuuaauaagaaaaaauuuauauuaaugauuguuuccuuuaguaauuuauuguucuguacugauauuuaaauaaagaguucuauuucccaaaaa

SEQ ID NO: 418 - RNA, 2576 nt, Homo Sapiens
gcuuccggcuuucgcucgcuuccauauccgcuccucuagucgcccuccgcuggccccgccuucguccccggaagauugggucuucuggcgagccacuguuugccguuugaucgggcaccaaauaaaguuucuuuauucaaaagcacuuuuuuuuuaaagccacaccacccccauucucagcuccuccuucgcggcgguaccgccucuguuucugcggcgauugaacagccgagcuuugcggccgggaucgcggaaagugauggcugucgucccggcgucucucucaggacaggacgugggaucauuugcauaucuuacaauuaaagacagaauaccacagaucuuaacuaagguuauugauacauugcaucgacauaaaagugaauuuuuugagaaacacggagaggaaggcguggaagcugaaaagaaagcuaucucucuccuuucuaaauuacggaaugaauugcaaacagauaaaccauuuauccccuugguugagaaauuuguugauacugauauauggaaucaguaccuagaauaucaacagagucuuuuaaaugaaagugauggaaaaucaagaugguucuacucaccgugguuguugguagaauguuacauguaucgaagaauucaugaagcaauuauccagaguccaccaaucgauuacuuugauguauuuaaagaaucaaaagagcaaaauuucuaugggucacaggaauccaucauugcuuuauguacucaccugcaacaauugauaagaacuauugaagaccuagaugaaaaucagcugaaagaugaguuuuuuaaacuucugcagauuucacuguggggaaauaagugugaucugucucucucagguggagaaaguaguucucagaauaccaauguacuaaauucauuggaagaccuaaaaccuuucauuuuauugaaugauauggaacaucuuuggucauugcuuagcaauugcaagaaaacaagagaaaaagcuucugcuacuagaguguauauuguucucgauaauucuggauuugagcuuguuacagauuuaauauuagccgacuucuuguuguccucugaacuggcuacugagguucauuuuuauggaaaaacaauuccaugguuuguuucugauacuacuauacaugauuuuaauugguuaauugaacagguaaaacacaguaaucauaaguggauguccaaguguggggcugacugggaagaguauauuaaaauggguaaauggguuuaccacaaucauauauuuuggacucugccucaugaguacugugcaaugccucagguugcaccugacuuauaugcugaacuacagaaggcacauuuaauuuuauucaagggugauuugaauuacaggaaguugacaggugacagaaaaugggaguuuucuguuccauuucaucaggcucugaauggcuuccauccugcaccacucuguaccauaagaacauuaaaagcugaaauucagguuggucugcagccugggcaaggggaacagcuccuggccucugagcccagcugguggaccacuggaaaauauggaauauuucaguacgaugguccccuuugacuugauuuaggagcucucaguugcauagaaagaucuggugagcaccuuuucauccccagaaaaggagcacgugaauugagucgccuggcggcucuguacgcgcucagggaagcuuagcuucuuggugcccaucuacgugcacuggaugauuuuucuuuugaacauuuugccccacuacacuguuuuggggauagcuggguuaagcaaguuaaagauauuuacauuuauauuggaauuuuagcaacuuuuuuucagguuaaauauauaauuucaagugcuuuuaaugaacuuauuuuuaauuggcuagggagcaaaaaauaagugaguucugcuuuuaguuaguuaaccuuguucuuuucuuaaauaguacacugcaugguauuuaauauuccaggaagcaugggauuuuauuuugcuugauuuugggcacaugaaauaauagcucuaggaaaaugcgcaucuuaaugacucuuuguaaagagaggcauuucuuacaacugugauguuugcuuacauaaaaguuaccucauaaguuaauucuaacuuuuauucuugaauuuuauuucauuucaauagcuuguuucauuugcacgccuuuguauuuugauugaccuguagaauggauguuaggaaacucaaaauugaacacagugaaacaaaugguauuugaagaaauguaauaucuuuuauauucuauuuaugauauccauaaucaaaugagauuauuuuaccacauaaauguuuuaaauaucagauuuuuaguuugcaguuuuaggaaaaugcuuuagauagaaaagguucuuaugcauugaauuuggaguacuaccaacaaugaaugaauuuauuuuuuauauucuuacacauuuuauuggucauugucacagauaguaaauacuaaaaauuucaggucaguuuguuuugaaacugaaauuggaaauaaaucuggaaauguuuuguugcacuaaaauaauaaaaugaauuguacugaaaa

SEQ ID NO: 419 - RNA, 2619 nt, Homo Sapiens
cgcucacuucugcuugcacuuaggcgaccucgggagcucggacuccuacgcagucaccgggaagggccgccgccccgcccgcggcugcuggcccgggugacgcuuccgccugcuauaagagcagcggcccucggugccuccuuccugaccucgcacccagcucggagcccggagcgugccucggcggccugucgguuuucaccauggagcagcugagcucagcaaacacccgcuucgccuuggaccuguuccuggcguugagugagaacaauccggcuggaaacaucuucaucucucccuucagcauuucaucugcuauggccaugguuuuucuggggaccagagguaacacggcagcacagcuguccaagacuuuccauuucaacacgguugaagagguucauucaagauuccagagucugaaugcugauaucaacaaacguggagcgucuuauauucugaaacuugcuaauagauuauauggagagaaaacuuacaauuuccuuccugaguucuugguuucgacucagaaaacauauggugcugaccuggccaguguggauuuucagcaugccucugaagaugcaaggaagaccauaaaccagugggucaaaggacagacagaaggaaaaauuccggaacuguuggcuucgggcaugguugauaacaugaccaaacuugugcuaguaaaugccaucuauuucaagggaaacuggaaggauaaauucaugaaagaagccacgacgaaugcaccauucagauugaauaagaaagacagaaaaacugugaaaaugauguaucagaagaaaaaauuugcauauggcuacaucgaggaccuuaagugccgugugcuggaacugccuuaccaaggcgaggagcucagcauggucauccugcugccggaugacauugaggacgaguccacgggccugaagaagauugaggaacaguugacuuuggaaaaguugcaugaguggacuaaaccugagaaucucgauuucauugaaguuaaugucagcuugcccagguucaaacuggaagagaguuacacucucaacuccgaccucgcccgccuaggugugcaggaucucuuuaacaguagcaaggcugaucugucuggcaugucaggagccagagauauuuuuauaucaaaaauuguccacaagucauuuguggaagugaaugaagagggaacagaggcggcagcugccacagcaggcaucgcaacuuucugcauguugaugcccgaagaaaauuucacugccgaccauccauuccuuuucuuuauucggcauaauuccucagguagcauccuauucuuggggagauuuucuuccccuuagaagaaagagacuguagcaauacaaaaaucaagcuuagugcuuuauuaccugaguuuuuaauagagccaauaugucuuauaucuuuaccaauaaaaccacuguucagaaacaagucuuucauuuucuuuguaaguuuggcucuguuggcuguuuacacccaugaauuuuggcauggguaucuauuuuucuuuuuuacauugaaaaaaauccagugguugcuuuugaaugcaucaaguaaagaagaagaaaagaauacauccgaugcguagauucuugaccauguaguaaucuauaaaauugcuauauccuccugauagccaugggaaaacaugauaagauggucauuuauuuugcaguuagaauuuuggaagccacaaaauagacagacacccugacuguugaagggagguuuaaaaacagauauucaauugaaauguaagagagcaccccaauugagagcccagguuacgaagacaagcuugccucgccugacuuuucugucccuuguucugcaggauuaguauucuguuacagaccucuaguuuuuagacucuucaauuaaagggccaaugguuauaaccugcauucccuuuuuuguucuucuuuauguauaauauauaguucauguggcgcugcaugaaaucaagaagugggugucuuaggauaaaagauaccaagagucuacaaaaauaaccauguaguaagauaaacugcugaacaaagguuuuacuguuagccaccuucucauguguuuucuuuucucuuuuucuuuuucuuucuuucuuucuuuuuuuuuuuuuugagacagagucuugcucuguuacccaggcuggagugcaguggcacgaucucagcucaccgcaaccucugccuccuggguucaagugauucucuugcuucagccuccugaguagcugggauuauaggcaugcaccacuaggccuggcuaauuuuuguauuuuuaguagagaugggguuuuuccauguuggccaggcuggucccgaacuccugaccucaggugauccgcgcaccucagccucccaaagugcugggauuacaggcaugagcuaccaugccuggccuucucauguguuuucugauuaaggcucuugacuuccaaggcuguguggggagauggggugggggcucuuggacugauauaaaacuuugucaaauguaguucuuugaauggagcuugaaacgccgcauauucuugcucccacaaggauagugggcaucaugaauuaauaaaacguccuaggauucugcaagcua

SEQ ID NO: 420 - RNA, 2478 nt, Homo Sapiens
gcacccaccgccccggcggcucccuugcggcgcagcugcaccaguuuuccgagagcagcgcauuuccccgccgggcgguugaugcgggagcgccaugacacaggcgccugcgcagagccgcgcguuggccuccuguuccgcuuaaaggggcggugcagaggcggcaggaagauggaguuggggaguugccuggagggcgggagggaggcggcggaggaagagggcgagccugaggugaaaaagcggcgacuucuguguguggaguuugccucggucgcaagcugcgaugccgcaguggcucagugcuuccuggccgagaacgacugggagauggaaagggcucugaacuccuacuucgagccuccgguggaggagagcgccuuggaacgccgaccugaaaccaucucugagcccaagaccuaguaagugaugaggggagcgggagccaguccgcacggaggcaguuugauaccagguagcccugcgcguccugggaccugccguggagcugggcggacgaugcugaggcagaucuccaagcugcguagccagaggagcagggcuugcguugcugcugcugcgcggaguugcgccccagcagcggaucuaacacugcaccagacugucgcuucgaacgugauuugggguccagggaggaaaagauggaaauguaauguuuaacucaaaugaaaggaaauaaguaagcgagagguuugaaacaaaugaacgaaggcuaaaccuucuaucgaaaaauggcaacuuggaagucuccuugcuuccuguauuguuuauuuauucuaggcccuaggcugaccggccagaauaacaguguugaccuaaccaaugaagaaacaacugauuccaccacuucuaaaaucagcccaucugaagauacucagcaagaaaauggcagcauguucucucucauuaccuggaauauugauggauuagaucuaaacaaucugucagagagggcucgagggguguguuccuacuuagcuuuguacagcccagaugugauauuucuacaggaaguuauucccccauauuauagcuaccuaaagaagagaucaaguaauuaugagauuauuacaggucaugaagaaggauauuucacagcuauaauguugaagaaaucaagagugaaauuaaaaagccaagagauuauuccuuuuccaaguaccaaaaugaugagaaaccuuuuaugugugcaugugaacgugucaggaaaugagcuuugccuuaugacaucccauuuggagagcaccagagggcaugcugcggaacgaaugaaucaguuaaaaaugguuuuaaagaaaaugcaagaggcuccagagucagcuacaguuauauuugcaggagauacaaaucuaagggaucgagagguuaccagauguggugguuuacccaacaacauuguggaugucugggaguuuuugggcaaaccuaaacauugccaguauacaugggauacacaaaugaacucuaaucuuggaauaacugcugcuuguaaacuucguuuugaucgaauauuuuucagagcagcagcagaagagggacacauuauuccccgaaguuuggaccuucuuggauuagaaaaacuggacugugguagauuuccuagugaucacuggggucuucugugcaacuuagauauaauauuguaaaaugcuuuucaaguguggguuuugcccugauuguugcaaauacaauuuccaccuucuggaaagguagguuugcuguggaggaaauaauguacuagaucauugucacagaaaaaccaacuaugauuuaugguuguguuuucagaauucaacauuaaagauuaauguuuauuuaaacgaacacauuccugcauucaggaugugaggccauuuaauaaaaagggcacaaagccugucagaguuuucaacggugcuuauagcugccagcuggauuccaaacagguaccacauugucucugagcuaauguuuauauuuuuccauucaggcaccgaaauaguuaauauuugaaauaagucuucaaaagaaaacauaagagauuauugaguucuugggacuggauccuuuauuucauaaguucagaucaucuuaaaugaaaaugccaugauuaucugcaguuaaguagaugacagcuauucuacaucagacuugauuuuugucagcuaauuacauaauugguaagcuauaauugaaaccuuauggcuuaaaauuccuuaacuccuuuuugauucauguuuguagucauguugucaacagaggcaaaguuaagcuugaugaugguuaaaaucgguuugauagcaccaugggacauuuuucuaacaaaaauaaaugcaugaagagacauagccuuuuaguuuugcuaauugugaaauggaaaugcuuuacaggaaguaaaugcaaauuacuuuuaagugugcuuuaaagaaaaauauuuuccccacaagagaaauuuaaauaaagaauuuuauuuguuua

SEQ ID NO: 421 - RNA, 1191 nt, Homo Sapiens
gacacauuucugguguuuuaagaugccugagccagccaagucugcucccgccccgaagaagggcuccaagaaggcagugaccaaagcgcagaagaaagauggcaagaagcgcaagcgcagccgcaaggagaguuacucuguguacguguacaaggugcugaaacagguccaucccgacacuggcaucucuuccaaggccaugggcaucaugaauucuuucguuaacgacauauuugagcgcaucgcgggcgaggcuucccgccuggcgcauuacaacaagcgcucgaccaucaccuccagggagauccagacggccgugcgccugcugcuucccggagagcuggccaagcacgccgugucggagggcaccaaggccgucaccaaguacaccagcuccaaguaaacauuccaaguaagcgucuuaacaccuaaccccaaaggcucuuuuaagagccacccaggggagacaacagcuuuuagacauaucuuuuccaacagucgucacugcuggacacuguuucaucuugcaaauaaaccaaugaaaaugagugauccuagaagaagauaaauggagguauuuugaacaaucaaagaaggacaaaugaacaccuggcugagaaaaauuagcucuuuuuucuaugcauaaaacuauuaaaauauucuucauagaaauuuaugacacaggaaacauaaagacaaaauuaaaauaacuccuaguaucuccuauucuuuuuauauguauauuauauauacucauauucauauauacauauaucucacaucauguaucauauauaaaauaaauuuaggugucaugauauauauuuagauaaauauacuuagaaacuuuuuuauggauguauaauuuauggauauauugauaauuauguauuuguuauugacuacuucaauugauucccauuuuuaugcauuauauuauagauuauauagcucacacaucuuuguacauaaaucuuuguucaaauauuauuuccuaaggauagacuucaugaaguggaaauacuaaaucaaaagugaaaaacauuuucuaagguucuuaacauauacauugccaaauugcuauucaggaucauaccaauuuauaaucccaaaauaauauggaaauuccuguuuuauagcacucauauuuacaauaaauuuuaaaaaucacuguuaaccuaauaguccuuc

SEQ ID NO: 422 - RNA, 367 nt, Homo Sapiens
augucuggccgcgguaagggcggaaagggucuagguaaggguggcgccaagcgucaccguaagguauugcgugacaauauccaaggaaucaccaagcccgcuauccgccgccuggcucgccgcggcggcgucaagcguauuucuggccucauuuaugaggaaacucgcggagugcugaaaguuuuccuggaaaauguaauccgcgaugcugucaccuacacggaacacgccaaacgcaagacagucacagccauggacgugguguacgcgcucaagcgccagggacgcacucuuuauggcuucggcggcugagcuuaccucuacaguacacuaccgcaaaaccaacggcccuuuucagggccaccua

SEQ ID NO: 423 - RNA, 4168 nt, Homo Sapiens
agaacaaacuccuaccucuguuugcaacuaagaguuacaucccccaugccaagaccuuccgaggcgucccaaagggggaaauuccucgcugccggacugcgcccacccuugaggaccucacauucucuuugggcagagcggaagccagacagagacagggacuacgaagcgacaauccccagcccugugugugcaaggagcccccgaggggcaggcagccacgcugcagaaggcuagacucuccgacccccagggagccuggugugggcugcagggacagaacgcuucucagaggagggcgccgggcgcugccccggggauucgggccggcucgcgggcgcugccagucucgggcggcgguguccggcgcgcgggcggccugcugggcgggcugaaggguuagcggagcacgggcaaggcggagagugacggagucggcgagcccccgcggcgacagguucucuacuuaaaagacaaugacuacugaugaaggugccaagaacaaugaagaaagccccacagccacuguugcugagcagggagaggauauuaccuccaaaaaagacaggggaguauuaaagauugucaaaagaguggggaauggugaggaaacgccgaugauuggagacaaaguuuauguccauuacaaaggaaaauugucaaauggaaagaaguuugauuccagucaugauagaaaugaaccauuugucuuuagucuuggcaaaggccaagucaucaaggcaugggacauugggguggcuaccaugaagaaaggagagauaugccauuuacugugcaaaccagaauaugcauauggcucggcuggcagucucccuaaaauucccucgaaugcaacucucuuuuuugaggcaauuauugagcuccuugauuucaaaggagaggauuuauuugaagauggaggcauuauccggagaaccaaacggaaaggagagggauauucaaauccaaacgaaggagcaacaguagaaauccaccuggaaggccgcugugguggaaggauguuugacugcagagauguggcauucacugugggcgaaggagaagaccacgacauuccaauuggaauugacaaagcucuggagaaaaugcagcgggaagaacaauguauuuuauaucuuggaccaagauaugguuuuggagaggcagggaagccuaaauuuggcauugaaccuaaugcugagcuuauauaugaaguuacacuuaagagcuucgaaaaggccaaagaauccugggagauggauaccaaagaaaaauuggagcaggcugccauugucaaagagaagggaaccguauacuucaaggugugugagucccuaugcaauccuuuccaucucaaagaauuuauucaaguguuggugaggaggcaaauacaugcaggcggugauucaguaugggaagauaguguccugguuagagauggaauaugguuuaucagaaaaggaaucgaaagcuucugaaucauuucuccuugcugccuuucugaaccuggccaugugcuaccugaagcuuagagaauacaccaaagcuguugaaugcugugacaaggcccuuggacuggacagugccaaugagaaaggcuuguauaggaggggugaagcccagcugcucaugaacgaguuugagucagccaagggugacuuugagaaagugcuggaaguaaacccccagaauaaggcugcaagacugcagaucuccaugugccagaaaaaggccaaggagcacaacgagcgggaccgcaggauauacgccaacauguucaagaaguuugcagagcaggaugccaaggaagaggccaauaaagcaaugggcaagaagacuucagaaggggucacuaaugaaaaaggaacagacagucaagcaauggaagaagagaaaccugagggccacguaugacgccacgccaaggagggaagagucccagugaacucggccccuccucaaugggcuuucccccaacucaggacagaacaguguuuaauguaaaguuuguuauagucuaugugauucuggaagcaaauggcaaaaccaguagcuucccaaaaacagccccccugcugcugcccggaggguucacugagggguggcacgggaccacuccagguggaacaaacagaaaugacugugguguggagggagugagccagcagcuuaaguccagcucauuucaguuucuaucaaccuucaaguauccaauucagggucccuggagaucauccuaacaauguggggcuguuagguuuuaccuuugaacuuucauagcacugcagaaaccuuuaaaaaaaaaaugcuucaugaauuucuccuuuccuacaguuggguaggguaggggaaggaggauaagcuuuuguuuuuuaaaugacugaagugcuauaaauguagucuguugcauuuuuaaccaacagaacccacaguagaggggucucaugucuccccaguuccacagcagugucacagacgugaaagccagaaccucagaggccacuugcuugcugacuuagccuccucccaaagucccccuccucagccagccuccuugugagaguggcuuucuaccacacacagccugucccugggggaguaauucugucauuccuaaaacacccuucagcaaugauaaugagcagaugagaguuucuggauuagcuuuuccuauuuucgaugaaguucugagauacugaaaugugaaaagagcaaucagaauugugcuuuuucuccccuccucuauuccuuuuagggaauaauauucaauacacaguacuuccucccagcauugcuacugcucagcuucuucuuucauucuaauccuugcuauuaagaauuuaagacuugugcuuacaauauuuuugaccuggaguggaucuauuuacauagucauuuaggauccaugcagcuuuuuuugucuuuuuaagauuauuggcucauaagcauauguauacugguuuauggaacuuuauuuacacuccucuaucaugcaaaaaaauuuugacuuuuuaguacuaagcuuaauuuuuaaaaacaaaaucuguaggguugacaaauaaauaguugcucuucuacacuagggguuucaccugcagguuugacacgcaguugcucgcuuuuccugcccugucaagcuucucuguucuggcgugaguugugaaagaguugaagacagcuucccaugccgguacacagccaguagccuaaaucuccaguacuugagcugaccauugaacuagggcaagucuuaaauguguacauguaguugaauuucaguccuuacggguaaacagauugagcauggcucucuauucccucagccuaagaaacacucaugggaaugcauuuggcaacccaaggaaccauuugcuuaaaccuggaacaucucaccuuuuuaaauccuaaaaaacacuggcaguuauauuuuaaauuaguuuuuauuuuuaugaugguuuuaucaaaagacuuuuauuauuagauugggacccccuucaaaccuaaaaaucaaguuauuuccuuuuauaauacuuuucuuccccauggaacaaaugggaucaauuugugaguuuuuuccuuuaaugauaacuaaaaucccucuaauuucucauuuaugcuuuugucuuuuuuaugaaauauuucuuuuaaaagccccagucucaccuacgaaauaugaagagcaaaagcugauuuugcuuacuugcuaaacuguugggaaagcucuguagagcaugguuccagugaggccaagauugaaauuugauacuaaaaaggccaccuagcuuuuugcagauaacaaacaagaaagcuauuccaagacucagaugaugccagcugucucccacguguguauuaugguucaccagggggaacuggcaaaaguguguguggggaggggaagggugugugagugguucugagcaaauaacuacagggugcccauuaccacucaagaagacacuucacguauucuuguaucaaauucaauaaucuuaaacaauuuguguagaaguccacagacaucuuucaaccaccuuuuaggcugcauauggauugccaagucagcauaugaggaauuaaagacauuguuuuuaaaaaaaaaaaaucauuuagaugcacuuuuuuguguguucuuuaaauaaauccaaaaaaaaugugaaaaaaaaaa

SEQ ID NO: 424 - RNA, 4977 nt, Homo Sapiens
gcgcggcaucguggggcggggguggggcgggacugagggcggagugugagcgggcucgguuuugggccgcggcgggagcgggagucgccgccacucgagugcgcaggcgccuggcgauuaccggucucaccauggagcggaaaggugagcgguggagcggccuccgccacgaggggcaauggucgccggggcgaggcccgggucagcgccgggagcuucgcuuaacugccgcgguucgguucccggacgugcggcgccccuccacugagguggcgccgccccacacccccugccucugggcugcggguccgcgccccucaguccgggcguccucuggcgccggccguagccgccccuuguuccccgccaggccggcucgcgccuuggggccacuccagggcccggcccuuggcgggcgacgcagacccccacccgcccgcccccugacccggccugagaccccuccggcgcaucccgcccgggcgcugcucugcgccccgugggccgccagccccacggccggccgccucgccggagcccgcagccgcccccgaggcaggccccgcagccgggccuggcgccccugcugggucuccacccucaccuuggucgccuccuuuccuccacauucgcccuucauccaucccucucuccugcagugcuugcgcuccaggcccgaaagaaaaggaccaaggccaagaaggacaaagcccaaaggaaaucugaaacucagcaccgaggcucugcuccccacucugagagugaucuaccagagcaggaagaggagauucugggaucugaugaugaugagcaagaagauccuaaugauuauuguaaaggagguuaucaucuugugaaaauuggagaucuauucaaugggagauaccaugugauccgaaaguuaggcuggggacacuuuucaacaguaugguuaucaugggauauucaggggaagaaauuuguggcaaugaaaguaguuaaaagugcugaacauuacacugaaacagcacuagaugaaauccgguugcugaagucaguucgcaauucagacccuaaugauccaaauagagaaaugguuguucaacuacuagaugacuuuaaaauaucaggaguuaauggaacacauaucugcaugguauuugaaguuuuggggcaucaucugcucaaguggaucaucaaauccaauuaucaggggcuuccacugccuugugucaaaaaaauuauucagcaaguguuacagggucuugauuauuuacauaccaagugccguaucauccacacugacauuaaaccagagaacaucuuauugucagugaaugagcaguacauucggaggcuggcugcagaagcaacagaauggcagcgaucuggagcuccuccgccuuccggaucugcagucaguacugcuccccagccuaaaccagcugacaaaaugucaaagaauaagaagaagaaauugaagaagaagcagaagcgccaggcagaauuacuagagaagcgaaugcaggaaauugaggaaauggagaaagagucgggcccugggcaaaaaagaccaaacaagcaagaagaaucagagaguccuguugaaagacccuugaaagagaacccaccuaauaaaaugacccaagaaaaacuugaagagucaaguaccauuggccaggaucaaacgcuuauggaacgugauacagaggguggugcagcagaaauuaauugcaauggagugauugaagucauuaauuauacucagaacaguaauaaugaaacauugagacauaaagaggaucuacauaaugcuaaugacugugauguccaaaauuugaaucaggaaucuaguuuccuaagcucccaaaauggagacagcagcacaucucaagaaacagacucuuguacaccuauaacaucugaggugucagacaccauggugugccagucuuccucaacuguaggucagucauucagugaacaacacauuagccaacuucaagaaagcauucgggcagagauacccugugaagaugaacaagagcaagaacauaacggaccacuggacaacaaaggaaaauccacggcuggaaauuuucuuguuaauccccuugagccaaaaaaugcagaaaagcucaaggugaagauugcugaccuuggaaaugcuuguugggugcacaaacauuucacugaagauauucaaacaaggcaauaucguuccuuggaaguucuaaucggaucuggcuauaauaccccugcugacauuuggagcacggcaugcauggccuuugaacuggccacaggugacuauuuguuugaaccucauucaggggaagaguacacucgagaugaagaccacauugugcacauuauagagcugauaggcagaauuccaagacgcuuuucccucagugggaaauauucacaagacuucuucagucacagagaucacauugcauugaucauagaacuucuggggaaggugccucgcaagcucauuguggcaggaaaauauuccaaggaauuuuucaccaaaaaaggugaccugaaacauaucacgaagcugaaaccuuggggccuuuuugagguucuaguggagaaguaugaguggucgcaggaagaggcagcuggcuucacagauuucuuacugcccauguuggagcugaucccugagaagagagccacugccgccgagugucuccggcacccuuggcuuaacuccuaagccccugcccagcaccacagcagagaucacacacugacccuccgcccuuccccuucaagcauuuuccucuucccuuuucagggugaagcucuuccuucaagaguuucuagaucuuguuuuuuuuuuaauccaacauguucauuuggguuugcuuacuugacccuguggagauccccacagccauugggcauccuaggugaauuuggccuugguugggcucugccaaagacuaauggacuaaaaugugaaacagccucuugcccuguaccuuuccuucccauuaggacauccuuuaaauuauaagcauccuuuuugaaaagagcuaugaagguguaugagcccauccuuuuauucauugacucuaagagucaaauuuucuagugcauauccuauugccagcauaaggaugaggagggggaaagggucuuaauucuauguacagcagagacauuaaacuugcuguguccgggcugcaucaucuuccuggacuguuucuguuguucucuguguucacauuuuuuccugcaacuuuuaagcuacugucuuuuuuaaauagcuauaugaacaccaaauuuggguaccauuuuaucacuguucaaagcacugucaaauuccuuucauccuuuaauaguuaagaucuuugaaucuucagucugauuuuuaauguaagcaaaaacagaaccauugaauaguaauuucuugagaaccucagguguucuauaaacaguccuuuccuguaugucuucuauuacccuaagaccagaguuauuuugguugguuguuuuguuuuauuuuuuguuuuuguauccauggcuggcacuuuacucauugcacuugaguuuauugccccauaacuaaaggaucaggaugaugguagaacggagaucuggguuucagagcuuucccauuuaagaaaaauagaucuugagauucugauucuuuuccaaacaguccccugcuuucauguacagcuuuuucuuuaccuuacccaaaauucuggccuugaagcaguuuuccucuauggcuuugccuuucugauuuucucagaggcucgagucuuuaauauaaccccaaaugaaagaaccaaggggaggggugggauggcacuuuuuuuuguuggucuuguuuuguuuuguuuuuugguugguugguucguuauuuuuuaagauuagccauucucugcugcuauuucccuacauaaugucaauuuuuaaccauaauuuugacaugauugagauguacuugaggcuuuuuuguuuuaauugagaaaagacuuugcaauuuuuuuuuuaggaugagccucuccuagacuugaccuagaauauuacauauuccuccaguaaguaauacugaagagcaaaagagaggcaggauuggggucacagccgcuucuucagcauggaccaagugggccuuggggauugcagcguucucgaaguggcuguaggacucgaauuuacagaaagccacagaggugcaacuugaggcucugcuagcaagccaccagugaggcuauuggguaaccaccuuucuauacaggagauuggaaucuacuuugucauuuauccaccacagugacaaaggaaaaguggugccguuaugcaauccauuuaacucauaaacauauuacucugaguaacuggccagccauucaucggauccuucauuggguacuccugaaaucagacauguuccuguagaaagaauuuuaaguuaggcuuucuaugcaccuaucaagaaucaagagaauagauuguaucaaacaacggcagggaaauccuucagcaauucuaauccacuuuggguuuucagcuguuuuuacaucuaaagcaauagacuagaacugaauuaucuucuacauaguaaaaucacaauuguggaauuacaggaauucuggugauauuaaggugaaauaacaaaacacaaaaggcccuauuuuaacaguugaugugacaguaaguuuuaauagaaccuguaacuucauuuuggaaaugcuucuccaccaaauaagggcuuuuuccccuauuuaaggagccagauggauugaaagauguggaaauaggcagcuguagaucuugaucuuccagguaccccauguaccuuuauugagcuuaauuauaauacugucaaauugccacgaucucacuaaaggauuucuauuugcugucaguuaaaaauaaagcccuaaauacauuuuuauucuuucuacugagggcauugucuguuuucuuuguaaaugccguacaauaaacaaauuauuuaauaaccua

SEQ ID NO: 425 - RNA, 1928 nt, Homo Sapiens
gugaagcucucagugugccucuguccuuugccacaaacaugagguucacauucccucucauggcuauaguccuggaaauugccaugauuguuuuauuuggauuauuuguugaguaugaaacggaccagacuguucucgagcagcucaacaucaccaagccaacagacaugggcauauucuuugaguuauauccucuguuccaagauguacauguuaugauauuuguuggguuuggcuuccucaugaccuuccugaagaaauauggcuucagcaguguggguaucaaccuacucguugcugcuuugggccuccaguggggcacuauuguacagggaauccugcaaagccagggacagaaauuuaacauuggaaucaaaaacaugauaaaugcagacuucagugcagccacaguucugauaucuuuuggagcuguccugggaaaaacgagccccacccaaaugcugaucaugacaauuuuagaaauuguuuucuuugcccacaaugaauaccugguuagugaaauauuuaaggccucugacauuggagcaucaaugacgauccaugccuuuggggccuacuuuggcuuggcuguagcaggcaucuuguaucgaucuggacugagaaaggggcaugaaaaugaagaguccgcauacuacucagacuuguuugcaaugauugggacucucuuucuguggauguuuuggcccagcuuuaacucggccauugcugaaccuggagacaaacagugcagggccauuguaaacacguacuucucucucgcugccugugugcucacagccuuugccuucuccagccuaguggagcaccgaggcaagcucaacaugguucacauucagaaugccacccuugcuggaggaguugcugugggcacuugugcggauauggcaauucacccauuugguucuaugauuauugggagcauugcaggaauggucucugugcuuggauacaaguuccugacuccacuuuuuacuacuaaacugaggauccaugauacaugugggguccauaaccuccacggcuuaccugguguagugggaggccuugcaggcauuguggcaguagcaaugggcgccuccaacacgucuauggccaugcaggcagcugcacuggguuccucuaucggaacagcaguuguuggaggucugaugacaggucguuuaauucuaaaguugccucucuggggacagccaucugaccagaacugcuaugaugauucuguuuauuggaaggugucccuaagacgagauaacuugacaaucaguuccauggacauggugaccacagccagcuggaaccugaagucuaaacaccauuccugcucuccagcuuccuuucccauuauccagaaucaaguccaaauaaacaaaaagggaguaaccaaagagaguauggaccagagugaauagauccuaagucccaaauggccaguguaaaaauguccuuaugucugaugcugucucuugcucuucaaugauuaauugaggggauguuacucauaaaacagauaaucaaauagaucuucuccaggauucccaaaaagcuuuuggcagugaguaaauacagaguaaacaugucaguuucuuaauguagacacuaugucuucaaucccaaaaauuauaaaacugaaacccaugaagcaagaauagaugugagaaaucuauguaaaaaaauaauuaaagaaaugcauguguguaaaguaguaauaugaugauuuuagguagugcuuuuuauuuuaaaaauagucuaguuaguaauguuguauccuugcaugaauauuauucuuaauuccuuuugcauguugacuauuugcaacgagcucaaaugcuaucugaucaaagucuauuuugcauaaaauguccaauaauuaaauauuguuauaaaauaaaacaucagucuuugacucu

SEQ ID NO: 426 - RNA, 4918 nt, Homo Sapiens
ugacucgggucacgcagucucucucucucucccuccuccgggaggaacugccgcgcuccggcugacuccuccgccggcgggcggggcgggggagggggcuucgggcgcgcugggaaccgcgggacccggaccugggcgccgcccgccgggggacgcgcggcccccgcuuccgccgggccccgcugagcucuagacaaaccuccgcuucagaaauaggcugcgggcggccggcuaggaggcuuggcccccaccccgggacccccgccguccccgggccggccggccggugggcacgaugagccaggugcuggggaagccgcagccgcaggacgaggacgacgcggaggaggaggaggaggaggaugagcugguggggcuagcggacuacggagacgggcccgacuccuccgacgccgauccggacagcggcacagaggagggaguucuggacuucagugaccccuucagcacugaagugaagccgagaauccugcucaugggccugaggagaagcggcaagucgucuauucagaaaguugucuuucacaaaaugucucccaacgaaacucuguucuuggagagcacuaauaagauaugccgggaagauguuuccaacagcuccuuugucaauuuucagauuugggacuucccaggacagauugacuuuuuugacccuacauuugacuaugagaugaucuuccggggaacaggagcacugauauuugucauugacucacaggaugauuacauggaagcccuggccaggcuccaccucacggugaccagggccuacaaagugaauacugacaucaacuucgagguguuuauucauaaaguggauggucugucagaugaccacaaaauugaaacccaaagagauauucaccagagggcaaacgaugaccuugcagaugcuggauuagaaaaaauucaccucagcuuuuaucugacaagcauauaugaucauucaauauuugaagcuuuuagcaaaguuguucagaaacugauuccacaacucccaacucuggagaauuugcugaacaucuuuaucucaaauucuggaauugaaaaggcauuucuauuugauguggucaguaaaauuuauauugcaacugauaguacuccgguggauaugcaaaccuaugagcucugcugugauaugauagaugugguuauugacaucucuuguauuuauggucucaaagaagauggagcaggaacccccuaugacaaggaauccacagccaucauaaagcuuaauaauacaaccgugcuuuauuuaaaagaggugacaaaguuccuggcucucguuugcuuugucagagaggaaagcuuugaaagaaaagggcuaauugacuauaauuuucauugcuuccggaaggccauucaugaaguuuuugaggugagaaugaaaguaguaaaaucucgaaagguucagaaucggcugcagaagaaaaagagagccaccccuaaugggaccccuagagugcugcuguaggugagguuucaggaaugucuuuugaaaucagaccuuauccaugaggcugcugcgccauguugcacuaaaggaagaggaagaaggagauugggacacauaccauugauuuguuguuaaaaaaaaaaaauuccugcaacccucuugaucuucucuuuuauaaauaaaguaagcacuuugaagcaaaaacuuguauauuaacagugaugugaaauccauugucauuucauuacacaaauguaaacuuuuauggucuguagucaaaaaaaucccgugugagaacugccaggaauuguacauauuuugcacuuuuucauguuucucauugaacugaacuuugauaaaacgacuuuucuaagcuuuuuuucuguacuuggugucaaggacaugcauacuguaguccauaucuauauggcaaucagaaauuaaucaaaaagugaugcauugguaaugacuuuuuguaaauuuggaaaucuuugcuaccaauuguugagaaaaaucauuuuucaguggagcuggaacagauuggagcuacaagcuccaggagcaauaagaacuguccccuauuuauaauggguguaaacaguuuuguagaauaaugcuagcaccagacuuaccuaaaaauuucuauagcaguggcugugcuucccugcucaacgguuuuuaugaagcuguuuaccucaacacacaucucuauaaucacuuuauacagagagguuauuucuuuuuguugcauuaguauucuuuugaaacuuugggaccagauuuccaaaauggugccgaacacuggagagaaguaagaaugucacugaauuguaggguuucuggaggcuuuucuguaccuaccacccagggcuaaaguaacaucagaggccuaaaguuguuccaaaaguaugugauuggcaacugcagacuaaaaaacauagauacaauucuggacuuuuggcccugugcgauggucuggugugcugcauuuaaaaugcuuauucaggaccaguucuuuauugcuccaugaccauagugaauagaacaaaucgcagaaccccaccauggagcucaauccuguuagucacuuuugucaccuccacaucuccuucucacuggugauaacaugccucauguacuccacuuguucccaccuuaugauuaagccaagcucagccugccaccagcaugcucugcaaggcugaagagucauccugaagaccccuaaaggucagugggaaaaggauggcuggagagacauuacaauuagcuguguaauuguuucugugaaauuauuucacuuauguuuacuuuagacuaacaggaaauuaagaguccuaaaucuaccccuaugccaaaucauuccaaguagauaauuuuacgugcaucucaaggguuagcacccuaaggcaugcuuguggggcauuagaaaaugagauuuuuuuuuuuuuaaagcagagccuccuaagaacaucaaaguugguccuagcaaaauauauaaagucccuaaagcaacuuauacuugaaacuuuuuuuuuuuuuuuuuuuagaggggggccucauucuguugcuugugcuggaauacauugguacaaucauagcucacuguuaccucuugggcucaagggauccuuccaccucagccucccuaguagcuagaacuacaggugugcacaaccacgcccggcuaauucuuaaauuuuguuuuuguagagacaggaucucacuguguugcccaagauggucucaaacuccuggccccaagcaauccuccugccuuggccuccucaaaugcugagauuacaggccugagcuacugugcccagccuaaacuuucccacuucucucuguggcuucuuuccaaccucucuccuuccucuccccaaguccuguuucuuugaagcugguaacugaauuuaagaugauaucugguugguguuuaagguuugagccucccaagguucugugcauuuugaaaggagauuucuaaaaauaauuaaggugcccuaacuccuuuccucaugauuccuacuccgaaaccuggaugguuaggagcccagggcucccugauuuccagagcuauauccuguuggaccuuugccaacagaccugacacuuagggguuauuguuauaaaucuaauucucuaauauuuuuuacauguuguuucacuuugaauaagcaaaugaagaaucaguuuucuaauaugacuuuauccucaagcuagagacacuagccuauuugguaaaucacacauuacuuagguauauuuauuacuauaaccagguuggagcuuccauguuuaagcuggguauaugauggguuuuuguuaaaaugugccuuaaaaagccuauuacuucaagagcaaaugauucuuugggggaaaggcaaaaauaauucuaugacauagggcccaaguucaugguaguaaguguacucuuugauuaaucacacgcuaauauagauuacugccucuaacuuuguaaguguggcaaugacuucuuaauuaaagaaagaugcaggaguuaugucuaagcguucaguuuuucaaaucuguguuauuggaaaugucuucaagucauuuugcauuguauuuuugauaugagaggcagcuuauugcgauguguauggccauguuucauucucaaauuuaauucuauaaauacaaauccuaaauacauggcuacagcaacugcacuggaacauuuuugcuugguuuuagggauugagaacuugccuugcagguuuccuuccucaaaaggagcagggcaguccuuucccuguugagucaauuagaauuuuuacauagaggugagacugugaauuauuuugguuauuuucagugauguagauuagugugaaugaccaggguggaauguuuuugaaggaauauaaagcaaaaacugguugacauucacaaacuguucuuuugugaacauauuuuggacccuuaaauaugacuaaaaucacagcaauauuguuacauacggguuauaugccaacucuguuugaaauauacucuggaaaaacagcugaauugucuugguuauuaaaguaugguauguauucaacuuguacagacuggauguaauuuguaaucagguauaguccauguuuuacuuuaagcaguacaucacuuaauaaccauuguuaagccauugcuuucaagaauguuaacugccaauuuaaaagcauguguccuagguucaugcuuugguaaagcucucauuucaaguguauucauagcuaagcuuucugggagcagaauugucucuuuggugaaaaggaaguacagccuuuccuguuucugagguugcuuaccauacauguaugucacuguuucauuggcccuguuacauccauuugguaaaauuuauuuguccugauuaaccagcucucauuuuauggaaaugaugauaaaucucacuacuuaaauuua

SEQ ID NO: 427 - RNA, 2157 nt, Homo Sapiens
gacuggaggagcacaggccuuggaaaggaaagcagcugagauccagaggaguggaaggcucccccuugacuaaagcuggcagccacauguuaugcaaacauucuccccucuguaaauacuacaugaauguuauuuuugcuuucagaaaucacuaaaccuuggccauggucacuuccucuuuuccaaucucuguggcaguuuuugcccuaauaacccugcagguugguacucaggacaguuuuauagcugcaguguaugaacaugcugucauuuugccaaauaaaacagaaacaccaguuucucaggaggaugccuugaaucucaugaacgagaauauagacauucuggagacagcgaucaagcaggcagcugagcagggugcucgaaucauugugacuccagaagaugcacuuuauggauggaaauuuaccagggaaacuguuuucccuuaucuggaggauaucccagacccucaggugaacuggauuccgugucaagacccccacagauuuggucacacaccaguacaagcaagacucagcugccuggccaaggacaacucuaucuaugucuuggcaaauuugggggacaaaaagccauguaauucccgugacuccacauguccuccuaauggcuacuuucaauacaauaccaaugugguguauaauacagaaggaaaacucguggcacguuaccauaaguaccaccuguacucugagccucaguuuaaugucccugaaaagccggaguuggugacuuucaacaccgcauuuggaagguuuggcauuuucacgugcuuugauauauucuucuaugauccugguguuacccuggugaaagauuuccauguggacaccauacuguuucccacagcuuggaugaacguuuugccccuuuugacagcuauugaauuccauucagcuugggcaaugggaaugggaguuaaucuucuuguggccaacacacaucaugucagccuaaauaugacaggaagugguauuuaugcaccaaauggucccaaaguguaucauuaugacaugaagacagaguugggaaaacuucuccuuucagagguggauucacauccccuauccucgcuugccuacccaacagcuguuaauuggaaugccuacgccaccaccaucaaaccauuuccaguacagaaaaacacuuucaggggauuuauuuccagggauggguucaacuucacagaacuuuuugaaaaugcaggaaaccuuacagucugucaaaaggagcuuugcugucauuuaagcuacagaauguuacaaaaagaagagaaugaaguauacguucuaggagcuuuuacaggauuacauggccgaaggagaagagaguacuggcaggucugcacacugcugaagugcaaaacuacuaauuugacaacuuguggacggccaguagaaacugcuucuacaagauuugaaauguucucccucaguggcacauuuggaacagaguauguuuuuccugaagugcuacuuaccgaaauucaucugucaccuggaaaauuugaggugcugaaagaugggcguuugguaaacaagaauggaucaucugggccuauacuaacagugucacucuuugggaggugguacacaaaggacucacuuuacagcucaugugggaccagcaauucagcaauaacuuaccugcuaauauucauauuauuaaugaucauagcuuugcaaaauauuguaauguuauagggcgucucuuuaucacucagcuucugcaucauaugcuuggcugaauguguuuaucggcuucccaaguuuacuaagaaacuuugaagggcuauuucaguaguauagaccagugaguccuaaauauuuuuucucaucaauaauuauuuuuuaaguauuaugauaauguuguccauuuuuuuggcuacucugaaauguugcaguguggaacaauggaaagagccuggguguuugggucagauaaaugaagaucaaacuccagcuccagccucauuugcuugagacuuuguguguaugggggacuuguauguaugggagugaggaguuucagggccauugcaaacauagcugugcccuugaagagaauaguaaugaugggaauuuagagguuuaugacugaauucccuuugacauuaaagacuauuugaauuca

SEQ ID NO: 428 - RNA, 5544 nt, Homo Sapiens
gccccagaucggaagugacggagacgugcuagcgcgucgaagguagcucuaugguuuuccucgcguucuugagucgggaaauggccgcugugugguugcaacggagauaaauucccggaaccgcgauucggcgugucaggaauucgaauuuagaguuuaauuucucagagcauucucuccaggaagaauuuuuacaguaucucaaagacuucacuugacuucuugauccugcauaaaaccaaggagaaaagaaaugggucgcuccaauucuagaucacauucuucaaggucaaagucuagaucacagucuaguucucgaucaagaucaagaucucauucuagaaagaagcgauacaguucuaggucucguuccagaacauauucaaggucucguaguagagaucguauguauucuagagauuaucgucgcgauuacagaaauaauagaggaaugagacgaccuuauggguacagaggaagggguagaggguauuaucaaggaggaggagguagauaucaucgaggugguuauagaccugucuggaauagaaggcacucuaggaguccuagacgaggucguucacguuccaggaguccaaaaagaagauccguuucuucucaaagauccagaagcagaucucgccggucauauagaucuucuaggucuccaagaucauccucuucucguucuucauccccauauagcaaaucuccuguuucuaaaagacgagggucucaggaaaaacaaaccaaaaaagcugaaggggaaccccaagaagagaguccguugaaaaguaaaucacaggaggaaccgaaagauacauuugaacaugacccaucugagucuaucgaugaauuuaauaagucaucagccacauccggugauauuuggccuggccuuucagcuuaugauaauaguccuagaucaccccauaguccuucaccuauugcuacaccaccuagucagaguucaucuugcucugaugcucccaugcucaguacaguucacucugcaaaaaauacuccuucucagcauucacauuccauucagcauaguccugaaaggucugggucugguucuguuggaaauggaucuagucgauacaguccuucucagaauaguccaauucaucacaucccuucacgaagaaguccugcaaagacaaucgcaccacagaaugcuccaagagaugagucuaggggccguuccucguuuuauccugaugguggagaucaggaaacugcaaagacugggaaguucuuaaaaagguucacagaugaagagucuagaguauuccugcuugauagggguaauaccagggauaaagaggcuucaaaagagaaaggaucagagaaagggagggcagagggagaaugggaagaucaggaagcucuagauuacuucagugauaaagagucuggaaaacaaaaguuuaaugauucagaaggggaugacacagaggagacagaggauuauagacaguucaggaagucaguccucgcagaucaggguaaaaguuuugcuacugcaucucaccggaauacugaggaggaaggacucaaguacaaguccaaaguuucacugaaaggcaauagagaaagugauggauuuagagaagaaaaaaauuauaaacuuaaagagacuggauauguaguggaaaggccuagcacuacaaaagauaagcacaaagaagaagacaaaaauucugaaagaauaacaguaaagaaagaaacucagucaccugagcagguaaagucugaaaagcucaaagaccucuuugauuacagucccccucuacacaagaaucuggaugcacgagaaaagucuaccuucagagaggaaagcccacuuaggaucaaaaugauagcgagugauucucaccguccugaagucaaacucaaaauggcaccuguuccucuugaugauucuaacagaccugcuuccuugacuaaagacaggcugcuugcuaguacacuuguccauucugucaagaaggagcaagaauuccgauccaucuuugaccacauuaaguugccacaggccagcaaaagcacuucagagucauuuauucaacacauuguguccuugguucaucauguuaaagagcaauacuucaagucagcugcaaugacccuaaacgagcgguucacuucguaucagaaagccacugaagaacauaguacucggcaaaagagcccugaaauacacaggagaauugacaucucaccaaguacccugaggaagcauacccguuuagcaggggaagagagaguuuuuaaagaagaaaaucaaaagggagauaaaaaauuaaggugugacucugcugaccuucggcaugacauugaucgccguagaaaagaaagaaguaaagaacggggagauuccaagggcuccagggaauccaguggaucaagaaagcaggaaaaaacuccaaaagauuacaaggaauacaaaucuuacaaagaugacaguaaacauaaaagagagcaagaucauucucgaucuucauccucuucagcaucaccuucuucucccaguucucgagaagaaaaggagaguaagaaggaaagagaagaagaauuuaaaacucaccaugaaaugaaagaauacucaggcuuugcaggaguuagccgaccacgaggaaccuuuuuucgaauuagaggcagaggaagagccagaggaguuuuugcugggacaaauacugguccaaacaacucaaauacuacuuuucaaaagagaccgaaggaagaggaaugggauccagaauauaccccaaagagcaagaaguacuucuugcaugacgacagagaugaugguguggauuauugggccaaaagaggaagaggucgugguacuuuucaacguggcagagggcgcuuuaacuucaaaaaaucagguagcaguccuaaauggacucaugacaaauaccaaggggaugggauuguugaagaugaagaagagaccauggaaaauaaugaagaaaagaaggacagacgcaaggaagaaaagguauaagaauaauaaauaugaaguaagauuacaacagagcagaacuugcacccaccauuuuuuuuaccugauuuuuguuuucaaauaagaauguaagcauuuuacuuaaauuuuacuguuugcaaguagucuauagaaauuuuguuuuaagucuucaaauaucuugagaaauaguagacuguauguugaaaauuguacugaaauaaaguagaaaauuguuacguaccauauuuguaacuaucaacuuuuaaaacuuuuaacguuuuuguuacaugcauuguaauucugcuuugucuauaagauauggucaaguacagcucugugaaaguucugauucucuuccuucccuguuugucaauguuuuauucugaaguaaacguuagcucuacauauaaauccuggaacagaaauuguuuauagagacuacacuaauuauuuuaacuguauacaucuguuuaauuugaacacacuacaucguagggugacugauuuuugaaguauaccacagacaaaaaguuguuacuaugguaaacuaagcuaguuuaacacuugagcaaaugcuuaagaaggaauuaaaaaaaaaaagcuuugccaauagcuaaaaaguacaagcuauuaaaaaucagauugaaaaguuuugagaaaauguuauuuuuacugaaagcaagcaguggccuauaaagaacauucuuaggagccuuuucuauuugcguucaaaacuguguguucucuuucuauuccuauuugauaguuugagucauggucuuagauauuagcuauuugugagaggaaacugguuuguaacaauacugcaaauagaaaccccauuucuacugaacauccuaguuuuaaacagaagaaaaacuguaauccugggguugguauguaggaggucuauccugcagaauaaguugauacauuaguaccugauuucauaucuuacauauuuauuugagcugaacauuaguuuguaguguaacuauuaguaaaaauagagaaacacagcauacuguucauuaauaguauuuuaaaaaaauuguuuuucaaaugucaccaauaaaaguuuuggcaggaagcuuguugcggcauugaucuaaccuuuuucccccccauuucaguugcaguuuuuguagaauggcuuuuucuuuuuccucuuaagaguucuauucuucagguagauaauuuuucaaaugugaauuaucuuuugugucuauauugauagcucuuaaaggagugaaaaucuaaaauaguaaauuucaauguuaagugucugcuuuaugggcauauauaaaaguagacacauuucauuuguuaauuuaguuguguguguguguuaaaaggagcuaaugcuuauucuguuaauguaaacuuuugaagaucuuaaguguauugcucuuucaucuuaaacacuuucgaggauuugcagugcgucuagcaccuagauuacagccaggaacauugguuaagaacuguuggaaacaaaacuaaaagcaaacucaacauaugugauguuuauggcccucagauccuuaguauugugugauuuucccccguuaacaugucuuucuaaaauugucuauuaaagcagaggaaauaccugccaaaggaaguauguauugcauuaaucagggcauaacuaauauucuccuguucagaauaauacuuauuuacgugugaaagcaacauggaugugauucccaacacagaauuuucaugacccuuuuauuguauacaaauaaauaccauaacaguuacuugguuagacaucaaaucugugugcaugacuaugugcuuauccacuuaagacaauagguaaaaggggaucugagaaauuauguaauagggagugggaauaaaacuacuuaauuccugugggcagguuauauuuuaaguucaaaugcauugcuuuaaccuuugguuacuuuuauucuguuaaacagaauugaagaaagaguauuauaccagaguguaguaggcuagggugauuguaagaacucuguaauagaaugucauuguggauguuaccuuuuucagauccaagcauauaaaaagccuguauauuuuuuaaaaacacaucuuaacuccacgcuuuacgauauuauaaaaguugaaugguuccucuugguaaggauauuugcuuacaagugcuaggaaauaacucacugauaccugcguuaacauacuuuguuuugccuagagaggggcaauaaaaaugaaccaaaggauauuuccagaaaggauuaagaaagcuguuuaagaaggccaugacucuuuagguguguauguguaccuuucagcauccuaggaauuuuuauacuaaaagcaaaauguuuuuuccaguuagucuucuucaaggaauuacuauuguuccuuuugucacagguaaaaucaguguugggaauuauaauuugagaaaaauauuacccaguaacauugaauguagauggcuaaacgauucuuacucagugugauguauaaugaugcaacagggacccuuguaaauugucauacgccaauaaaaugucacaaguaau

SEQ ID NO: 429 - RNA, 2194 nt, Homo Sapiens
gccuccugccgacgccggcacagaccccggugacggaagugacguaaggccggggcuggagggcagugcugggcuggucccgcaggcgcucgggguuggagccagcgaccgucgguagcagcauggcucuccucuuucuccuaccccuugucaugcagggugugagcagggcugagaugggcaccgcggaucuggggccguccucagaugcuuuugaagucaccagaaaauagucuucuccaauuccaauuuaaauauggagugccuacaccaacuaauguuacaauugaauccuauaacaugaacccuaucguauauugggaguaccagaucaugccacaggucccuguuuuuaccguagagguaaagaacuaugguguuaagaauucagaauggauugaugccugcaucaauauuucucaucauuauuguaauauuucugaucauguuggugauccaucaaauucucuuugggucagaguuaaagccaggguuggacaaaaagaaucugccuaugcaaagucagaagaauuugcuguaugccgagauggaaaaauuggaccaccuaaacuggauaucagaaaggaggagaagcaaaucaugauugacauauuucacccuucaguuuuuguaaauggagacgagcaggaagucgauuaugaucccgaaacuaccuguuacauuaggguguacaauguguaugugagaaugaacggaagugagauccaguauaaaauacucacgcagaaggaagaugauugugacgagauucagugccaguuagcgauuccaguauccucacugaauucucaguacuguguuucagcagaaggagucuuacaugugugggguguuacaacugaaaagucaaaagaaguuuguauuaccauuuucaauagcaguauaaaagguucucuuuggauuccaguuguugcugcuuuacuacucuuucuagugcuuagccugguauucaucuguuuuuauauuaagaaaauuaauccauugaaggaaaaaagcauaauauuacccaaguccuugaucucugugguaagaagugcuacuuuagagacaaaaccugaaucaaaauauguaucacucaucacgucauaccagccauuuuccuuagaaaaggagguggucugugaagagccguugucuccagcaacaguuccaggcaugcauaccgaagacaauccaggaaaaguggaacauacagaagaacuuucuaguauaacagaaguggugacuacugaagaaaauauuccugacguggucccgggcagccaucugacuccaauagagagagagaguucuucaccuuuaaguaguaaccagucugaaccuggcagcaucgcuuuaaacucguaucacuccagaaauuguucugagagugaucacuccagaaaugguuuugauacugauuccagcugucuggaaucacauagcuccuuaucugacucagaauuucccccaaauaauaaaggugaaauaaaaacagaaggacaagagcucauaaccguaauaaaagcccccaccuccuuugguuaugauaaaccacaugugcuaguggaucuacuuguggaugauagcgguaaagaguccuugauugguuauagaccaacagaagauuccaaagaauuuucaugagaucagcuaaguugcaccaacuuugaagucugauuuuccuggacaguuuucugcuuuaauuucaugaaaagauuaugaucucagaaauuguaucuuaguugguaucaaccaaauggagugacuuaguguacaugaaagcguaaagaggauguguggcauuuucacuuuuggcuuguaaaguacagacuuuuuuuuuuuuuuaaacaaaaaaagcauuguaacuuaugaaccuuuacauccagauagguuaccaguaacggaacaguauccaguacuccugguuccuaggugagcaggugaugccccagggaccuuuguagccacuucacuuuuuuucuuuucucugccuugguauagcauauguuuuuguaaguuuaugcauacaguaauuuuaaguaauuucagaagaaauucugcaagcuuuucaaaauuggacuuaaaaucuaauucaaacuaauagaauuaauggaauauguaaauagaaacguguauauuuuuuaugaaacauuacaguuagagauuuuuaaauaaagaauuuuaaaacucg

SEQ ID NO: 430 - RNA, 2949 nt, Homo Sapiens
agggagccggaggggacgcgccggaggaaagauggaagacuaccaggcugcggaggaguuuucguacuguaaccauaugggaggugauacagugccuuuccuuugugauuaaggucacgguagucacuuggaaggauccuuuaagcuuccagaaaugacuuaaucucuaagauauugcaaauuguucuucacucagugaguugguuuuguuuccaaguccgacuucugaguacagcaagugagguggcuucgggcagucagcuccugaacccccuaaaaagaaagggcagggccugcaguggacagcagccagacagggaggaagacucacugccaagucaggguucucugccuugauucccucaggaugcacguugacugagggccccagggguugcccucucgaaggcguguccagagcuacguaccuuuccugggacucagcaguaacuuuaaacgcuugugcucaugugaagagcacauuggcaggcaagugccugacuaauguuauuuucaggaugaccuuuuacccauucagaucuaccauguguaaaaggaaaacuauacuccuggcacuagauuccugcaggcagcccaccuccugagucauccagacacugacagagaacagccaugcuggcagcuggugguuaguccuggagucggagggcagcacugggaaagaaaaauaauuaccuggagauaauguaaucaucguacauuuuacaaguaauggugcuuuaaaaaaaucuccucaaggucaaacugauccuccuaaucaguuuacaucauggaagagagaauuacaucuuaaauggauuacuucagcagcuucaguuaauuuauacaaaaaucaaccaacucauuaagccucucuauugguuaaugauucuagcagccaguugaaauggaagaagagaaugaauucuaguuuaaagugaagucuuagauuguggcaugauuaaaacaaaacagggccaggugugguggcuuacgccuguaaucccagcauuuugggaggcugaggcgggaggaucaccugaggucaggaguucgagaccagccuggccaacaugaugaaaccccaucucuacuaaaaauacgaaaauuagccgggugugguggagggcaccuguaaucccagcuacuugggaggcugaggcaggagaaucacuugaaccugggaggcagagauugcagugagcugagauugcgccacugcauuccagccugggcuacagagcgacacuccgucucaaaaauaaauaaauaaaaauaaaacaauaccuuuaaauuaugugcauguauucuagucuucugguuucugaagacuguaaugccauccuugguaaagcugaacagucuaguuagauuauuucuaaggucuucauuucuacauuauguucauuaccuacauuugcauuuaucaauguaguggaaauaucuuuuaaauaaaucaaacuuaacugaauguucuuccuuacagacugcuuuuguuguugaugaagugagcaacauuguaaaagaggcuauagaaagcgcaauuggugguaacgcuuaucaacacagcaaagugaaccaguggaccacaaauguaguagaacaaacuuuaagccaacucaccaagcugggaaaaccauuuaaauacaucgguaauggagucuuguuucuuuuauauuugcgggaugguuuuuuaacacugaucagaggggcauccaguaccagaaacaacagcuaacguggcucaacucaaggaaggcuccuggugggagucggucguguguguaguauacguuagcguacgcuugaccauuuggcugcugguacaauugcagaucguaugugaagcgggaucuuacaggaggucccaucagaugcuuuuagaacaagugaagcauagaggaaguguggacagcccccagcugacaguggcucaacuuagaauuuuucaacuuugauggauuuaccaggguauuaagugcauuugcaacuuacauuuucauauauuguugauuuaugauggguuuaugggauguuguaagucaaggagcaccuauaauuugucaauauagugagacaaggcaaucugucccuauaauuuuuaucgagaacaucaaccacguggagcuacauacauuguacguuugcuaaaaguggacagaaugacauuuguguuacccaguagacuucucuaacaaaaauuuguuuuaacuuaagugaccuguguaauuaugcagaagaauggagcuggauuacacacagcaaguuccugcuucugggacagcucuacugacgguaugauuuucauucauguuugugaaguuuuguugugugaaauauaugacuggaaguuuccuaucuuugaaugcaaugcauguuuaucaccuuuuaaaacauuuaauaauagacuugccaagguucuuuguguagcauagagauggguacuugaauguuggccuuauugugaguaaaacgucgucccccagcuuucccugccguaaaugcugcucucuucccucccgcagggagcugcacugugcgaugggagaauaagaccauguacugcaucgucagugccuucggacugucuauuugaccugcaguccagccuauggccuuucuccuuuugucucuaguucauccucuaaccaccagccaugaauucagugaacucuuuucucauucucuuuguuuuguggcacuuucacaauguagaggaaaaaaccaaaugaccgcacugugaugugaauggcaccgaagucagaugaguaucccuguaggucaccugcagccugcguugccacuugucuuaacucugaauauuucauuucaaaggugcuaaaaucugaaaucugcuagugugaaacuugcucuacucucugaaaugauucaaauacacuaauuuuccauacuuuauacuuuuguuagaauaaauuauucaaaucuaaa

SEQ ID NO: 431 - RNA, 140 nt, Homo Sapiens
uuucucauuugacuaccacauuuucuccuaauaauagauuuuaguggcuaugcuuaugggauagauuaaacuugccaugaucugaagagggaggguuuuuucauguccuccuccuauaugaaauggcugaacggauauua

SEQ ID NO: 432 - RNA, 2902 nt, Homo Sapiens
gcgguaguggcggaagagguucggcggcugauggcggaucaggaucggaagccugcguaacuuucucccuugauccgggagucuuuccacuggauucacaaugacauccuuucaagaagucccauugcagacuuccaacuuugcccaugucaucuuucaaaauguggccaagaguuaccuuccuaaugcacaccuggaaugucauuacaccuuaacuccauauauucauccacauccaaaagauuggguugguauauucaagguuggauggaguacugcucgugauuauuacacguuuuuaugguccccuaugccugaacauuauguggaaggaucaacagucaauuguguacuagcauuccaaggauauuaccuuccaaaugaugauggagaauuuuaucaguucuguuacguuacccauaagggugaaauucguggagcaaguacaccuuuccaguuucgagcuucuucuccaguugaagagcugcuuacuauggaagaugaaggaaauucugacauguuaguggugaccacaaaagcaggccuucuugaguugaaaauugagaaaaccaugaaagaaaaagaagaacuguuaaaguuaauugccguucuggaaaaagaaacagcacaacuucgagaacaaguugggagaauggaaagagaacuuaaccaugagaaagaaagaugugaccaacugcaagcagaacaaaagggucuuacugaaguaacacaaagcuuaaaaauggaaaaugaagaguuuaagaagagguucagugaugcuacauccaaagcccaucagcuugaggaagauauugugucaguaacacauaaagcaauugaaaaagaaaccgaauuagacaguuuaaaggacaaacucaagaaggcacaacaugaaagagaacaacuugaaugucaguugaagacagagaaggaugaaaaggaacuuuauaagguacauuugaagaauacagaaauagaaaauaccaagcuuaugucagagguccagacuuuaaaaaauuuagaugggaacaaagaaagcgugauuacucauuucaaagaagagauuggcaggcugcaguuauguuuggcugaaaaggaaaaucugcaaagaacuuuccugcuuacaaccucaaguaaagaagauacuuguuuuuuaaaggagcaacuucguaaagcagaggaacagguucaggcaacucggcaagaaguugucuuucuggcuaaagaacucagugaugcugucaacguacgagacagaacgauggcagaccugcauacugcacgcuuggaaaacgagaaagugaaaaagcaguuagcugaugcaguggcagaacuuaaacuaaaugcuaugaaaaaagaucaggacaagacugauacacuggaacacgaacuaagaagagaaguugaagaucugaaacuccgucuucagauggcugcagaccauuauaaagaaaaauuuaaggaaugccaaaggcuccaaaaacaaauaaacaaacuuucagaucaaucagcuaauaauaauaaugucuucacaaagaaaacggggaaucagcagaaagugaaugaugcuucaguaaacacagacccagccacuucugccucuacuguagauguaaagccaucaccuucugcagcagaggcagauuuugacauaguaacaaaggggcaagucugugaaaugaccaaagaaauugcugacaaaacagaaaaguauaauaaauguaaacaacucuugcaggaugagaaagcaaaaugcaauaaauaugcugaugaacuugcaaaaauggagcugaaauggaaagaacaagugaaaauugcugaaaauguaaaacuugaacuagcugaaguacaggacaauuauaaagaacuuaaaaggagucuagaaaauccagcagaaaggaaaauggaaggucagaauucccagaguccucaauguuucaaaacaugcucagagcaaaaugguuauguucucacauugucaaaugcacaaccaguucugcaauaugguaauccuuaugcaucucaggaaacaagagauggagcagauggugcuuuuuacccagaugaaauacaaaggccaccugucagaguccccucuuggggacuggaagacaauguugucugcagccagccugcucgaaacuuuagucggccugauggcuuagaggacucugaggauagcaaagaagaugagaaugugccuacugcuccugauccuccaagucaacauuuacgugggcaugggacaggcuuuugcuuugauuccagcuuugauguucacaagaaguguccccucugugaguuaauguuuccuccuaacuaugaucagagcaaauuugaagaacauguugaaagucacuggaaggugugcccgaugugcagcgagcaguucccuccugacuaugaccagcagguguuugaaaggcaugugcagacccauuuugaucagaauguucuaaauuuugacuaguuacuuuuuauuaugaguuaauauaguuuagcaguaaaaaaaaaaaaaaaaaccacaccuaaaauagaccacugaggagaccauagagcggaugcuuucaugcacccuuuacugcacuuucugaccaggagcuacuuugaguuugguguuacuaggaucagggucagucuuuggcuuaucaauaaauuuuaaucucuguuaaucuuaccugcuuuaaaaaaaaguucuuguguguucguaucuuuauuuauucccuaguuugcagaacugucugaauaaaggauacaaggauuauuucaauguuacugcacugaaaaacguguauguauuagugugcuagauuauuuagcagaauauucacaaguuucuguugaccuuguugauugagcaugacuacuaaauauuauguaauaaaaagcauuugucauaaca

SEQ ID NO: 433 - RNA, 105 nt, Homo Sapiens
ugugcucauuuuggcaguacauauacuaaaauuggaaugauacagagaagauuagcauggccucugagcaaggaugacaugcaaauucaugaaguauuccauaua

SEQ ID NO: 434 - RNA, 906 nt, Homo Sapiens
acgacuaaaagagaagcagaggagcugauagaaauugagauugauggaacagagaaagcagagugcacagaagaaagcauuguagaacaaaccuacgcgccagcugaauguguaagccaggccauagacaucaaugaaccaauaggcaauuuaaagaaacugcuagaaccaagacuacaguguucuuuggaugcucaugaaauuugucugcaagauauccaccuggauccagaacgaaguuuauuugaccaaggaguaaaaacagauggaacuguacagcuuaguguacagguaauuucuuaucaaggaauugaaccaaaguuaaacauccuugaaauuguuaaaccugcggacacuguugagguuguuauugauccagaugcccaccaugcugaaucagaagcacaucuuguugaagaagcucaagugauaacucuugauggcacaaaacacaucacaaccauuucagaugaaacuucagaacaagugacaagaugggcugcugcacuggaaggcuauaggaaagaacaagaacgccuugggauacccuaugaucccauacagugguccacagaccaaguccugcauugggugguuuggguaaugaaggaauucagcaugaccgauauagaccucaccacacucaacauuucggggagagaauuauguagucucaaccaagaagauuuuuuucagcggguuccucagggagaaauucucuggagucaucuggaacuucuccgaaaauauguauuggcaagucaagaacaacagaugaaugaaauaguuacaauugaucaaccugugcaaauuauuccagcaucagugcaaucugcuacaccuacuaccauuaaaguuauaaauaguagugugaaggcagccaaaguacaaagagcgccgaggauu

SEQ ID NO: 435 - RNA, 849 nt, Homo Sapiens
cucaaacaccgccugcuaaaaauacccgacuggaggagcauaaaagcgcagccgagcccagcgccccgcacuuuucugagcagacguccagagcagagucagccagcaugaccgagcgccgcguccccuucucgcuccugcggggccccagcugggaccccuuccgcgacugguacccgcauagccgccucuucgaccaggccuucgggcugccccggcugccggaggaguggucgcagugguuaggcggcagcagcuggccaggcuacgugcgcccccugccccccgccgccaucgagagccccgcaguggccgcgcccgccuacagccgcgcgcucagccggcaacucagcagcggggucucggagauccggcacacugcggaccgcuggcgcgugucccuggaugucaaccacuucgccccggacgagcugacggucaagaccaaggauggcgugguggagaucaccggcaagcacgaggagcggcaggacgagcauggcuacaucucccggugcuucacgcggaaauacacgcugccccccgguguggaccccacccaaguuuccuccucccuguccccugagggcacacugaccguggaggcccccaugcccaagcuagccacgcaguccaacgagaucaccaucccagucaccuucgagucgcgggcccagcuugggggcccagaagcugcaaaauccgaugagacugccgccaaguaaagccuuagcccggaugcccaccccugcugccgccacuggcugugccucccccgccaccuguguguucuuuugauacauuuaucuucuguuuuucucaaauaaaguucaaagcaaccaccuguca

SEQ ID NO: 436 - RNA, 2520 nt, Homo Sapiens
cuccugguucauucaaggucuacauaguuaaagguuguuccagagggauguguguaauuccucccaguauuugauguuccuuuauuacuuauuuucacuugagccaacagccugaacuggucaggcuuugggcugaugccagcugcuuuaucugguagcacuguuacauaaaauuaacauuuauuggugaucacuaggugccaacauuaugcgaagaacuuuacguggacaucccauuuaauucucagaagccgaucacaaggccuuagcucccgcgcuagagagaaacauguaucguuuucgaucacagcucuucacggggauuucugcugccgccaccgcccacucuuacccccgccgcuucucgacucuguuguuagccgaagacucgccucucagccgcccgccgcacagacgcacgaguaaaaagugcagcuccaucggcugauccucgcuaagcuccgacucugggcggcaccgggcgucccacgaugccgaagaacaagaagcggaacacuccccaccgcgguagcagugcuggcggcggcgggucaggagcagccgcagcgacggcggcgacagcagguggccagcaucgaaauguucagccuuuuagugaugaagaugcaucaauugaaacaaugagccauugcagugguuauagcgauccuuccaguuuugcugaagauggaccagaaguccuugaugaggaaggaacucaagaagaccuagaguacaaguugaagggauuaauugaccuaacccuggauaagagugcgaagacaaggcaagcagcucuugaagguauuaaaaaugcacuggcuucaaaaaugcuguaugaauuuauucuggaaaggagaaugacuuuaacugauagcauugaacgcugccugaaaaaagguaagagugaugagcaacgugcagcugcagcguuagcaucuguucuuuguauucagcugggcccuggaauugaaagugaagagauuuugaaaacucuuggaccaauccuaaagaaaaucauuugugaugggucagcuaguaugcaggcuaggcaaacuugugcaacuugcuuugguguuugcuguuuuauugccacagaugacauuacugaacuauacucaacucuggaauguuuggaaaauaucuucacuaaauccuaucucaaagagaaagacacuacuguuauuugcagcacuccuaauacagugcuucauaucagcucucuucuugcauggacacuacugcugaccauaugcccaaucaaugaagugaagaaaaagcuugagaugcauuuccauaagcuuccaagccuccucucuugugaugauguaaacaugagaauagcugcuggugaaucuuuggcacuucucuuugaauuggccagaggaauagagagugacuuuuuuuaugaagacauggaguccuugacgcagaugcuuagggccuuggcaacagauggaaauaaacaccgggccaaaguggacaagagaaagcagcggucaguuuucagagauguccugagggcaguggaggaacgggauuuuccaacagaaaccauuaaauuugguccugaacgcauguauauugauugcuggguaaaaaaacacaccuaugacaccuuuaaggagguucuuggaucagggaugcaguaccacuugcagucaaaugaauuccuucgaaauguauuugaacuuggacccccagugaugcuugaugcugcaacgcuuaaaacgaugaagauuucucguuucgaaaggcauuuauauaacucugcagccuucaaagcucgaaccaaagcuagaagcaaaugucgagauaagagagcagauguuggagaauucuucuagauuuucagaacuugaagacuauuuucuaauuucuauuuuuuuuucuauuucaauguauuuaaacucuagacacaguuuuuauccuggauuaacuuagauaacuuuuguagcagugguuauauugcuuauaauuuaauguacaauacuauugaaacuggugaguucugauuauuaaauauucucuguaaaucaguaaacauguauaaaguauuuguaauguuuggucauaauuuauuuaugaagacagcaaaagacugauuucaugauggggaaaacaauuagccaaaguuuaauuucuuacacugugguugucaagaauacugauuuacuauaaugauauauacaugcaagauauuuaacuuaauaucuuagacaagaguucuggguacaauuuugggaucuaguuccccuggaaaagcugcuguauuuuuaauuuuuaauggaauguagcuuuuaaaauccugucacuggcaucaacaaaaggaauuauaccaugagaccuuauagcuguacuuaaaagccauucaguucagcuauugggaguucaugaugaauuagcauaugccagaaagguugcuaaccuuaacaucugagagcaguaacacugauuuuaucugcuguaugagacuuugugcauuuuacuuugaaauaaagauuuuuuuccacacugaaa

SEQ ID NO: 437 - RNA, 2092 nt, Homo Sapiens
agucaucauaguggcagcuuccgccugcuacaggauauuuauauauggaagcauaccauggcaggagugcuggaaagguggugucagcuaacaguugcuucagccagauaaggacgaguccaauaaaaaccucaucaguuaccaacuaaaucagggcaugguguuuuuuuguuguuuucuuuuuaaagcauaguuuuaguaauauauuuacuaaaaaccuuagacauuaugaaaaaagucaggauuuggaaucuuacacugcuuggcuaaauugacacaauauagaccaacaguuucauccuggggcuuaugggucucauaggagcacccguaugcugaagaaaggcaaagagagaacuacagaauuuguagaaaaguuuuguuguaguugcuucugaacaauuaguuuuuguuuguuuguuuuguuuuguuuuguuuuucugguaaccuagcagucaaagcucacauuuuuguguuccaucuuaacauaagucaccaacuucuaaaccuggcacugggcauuugaagaauaggauucgucccuacucuaaggaguuuucagucuaucgggaaaucaaagauguaagcaaauagaugcaauaaaauacuacagauguucugauagaagaauguaaagaauccagcaaaggcaaaaggaaagacagggacaaugacucauucuucccaggacacugguucuuguggcauucaggaagauggaaagcuuuaugugguggauuccauaaaugacuuaaacaaacuaaaccucuguccagccggaucgcagcaucuguuccuguuaagacagucuucaaagaacuuuccaaagaggucuaaggagauagcuuaacccugcuuauuccuugaauaccaauagagaagaagcucuagaggacaaaaucccaguccuuggcacaaacucaggaaauggaagccggagucuguuuuuuguggggcugcuaauugugcugauugucagccuggcacugguuuuuuucgugauauuucuaauaguucaaacuggaaacaagauggaugaugugucaagaagacuaacagcugaaggaaaagacauagaugaucuuaagagaaucaauaacaugaucguaaagcgacucaaccaacucaaccaacuggacucugaacaaaacuaaaggaaugauuuucugaaagcaccugcuaacaccuugagcuuuuuacuuuccugggaguguacaggguuaggaacugagaaagugcacuuccucaggcaacagaugaucuggucaggcaacccaccccuggggcccacuuucugcagcaagaugggagcaauuccaaggcaaguggguaugggaauagcaacuaaaaaggggugaacuugucucagcccccuuuuaugguagggcacuucaacuuuaauggggugggcggcuagcagggaggagaaucaacaaagcaagagaacuugacuauguacguccaacuucuuacagaaggagcuuugcuaccagaacaaguucacugugucaaugaaguucaugacaccucaugcaccuuuacagauaucugggaaagccugagaaauucauugaguuuuauguauugaagggaaccaggugauuacucuuuucaauaagagggauucugcucaggugauuagacuuugacucuauuuccccagggacagugaugggugggccccagagcuaguugcugucugguguuugcuggugaaaacaugagcaguaguuauguggggcugagagucaaaagggaaagccuaauuaauucaacuaauguuuauuaagcuccuacucugugcaaaucacucuacucaagaggagcucacauaagagugcaggauaaagaaaggagauggacaguuauauguaauuauauaaacuuuguguauuuuguuucucaugaaaaaaccccuuuggcacccugcugauugauuuggaagaaaucugauagauuuguggccuuuccuaaauugcacuaggaaauuauguaguuagaauauuuggaaccugcauuaguuccagcaaugaaaguaagacacacagcauaugacauaagacacagugugaaauaaaugaguuuaaaaagc

SEQ ID NO: 438 - RNA, 2794 nt, Homo Sapiens
ggccgcaggcccgcugcggcggacugggcggcggaaguucgacggcgccgggcgaguggcuguugagcggcgccgcgggaguuccgcagguuucccguguucgcagcggagccggaggccagcugaacccggccgugggaucccggauaggaggaggaggggacccauaggacgcguuaacauggaccuggaaaacaaagugaagaaggaggaguccuuuucugaguagaguccacagaagagguauucuauugaugggcuuaggucacgagcaaggauuuggagccccuuguuuaaaaugcaaagaaaaaugugaaggauucgaacugcacuucuggagaaaaauaugucguaacugcaaguguggccaagaagagcaugauguccucuugagcaaugaagaggaucgaaaagugggaaaacuuuuugaagacaccaaguauaccacucugauugcaaaacuaaagucagauggaauucccauguauaaacgcaauguuaugauauugacgaauccaguugcugccaagaagaaugucuccaucaauacaguuaccuaugagugggcuccuccuguccagaaucaagcauuggccaggcaguacaugcagaugcuacccaaggaaaagcagccaguagcaggcucagagggggcacaguaccggaagaagcagcuggcaaagcagcucccugcacaugaccaggacccuucaaagugccaugaguugucucccagagaggugaaggagauggagcaguuugugaagaaauauaagagcgaagcucugggaguaggagaugucaaacuucccugugagauggaugcccaaggccccaaacaaaugaacauuccuggaggggauagaagcaccccagcagcagugggggccauggaggacaaaucugcugagcacaaaagaacucaauauuccugcuauugcugcaaacugaguaugaaagaaggugacccagccaucuaugccgaaagggcuggcuaugauaaacuguggcacccagcuuguuuugucugcagcaccugccaugaacuccugguugacaugauuuauuuuuggaagaaugagaagcuauacuguggcagacauuacugugacagcgagaaaccccgaugugcuggcugugacgagcugauauucagcaaugaguauacccaggcagaaaaccagaauuggcaccugaaacacuucugcugcuuugacugugauagcauucuagcuggggagauauacgugauggucaaugacaagcccgugugcaagcccugcuaugugaagaaucacgcuguggugugucaaggaugccacaaugccaucgacccagaagugcagcgggugaccuauaacaauuucagcuggcaugcauccacagagugcuuucugugcucuugcugcagcaaaugccucauugggcagaaguucaugccaguagaagggaugguuuucuguucaguggaauguaagaagaggaugucuuaggaggagggcacccagaaguaucgagccauagcuauccaaaguggucugcauuucuacuguaaaaugcaauuugaaaaaaauaaaacgcaaaaaaagaaacuguaaaggaaaccaagagauuuuguuuaauuuuuuuggccauuuuuucuucaucaauuuuuuuucggucucaacuuuuaaacuugguuuaagcauuugauuuguaaaacaguaaauaauuguaucuuuccauagcuuuucaaaugugaaaucauuuuuggaagcuuggaucucauuaaacuucaugucucuauuccauuugugccacacacuuaaaaguuaguguacugaauggaaagaugagcauuccuaguucuacacuucuuuuuucccccucauguguaaaaugaaaagaaaacuaaauuugcccuaauaccaaggcgcuacguuuauugccucgucuuauucacugaccuuuguaaugauacacagugaauucuuuuugacaaagagaaaugcaguguaguaugcagagcugcuguuuuaaugccuaugcauuuacucuuuccugauuuaggcagagguggcauuuucuuuauugcauuucucuauuuuuuuaauguacccuaccuucaguauucucuuuguaaguuggugacuugcaucuguggccuugaauauuuuauuaucacauguggcauaacaguauccacacuuuuuaguucuuuauuuuuuuuuuuuuauuuugagcaauucuccugccucagccucccaaauagcugggauuacaggugcaugccaccacacccagcuaauuuuuguauuuuuaguagagacagguuuucaccauguuagccaggcuggucucaaacuccugaccucagaugauccgccugccuuggccucccaaagugcugggauuacaggugugggagccaccaugccugacccacacacuuuuuacuuguauagaugauuuuuggcuuggacauaaaagccaagccacccauuugcuuuuaauccaaagaacauguauaguuuuuguacccagagacuaugauuuauauugauugcacuugccugccaugauuuagauaagauuuuuuuugcaugguuuuuauucuuuccuaauggauccuguuuuauaauacuuccaagccuguccauggauauaucaaaugucuucacuuguauauuuucauggcuagguauuucuaauguuuauucuucccuguguacuucuacacauagcuaugcacuaugaaaauuaaauggaaugaaugauauguauauuacucaaaauaaaguuucuuucacuuuaa

SEQ ID NO: 439 - RNA, 9312 nt, Homo Sapiens
auugcuaagccauccuucagacagagagggagcggcugcaagagguaaugagagagauggcaagaaagaagcugaaaaaauuuacuacuuuggagauugugcucaguguucuucugcuuguguuguuuaucaucaguauuguucuaauugugcuuuuagccaaagagucacugaaaucaacagccccagauccugggacaacugguaccccagauccugggacaacugguaccccagauccuggaacaacugguaccacacaugcuaggacaacgggucccccagauccuggaacaacugguaccacuccuguuucugcugaauguccagugguaaaugaauuggaacgaauuaauugcaucccugaccagccgccaacaaaggccacaugugaccaacguggcuguugcuggaauccccagggagcuguaaguguucccuggugcuacuauuccaagaaucauagcuaccauguagagggcaaccuugucaacacaaaugcaggauucacagcccgguugaaaaaucugccuucuucaccaguguuuggaagcaauguugacaauguucuucucacagcagaauaucagacaucuaaucguuuccacuuuaaguugacugaccaaaccaauaacagguuugaagugccccacgaacacgugcaguccuucaguggaaaugcugcugcuucuuugaccuaccaaguugaaaucuccagacagccauuuagcaucaaagugaccagaagaagcaacaaucguguuuuguuugacucgagcauugggccccuacuguuugcugaccaguucuugcagcucuccacucgacugccuagcacuaacguguauggccugggagagcaugugcaccagcaguaucggcaugauaugaauuggaagaccuggcccauauuuaacagagacacaacucccaauggaaacggaacuaauuuguauggugcgcagacauucuucuugugccuugaagaugcuaguggauuguccuuugggguguuucugaugaacagcaaugccauggagguuguccuucagccugcgccagccaucacuuaccgcaccauugggggcauucucgacuucuauguguucuugggaaacacuccagagcaaguuguucaagaauaucuagagcucauugggcggccagcccuucccuccuacugggcgcuuggauuucaccucagucguuacgaauauggaaccuuagacaacaugagggaagucguggagagaaaucgcgcagcacagcucccuuaugauguucagcaugcugauauugauuauauggaugagagaagggacuucacuuaugauucaguggauuuuaaaggcuucccugaauuugucaacgaguuacacaauaauggacagaagcuugucaucauuguggauccagccaucuccaacaacucuuccucaaguaaacccuauggcccauaugacagggguucagauaugaagauaugggugaauaguucagauggagugacuccacucauuggggaggucuggccuggacaaacuguguuuccugauuauaccaaucccaacugugcuguuugguggacaaaggaauuugagcuuuuucacaaucaaguagaguuugauggaaucuggauugauaugaaugaagucuccaacuuuguugaugguucggucucaggauguuccacaaacaaccuaaauaaucccccauucacucccagaauccuggauggguaccuguucugcaagacucucuguauggaugcagugcagcacuggggcaagcaguaugacauucacaaucuguauggcuacuccauggcggucgccacagcagaagcugccaagacuguguucccuaauaagagaagcuucauucugacccguucuaccuuugcgggcucuggcaaguuugcagcacauugguuaggagacaacacugccaccugggaugaccugagaugguccaucccuggcgugcuugaguucaaccuuuuuggcaucccaaugguggguccugacauauguggcuuugcuuuggacaccccugaggagcucuguaggcgguggaugcaguugggugcauuuuauccguuuucuagaaaucacaauggccaaggcuacaaggaccaggauccugccuccuuuggagcugacucccugcuguugaauuccuccaggcacuaccuuaacauccgcuauacucuauugcccuaccuauacacccucuucuuccgugcucacagccgaggggacacgguggccaggccccuuuugcaugaguucuacgaggacaacagcacuugggaugugcaccaacaguucuuaugggggcccggccuccucaucacuccaguucuggaugaaggugcagagaaagugauggcauaugugccugaugcugucugguaugacuacgagacugggagccaagugagauggaggaagcaaaaagucgagauggaacuuccuggagacaaaauuggacuucaccuucgaggaggcuacaucuuccccacacagcagccaaauacaaccacucuggccagucgaaagaacccucuuggucuuaucauugcccuagaugagaacaaagaagcaaaaggagaacuuuucugggauaauggggaaacgaaggauacuguggccaauaaaguguaucuuuuaugugaguuuucugucacucaaaaccgcuuggaggugaauauuucacaaucaaccuacaaggaccccaauaauuuagcauuuaaugagauuaaaauucuugggacggaggaaccuagcaauguuacagugaaacacaauggugucccaagucagacuucuccuacagucacuuaugauucuaaccugaagguugccauuaucacagauauugaucuucuccugggagaagcauacacaguggaauggagcauaaagauaagggaugaagaaaaaauagacuguuacccugaugagaauggugcuucugccgaaaacugcacugcccguggcuguaucugggaggcauccaauucuucuggagucccuuuuugcuauuuugucaacgaccuauacucugucagugauguucaguauaauucccauggggccacagcugacaucuccuuaaagucuuccguuuaugccaaugccuuccccuccacacccgugaacccccuucgccuggaugucacuuaccauaagaaugaaaugcugcaguucaagauuuaugaucccaacaagaaucgguaugaaguuccagucccucugaacauacccagcaugccauccagcaccccugagggucaacucuaugaugugcucauuaagaagaauccauuugggauugaaauucgccggaagaguacaggcacuauaauuugggacucucagcuccuuggcuuuaccuucagugacauguuuauccgcaucuccacccgccuucccuccaaguaccucuauggcuuuggggaaacugagcacagguccuauaggagagacuuggaguggcacacuugggggauguucucccgagaccagcccccaggguacaagaagaauuccuaugguguccaccccuacuacauggggcuggaggaggacggcagugcccauggagugcuccugcugaacagcaaugccauggaugugacguuccagccccugccugccuugacauaccgcaccacagggggaguucuggacuuuuauguguucuuggggccgacuccagagcuugucacccagcaguacacugaguugauuggccggccugugaugguaccuuacuggucuuugggguuccagcugugucgcuauggcuaccagaaugacucugagaucgccagcuuguaugaugagaugguggcugcccagaucccuuaugaugugcaguacucagacaucgacuacauggagcggcagcuggacuucacccucagccccaaguuugcuggguuuccagcucugaucaaucgcaugaaggcugaugggaugcgggucauccucauucuggauccagccauuucuggcaaugagacacagccuuauccugccuucacucggggcguggaggaugacgucuucaucaaauacccaaaugauggagacauugucuggggaaaggucuggccugauuuuccugauguuguugugaaugggucucuagacugggacagccaaguggagcuauaucgagcuuauguggccuucccagacuuuuuccguaauucaacugccaagugguggaagagggaaauagaagaacuauacaacaauccacagaauccagagaggagcuugaaguuugauggcauguggauugauaugaaugaaccaucaagcuucgugaauggggcaguuucuccaggcugcagggacgccucucugaaccacccucccuacaugccacauuuggaguccagggacaggggccugagcagcaagacccuuuguauggagagucagcagauccucccagacggcucccuggugcagcacuacaacgugcacaaccuguauggguggucccagaccagacccacauacgaagccgugcaggaggugacgggacagcgaggggucgucaucacccgcuccacauuucccucuucuggccgcugggcaggacauuggcugggagacaacacggccgcaugggaucagcugaagaagucuaucauuggcaugauggaguucagccucuuuggcauauccuauacgggagcagauaucuguggguucuuucaagacgcugaguacgagauguguguucgcuggaugcagcugggggccuuuuaccccuucucaagaaaccacaauaccauugggaccaggagacaagacccuguguccugggaugcugcuuuugugaauauuuccagaaauguccugcagaccagauacacccuguugccauaucuguauaccuugaugcaaaaggcccacacggagggcgucacuguugugcggccucugcuccaugaguuugugucagaccaggugacaugggacauagacagucaguuccugcugggcccagccuuccuggucagcccuguccuggagcgcaaugccagaaaugucacugcauauuucccuagagcccguugguacgauuacuacacggguguggauauuaaugcaagaggagaguggaagaccuugccagccccucuugaccacauuaaucuucauguccgugggggcuacauccugcccuggcaagagccugcacugaacacccacuuaagucgaaagaacccucuuggucuuauuauugcccuagaugaaaacaaagaagcaaaaggagaacuuuucugggaugaugggcaaacaaaggauacuguggccaagaaaguauaucuuuuaugugaguuuucugucacucaaaaccacuuggaggugacuauuucacaaucaaccuacaaggaccccaauaauuuagcauucaaugagauuaaaauucuugggauggaggaaccuagcaauguuacggugaaacacaauggugucccaagucagacuucuccuacagucacuuaugauucuaaccugaaggucgccauuaucacagacaucaaucuuuuccugggagaagcauacacaguggaguggagcauaaagauaagggaugaagaaaaaauagacuguuacccugaugagaauggugauucugcagaaaacugcacugcccguggcuguaucugggaggcauccaauucuucuggagucccuuuuugcuauuuugucaacgaccuauacucugucagugauguucaguauaacucccauggggccacagcugacaucuccuuaaagucuucuguucaugccaaugccuucccuuccacacccgugaacccccuucgccuggaugucacuuaccauaagaaugaaaugcuacaguucaagauuuaugaucccaacaacaaucgguaugaaguuccagucccucugaacauacccagcgugccauccagcaccccugagggucaacucuaugauguccucauuaagaagaauccauuugggauugaaauucgccggaagaguacaggcacuauaauuugggacucucagcuccuuggcuucaccuucaaugacauguuuauccgcaucuccacccgccuucccuccaaguaccucuauggcuuuggggagacugagcacacguccuacaggagagacuuggaguggcacacuugggggauguucucccgagaccagcccccaggguacaagaagaauuccuaugguguccaccccuacuacauggggcuagaggaggauggcagugcccauggagugcuccugcugaacagcaaugccauggaugugacguuccagccccugccugccuugacauaccguaccacagggggaguucuggacuuuuauguguucuuggggccaacuccagagcuugucacccagcaguacacugaguugauuggccggccugugaugguaccuuacuggucuuugggguuccagcugugucgcuauggcuaccagaacgacucugagaucuccagcuuguaugaugagaugguggcugcccagaucccuuaugacgugcaguacucagacaucgacuacauggagcggcagcuggacuucacccucagccccaaguuugccggguuuccagcucugaucaaucgcaugaaggcugaugggaugcgggucauccucauucuggauccagccauuucuggcaaugagacacagcccuauccugccuucacucggggcguggaggaugacgucuucaucaaguacccaaaugauggagacauugucuggggaaagguauaauccuaagcgaugauccaguagucccuagccugucuggccugauuuuccugauguuguugugaaugggucucuagacugggacagucaaguggagaaauuauauuucuuuuuuauagcuauaucgagcuuauguggccuucccagacuuuuuccguaauucaacugccaagugguggaagagggaaauagaagaacuauacaacaauccacagaauccagagaggagcuugaaguuugauggcauguggauugauaugaaugaaccaucaagcuucgugaauggggcaguuucuccaggcugcagggaugccucucugaaccacccucccuacaugccguauuuggaguccagggacaggggccugagcagcaagacccugugcauggagagucagcagauccucccagacggcuccccggugcagcacuacaaugugcacaaccuguacggguggucccagaccagacccacauacgaagccgugcaggaggugacaggacagcgaggggucgucaucacccgcuccacauuucccucuucuggccgcugggcaggacauuggcugggagacaacacagccgcgugggaucagcugaagaagucuaucauuggcaugauggaguucagccucuucggcauauccuauacgggagcagauaucuguggguucuuucaagaugcugaauaugagauguguguucgcuggaugcagcugggggccuuuuaccccuucucaagaaaccacaacaccauugggaccaggagacaagacccuguguccugggauguugcuuuugugaauauuuccagaacuguccugcagaccagauacacccuguugccauaucuguauaccuugaugcauaaggcccacacggagggcgucacuguugugcggccucugcuccaugaguuugugucagaccaggugacaugggacauagacagucaguuccugcugggcccagccuuccuggucagcccuguccuggagcguaaugccagaaaugucacugcauauuucccuagagcccgcugguaugauuacuacacggguguggauauuaaugcaagaggagaguggaagaccuugccagccccucuugaccacauuaaucuucauguccgugggggcuacauccugcccuggcaagagccugcacugaacacccacuuaagccgccagaaauucaugggcuucaaaauugccuuggaugaugaaggaacugcugggggcuggcucuucugggaugaugggcaaagcauugauaccuaugggaaaggacucuauuacuuggccagcuuuucugccagccagaauacgaugcaaagccauauaauuuucaacaauuacaucacugguacaaauccuuugaaacugggcuacauugaaaucuggggagugggcaguguccccguuaccagugucagcaucucugugaguggcauggucauaacacccuccuucaacaaugaccccacgacacagguauuaagcaucgaugugacugacagaaacaucagccuacauaauuuuacuucauugacguggauaagcacucugugaauuuuuacagcaagauucuaacuaacuaugaaugacuuugaaacuacuuauacuucauacucauaaaaauuauuguguguugcuaauuuguucauacccacuauuggugaaauauuucuguuaauuuuguuauauguuuuuugugugaacccuaaagguuaaaccuuagcccugugggauaggcaguuagggagguguggaaaaucuaugcauuaccuuaaugucucugugugguuaguaugguagugacuguucaucauaugacauuuacugaagaugaacuggguccaugaugaaguguguguauguccacguuuguaaucauagaauggaccccauucuuuuguuaaauacacaagagaaagcuuucugugacaguuccaggucuugaagcuaaucagcaucucaagaaaguauccagaaagaacaucugcuaguugguuauaggcggugggaggaauaauauaccuaauugguuauagguggggggagcaugauaagcaaagaaaaggcaaacacaaggaaagaucagaugaaacagaagaugauaguaaaagugauccuaaguaagaacauaauguaaaauugucagcagccucauggggaggaaaaaggaagagucaacucacuugaagaagagggucuugagaaauccuuagcauaaagggcuacuggugagauugagaucugagcaggcaaagcucaaaagagaguuuggagguuaaaaauaauuuauuuuugcaguagugugcuuugaaauguguaaaucuuauuucuaauguauacaaccacauuucacauaaaaauaugcaauuuauaugccagauaaaaauaaaacaagugaauuugcaagugaccggaggaauucccugggacucaucaucgccuuggacuauaagagagaagcaaagggggagcuguacugggaugacggu

SEQ ID NO: 440 - RNA, 1541 nt, Homo Sapiens
ucccuaugaauugcugagggagagauacagcauagaaaaaaacaaggugaugcgauggcgaggaagcucaguguauuggaaguccuucugaucaucuucugcuuaauuguggugaccauagauauccucuugcugcuucuuguguuggaggaaacuucagauacuucauuuacuccagagugcccagagauuccccagucggaaaggauagacugcacaccugaccaggaggugaccgaggauaucugcagauggcaauauaagugcugcuggucgccuguggcagaugccaaugucccuaggugcuucuuccccuggaacuggggcuaugaagccagcaauggccauacaaauacaagcacaggauuuacugcccaguugaaaagguugccaucaccaucucuguuuggaaaugaugucgccaccacccuuuucacagcugaauaucagacauccaaucgguuucauuuuaagaucacugacuuuaauaacauacgcuaugaaguuucccaugaaaauauuaaccugguugaugggauugcugaugccuccaauuugagcuauuacguggagguuacugauaaaccuuucagcaucaaaauaaugaggacaagcaacagaagagucuuguuggacacgagcaucgggccccuccaguuugcccagcaguaccugcaacugucuuuccgacugcccagugccaauguguaugggcugggagagcaugugcaccagcaguaccgccacaauaugaccuggaagacuuggcccaucuucacccgggacgcuacccccaccgagggcaugauuaaucuguauggagcucauacauucuucuugugccuugaagaugccaggggcuccucuuuuggaguauuucugaugaacaguaaugccauggagguuacccuucagccagcuccugcgaucacuuaucgcacgauuggaggcauucuugacuuuuacguauuccuaggaaacacuccagaacaagugguucaggaauacuuggagcuuguuggacggccauucuucccucccuauuggagucuuggguuccagcuuagucgcagggacuaugguggcaucaauaaauugaaagaaguuguaagccgaaaucguuuagcugagauaccauaugauguccaguacucugacauagacuacauggauggaaagaaggauuucacuguugaugaagucgcuuacucuggucucccagauuuugucaaggaguuacaugacaauggacagaaauaucuuauuauuaugaauccuggcaucuccaaaaacucuaacuacgagcccuauaauaauggaagccuaaagagaguguggaucuuggggagcaauggcuuugcuguuggggagggauauccgggaccgacagucuuucccgauuauaccaauccaguaugcacugagugguggacagaucaggucgcuaaauuucaugaucaucuggaguuugauggaguguggauuguaaguuauuauuccugacucaaauuuccuuuggaaacagauaacgccaaauuuuc

SEQ ID NO: 441 - RNA, 5515 nt, Homo Sapiens
ggagaaaggagagaaaggaaagcgcgaggagccgccgccaccaccagcgcagcaguccuggagcugugaggagauucgggccgucacccugccuccccugcgucccgccaccggccgcuucuguccucggacccauuccaacaaucucguaaaacaugguggauuacuaugaaguucuaggcgugcagagacaugccucacccgaggauauuaaaaaggcauaucggaaacuggcacugaaguggcauccagauaaaaauccugagaauaaagaagaagcagagagaaaauucaagcaaguagcggaggcauaugaagugcugucggaugcuaagaaacgggacaucuaugacaaauauggcaaagaaggauuaaaugguggaggaggagguggaagucauuuugacaguccauuugaauuuggcuucacauuccguaacccagaugaugucuucagggaauuuuuugguggaagggacccauuuucauuugacuucuuugggucucaaacuccugaccucaagugaucugcccgccucggccucccaaaguacugggauuauagcugugagccacugcacccucccggaaaugcuuuuuaacggucaccuccuaggggagaugaagagaguuaccgcauaaucaguuuuaacuguauuuguaauguuuguuucuuuaccugggaggauauguuguagauacgugagauagaauaccuaagugacacaauggugugcaggcuauggcugcaaaguagaaaguuucuaaauagcaugcuuggauuuuuauuugaauuggaugaaguuuuuguguccuagagaaauucacaaaauguuccuaguuucagauaaaagguuaugauuuaacaucuuugcuuuuguucuuucuugucuuugaauagaacagugggggacgguaaggucuguuugcaaaguaccuaugaccaucuuacauuauuuuuauggguggggggcauugacuguggaaugugggcaguaacuugcacagucaguaaccguuugaguaacuucuuguuggcauccccauucuggcacuccuccucuaggucuccaccucacacgcugguuugugggcggaggggcagguuggugcgugggguguccgggcacuggcugugcaugccuucuuccucuucugucucuuggccaccuuuuccaaaaagucaccagugaccaauucucccaguguuucuuugggacucaaugccuugggcuuggcauuggguaaagccaacuggccaguuucauucugacgagcucuauaguaguccgguguggaccucugcccucccugcucugcggaagcuuccucagccuuugcuucucacuauuuacuauuugcggguccuggggguacccagcgucucaggguuuuggcugcccaccuguacgucgguccuuucaaacuguggucagagucaaccucaggugcugcuuuucucuagucacugcauuuuuuuuuuuuaguagagacaaagucuugcuguguuguccagccuggauucaaacuccugagcucaaggaauccucccacucagccuccagaguagcuggaucaagucacucuuguucauaaccucaguugcuucaugaaucucgauuucugcuugauuucagugcuugcuguuguauccuugugugcugcaguauuuauuguuaacauuugugacucaaauguauccacucccugcuuugguugcucuggccugcaaguaggccguacuaauucuguaguugguccuagcuugccuuugucuuuaccuugcaugcguuuaugucuuaaugcaccuauuaggauuccuugcuuuuaucacagguuucccauuuuucugaaaaaauuacaguaauuauuaacgcagaacccagguaaauuaaaaagguuuguaugcuuuaugaauuuuuaguaaguacucauugauugauaacagcaacagaggaaaacaaaacggucaguuccgaucuugauuuccaggagcacuuuguguuuccacuuggcagcgugaugcuuccucaugucggugauuuucuguugagacaucuucaagcaucaucuuacgucugcuuguuaacauuuguucagauuugauuucagcuaauccuuaaaaguuuuuugagacaucaaacuuagaauaaaaggaauuuccuuugccgagauucaucagguauuuacacuuagcuuacauggccacaccauuccucgugugugugugugugugugugugugugugugggcgcgcgcauguuaggguaauccauuuuucuguuuguuucugaauugcuuuggagaaggcaacucagacuccaaggaauacaacagcugccgugugaagcuuuucucacuuuuccaguggucguagcaggaacagcgucuugaccucacaucagugacgugaaaagagcugaguuugaagugcauauugguccuccauaaagaauguguguaugugcuguuuuuuuaauuaagucugguaauuuauuugauacaauguauuguaguuuuaguugaauuaaacuaguuaguaaaacuguuggugagguaguguuucaguuacucuguagauaagcucuuuuguuaaaaccucuuaaguuuuuuguuccugaauauguuacaaacaucuauuuucucuuacuguagcuaucacaugaggaaaaaaacuugaaaaaaagacuucauaguguguguuuauguuugauuuuagaagacccuuuugaggacuucuuugggaaucgaagggguccccgaggaagcagaagccgagggacggggucguuuuucucugcguucaguggauuuccgucuuuuggaaguggauuuucuucuuuugauacaggauuuacuucauuugggucacuaggucacgggggccucacuucauucucuuccacgucauuuggugguaguggcaugggcaacuucaaaucgauaucaacuucaacuaaaaugguuaauggcagaaaaaucacuacaaagagaauugucgagaacggucaagaaagaguagaaguugaagaagauggccaguuaaaguccuuaacaauaaaugguaaggagcagcugcugcgcuuggauaacaaguaauucaacgcacgcacuuaacagaaauguuaaacuauaacaagcaccauuugaggauuaacaggaacauuuuuuugaagauuucaaacgaacucgacuuucaguauaauuguaccuaaaguauuuauaaacagcucaucggagccucuauuugucauagacuuuugaguugauuguugggaccacauaauaggaccauuuuuuuuuugucuuuaaaauuguuguaaaucucuguaugcacuuugcuuuuuuauuaaacguacuccaaggugagucuugacucuuuaguguaggacaagauuguacacuaacaccagcauggaccugcuuuucauugugucugaaaugugagccacguagugucggccugcugugaaguuaacauugccaggacgauucuucuacagaaauaauuucaauuuuuuucaguauuuaguagugaaagauauuaauacauuaaugguaauacauuucugguuuaauauaaauuaaggauguuuucuaguugugcaugaaugcuggcaacuuaguaaguuuugacaauuguuuaaauauguaauguuaagcuuagguuuaaaaaaguaaagcugguaaacugggucuuugucauuugcuuuaaaaaaaaaaaaaaagaaaauaaaugcgaauguguuggugcauucuuccugagugggaucuggaguguggccgacgacgaugcccucgcugaggagcgcaugcggagaggccagaacgcccugccagcccagccugccggccuccgcccgccgaagccgccccggccugccucgcugcugagacacgcgccucacugucucucugaggaggagggcgagcaggaccgaccucgggcacccgggcccugggacccccucgcguccgcagcaggugugcaaagggaggcagccguggagcaggcgcagagugagacuucucugggugccagaggacagcgaggacacaaaccgcgccugggcugcuguguucugaccugagauugaaagaagguggcaagaggaagaagcagaagcagagagaggagucgaagaagaagaagucgaccaaaggcaaucacuagaccggacuugaggcacgcggugcacccccagacgcuggcgcuccaccgugcucggcaugcggucgugcacacgcgcuagguagcagcgucggucaggacugucucgaggccacacucgcucggcaggauuaugcgaucacggaucagucagagcagggucaggagacggggcugacggcacggguggcggggacagacguuugggacuuggccgcgacucucugcuucucuccagcucucaaucugcugcauuuuccucuagugcuuccggauccucuucauucuuuucggcuacucaaccacuccgcaugcugcuggaauauuucuggcuuuagaaguacaggagggcgcagauggcuaacugaguaacauucaugaaaugaggcuuucuguggcggcguaguguuuggaauuagaagguaauucaguagaguguaacuuagagaauauugcaagugacacauugaauccugcccgucagggcaccuuuuccucagagcaauccggccacacgaauagaaggcugucgugaaucacaucagauguaaaaucauuccuucuguuuacucuuuuaauuuucauccuuugcagguagugcaaauucaacuucaaauaugguguagguuuugcuagauuccauauuuuuuucuuggauuuuugcuaauuauuuuuagcaaaaaauuuuugcucaguggcacucucccuaguguccauggguuagggccaugcuggggaaaacgggccgguauuuacacacgcgcaaaacacccagagacggcacaaggagguugaacucauguuucaguucgcgaacauugacuccuuacgaaagucacuucauucuaacuagaugcgcccacuuccggucauuauuucguuugcaugauguauugcuucuucacguuuuguuuuuauugagcacggaguagaauuccagggcugccuugacuucuucccugcaugcucccucccagugacuuuccuucccuuucacaugaggaucugccguucauguugcuuucuccuuuguccucuuggacuugagggcauugugaaaagcuuugcugugauuuaaaaaugccagcaauuuuaaucuagcaguguugaagcugggaauuuuuuggcgcaauccauguagcagugacccaggcuugggagccagaaacaagugugaccugggauuuuauuuaacacaacuguugccaaagaguuggcuuuguuuauuugguuuuggcggggagaggagugguauuugaugcuuucuguggacaauguaacccuaaacacaucauguauuuuaaaugccaccuacauaaauaaaacauaagcauauugaauaca

SEQ ID NO: 442 - RNA, 321 nt, Homo Sapiens
cugguuaacguuccuaaaacccgccggacuuucuguaagaaguguggcaagcaccaaccccauaaagugacacaguacaagaagggcaaggauuaucuguaugcccauggaaagcggcguuaugacaggaagcagaguggcuauggugggcaaaccaagcugauuuuccagaaaaaggcuaaagcuacaaagaagauuguccuaaggcuugagugccuugagcccaacugcagaucuaagagaaugcugccuauuaaaagaugcaagcauuuugaacugggaggagauaauaagagaaagggccaagugauccaguucuaa

SEQ ID NO: 443 - RNA, 8645 nt, Homo Sapiens
gagacgcggacgucgcucuuccaagauggcggcgcguccgucgcgagcgaccgggccgaggggaggccagcgaagccgaguaaaaccgccgcccgggagaagacugaaggagcaguugccgccguuggcggcggcccgagcaguuuucgcugcugcuacggcuguugccaugaggcgaggcuagggaggaccucacuuccccgggguguaauaauguuaacugaggccagucuauccauauggggauggggaagccuuggcauuguccuuuuucugauaaccuuuggacccuuuguaauauuuuauuugacauuuuauauccucugcuuuguggguggggguuuagugguuacucuccuguuuggaaaaacaaacucagagaaguaccuagaacagugugaacacucauuucuuccuccaacaucaccugggguuccuaagugcuuagaagaaaugaaacgggaagccaggacuauuaagauugauagaagauugacgggugccaauauaauugaugaaccucuccagcaaguuauccaguuuuccuugagggauuauguccaguauugguauuauacacuaagcgaugaugaaucuuuucuucuugaaauuaggcagacucuucaaaacgcacucauucaguuugcuacuagagucucgcccugucgcccaggcuggaguacaauggcgcaaucucggcucacugcaaccuccgcuuccuggaacccuguuuuguuuaacaaaaccuuggucucacugugucuccuagaauauguaauuuaaauucuggcucugaaauuacagggaauugugguagugauuugagaacccuuucaguucuaaaauaguaagauucucuggucagguuguuacuaaucuugauuucuuuucaaucauguuuccucccaaaacacacacuaacauacuccaucacacuccacauuuugaauaccauuuggggaguuauuuuuuuuuaaguauauaggauugcuaauuagaguuaauuuacuuugggauuaaaguacucuucauaucuauuguuuuauuaguaggggucuuauaguaggauaacaaaauuuauuuaaaccuuuuaauauauuucuaaaugaucagaaagaaugcuugauucuaaacauaaaauacauuuacuaaucucuucucgaugauuaaaacccuuguaucaaugaaauaaaaaguuuuuguacaaccagacuauugcuguucuuuauagaaugcugaaaacaauaaaucuguaguguuaugaguuugauuuuuuuuaaguuuucugaaguguaaguucucccaccacguucaguuuuaagcuaucagcaugaagucacugaacauggaaauaggaagagauguacacaauuguuugccuacuccagcucacaguuggagaggauacagcuaagugaagagggggcagaggcagauuuguaaaccugaaguaaugaguuguauuuccuugugugguugcuaauuuagcuccuaugaaagaauuccccguauauuuuugaggacuaugguaggggguacucauacauuaacuuuaaguucaggaauguuugugaagaaggucaaauuaguuucauuauuuuaaucaauacugacaacuaaauccuuaaaguggaugauaaaaggagacucuggagagaugguuaugguaacauguaguauuuaugacugaauugacguaggggggauugauuuaguggauucaaaaugaagcuuacaauucugugccuuuacaauuuuacccaaauucaauuucagccugaguuuuugacaccguuaacaaaguaguucuucaaggacucugaaggauggaaacaaguaaaggauuauguauuuagagugaagaguaguauauccuuucuaauagugaauuaagagggggacuuaguaucugauucagagacucaggagaaggaauuuuuuucuuucacagauaagccacucaguugcuuucucucaacaaaaaaaagucugagucaguugaucaaaaggccuucuaauggaguaaaacuuuucucaaaaucuacucaaaguuacuugucaaaaaucuacccaagaaaacuaggaauucuauuuuaaugauuuuucaaaaauuucuauuuuuuuuacauagaagauaaagaccuuuuguugaagauuaauacauauuauuauaauuuuaugugauugguuauuauauugaucuuauuaacauaccuuuaaaaaggccaacucuuaacgugcguguguguguguguguuuguguauguguauauguauauaccuuuucccuugagauuccuuucaguucuaaaauacuaagauucuauggaccucuguguguguguguguguguguguguuguacauauagugucuauguauaccuacacauuaugcaguauauaguauacucuaccauucuuacuguuuuuaaaaaaggucuucguagucauuucucugaaaaacuaauguggcaucaggagcauaacauuuauuauaggauuguuuucuguggaaaaagcagcuuuuacuuuuaucauuuugacauaaggcaccuuuuccaggaaaauauucugccaugaaugugaagaucgccuuuacugccaagcgaucacccucuccucuagucaggcaagucuacaagaugacccuugcauauauauuuaucaugcucaucccccucuucugcucauuccuguguccuuucuucucccauauaaauacugcucuuucaucaagauuuaaguguagccucuuuaaugaagccucuuuaaauuaugacauauuccuuaaucuauagucuuugugugugugguucucgucaacaaaauuuuaagcugauuuugaaaugguuccuauucugugcuauugcagugaaaguucucuuaacugauguuugguuagccagugcucuccauucccuuuguaugcuguacugacugauaaccuuagcauuaagacuaggcucuauuacaucuauccacuucuguuuccacccuuggaguuguaugcuuaucaaaagucaguugugugauaccuggaccccaccuccagaaaaucugauacaauuagucuguagugugaccugaauauuggugauuuagaggagacagauaaucaaacacguugaaauaaaaguuguauuuguuuuugagccuaaauaucccaguuacacuuuuuaugauaaucaggucguuuaauuaacagucaacuuagauugaagaaauaugaauaugacaagguaguuucuaugaaaaccaagucacuugcuuuggaauuacucgcagcugguugaagaguguaauugaauuaagugagcgaaaggcagcuaugaaauuugaaagucuucaaggacucugcaugcagauuuguucacaaaugucuuuauugccaugccauuuuaaagaaacuggaaaccauagguuuugcaguguaggaacaguucauaguuuuuucaagacccaggucauguuaauaccacucagcagagccuuaaccaaagaaaaagucuuauuccuacacaggaagauuuauauaauugaacuuaaagugaaauauauucauggcucccucuuuugaucgaauguuuaaauuuaccuacugcccaauuaccaguuuuuuauacacuccaucccuguguauguauaugugugguuuuauguagcuaauauaaucauagacucaaagauguaaugaguguuguuagagaaaacaaacuuugggaaaugaugugacuugcugaauuucauagacuggcacugaugccuuugauuugaguaaaagacccaucauuugggggagucuuuuguuagaaucaaaggcaucugugucaguccagugcguuuuccagaaauacuugauuuugguaguguuuugugcuacugaugaugagcuguacacugcuuagaauagauggaacaagugaggcaauuuacaauccuaaacucaaccacauauuugggccuuuacuugccuuuuuaagggauuggcauuaaguagccaugggacaaaaagagcuucucaguacauauucuacuuuaacacuuuaaggaguaaggaagcaauuguuguuugugccuccuguugccauuguccaaacacccauuguaaacagugcuccgacccugaaaaaggaaucaauaaaucaauaugcauugagugccucugucaaaagaaauagacuggcaaccuuauuuuacuacacgcauuguagaugacuuuggcacacacuuacgaguauucagaaaggcucaacagaaaauaacagagaaagaugaucaagugaaagguacagcagaagaucuuguagauaccuucuuugaaguugaaguugaaauggagaaggagguuugccgugaucuagugugcacuucccccaaagaugaagaaggauuccuaagggauuugugugaggucuuacuauauuuauugcuaccuccuggagauuuccagaacaagaucaugcgauacuuugucagggaaauccuugcacgaggaauucuucuuccauuaauaaaucaacucagugauccugauuauauuaaucaguaugucauauggaugauccgugauucuaacugcaacuaugaggccuuuaugaacauuauuaaauugagugacaauauuggagagcuagaagcagucagagauaaggcagcagaagaauuacaguaucuuagaucucuagauacagcuggugaugauaucaacacuaucaaaaaucaaauaaauagcuuacuauucguaaagaagguaugugacucaagaauacagcgauugcagucaggcaaagaaauaaauacugugaaacuugcagcaaacuuugggaaacuuugcacagucccccuggacagcauucuuguagacaauguugcacuacaauuuuuuauggauuacaugcagcaaacuggaggucaagcacaucuauucuuuuggaugacaguggaaggauaccggguuaccgcccaacagcagcuagaaguuuuauuaagucgucagagagauggaaaacaucaaaccaaccaaaccaaaggucuuuuaagagcagcugcuguuggaauuuaugaacaguauuuaucagaaaaggcaucuccaagaguuacuguugaugacuauuuaguagcaaaauuagcagauacuuugaaucaugaagauccaaccccugaaaucuuugaugacauucaaagaaagguauaugaauugaugcuacgagaugaaagauuuuauccuuccuucagacagaaugcacuuuaugugcgcauguuagcugagcuugacauguuaaaagauccuaguuucagaggauccgaugauggggauggagaaucuuuuaaugggucuccuacaggaagcauaaauuugucuuuagaugaccuuucaaauguuucuucugaugacucaguacaacuucaugccuacauuucagacacaguauaugcugacuaugacccauaugcuguggcaggcguuuguaaugaucauggcaagacauaugcauuauaugccaucacuguacaccggcgcaaccuaaacagugaggagauguggaaaaccuaucgucguuauagugacuuccaugacuuccacaugagaaucacugaacaguuugaaagucucucaagcauauugaaacuuccuggaaaaaagacuuuuaauaauauggauagagauuuuuuagaaaagagaaaaaaggaucuaaaugcauauuugcaguuacuguuagcuccugaaaugaugaaggcaucccccgcuuuagcucacuauguguaugauuuccuugagaacaaagccuacaguaaaggaaaaggggauuuugcucgcaagauggacacuuuuguaaauccacuucgcaauucaaugaggaauguuucaaaugcaguuaaaucccuuccugauagcuuggcagagggaaugacuaaaaugucagacaacaugggcaaaaugucagaaagauuaggucaagacauaaagcaaucauuuuuuaaggugccuccuuuaauuccuaagacugauucagacccugaacaucgccgaguuucggcucaacuugacgauaauguggaugacaauauuccacuuaggguaaugcugcuucucauggaugaaguauucgacuuaaaagaaagaaaucagugguugcgaaggaauaucaaaaaccuacuucaacagcuuauuagagcuacauauggcgauacuauuaauagaaaaauaguugaccauguugacuggaugacuucaccugaacaaguagccgacucagugaaacguuucagagaugcauuuuggccaaauggcauuuuagcagaggcuguuccaugcagagauaaaaguauucgaaugagaacaagaguagcaggaaaaacgaaauuacuugcaauuaugccagaugagcugaagcacauuauuggggcugagacaacacggaaagguauucuucguguuuuugaaauguuucagcacaaccaauuaaauaggagaaugguuuaugucuucuuggaaggcuuuuuagaaaccuuauuuccacaguauaaauuccgugaacuuuucaacaaacugcauucacggucaaagcagaugcagaaauauaaacagaaacuucaaacuacucaagcgccuucuuugcagaaaaggugacacuccacucuaugaagcugguguucauuuuguccaggacuaaugguauggacagaucuucuggggcuuaacucaaauacuguugugucugcaccagucuuuuagugucucaaaauagauuauuaauacauccauaagucugugguucuucucauucucaucuauaauccaccacuaccaagagagauuucugugucuuaaaugauuuggugcauauuuugcaacauugagagaaaacugcccccaucucaagcaagaauggcguugguuucuuccauuucaaacuaaucagcauucuccagcaaugacaaagugccagaguguauauaugaaagcuaaggaaagcacaaaacaaugguucagagauaaauuggcuaauuuguuuaacaguuggagacugugcaauguacgacuuggaggaguuuguuuggcauaaugauuuuguaggucugucagcauuuugauauauuguggauuagccaggugaaugauccuugaaacaucucuuucaggucuggagaaagagacagaaugcccuuaaagugugaaauaaccuuauaccugaauuacaguuuugugauauaaaauaaagcugaguauaaaauaaaaccaaucaaacacagaauuugauuggauuuguuauucauugguauacaacaauuuuuauucuuaugugugcuuuaagggcuguguuuugcucuuaggguacucaauuuuauguuuccuuuuggcauucuuugugcaaaaagaagcaugugguggcucucauuuaaauuucaaaauuauuaguuuuaucuuuaacagauuacugauuauacagaagauauaauuuauuggaagaacugccaaauacauuuuguccuucuaaaaauauggaaauuuaaauaguagucuggaaaguuaccauaugauaauuuuuaauugugugaucuagacaugccuuagguaacugcagaaauagcaaauuaaaugauuaaugagcuuauuagucauaguaaacauacagauuccuaauucuaugacaguguacauauaugaaaauaaaugaugaaaaaagaacuauaauauuuuuaaaaauaugcuuuuauuuauauuucacauaauguaaaguucuacaaaauaaagcuaguaggcaagaccccucaguguauaccuuuaaacccauaaauuaauuuuauaucaauaaaauaaaauacuuucucuaguuuuggagcuucuguauuuccuauaguuuucugacuguccauuuuauccaucuuagaaguauucacaucccuucuaugcaggauuucugcauaguuuuaaauacuuucauugccuaaggguuugggugugucagcuuuuuuuguuuuaaaaauauuuaacacuaaaaccuuaaaauaaugaagcuacuuaucagaccacugagccaagauccugguauuaaaagaaagucugggugcuuaagauaaagggacagaguauugguaucccaguuauuugggagcuuuaagauuggaacaagauaucacugucuuguuuucacuuagauccuacuuacaaagugaggguuauuaacagaauaaagccuuccuuuaaagcuuuauaauaaucauauuuauuaauaaugcuguugugcauacuuauaguaugcauauauucagcauauguugcaugucuucagaauuacauaaaaugaaaucccuuucauugcaacuugcaagugagaaaagauccuuaguggcucugguggaagaaauaguauuucuucuucucagggugucucccugccuuggccccucccugagccccaggcuuuaaaagugaaaauguuugaaacaugaaacaugucuguaggaagcaucagcauggccauaagugcagugauuuucauauaugccucugcccauuucaaauauauuuuugacaugaauaaaucuaacaguauacagaauaauucauguaagacccuaacguguacaugugaaaaagcauuucuauauaaugugaggagcacuggccaucaauuaggga

SEQ ID NO: 444 - RNA, 3204 nt, Homo Sapiens
cccccgccgcucccgacgccgccgccgcagccgccgccuccccucugccucccgguggcuccucgcucuccuuccaucucucucgcccccucucccuccgucccguccucgccgcuccccucaccccgccucucucccccucccccagccccuccucuccucaccccacccggccucccucccucccucgcccgcccggcgcucgcagagccgacaccaggggggcucucgauguagcaccaugacaggcaucgccgccgccuccuucuucuccaauaccugccgauucgggggcugcggacuccacuuccccacccuggccgaccucaucgagcacaucgaggacaaccacaucgauacagauccacggguuuuagaaaaacaagaauuacagcagccaaccuauguugcccugaguuacauaaauagauucaugacagaugcugcccgccgagagcaggagucccuaaagaagaagauucagccgaagcucucgcugacucuguccagcucagugucucgagggaauguguccacucccccacgccacagcaguggaagccuuacuccccccgugaccccacccaucacccccuccucuucauuccgcagcagcacuccgacaggugagcagcgaguaugacgaggaggagguggacuaugaggagucggacagcgaugaguccuggaccacagagagugccaucagcuccgaagccauccucagcuccaugugcaugaauggaggggaagagaagccuuuugccugcccaguuccuggauguaaaaagagauacaagaaugugaauggcauaaaguaucacgcuaagaauggucacagaacacagauucguguccgcaaaccauucaagugucgcugugggaagaguuacaagacagcucagggccugcggcaccacacaaucaauuuccaucccccggugucggcugagauuaucaggaagaugcagcaauaacaugcuggucauaacugugccaagaaauccucaccagcaguugcugauuuugaaaacagccaccuuuuuucaggggaagcauucagcaacccuuuaaagaaaaagaauuaaaugcaugcuuuaaauuuuuucuguaauuuuggaaugauguaucuuuguagaguuaaugauuuuguacauuugcacauguaaucaucauacccauuuucauuacuuugauauaaggugcuaaacaaaaaaagcucuagguucuucagcacauuucccccaaaacaaaauaaaauugagggcauguugcauauuguugaauuguauugcggugguaucaaccuggggggaggaggggcuggcacugagauuuuuuuuucaagauuguaaugugauugaaguuuucaacacaucaacucacauauguucaaaaccaaaauaauaccuucauuaucaaacugguuaccaugccuuacauaauggaguuaguauuugugaguagaaagacuuuagguaauggaaauauaaauaagaaagaauguuuaacauaauaugcuaaaaauauuuucauauuuaaauaacauacguaaaggugugcuuucuguguuuuauauuaucuugcaaauccuuuugcccuuuaaaaagcugaaaaucuugccaucugacuuacuagucauuuuaguguuauaaauggcauuuuguacaaaauagucuauucaguucguucauucauuuaacacacauugauugagugccugcuggguacaagggauucaauuuaugccuauugauaucugcggaccaagauacccauuuagugaaauacuuuuuucccugaaaucuguuagaaaagacuuugaaauacuucagugcaaagugugugugugugaaguuuaguuauaucuucaucuucagaugaaguuuuaaagcacuuuguaguucucuauugccaacaauuuaauguuuauguguugccaauucuugcaaccacugcccuaccaaaccuguggguugcaaaucagaacuaaaauucuaagcacguuucaaagaugaacacuuuuguuaagaccccuauugccucuucuucaugcucauuuuuuacuuuuuuuaaaagguacuuuucucaucacauuguagagaggucugcauucucauuggaaaugucuguuuagcuuuauaaaacaaacacuuugcugaaauaggaaaaugagccuuauugacaauuaagugcuucuugcagcagguggucaaagaaaagcaugacuaauacgaccuauuagaguaaucuacaucuggaccauuccuuaaguuuuuccucaccgacaguaccaucaugccuugaguguucuuuucucccaagugcuauuccuuaaacacgagaguuuaccaguugccuaauaaugcaauaaaaaaugcuuugagauagcuaacugcccauaaaacaaacucaaauugcuuauaaaguuucuucccauguucccauuugaugaaaagucuuacaucacauauaacugggaagcaggggucccuccucaauuuucagacauuuugaaaggaugacaguucuguuuguuagaugaguaaaccucuauauucauaaguucuaaaauccuucauuaugagggauucaaaguauuuauaaaaacacugcccucuaaaaauuuccucagaucugaaguauggucuugguccugaauauacaguguuauccuauguuuaaaagggugauccagacaugagacgcaacuaguuggugcauaagaaggccccacuuggcuauuucauaucuaccuacaauugaccaaaaaaaauuuuuuaggccagcaauuauuauuuagcuucgcucuuucuagugcaagaaacugcaggcuggaucaguaguucaacagcuaaacagucauaaaauagucauugugcauguuaaauuucuuucaaugcuuucaaagauaaauuccaauuucuauuuacuuauucauugugacaguauuacuaaacagguaaggaugggaauauuuuguuauacuguguauagugaauguauuguacugugucugugaaaacugugcuuuaaauuauauuuucauauguuuuguuggggacagagcacauuaagucugaaagcaacagagguuuguuuuagaacugaaggcaauuuaaucaaaauuccugucaagaaaagcugcuuauaaauguaaaugaaaucacauuuaaaauaaacugccucugacccaaaaauaaa

SEQ ID NO: 445 - RNA, 3610 nt, Homo Sapiens
agaggacgcugcuuuccgcgcuggacggaccaagcgagggagggugcgaggggaaaccggaaggaagaggcggcggcgccagccuuccucggccggaggcggaggcgagaccccaggcgaggccgcggcgggagggccacgcccccgccgccgcgccggaggggcccaguguggacggggccaccggcuggagcggaucccacaccuccggaccgagggacgcgguuacuccacaggauccgcugaacauaggauguugccacaaaaucuaccucguguauuuuucucuuucacucaugagcugcacaauugcagauuugagcacaaugucugcagacuguguugaaaaacucugaagaaccuaauuaacacaggaugaccuaggagugauucuaagucuguguaacaagauauuacucauuagugaaugugucagucuugguacugaaugcugcagauaacagcaaguagguucuccuuuauuucugaaguauucacuugaccuuccaucaguaagacggacuuuucuaaucuguuccuggagauauuaauggaauacagucauguccacucaagacgagaggcagaucaauacugaauaugcugugucauuguuggaacaguugaaacuguuuuaugaacagcaguuguuuacugacauaguguuaauuguugagggcacugaauucccuugucauaagaugguucuugcaacauguagcucuuauuucagggccauguuuaugaguggacuaagugaaagcaaacaaacccauguacaccugaggaaugucgaugcugccaccuuacagauaauaauaacuuaugcauacacggguaacuuggcaaugaaugacagcacuguagaacagcuuuaugaaacagcuugcuuccuacagguagaagauguguuacaacguugucgagaauauuuaauuaaaaaaauaaaugcagagaauuguguacgauuguugaguuuugcugaucucuucaguugugaggaauuaaaacagagugcuaaaagaaugguggagcacaaguucacugcuguguaucaucaggacgcguucaugcagcugucacaugaccuacugauagauauucucaguagugacaauuuaaauguagaaaaggaagaaaccguucgagaagcugcuaugcuguggcuagaguauaacacagaaucacgaucccaguauuugucuucuguucuuagccaaaucagaauugaugcacuuucagaaguaacacagagagcuugguuucaaggucugccacccaaugauaagucaguggugguucaaggucuguauaaguccaugcccaaguuuuucaaaccaagacuugggaugacuaaagaggaaaugaugauuuucauugaagcaucuucagaaaauccuuguagucuuuacucuucugucuguuacagcccccaagcagaaaaaguuuacaaguuauguagcccaccagcugauuugcauaagguugggaccguuguaacuccugauaaugauaucuacauagcagggggucaaguuccucugaaaaacacaaaaacaaaucacaguaaaacaagcaaacuucagacugccuucagaacugugaauugcuuuuauugguuugaugcacagcaaaauaccugguuuccaaagaccccaaugcuuuuuguccgcauaaagccaucuuugguuugcugugaaggcuauaucuaugcaauuggaggagauagcguagguggagaacuuaaucggaggaccguagaaagauacgacacugagaaagaugaguggacgaugguaagcccuuuaccuugugcuuggcaauggagugcagcaguugugguucaugacugcauuuaugugaugacacugaaccucauguacuguuauuuuccaaggucugacucauggguagaaauggccaugagacagacuaguagguccuuugcuucagcugcagcuuuuggugauaaaauuuucuauauuggaggguugcauauugcuaccaauuccggcauaagacuccccucuggcacuguagaugggucuucaguaacuguggaaauuuaugaugugaauaaaaaugaguggaaaauggcagccaacaucccugcuaagagguacucugaccccuguguuagagcuguugugaucucaaauucucuauguguguuuaugcgagaaacccacuuaaaugagcgagcuaaauacgucaccuaccaauaugaccuggaacuugaccgguggucucugcggcagcauauaucugaacguguacugugggacuuggggagagauuuucgaugcacuguggggaaacucuauccauccugccuugaagagucuccauggaaaccaccaacuuaucuuuuuucaacggaugggacagaagaguuugaacuggauggagaaaugguugcacuaccaccuguauaguggggaaguucagggagugcacgccugaguuaugugcuuugucauuuucuuugcuaaacaaaagaggcuaugaaagaacuaaauaugaguacauaaaauucuaucuuugauaaauuuuauuuuuaugcccuacuuaauauuugcaucaguauaauauauaucagugagucuuacagaaagauaugcuuccauaauaugaaauagauuauucaauaauugagaaacuuuauguguaaucaugagaguauaagaaucuggauuaucuaacauuguuagcccuguguauguacaguucaaaaaguucauuuauaaaaguaguuuccuguuccuagugugauguaucacaaauugugcugagguuauuuuaguauguguguuucauucccgugcuucuguucugaaguccuggaauacaguuuucaguguaauuaauucaacugcacuuaacacuaauguccguguugguauagaaaugucuaaauccuauacucuaguugaggaagaucuuccauaauuuuaugguauuacacagggaaagcuaugacugcaggaucagucuaacuauacuauuaggugcauguauucucuuuucacuaacuuauacuugucuaucuagaauacaggucuuccagucagcuggucauuuaccagguguggacuuaaguugcuaggcuugcaguaagaauugccagccacucauugugcgggucugcguggagcuuuaaucagaaaaagccuccacuuucuguauuauguuaacauuggcucaugcauauaacuaucugcugcugauguaguucuccaucuucaagauuuagaguggguuaaccaggucauuacaucuuaauuuaauaacaagcauuacuguagagugauuguguauagaucuguuagcugucaggguguguuuuuuuuaaccuguugugugcguguggggguuaggauuaguaaggugaacuguucaggaauucucugcacuagcugugcagaagagcagauaacuagcgcugcucuggcauuaaucccaggaaccacuagcaguaguggggcgccgccaaucuaacaugagcacaggugcuucaugacaaacauuacuagcauguucaacugcaccauguucuggcacuguauuuugaaugacauuaauuuauuaaauaaauuguauauauucaaua

SEQ ID NO: 446 - RNA, 4896 nt, Homo Sapiens
cugucaggugacucucccguggcgccauggcggaagcagaggagcagaggaaacugggucccuugaagaaucuacagaugagucugaggaagaagagagcgaagaggaacccaagcugaaguaugaaaggcuuuccaaugggguaacugaaauacuucagaaggaugcagcuagcugcaugacaguccaugacaaguuuuuggcauugggcacacauuauggcaagguuuauuuacuugauguccaggggaacaucacucagaaguuugauguaaguccugugaagauaaaucagauuagcuuggaugaaaguggagagcacauggguguguguucagaggauggcaaggugcagguauuuggacuguauucuggagaagaauuucacgagacuuuugacugucccauuaaaauuauugcugugcacccacauuucgugagauccaguugcaagcaguuugugaccggagggaagaagcugcuacuguuugaacggucuuggaugaacagauggaagucugcuguucugcaugaaggggaagggaacauaaggagugugaaguggagaggccaucugauugcuugggccaauaauaugggugugaagauuuuugacaucaucucaaagcaaagaaucaccaaugugccccgggaugauauaagucuucgcccagacauguaucccugcagccucugcuggaaggacaaugugacacugauuauuggcugggggacuucugucaaggugugcucagugaaggaacggcaugccagugaaaugagggauuugccaagucgauauguugaaauagugucucaguuugaaacugaauucuacaucaguggacuugcaccucucugugaucagcuuguuguacuuucguauguaaaggagauuucagaaaaaacggaaagagaauacugugccaggccuagacuggacaucauccagccacuuucugagacuugugaagagaucucuucugaugcuuugacagucagaggcuuucaggagaaugaauguagagauuaucauuuagaauacucugaaggggaaucacuuuuuuacaucgugaguccgagagauguuguaguggccaaggaacgagaccaagaugaucacauugacuggcuccuugaaaagaagaaauaugaagaagcauugauggcagcugaaauuagccaaaaaaauauuaaaagacauaagauucuggauauuggcuuggcauauauaaaucaccugguggagagaggagacuaugacauagcagcacgcaaaugccagaaaauucuugggaaaaaugcagcacucugggaauaugaaguuuauaaauuuaaagaaauuggacagcuuaaggcuauuaguccuuauuugccaagaggugauccaguucugaaaccacucaucuaugaaaugaucuuacaugaauuuuuggagagugauuaugaggguuuugccacauugauccgagaauggccuggagaucuguauaauaauucagucauaguucaagcaguucgggaucauuugaagaaagauagucagaacaagacuuuacuuaaaacccuggcagaauuguacaccuaugacaagaacuauggcaaugcucuggaaauauacuuaacauuaagacauaaagacguuuuucaguugauccacaagcauaaucuuuucaguucuaucaaggauaaaauuguuuuauuaauggauuuugauucagagaaagcuguugacaugcuuuuggacaaugaagauaaaauuucaauuaaaaagguaguggaagaauuggaagacagaccagagcuacagcauguguauuugcauaagcuuuucaagagagaccaccauaaggggcagcguuaccaugaaaaacagaucagucuuuaugcugaauaugaucgaccaaacuuacuucccuuucuccgagacaguacccauugcccacuugaaaaggcucuugagaucugucaacagagaaacuuuguagaagagacaguuuaucuucugagccgaauggguaauagccgaagugcccugaagaugauuauggaggaauuacaugauguugauaaagcaaucgaauuugccaaggagcaagaugauggagagcugugggaagauuugauuuuauauuccauugacaaaccaccauuuauuacuggcuuguuaaacaacauuggcacacauguugacccaauucuacugauucaccguauuaaggaaggaauggagauccccaauuugagagauuccuugguuaaaauucugcaagacuacaauuugcaaauucugcuucgugaaggcugcaagaagauucucguagcugacucuuuguccuuacugaagaaaaugcaccgaacucaaaugaaagguguucuuguugaugaggagaacaucugugagucgugccuuuccccuauucuuccaucagaugcagcuaagcccuucagcgugguggucuuccauugccggcacauguuccacaaggagugccugcccaugcccagcaugaacucugcugcacaguucugcaacaucugcagugcuaagaaccguggaccaggaagugcaauuuuggagaugaaaaaauagcucauuucuccuugucagucuccuugucaccacucuuuuugagacuguuuuugcaacaacaaaagcauuuguugacacucgugcuguuaagagauuuguuuauguuuauauuauacucaaaaacaauuucuucaucuauuccuguacuaaugguuucucuuugcaguucacagagaauuuggggcucucuucaugccuugaaauuuugggguccauagugaauauuuuguuauuuauuuguuuggcucauucuuuauauaguaauggaaacauaagucuaggaguuagaaaugaauuuuuuagaccuuaguaaaaccauuuaaccauaaaauggacaacugagaauucucccagcugccugaaagcgucgccaacugugguuauccugcaagcugcuaccugcaacuuggacguuguuuccacgugcucugcuggcuacgauucuugcauucuggguuuggcuuuuuucugugucaucaacuaugguuauccucuaaauaggcauuuaaugaaacauuguacaaauugucacucauuugaugacaccugggaauaacauuagcaggcugauguccugcaccauuauguuuacuaaucacauguucugugugcugugacgacugucaaagaguaucuggccauggcggacacucagcauuuguugauugaauaaauguuagcucuucucauugugaaggacucacuuuuacugggauaaacaaaugcaguuaagaauucuggcacccuuguaaggaagaaaagagaguucaacaccuucgagucugagcgcuuguggcuagaguuugccaggagggaggaaaccagugacccugaaaacugagggugccucaggagcagugggaccaccugaugcugaaggacggacuaaugauguuuccucuugccuucucuggugccuccauugcccucauggaacagagcauaucauagagggagaaaagucaaacuuguaauugugucuuacaguuacuggcuucaucuuccuugggauauauggucauccucuaaugaguguaaaagugcgcaaaacacauccuuauuguuccugaucucuuagucccauaaaugggaacaaauacagcuuucugcuucuuucuuuuuggggaaaggacagggugcuagugaguacugacagcaugccagcuaccgaagucacccagccauucccaugagcagcaguucauuuaauugucacagcgucgccaggaagaagaucugauaaaccuagguuuacagauaaagaaagcaaaauguagagauguuguugaggucacagaggugacugccuaacuucagagcagggcuucugaucccuuuaagaaauuacagggccagccgggcaugguggcucacgcccguaaucccagggcuuugggaggccuuggcagguggaucaccugagaucgcacguucgagaccagccugaccaacauggagaaaccccaucucuacuaaaaacacaaauuagccaggcguggugguacaugccuguaaucccagcuacucaggaggcugaggcaggagaaucacuugaccccaggagacguagguuguggugagcugagaucgcgccauugcacuccagccugggcaacaagagcaaaacuccgucucaaaaaagaaaagaaaagaaaagaaaucauagggccaaguucaaaggaaaugcacagaacauaucuucacauuagaguuaagaauucucuagcaaacaacagauuuuuuuguuguuguuagucacaaauacuuagaacuggaaggcucuuuguuauuauugaauguaccccucagccuucucagcauuuccuuaucccaagacuagugugcuuucugcuacacugcuaguuuucaguuuuguucuuacccaauuguuuuuucuuuucaacauuaccaauuuacagauucaguuuauuacauuuacauuaauccucacuuaugauuugagcaagcucauuuccagaaaaguuuacuuuaagaucaucaauaggauuugcuaauuucagugaagucauuuugcuucagggguaaauuauccuaguuaccaaguccuauuuggacauaaagaaaauccuacuuauagaaaaggagaaaauaauuaaacagucuucauuuuuaaguaacugauuuaaaaggaaaauaauaaaauauguucguuuaucauuucagaaauugcuguaacacacuggaaaauuccugaacaauauagauuuuaucguuaauaaaaaacacuagcuuucguuccuuagaaugucuuuucuuuugaauaaacaguauugggugauuua

SEQ ID NO: 447 - RNA, 121 nt, Homo Sapiens
uauggccauaccacccugaaugcgccugaucuugccugaucucagaagggaagcaggguugggccugguuaguaguuggaugggagaaaaaacuuuuuguagagacacggucucauuaugu

SEQ ID NO: 448 - RNA, 858 nt, Homo Sapiens
gcagcaaggccgagacccagcagccacccgccgcccccgccuuuccccccaccgccccccucccguccccccgccgcccccgcccucagcgccgccgacaccaagcccggcacuacgggcagcugcgcagggagcggugguccgggcggccucacaucggcggcgccugccagcguggacaagaaggucaucgcagugaagguuuugggaacaguaaaaugguucaauguaaggaacggauaugguuucaucaacaggaaugacaccaaggaagauguauuuguacaccagacugccauaaagaauaaccccaggaaguaccuucgcaguguaggagaugaagagacuguggaguuugauguuguugaaggagaagagggugcggaggcagcaaauguuacagauccuggugguguucgaguucaaggcgguaaauaugcagcagaucguaaccauuauagacgcuauccacgucauagggguccuccacgcaauuaccagcaaaauuaccagaacagugagaguggggaaaagaccgagggaucggagaaugcucccgaaggccaggcccaacaaugccggcccuaccgcaggcaaagguucccaccuuacuacaugcggagacccuaugggugucgaccacaguauuccagcccuccugugcagggagaagugauggagggugcugacaaccagggugcaggagaacaagguagaccaccaccucaacgucgguaccgcagcaacuucaauuaccaacgcagaugcccagaaaacccuaaaucacaagauggcaaagagacaaaaucagccaauccaccagcugagaauucgucugcucccgaggcugagcagggc

SEQ ID NO: 449 - RNA, 64 nt, Homo Sapiens
augacugauuucuuuugguguucagagucaauauaauuuucuagcaccaucugaaaucgguuau

SEQ ID NO: 450 - RNA, 3311 nt, Homo Sapiens
aggggugagcuggcggcgggggaggcgggcagcggagccaagcugacccggcgagcggagccggggcuggagagcggcgaccacugcggaucucggaaggaagaaaugauguaaaucacucauccaaaccuuaaggucaaaggugagaaggaaggucaggaagaacauggccuggccaaauguuuuucaaagagggucucugcugucccaguucagccaucaucauguuguaguguuccugcucacuuucuucaguuauucguugcuccaugcuucacgaaaaacauuuagcaaugucaaagucaguaucucugagcaguggaccccaagugcuuuuaacacgucaguugagcugccuguggagaucuggagcagcaaccauuuguuccccagugcagagaaagcgacucuuuuccucggcacacuggauaccauuuuccucuucuccuaugcugugggccuauucaucaguggcaucguuggggaucgguugaauuugcgauggguucugucuuuuggcaugugcucuucugcauuagugguguuugucuuuggugcgcucacagaauggcugcguuucuacaacaaauggcuguacugcugccuguggauugugaacggccugcugcaguccacugguuggcccugugugguugcuguuaugggcaacugguuugggaaagccggacgaggaguuguuuuuggucucuggagugccugugcuucggugggcaacauuuugggagcgugccuagcuucuucuguucuucaguaugguuaugaguaugccuuucuggugacggcgucugugcaguuugcuggugggaucguuaucuucuuuggacuccuggugucaccagaagaaauuggucucucggguauugaggcagaagaaaacuuugaagaagacucacacaggccauuaauuaaugguggugaaaaugaagacgaauaugagccgaauuauucaauccaagaugauaguucuguugcccaagucaaggcgauaagcuucuaccaggcauguugccuuccuggagucauaccguacucacuggccuacgccugcuugaaguuagugaauuacuccuucuucuucuggcuccccuuuuaucugaguaacaacuucggcuggaaggaggcggaagccgacaagcuguccauuugguacgacguuggagggaucauagguggaacuuugcaaggcuucaucucugauguacuacagaagagagcgccgguucuugcccugagucugcuucuggcaguugggucccucaucggguauagucguucuccaaaugauaaguccaucaaugcccuucugaugacuguuacaggauuuuuuauugguggaccuucuaauaugauuaguucugcuauuucugcggacuugggucgccaggagcucauccaaaggagcagugaagcuuuggccacugucacaggaauuguggaugguucggggagcauuggagcugcagugggccaguauuuagugucucugauccgggacaagcuaggauggauguggguuuucuacuuuuucauucucaugacaaguuguacaauuguguuuaucucgccauuaauagugagggaaauauucucucucgugcuaaggagacaggcucacauauugagggagugaccggugcccgcgagacagaaagaacaaugucagccacaucaggaccgcuggggcuucgagucugcccuaauuuggguuugucuaggagcuccagccugaucuuggauugucaggcgucucucaacacugccagccaccugagaugcugaccagcagugaaggcugcacuaguuuucuacacuacaggaauuacuguugaugauuuuugcuguuguuucaugaaugugccgagugacuucugacucugccagcaucuuugaccucugacucugcccgcgucuuuguuuggccuauugagguuuagcguuuuaaccuuaacuguuguuuuggacuugaacuuucucuagccuugaaaauggagugaacaggaggcaaagccacgcgugguuuguguuggugguauguuccacaaauggaagagaucauugcauuuugcuuugguaaugaguuuacagagagugggucaucuuugaagcaucaaauccugaucaaaugcucaagcuggaccgagcugcaagccugccuuggacaaagaaucccucuguucacuguggugggaaagaucacacuacaugccuguugauuggcucagucacucugugucugaucuaaacgucauucagcccuagaagcaugaauugcuucaaauuauugucaacuuguucucuuccauuuucauucaaauuaacuuugacuccuggaaguauugagucuuccuuucaaggaccauaagguacaucaguuaucuugaacauucugacguguaaaggaccauaagguacaucauuuaucuugaacauuccgacguguaacucacagccgaagcacuccaucccagauuuguugucugggaacuuaggauccucuaggaagcuaaucugcuuagucuauuuuuagaggauugaucucuggcacaagcagcuuccuggaguuaccucagcagaagacuagaauuagagaaaagggaaagaccuuuucuucuaguaagugucaaguacagaugcucuuugacuuaugaugggguuaugucccaguaaacccauuggaagucaaaugcauuuaauaccccugacuggacaccacagcuuagccucguccacccuaaauguacucagaacacuuagaauugcccacaguugggcagaaucaucuaacacaaacucuauuuuauaaucgaguguugaauauaucauguaauuuauugaauauuguacauuauguugaaauugcaaccauuucacaccauuguaaaguccaaaaaucagaagcugaggacugucuguacaugacauugaaucacaugaauggauuacuagggccugagggguguccguucuuuagaaaaauguagaguauauauaucuucagggcugugaauuccauacuaguuaucaauauuuuaagaucauucuguauauacauauuuuaaauuaugcaagcaaacuaggaggagaaugugcaauuuugagggauaccuaauuugcauucgguuaggggauauuuuucaaccucuugcuuuauacucugauaugggguguguuuaugaacuuguuaauguuauuuaaucaugcagauuuccaaucaguguauugcucauuuacugacaaaaagggaaaauacgaaacacagaaagggaaaauaaacugacuuuuauaaugaa

SEQ ID NO: 451 - RNA, 3037 nt, Homo Sapiens
aaggcuccucagccgagcgccgagcggucgaucgccguagcucccgcagccugcgaucuccagucuguggcuccuaccagccauuguaggccaauaauccguuauggagcaugccuuuaccccguuggagccccugcuuuccacugggaauuugaaguacugccuuguaauucuuaaucagccuuuggacaacuauuuucgucaucuuuggaacaaagggcaguuaacugccaccaaguggugguuguaugccauagcucuguaacaugaacaguguuuccaauaaacuguccaccgcaaaacccguuaaaaaaugagugagcuccaugagcugaggagcuagcagauugccgggauuacaaagacaacgagacaggacccuuuccuuagcaggauuuacaaucucucuuuuaagagccugugccgauggaggugccaaccgcuuauaugauaucaccgaaggagagagagaaagauuccucugacaguauccuccaagaccugacauggacaaugugugaaaaagcgcucaaccuccaacuugaaacucuccucgaggcccccagccaccagucaucucaucaggacaccgaaagacacccauuacuguggagcuuccaagggucuuggcaacucuuuuaucggaaacgagagcuuuuugccugaauucaucaauggagacuuugauucuauuaggccugaagucagagaauacuaugcuacuaagggaugugagcucauuucaacuccugaucaagaccacacugacuuuacuaagugccuuaaaaugcuccaaaagaagauagaagaaaaagacuuaaagaagaaacagugaaaggaauacuguucaauuccaacaucagcuguguaaccgaggcaucguaauacuuuuaugacaaguuucacuaccuuuuugccugugccaguguaccucaaagggauaugguugaugugaucgugacacugggaggccuugcugggcguuuugaccagauuauggcaucugugaauaccuuguuccaagcgacucacaucacuccuuuuccaauuauaauaauccaagaggaaucgcugaucuaccugcuccaaccaggaaagcacagguugcauguagacacuggaauggagggugauugguguggccuuauuccuguuggacagccuuguaugcagguuacaaccacaggccucaaguggaaccucagaacuugugacuacacuaggaccaccuggauagccaaggauaaucccgucccaagacuaaucagauuaaucagacuuaaucacaucuguaaaguuccucuugccauguaacaaaugaugugcuugcuuuuggaacauuggucaguacuuccaauaccuacgacgggucugguguugugacuguggaaacugaccacccacuccucuggaccauggccaucaaaagcuaaccuguugacuggcauccauaagugugccucugccuuaucucauuucucaacaguucauugcucaacaagaacgauucaccuggguuugcaagaaucuaaaccucucuaggggaagcccacuggguuuaaagauguuaguguuuagauaauacagguaacauuauaaaugacagaucucaauuuuauaguagugggaaagauacaugcuaagaaagcaaauaagcucuauuauauucgguuggaaccuaaugggaaucauuccacuauacaauucaguacugauuauucuucuuacauuauuaaucauuccauuuauccuagaaaauuguuuuuaauuugaaucagagaaaacuguugagguuccucuuggagucuagaacauccuuaaaugucuaacaacaagggcuaccucugaguaccuuuuaguauuaguuuucuguauaugauauauauuaucuuauacugaaaaaaaauuccuuucagauugggguguuagaagugcaccaggucacucugaccuuauuacugucuuugguauugucuuaaauaaaucaagaaucauugaccuaauuguuaaauuuaaaaauagguaguuagcaauagguggaaagagaaaugaugugaaagauaaaugaugauucguggagcccuacucacacauuaacccccaaauucaaaaguaagaaugcaaaagucuagaggggguaacagucugcaucaucaucacaaccuaaauggagaaagcugugcagaggaaacuuaagcauaaaaauugaauucguuucugacauaccuuagacugaaaaacuguugguucauccagaaguguauucauauuaccagaaaaugaguuugucuauggggauacaugaacuucauauacuaaggagccuaacuccaaagccugcguucucaucccagucugauauucaccuaaguuuccggacccuuuuccuuagcuguaaaauggaagcgguuggacugauggugucugagguucuuucccacacugaaauucuaaauauugacacuuagcagucauagggcugauaauacacacaguuacugacuuagccuaaacaaccuggugcaucgaaauguauucaccuuucuuuuguaaagagaccaucuucuaucuucuuuccaccuuucucuguuuuaugaaaccaacuguugacauacaaaccaugauugaaggagaaccuguccaacauguuuuauguacacaaaucccuauguugcuauaagaaaagugaaaguaacuguuuucuucuuggugcuaugacagugugagacucagguugucuguagagaaugaaaggagcaguggcccgcgugauuguggcauuuaaggagcaguggcccaugugacuguggcauuuucggcacuuuucauuacuuucugcuugaccggaaguugaggcuuagcuauguuuccaucuucaguuucugaagacuaguuauauauuccuuacuagaaauauauucauaauauauaaaagaaauauaucugugauuuuaaaauuuugcuaccaaagaaugcauguucugugugcccugaaaauguuaccaguguuaauaaauggauacuuaucaaaaaagaa

SEQ ID NO: 452 - RNA, 4105 nt, Homo Sapiens
cggcaggguuggaaaaugauggaagaggcggagguggaggcgaccgagugcugagaggaaccugcggaaucggccgagauggggucuggcgcgcgcuuucccucggggacccuucguguccggugguugcuguugcuuggccuggugggcccaguccucggugcggcgcggccaggcuuucaacagaccucacaucuuucuucuuaugaaauuauaacuccuuggagauuaacuagagaaagaagagaagccccuaggcccuauucaaaacaaguaucuuauguuauucaggcugaaggaaaagagcauauuauucacuuggaaaggaacaaagaccuuuugccugaagauuuugugguuuauacuuacaacaaggaagggacuuuaaucacugaccaucccaauauacagaaucauugucauuaucggggcuauguggagggaguucauaauucauccauugcucuuagcgacuguuuuggacucagaggauugcugcauuuagagaaugcgaguuaugggauugaaccccugcagaacagcucucauuuugagcacaucauuuaucgaauggaugaugucuacaaagagccucugaaauguggaguuuccaacaaggauauagagaaagaaacugcaaaggaugaagaggaagagccucccagcaugacucagcuacuucgaagaagaagagcugucuugccacagacccgguauguggagcuguucauugucguagacaaggaaagguaugacaugaugggaagaaaucagacugcugugagagaagagaugauucuccuggcaaacuacuuggauaguauguauauuauguuaaauauucgaauugugcuaguuggacuggagauuuggaccaauggaaaccugaucaacauaguugggggugcuggugaugugcuggggaacuucgugcaguggcgggaaaaguuucuuaucacacgucggagacaugacagugcacagcuaguucuaaagaaagguuuugguggaacugcaggaauggcauuugugggaacaguguguucaaggagccacgcaggcgggauuaauguguuuggacaaaucacuguggagacauuugcuuccauuguugcucaugaauugggucauaaucuuggaaugaaucacgaugaugggagagauuguuccuguggagcaaagagcugcaucaugaauucaggagcaucggguuccagaaacuuuagcaguugcagugcagaggacuuugagaaguuaacuuuaaauaaaggaggaaacugccuucuuaauauuccaaagccugaugaagccuauagugcucccuccugugguaauaaguugguggacgcuggggaagagugugacugugguacuccaaaggaaugugaauuggacccuugcugcgaaggaaguaccuguaagcuuaaaucauuugcugagugugcauauggugacuguuguaaagacugucgguuccuuccaggagguacuuuaugccgaggaaaaaccagugagugugauguuccagaguacugcaaugguucuucucaguucugucagccagauguuuuuauucagaauggauauccuugccagaauaacaaagccuauugcuacaacggcaugugccaguauuaugaugcucaaugucaagucaucuuuggcucaaaagccaaggcugcccccaaagauuguuucauugaagugaauucuaaaggugacagauuuggcaauugugguuucucuggcaaugaauacaagaagugugccacugggaaugcuuuguguggaaagcuucagugugagaauguacaagagauaccuguauuuggaauugugccugcuauuauucaaacgccuagucgaggcaccaaauguugggguguggauuuccagcuaggaucagauguuccagauccugggaugguuaacgaaggcacaaaauguggugcuggaaagaucuguagaaacuuccaguguguagaugcuucuguucugaauuaugacugugauguucagaaaaagugucauggacaugggguauguaauagcaauaagaauugucacugugaaaauggcugggcucccccaaauugugagacuaaaggauacggaggaaguguggacaguggaccuacauacaauggcaaaaaaaugaauacugcauugagggacggacuucuggucuucuucuuccuaauuguuccccuuauugucugugcuauuuuuaucuucaucaagagggaucaacuguggagaagcuacuucagaaagaagagaucacaaacauaugagucagauggcaaaaaucaagcaaacccuucuagacagccggggaguguuccucgacauguuucuccagugacaccucccagagaaguuccuauauaugcaaacagauuugcaguaccaaccuaugcagccaagcaaccucagcaguucccaucaaggccaccuccaccacaaccgaaaguaucaucucagggaaacuuaauuccugcccguccugcuccugcaccuccuuuauauaguucccucacuugauuuuuuuaaccuucuuuuugcaaaugucuucagggaacugagcuaauacuuuuuuuuuuucuugauguuuucuugaaaagccuuucuguugcaacuaugaaugaaaacaaaacaccacaaaacagacuucacuaacacagaaaaacagaaacugagugugagaguugugaaauacaaggaaaugcaguaaagccagggaauuuacaauaacauuuccguuuccaucauugaauaagucuuauucagucaucggugagguuaaugcacuaaucauggauuuuuugaacauguuauugcagugauucucaaauuaacuguauugguguaagaguuuugucauuaaguguuuaaguguuauucugaauuuucuaccuuaguuaucauuaauguaguuccucauugaacaugugauaaucuaauaccugugaaaacugacuaaucagcugccaauaauaucuaauauuuuucaucaugcacgaauuaauaaucaucauacucuagaaucuugucugucacucacuacaugaauaagcaaauauugucuucaaaagaaugcacaagaaccacaauuaagaugucauauuauuuugaaaguacaaaauauacuaaaagaguguguguguauucacgcaguuacucgcuuccauuuuuaugaccuuucaacuauagguaauaacucuuagagaaauuaauuuaauauuagaauuucuauuaugaaucaugugaaagcaugacauucguucacaauagcacuauuuuaaauaaauuauaagcuuuaagguacgaaguauuuaauagaucuaaucaaauauguugauucauggcuauaauaaagcaggagcaauuauaaaaucuucaaucaauugaacuuuuacaaaaccacuugagaauuucaugagcacuuuaaaaucugaacuuucaaagcuugcuauuaaaucauuuagaauguuuacauuuacuaaggugugcugggucauguaaaauauuagacacuaauauuuucauagaaauuaggcuggagaaagaaggaagaaaugguuuucuuaaauaccuacaaaaaaguuacugugguaucuaugaguuaucaucuuagcuguguuaaaaaugaauuuuuacuauggcagauaugguauggaucguaaaauuuuaagcacuaaaaauuuuuucauaaccuuucauaauaaaguuuaauaauagguuuauuaacugaauuucauuaguuuuuuaaaaguguuuuugguuuguguauauauacauauacaaauacaacauuuacaauaaauaaaauacuugaaauucucuuuugugucuccuaguagcuuccuacucaacuauuuauaaucucauuaauuaaaaaguuauaauuuuagauaaaaauucuagucaaauuuuuacagauauuaucucacuaauuuucagacuuuugccaaagugugcacaauggcuuuuuguuaauaaagaacagauuaguuuugaagaaggcaaaaauuucaguuuucugaagacagcauguuauuuuaacaaucaaguauacauauuaaaaauugugagcaaucucaaa

SEQ ID NO: 453 - RNA, 100 nt, Homo Sapiens
ggcuggucugagugcagugauguuuacaacuaauuggucacauucaguuacagauuuauuuguuccuucuccauucccacugcuucacuugacuagccuu

SEQ ID NO: 454 - RNA, 3545 nt, Homo Sapiens
aggagcagugggcgcugagagcagcaaggccagggagggcuaucuucaggcucaugcaggaggggaagauugggccuggucuugaaagauggagaguugaaaacuuacagaguccugaggcuuucagacugaaaaaggcuuucuucugucacugacaaucgccaccaugauccauagucuuuucuugaucaacuccucuggagacauuuuccuggagaaacauuggaaaaguguggucagccguucuguuugugauuacuuuuuugaggcgcaagagagagcuacugaggcagaaaaugugccuccgguuaucccuaccccucaccacuaucucuuaaguguuuaccgccacaagaucuuuuuuguggccgugauccagacggagguccccccucuguuugucauugaguuucuucaccgagugguggacacauuucaggauuauuuuggagucuguucagagccagugaucaaagacaauguaguugugguuuaugagguauuggaagagaugcuugacaaugguuuuccauuggcuaccgagucgaacauucuuaaagaacucauaaagccuccuaccauccuucgaacgguugucaacaccaucacaggaagcacgaaugugggugaccagcuucccacugggcagcugucaguggugccuuggcgacggacuggggugaaauauaccaacaaugaggccuauuuugaugugauugaagagauugaugcaauuauugauaaaucaggcuccacaauuacugcugagauccagggggugauugaugccugugucaagcugacuggcaugccagaccuuacacuuuccuucaugaacccuagguuguuggaugaugucagcuuccauccuuguguucguuucaaacgcugggaaucugagcgcauccucuccuucaucccuccugauggaaacuuccgccugcugucuuaccaugucagugcacagaaucugguugcaaucccaguguaugucaaacauaacaucaguuuccgggacaguaguucccuuggacgcuuugaaauaacggugggacccaagcagacgauggggaagaccauugagggagugacugucaccagccagaugcccaaggggguccugaacaugagccuuacuccaucacaggggacacacacauucgacccagucacaaagaugcugucuugggauguaggaaaaauaaauccacaaaagcuaccaaguuugaaggggaccaugagucuucaggcuggagcuuccaaaccagaugaaaaccccacaauuaaccugcaguuuaagauccagcagcuggccauuucuggacucaaggugaaucgucuggauauguauggagaaaaguacaaacccuuuaagggcauaaaauacaugaccaaagcugggaaguuccaaguucgaaccugaagggagcauuugcugagggaauagucuugcacauuuuuucauuucuuacuugucuaaaaguaaaaaaaaauaucagccugucuccuaggucaguccccuccuggacccacccgcucccuuuuuuccuuagccuucagugccauggaacuaaucaagggaggaaaaggucaccagggagaacuggacagaacugaaacacagcaacaccaguucucaaggacaaggugugugauggggguaggaagcuuggugcuuauguaaccauuuuaaacgugguuucuauaggaaagaccaacauuuguuuagcuugcuuggcuuuaauuaucuaaagccaaugaaagacuucuuuguugauuuuuuaagauagaaagauuaaaaagaaagaaagaugggaagaaaaugaaugucagucaaggaaaggccacuuaaggaucugcucuaugaaggagaagaaagaggaaaaagaaguaaaggaguuaggaggagacacuuaaaugaaagauuggcaagaaaagcagucggacucuaccuuaaggagggaugggaaggaaagaguugaguugguuucuuucugauuccucuacucauguagaaaacacuuguacuucuggaaauggacuggagacuuuuuaaauuugaguccacuauugacauggaaaccccaguggaaucagauuuucccucaaagaccaugaugguaucggacuaguuuucagacacugccuguugcuguccaucagcacuuggucucuuaucuucagugagaaggugacccgccuucuucccaugguggcugccuaaagugcuucuuuucuaacccaaaacaguucuacucacuuccuuuuacagaauucaccggccauuuuccuguuaccugauccuucuacaggauuuuuaaaaaguaagagaguuucagagaagccgaucccauaauccccagugcagccaggguuugugugucaucguacuggaguagagggccgacucuucccaugaaggugagcacagcugugagugagugagcucauaucuccauuugucagugcuggacugguaccagaucguaaccuucccguuggucggaaacuuuuccaucugucgcccuagaaaaagagaaagcuuaccaucgagggugugguugauccuugaagcugcuugguaaaguuaucauuuccucagucuuuucuuuuguacuccuaucauguauucauuaauaucuaccagucccuuuucauucuaagacaaaacauuucuccuaaaucucugaauaaaaucagugcuguaggaagauggacuguguugaucauggguguaagcaacccaguuuaagaaacauggcaacuaaagggauaccucaggcuuucuuucccagugggucauuuuuguccuaguucagugugucuguuacuauuuaaauauuuauacaaaaggguuuuuguuuauagcuuaaggaaugauacugugcucugcuuggugcauggagaaaaaggaagacccguacucuccacacccuagagcuuuucucuaaauauugugcaaaguuuuugcuaguuuuaucuucugacuuugggacuaguuuuugcugcagaguuguguugcuuugugauuuuccucugggauaguguacuguacacaaccagauguguuccacacuccgugacuccgcaguuuguccuggagugacauacacauccaccauggaaagggaagcaucucugccuguggauucucaaguacuuggaagcaccucuccugaggaaccuacaggauucuaagguuuccuaggucacugaacaacuaaucuuggucccugaauauuucuagguuuguaagugcagcaguuuuauuuccucuagaacucauccuguuucaagggaaguaccuaagaagauauagaguguuucuaggguaagggaccugcagguguaagcauagaugaaauaacuguccugucacaugugcagcaggccauggaguguagcgggcaucgcugccgccauuccugcagcaucaccauaagcagugcagggugucuccaucgagcuguuugguuccauguguguuuaacaugugcagaaguagcuucucuguuuaaguuuaauaaaguugaguuucaccaguc

SEQ ID NO: 455 - RNA, 1984 nt, Homo Sapiens
gguucggguagcggggacgcgcacgcaccuugcgcgucuucgccccuccugcgguugccaggcaaccggccccggaaguugcggcaggugcguccgcagcgggcgccgcuagccagcggaagauggcggagggcggaggcccugagcccggcgagcaggagaggaggucuuccgggccgcggccuccgagcgcgcgggauuugcaguuggccuuggcagaauuguaugaagaugaagugaagugcaaaucuuccaagucuaauagaccuaaagccacagucuucaagagcccacggacaccaccucaacgguuuuacucaagugaacaugaauacaguggauuaaauauaguucgaccuucaacugggaaaauugugaaugaacuuuucaaagaggcaagggaacauggggcugucccucugaaugaagccacaagagcuucaggugaugauaaaucuaagucauuuacagguggaggauacagauuggguaguucuuuuuguaagcggucugaauauaucuauggagaaaaucagcugcaagauguucagauuuugcuuaaacuguggagcaaugguuucaguuuagaugauggagaauugagaccuuacaaugaaccaacaaaugcucaauuucuggagucuguuaagagaggagagauuccccuggagcuucagcgccuuguucaugguggccaagugaauuuggauauggaggaucaucaggaucaagaauacauaaaaccuagauugagguucaaggcuuuuaguggagaagggcaaaaacuuggaagccuuacaccugaaauagucaguacaccuuccucuccagaagaggaggauaaaucaauacuuaaugcaguuguucuuauugaugauucagugccaacaacaaaaauucaaaucagguuagcagaugggagucguuugauacaaagauucaauaguacacacaggauccuggauguccggaacuuuauuguacagucucguccugaauuugcggcucuugacuuuauucuugugacuucauuuccgaauaaagagcuaacagaugaaagccugacacugcuagaagcagauauucuuaacacuguguuacuccagcaacuaaaauaauauuguuccuguccaugcaguagcaugugggaauagaugaugugccguauuaauaaggacaauacuucagcauuaaaaacagccaaauuauuuuuauuauuuuuacagauaaauuuugguuuuauuguuauucugucuuccaaucugaauauagacaaauuuggauuaggaauagaccuugagauaaguauguuugaguuuuuaguugaaggacuggcuuauguugauaguuuuuggauuucuaggcaaaugaguuguuacaugcuuaguguuaauguaacaacauuuguuugcagagaaaaaugaacaaaaccccuuuuugauaaaugcauuugguaaaauuugcacuaaaguuucuugaugcagcauugaccaacagccauuaagaaaucuuuugaucaaauaaguugaaaauuugucuauaauauauacugaaacgugucuuuugauuuugaaauuguuugaucauacaauaauuauuucuccuauuaagauuuuacacauccuuuuuacuuacugauuuagauauauuacuaguaucagaaacuacaguuuugccuuguauuuuacagaauuaugacuguugugaacuuaaacagaaacacauaaaggucagcaauucuuuuuuuuuuuuuuuuugauauggaguuuugcucuuguugcccaggcuggagugcaauggcauaauuucugcucaccgcaaccuccgccucccagguucaaaagauucuccugccuuagccucccaaguagcugggauuacaggcaugcgccaccaugccuggcuaauuuuuguacuuuugcuagagacagcguuucucuguguugaucaggcuggucucgaacuccgaaccucaggugaucca

SEQ ID NO: 456 - RNA, 4200 nt, Homo Sapiens
uggggcgggccugaugagcaccuggauuuucacccggcgugcugguaauuccuacacuuguggguguuugagagacaugaagaggggaggaugaccucuucccggaagcgggacuuccauaaaagaagcguggugggcgggucccgggcaccugugguuuggugaguccuccagguaacugugaugcgggggucagcgggagaggcacccggaagcucccggcgucugcaccccggcagcgcgaggaaaugcccaaagaaacuauagugacacugaaacugaaggagagauuuuuaauuccuuagugcaauacuuuggugacaacuuggggcgaaaaguuaaagcgaugccauuaguugaagaaacuucuuuacuggaagauucgucagugacuuuuccugugguaauaauaggaaauggacccucaggaauaugccuuucuuauauguuaucaggcuacagaccguauuuaucaucagaagcaauacacccaaauacaaucuuaaauaguaaauuagaagaagcaagacaucuuuccauuguugaucaggacuuagaauacuugucugagggccuugagggccgaucauccaauccaguugcaguacuuuucgauacacuucuucauccagaugcugacuuuggguaugauuauccauccguuuugcauuggaaauuagagcaacaucauuauaucccucacguaguucuugguaaagguccaccugguggggcuuggcauaauauggaaggcuccauguugacaaucagcuuuggaaguuggauggaacuaccuggacuuaaauuuaaggacuggguaucaaguaaacgaaggagccuaaaaggggaucgaguuaugccagaggaaauagcucgcuacuauaaacauuauguaaaagucaugggucuucagaagaauuucagagagaauacuuacauaacuuccguaucaagacucuacagagaucaagaugaugaugauauucaagacagagauauuucaacaaagcauuuacagauagagaagucaaacuuuaucaagagaaacugggaaauuagggguuaucagcgaauagcugaugguucucauguucccuucugccucuuugcugagaauguagcgcuggcaacuggaacgcuggauucuccugcccaucuggaaauugaaggggaagauuuuccuuuuguguuucauucaaugccugaauuuggagcugcuauaaacaaaggaaaguugcguggcaaaguggauccaguguuaauuguagguucugggcuuacugccgcugacgcaguacugugugcuuacaacaguaauaucccugugauucauguguuucgcagacgaguaacugauccaagcuuaauuuucaaacagcuucccaaaaagcuguauccugaauaucauaaagucuaucauaugauguguacucagucauauucuguagacucaaaucuuuuaucugauuauaccagcuuucccgagcaccgugugcuuuccuuuaagucggacaugaaauguguucuccaaagcguuucuggauugaagaaaauauuuaagcugucugcagcaguaguauugauagguucucauccuaaucugucuuuucugaaggaucaaggguguuaccuaggccauaagucaagccagccaaucacauguaaggguaauccuguggaaauagauacauauaccuaugaguguauuaaagaagccaaccuuuuugcauuggguccuuugguuggagacaauuuuguucgauuuuuaaagggaggggcgcuggguguuacacgcuguuuagcuacaagacagaagaaaaagcauuuguuuguugaaagaggaggaggagaugggauagcuuaaagcaaguuuacaaguaauuaaaauggacaguuugccauuaaagauuuuuaauagugguuuugcaguguacuggcuugaauuuucuggacuugaguuaacugaaggagagccucaaacuauaguaacuucauuuuuaaaaguuacuagaauuugguauccugauuuauauugcaguguuucaaaggugucacugucagacaaauagaaacacugccaacuugguguaacuuaagcuuucauuuaacuaaaacauucuuuucuugcaaaacuuauuuuucaugaucauuuuugguuauuuauuauacuugauuccaaaauaguacagccuugaaucuauaaaacugugcagucauuaugccagaaauuaucuuaaauauauaaugggucaccuugcuguucaaaggguggugcaagguccugcagcaucuuacaucuguagcuuguuagaaauguaaacucucaggccccacaacuuacuuccugcauuuuaacaagauccccaagggauauguaugcucauaaaaauuugagacacugguuuaaaugaaaauggauauaagguauguauaacuggggguggggugaggguaggaggcauuuacaacucagauuuuauuuauuuugaaauuaucaauuguauaaaucuaauuuauuaccaaauagggucuuuuaaaaaauauuuuuaucguugaaaccuugacagguacuucauauucuucuaauaauuuaaacaguccaauaaugugguauacacuuugacauccaagaacucaccaagauguuuuucagagauuuauucucgauuuaacuaucauagcauuuaaugaaucugauuuguaguucaauaaauuguggguugaacuacuuaucccugugugaacauugaauuacuuucugucacugaaacugagguauuugggugugguaaguacuucgaaaauuguaauacuguuugggcauugucuaaauuauuaaagguuaaaauagaaaauaaagucagaauuuuucuuuuccauuccaaagguguacuuagagaucucuauuaguauucauucgagaugacauagcagcucauaucaugguuguuuauuggauuuaucuguucuaauuauauaaguguguuuacugucuguguuuucacacaaacugcuagaauuuuuaauguuaagacgaaaacaucugaaguucuccauggcaaauugaauuuuucagucauuuucuuuucuuuuuuugguacaauuacuucaucuggaaugucuucauugaacucguuauucuauuuuucuuagaauuaaaaguggauuaauguggguuuuucuguucauuuuauugcaguauuaaaugcuuaagcuuauuaggaccauaauucacuuuaaauauaauuguauagaauauauuugcgucgaucaaauaauugcuucagaugaauucuuagacucuugauaauaucacaccuaauuuaacuugauuuuacaagcuguacaauccaguuuuaguuuucuauugugauaauaacuuuuuucaaaccaguuucacaucuuaaugaaauaacauucucugacugcacuugcuucaguacucucuugccugccuguuuuugaccucugcaugaguuggauuagauguuuuucuuacugucacuucuaaauagaaaaugacaguguuauaaaaaagggaaggauaaaaccuuugacauccccuugugucucaaaaguccacaguuauucaaacaauggcuuuuuuugugaugagaguauuuguuaaaaaaaaaaaaagacuucaagaaaaauaaaaguucaguggagcugcaaauaaaucuggugaauaauuucaucuuugguaaucucccauuuccugaguucuuccucaauccaagcuguccuguguaguauauaacauuugggcauuuucucugauauacuauacucucauguucuauaaauuucugucccguaauucuaacacuuuacauuuuuucuuugcuaucagcuauagcuauucauggaagggaagaaucacuaaauacuugucuaguuauagcaugaugugagcaucuccuccuuaucccucgaugccuggcuuggugucuggcaaacaguccauaauuagcagauguugaaagaccguuuacaaagcagaauuuggggauuuaaagugcaaugauacaacaaaaagauuuaauuacagcuuccaguguuuugacuaugugaaccauauccaacuacuuuuuugaaaaucuaguucuauguaauauauuucuguggcaucaaauuuuaguugauuguauuagucaauaggaagugguggaaaauuucuaaauaaauucaacuauuaaa

SEQ ID NO: 457 - RNA, 2889 nt, Homo Sapiens
ccaggcagccguugucggguucgacuggaggggcgggggagucaccugcgagcggcugcgcuggcggccagcccgcccaccgcgucuggaucgcgccggcugcgcggggcugcggacagcacacacccuggaaggccccggcggggaacgggcagaguccgcgcccugcguccgcgaccaggaggaucggaccuucgccuucgcugucgccgccgccgccgcccgcggccgucggggcuauuagugaaagaugguggaucgcuuggcaaacagugaagcaaauacuagacguauaaguauaguggaaaacuguuuuggagcagcuggucaaccuuuaacuauaccuggacgaguucuuauuggagaaggaguauugacuaaguugugcaggaaaaagcccaaagcaaggcaguuuuucuuguuuaaugauauucuuguauauggcaauauugucauccagaagaaaaaauauaacaaacaacauauuauuccccuggaaaaugucacuauugauuccaucaaagaugagggagacuuaaggaauggauggcuaaucaagacaccaacuaaaucuuuugcaguuuaugcugccacugcuacggagaaaucagaauggaugaaucauauaaauaaauguguuacugauuuacucuccaaaagugggaagacacccaguaaugaacaugcugcugucuggguuccugacucugaggcaacuguauguaugcguugucagaaagcaaaauucacaccuguuaaucgucgccaccauugccgcaaaugugguuuuguugucugugggcccugcucugaaaagagauuucuucuucccagccaguccucuaagccugugcggauuugugacuucugcuaugaccugcuuucugcuggggacauggccacaugccagccugcuagaucagacucuuacagccagucauugaagucuccuuuaaaugauaugucugaugaugaugacgaugaugauagcagugacuaaggacacauuugggaguauuuaaucagguguggcuaucugagaaaucaacuuugggggaaauguaagauucugagcucucucucuguuuuguucuagccaugaauuugccugagaaacuuguaaccuaugugccucaauauauuccauagaaaguaggucccccugccuucucccacuccucacacucuucuacagggauaggcuuuugcaaauauaucagauaaauuuuuuguuucuuguuuauuuuuagguuauuuucuuggaagguugggaaaagauguuuguuuuaacaggucauguacuacguuguuguuuucauuucuguuauaaguaaaacuaaaagcacagaauggugggaaaggggcuauaaugugguucauuaauaauguuagcagcuuuuuucuaaccauccugucuaaugguuaagacaccaguaacaaaaacacaugauuuggaaauacuuuggcuuuuucauauaccuaguggugccuuaucauaauagcacuguuacaugaaauaagccccuaccuucuuacuuucugguuuguugaaaaaauacacuggugcucuuugaagugauaaaaugaguguuuaugaauggguguaauuaggaaauacuucucaucugacagcuacaaauaacuaaguuuggagguauuuucacucuauaugaauaaauauuuuuccauaaaauaguugugauuauauuuuuguuuuauauaggucccaaauuauaauugucaaauauauauuuuaaauuaauaaaaguugucauucuuaggaauuugguuugaaauuuaucaguuauacagaauugucauacugcauuagcuucuaccuuuaguaagacauauuuuuuagguauaaauucuuaugcuuuaacauuauuucuggauugaaaaucuuauaaaacccuugaaaauaaacagucucuuuuuuacaaagccuguguuagagcacagauuuaccuaggcuugaagauuuggaagaaauaauauguaagaauggccucaaggcagaccacuuuaaguuuggcuagacuucauaucguggaaguauugucuauuucagugugaaacuaucuugaauuugcaaauauaguguuauauuuuauaaaguuuuguaaaaucccaaacaauauuucuauuuuuguaaaacaauuguauguauaaucuguauuugaaaucauuuugcaaucuauggaaauagaguagcaauugcuauuucuaaauugugaacuuuaagucaaucuagauuuauuuugagaaguaauuguucacucuuuacuuuugaggcagccauuagguugaaaguauauauuuaucauauaaaacuugaugcguuuugcacuacucuuuccauuuauaugcugcaaacaacuacagucuuugaaauauggaaaaucagcagucuaaaguuuguuuuaaauucuaaauuuaaaaaaucuucaaaucugaauauaccgcaaaugucaugagaaguuugauucaguaacuugugauggaggauucuuugguaucuuacuguuugguuaaggcacuaauuuuacuuaccuauuagauuuugaaaguaucugagauauacaaaucucccuguaggaaaugugaaagaaaagcacaacaaaacuaggguuuuuuguucauuugcuugcuuuuaugauuuuuuuugguuuguuuuaauaucagguggauuuuuguuucuaagcaauauauacauaaaaucaaccaacauaucugaaaaggaucaugaaaccugagaaaugcuaauggagauuugcugguacauaggaaucuagcaaauucaggaaccaaggggaaauguugugagauaacauuuacauugucaaccuuuauugacuuuguuuuuacaauaaaaaauauuuuacaacu

SEQ ID NO: 458 - RNA, 1248 nt, Homo Sapiens
gcccucucaccccgcugccucuagguucugggaagauggcgaaggucucagagcuuuacgaugucacuugggaagaaaugagagauaaaaugagaaaauggagagaagaaaacucaagaaauagugagcaaauuguggaaguuggagaagaauuaauuaaugaauaugcuucuaagcugggagaugauauuuggaucauauaugaacaggugaugauugcagcacuagacuauggucgggaugacuuggcauuguuuugucuucaagagcugagaagacaguucccuggcagucacagagucaagcgauuaacaggcaugagauuugaagccauggaaagauaugaugaugcuauacagcuauaugauaggauuuuacaagaagauccaacuaacacugcugcaagaaagcguaagauugccauucgaaaagcccaggggaaaaauguggaggccauucgggagcugaaugaguaucuggaacaauuuguuggagaccaagaagccuggcaugaacuugcagaacuuuacaucaaugaacaugacuaugcaaaagcagccuuuuguuuagaggaacuaaugaugacuaauccacacaaccacuuauacugucagcaguaugcugaaguuaaguauacccaagguggacuugaaaaccucgaacuuucaagaaaguauuuugcacaggcauugaaacugaacaacagaaauaugagagcuuuguuuggacuuuauaugucggcaagucauauugcuucuaauccaaaagcaagugcaaaaacgaaaaaggacaacaugaaauaugcuaguugggcagcuagucaaauaaacagagcuuaucaguuugcaggucgaaguaagaaggaaaccaaauauucucuuaaggcugucgaagacauguuggaaacauugcagaucacccagucuuaagguuucaaaaacucuuugacauuagauuucacaacugcacaauugaacuuauuggccuguaacuuauuuacuaaaugcucagugcuauuuauauacuacaguaauuuucuguuaagaaggcaguuguaaagaauguguuuauauaaaccuaaaaaugccuuuuacugcuaaguggggagaugggggaaauccauggaagagagauuuaagacuuauugauuguacaucagucucuucauaucacauauacauguauauauauaaaacucuaauguaguauaaccuuguuaaauaaaccaugaugauuuauuaaacuugc

SEQ ID NO: 459 - RNA, 4153 nt, Homo Sapiens
ucagcgauggccaaguaugggagaagccaugcuggaaugaacaugugggaccauuuugugcaguuucucagcgccaacacugacugguccccugggcucgugggccgccggcagccucggcucguucuccagacaguguuccaagaagccacuuccagcgaggaagcguuggccugagaacuggaaccucugcggucucugcaaacacgacaaugacaaacacuugagagggcaugggagaaaggagcuccuucauagggcagggaggggugggcacuugggugugaccaaggagaggaggcgcgccuggucaacagcucucccuggcccguguccagcucccuccucacacagagaggggggcgcaucucagggauggcaucuuucccccccacagggaaauucuuaucuuugaaacagcaugggaaucgaggcacccaggaggggagcagaggcaggcaggccuccuucaggcccauccuccagcugggcugguggugccagggaggcucccugcuugguaacaaaggccugagggagaguugcgaaacccagcaggaaagccggcucaccuucgccucccccugcggcugggaggagaggaaauaucccauggcugacugugccaaggaggugucugagccagcccucccggcccgagggcagggcagguggcccugagagauaagccaaucccgcagcugcagaugaggaguucugagaagcauugcucaggacagcgguaaaucacuucuuggaggugcccugcacgccgguccugggagcaggcggccucccgggggugcgggagccccacuccuccgugguguguuccauuugcuucccacaucuggaggagcugacgugccagccucccccagcaccacccagggacgggaggcaugagccggucaaggcaccugggcaaaauccggaagcgucuggaagaugucaagagccaguggguccggccagccagggcugacuuuagugacaacgagagugcccggcuggccacggacgcccucuuggauggggguucugaagccuacuggcgggugcucagccaggaaggcgagguggacuucuuguccucgguggaggcccaguacauccaggcccaggccagggagcccccgugucccccagacacccugggaggggcggaagcaggcccuaagggacuggacuccagcucccuacaguccggcaccuacuucccuguggccucagagggcagcgagccggcccuacugcacagcugggccucagcugagaagcccuaccugaaggaaaaauccagcgccacuguguacuuccagaccgucaagcacaacaacaucagagaccucguccgccgcugcaucacccggacuagccagguccuggucauccugauggauguguucacggauguggagaucuucugugacauucuagaggcagccaacaagcgugggguguucguuugugugcuccuggaccagggaggugugaagcucuuccaggagaugugugacaaaguccagaucucugacagucaccucaagaacauuuccauccggaguguggaaggagagauauacugugccaagucaggcaggaaauucgcuggccaaauccgggagaaguucaucaucucggacuggagauuuguccugucuggaucuuacagcuucaccuggcucugcggacacgugcaccggaacauccucuccaaguucacaggccaggcgguggagcuguuugacgaggaguuccgccaccucuacgccuccuccaagccugugaugggccugaaguccccgcggcuggucgcccccgucccgcccggagcagccccggccaauggccgccuuagcagcagcaguggcuccgccagugaccgcacguccuccaaccccuucagcggccgcucggcaggcagccaccccgguacccgaaguguguccgcgucuucagggcccuguagccccgcggccccacacccgccuccaccgccccgguuccagccccaccaaggcccuuggggagccccgaguccccaggcccaccucuccccgcggccccacgacggcccgcccgccgcugucuacagcaaccugggggccuacaggcccacgcggcugcagcuggagcagcugggccuggugccgaggcugacuccaaccuggaggcccuuccugcaggccuccccucacuucugaaggucccauccccugcugcccuccgcaggcccagggcugggcacucccugagacccaaagacccaccucaacgacgaguggcguugagccacuucccuuugaaaagacacucaaaaucacugccaugguucaauguucccaggccccaggccauccacuugccggcccccaccaguucuuggguuccccgcucuaguuugaccugugcagcacauuccagaagguuccagggagguuguggggcagcuagaggacaaaaucaugaaaacagagucccugucuuccagagaucauccggggcuuuaauauuaauggcccccaaaacuccguaagaagcaggaaaugcagcccaaguuuuacaaauggguaaacagaggcacugagagauagaugguaguuugguacuucugguucccagugcccaggaaugguccacucccaagaaauucaggaaagaaagacugaggagaaggugugggaacauucuggauguuucgggagaguuggggaaacuccuccucuuaggaaaggcuaauacuaggguauccuugggcccaaugaauuaggggugaggccccagaacccguuaucuaugaguuguaugggggagccaucugaagcuguagccaccagggaugcagcuagcugaggaguuugggguguuggguuggacaaggcagguuaguagacucagauucuugcuucaaagagccuugggcuggccuggaggucccuggagucuagacuggaccuaggagcuugaguugucaggggccaggacuggccccacugcagugcccaggccagucuugagcagcagggagggcucagcuguccccagauccaggugccucugaccagccuggucaccuccugaggaauaaaugcugaaccucacaagccccaucauucauuucuucucaauucacagugccccucuuuguuucugggguggaacuagguccugagggcacagccuagcugagugcaaagaaauauaggaugcuuagaaagcauacaggaggggccaggcgugguggcucaugccuguaaucccagaacuuugggaugccaaggugguuggauuaccugagaucagguggauuaccuggucucgagaccagccugaccaauauggugaaaccccgucucuacuaaaaauacaaaaauuaggcugagacaggagaauugcuugaacccaggaagcagagguugcaaugagcugagauugcaucacugcacuccagcaugggcaacaaagcaagacuccgucacagaaaaaaaaaaaaaaaauuccugaaaguaaacaaaacaaaacaaaaacaaaaaaacaaacaacacuuugguuccugauggcuuucugaacccagcccugaccuuguuguuucacagcugacggcugagaugagguuagaaugacugggcccggcugaacauuccaaauuggauuucaccaucugcugagaaaguuuaaggaaggcaaagcuugccaggucacagaagcucccaagcccagcuuuccaaaggccucagccugugccugugucgagcucaguccugggagauaggggagaaccugcaggcaggaacaagccccccuacuccugaccacccuccaucagcagucuccccuccguggucgucuuuguugacaaaggugcaguuucuccucuccugggcaccuguaacaugugaugcgcugccugcugggagguuaggucggggcugccccggcgaguggagcaugagcagaaccgccgagggucacuucugggcagaagcuuugagagccuggguccagguugccacauagaagcagcucuccaguugaaacccuccucugccagccugggguccuaagcgaugagcagaaucccccacucccaccccaccaacccacaauggauauguagugagcaagaaauaaaccuuuguuguuuaagcca

SEQ ID NO: 460 - RNA, 8561 nt, Homo Sapiens
gcugacgucgccggggcccggcgucgcgucagggcuggccggcggcggaggcggcggcggcggcggcgauggcagcggacccugagcgagcuugagggcucggacccagcucccucccgcgaaaccuugggcggauccggcgcugcggccccagcucgcuccgcuccugcucccuccccggccgcugccugggcggaggcagaggcagaggcccgggcuggccgcccugcucgugccccagcucggccccggacggcccggcugcugugcagagaggaggccgagucgguagugaaaagagaauacugaagaauaggaucucaagaugaguaaaaagcccccaaaucgcccuggaaucacuuuugagauuggugcucguuuggaggcacuggacuacuuacaaaaaugguauccaucacgaauugaaaaaauugacuaugaggagggcaagauguugguccauuuugagcgcuggagucaucguuaugaugaguggauuuacugggauagcaauagauugcgaccccuugagagaccagcacuaagaaaagaagggcuaaaagaugaggaagauuucuuugauuuuaaagcuggagaagaaguucuggcucguuggacagacugucgcuauuacccugccaagauugaagcaauuaacaaagaagaggaacauuuacaguucaguuuuaugauggaguaauucguuguuuaaaaagaaugcacauuaaagccaugcccgaggaugcuaaggggcaggugaaaucccagcauccacuaagcugguguuguccuaucgacccagcuggaucguguaaccagucuaugggaagugaggauuggauagcuuuagucaaagcagcugcugcagcugcagccaagaacaaaacagggaguaaaccucgaaccagcgcuaacagcaauaaagauaaggauaaagaugagagaaagugguuuaaaguaccuucaaagaaggaggaaacuucaacuuguauagccacaccagacguagagaagaaggaagaucugccuacaucuagugaaacauuuggacuucauguagagaacguuccaaagauggucuuuccacagccagagagcacauuaucaaacaagaggaaaaauaaucaaggcaacucguuucaggcaaagagagcucgacuuaacaagauuacugguuuguuggcauccaaagcuguugggguugauggugcugaaaaaaaggaagacuacaaugaaacagcuccaaugcuggagcagguaugaaaugguagcauuugauuuuuuucaagguucccacuggaaugaucacggagcucuaguaucuacguaauugaaauuccccuuuugaucagauaugggaauaggaagcuaauuaauugaugauauauuuuuaacucugccuucuccaagguauacagauaacuacagacuucauuaguguuugauuucauagacuggcauuaaagccuuugucuccaaaauuugaaggccuggagacaggcaucccaggguauaagcuuccagcuggaucaccuuuaacuagcuuacaaaaagacccuuacacaaauacuuuccauuugugaguuaaaacaggguuuuuugacaucgaauaaagcuucuuuuguaagaaguuucuuuuauauuguaacaauugguguuguuagacugacuauguguuuuaugaauugaucaaugagccauacauuuuugcuaggauguauauuuuaauaacuacaaaaaaagagaguuuaaaaaacuauuaagggucugucuuuaaaccaccuaauagaggaauuuaaaagugaagguugcaguugcuagauuuugccuuggcuaccuucagauucccacaauacuuguacauaaugaacugugcaugcuuuuacauucucuaagggcuuaacuucuuaggcacuguaagacuauaagaacgcaguaauagccauaacuggauuuccuugguucuccuguuuuaaaaucugagccuuaauguaguuuuaauauauccuuuuuguauuacuuuucuuuauuaguagccuaauaaagaagacuuugaguaucuuuugcucuccucuagaugcguuuuaaaaacuauuccaaauuuaauugauauuguauugaguuuuucaggguuauuuuaggccugauuugauaacaaugcguuguuuuggugccuccauuaauguuguauuaaaucaaugggucuuuuaaauugauuaauaugucauugaaucauaccuucugauuuucugugaucauccaacgguuaagucuuugccguuauugucaauauaucaaccaaauuuuaaauaacuuuuuuuacuguguauuacuauauucaacgucccagauauaacaauauuuuguauuuucaccacuguuuaugguauucucagaaugcgauaaaucagggacuuggguaauaaaauguuucuggaaaauucauuacaaugucaaucuuugauuaugcacaauccugcugaggugaaugugauugugaaaaguacuuauuaaauguggaaguuaguguagagggcaguacccgucuuagagagaaguacagaaaaccacguuuugaaauugaauuuaaaaaagaaaggaaaauuguguaacucggcuguuucuauuuucauaauuaaaaacuuuugagaguccuugccaguuuuguaacaaagagaccaacaaucauuaaugaaaaccuuguaaauuauuuuagauuuucaggaacaccaugccauucccucauuuucuacuugucauucagguugauuucaaugugaaaauguuuugugaacaaacacuuauuuuuauccuauguguuagccucgcuucauaguuaaaaagccgaguuauaaagcucuuaauuacaucucaauugguaucagcaauagaccuaaaggagagguauugauuguuacuaaccucuguuuccuaaugaguuaaaguaaugucacucaugacauagauugauaacaggccuguagucaaaacuuacugugcuaauggacuuauuuauauuuuuuaaaaauucaaacuguggucuugaaccccaauucucagcuuauuaauuauagauuauuuaauuguauuagggauaugucauguuauauuuacuuuuggauaaaacuugcauuagaugcauaauaacucaguaaguuuuaaaaacaauguuaauuuuuccuuguuuagaaguuaagcaccuuaucaagauauuaaguuuuaaaaucuuguuuuauaacuuuguaacuugagaguaauggaugcuguagugaugucuuucacauaugugaagaugaacaauaaaauuguuuauuuacaaguaagcgauuucaccuaaaccucaaagucagaaaaaaaaugaagcugacauuagcaguucugccaacacucagaaaccugcacuguuauccucaacuuugucuucagggaaggcucgcagcaagaaaugcaaacaugaaucuggagauucuucuggguguauaaaacccccuaaaucaccacuuuccccagaauuaauacaagucgaggauuugacgcuuguaucucagcuuucuucuucagugauaaauaaaacuaguccuccacagccugugaaucccccuagaccuuucaagcauagugagcggagaagaagaucucagcguuuagccaccuuacccaugccugaugauucuguagaaaagguuucuucucccucuccagccacugaugggaaaguauucuccaucaguucucaaaaucagcaagaaucuucaguaccagaggugccugauguugcacauuugccacuugagaagcugggacccugucucccucuugacuuaagucgugguucagaaguuacagcaccgguagccucagauuccucuuaccguaaugaaugucccagggcagaaaaagaggauacacagaugcuuccaaauccuucuuccaaagcaauagcugauggaagaggagcuccagcagcagcaggaauaucgaaaacagaaaaaaaagugaaauuggaagacaaaagcucaacagcauuugguaucaggaguugggauuucucagcacugcuaaugaagauccccucuuauaguccaauaagcuuaucaggacuuccagagucaugacaugaacaguuuaauugaacccauccacucugggcaggugacuggaauagcugauuaaaacauaaaugcugcuuuuagguuaaccacaaaggaacaacucaggaucagucgugauugcuaaaguauucacuuuuaucuuuuagguaagagaaaagaaaaagauaaggaaagaagagagaagagagacaaagaucacuacagaccaaaacagaagaagaagaaaaaaaagaaaaagaaaucuaagcaacauggacuauucagacuaugaagacaguucccucgaauuuuuggaaaggugcucuucuccacuaacucgaucuucugggaguucucuggcuucacgaagcauguuuacggagaaaacuacaaccuaucaguacccaagggcaauucuauccguugaucuuaguggugaaaacuuaucagauguagacuuccuagaugauucuucaacggagaguuugcuucugaguggggaugaauacaaucaggacuuugauucaaccaauuuugaggaaucucaggaugaggaugaugcucuuaaugaaauugugcgauguauuugugagauggaugaggagaauggcuucaugauccagugugaagagugcuuguguuggcaacacagcgugugcauggggcugcuggaggagagcauuccagagcaguacaucugcuauaucugccgggacccaccaggucagagguggagugcaaaauaucguuaugauaaggagugguugaauaaugggagaaugugcggguuaucauuuuucaaagaaaauuauucucaucucaaugccaaaaagauaguuucuacacaucaccugcuugcugaugucuaugguguuacagaagugcuacacgggcuacagcugaagauuggaauacuaaagaauaaacaucauccugaccuucaucucugggcuuguuccgggaagcgaaaagaccaagaucaaauaauagcugggguggagaaaaaaauagcucaagacacaguuaaucgagaagaaaagaaauauguacagaaccauaaagaaccaccucguuugccccuaaaaauggaaggaacuuauauaacaagugagcauagcuaucaaaagccacaaaguuuuggucaggacuguaaaucucucgcagacccugggagcucagaugaugaugauguuaguaguuuggaagaagaacaagaauuccacaugagaaguaaaaacaguuuacaguacucagcaaaagaacauggaaugccugaaaagaauccagcugaagggaauacaguauuuguuuauaaugauaaaaagggcaccgaagacccaggagacucacaucuucaguggcagcucaaucuccuuacacacauagaaaaugugcagaacgaaguuaccagcaggauggaccuaauagaaaaagaagucgauguucuggaaagcuggcuugauuucacaggggaguuggagccaccagauccucuugcaagauugccccaacuuaaacgccacauaaaacagcuccuaauugacaugggcaaaguacagcagauagcaacucuuugcucuguaugacaacagugaacacuuaaugaaagaauguggcuuucuucagucaaagcauuuuuauuauccacgugauggcuaaguggauaauuuaaaagcuuaguaaugucuggucauucacugauuugugaugucaauaggauggcaccuuggaaagaaaaaugaagaacaacuuuaucaaggaagcuaguauuuaaaaacaaauucaugagcaagcugcaaaugagaauguguuauaugccaaggaacaaugaaguagaauauaauguauacuaagggauuucaaguucucagaauuuuugaguaguugcuuacgugaagcucaagauaccuguagaaagaaauaugguauauuuguauaguuuuuaauagaaagaucuauguuuauaaaccagcacuuggccaaaaacaaaauuguaaaggaaauuuaaauucuggagaauucuacaggguugcucuaagaacugucuucucagcaguugauccagcuguacggaaauuuaggguauuuaaacuuuuaaaggaucaugagcuguuucuugggcgaugaauguucucaaucagaaaacugacaguagaaaucucacuucuggggaaaacaguuguggaauucuuacuucauuaugaauguauuuaaaaaacaaacaccaaauaauuggaauauauugcaggcauuaagcucauuaaaaacaaacuggcuugcagaaggguccgaugugccaagugaucaugauucugcuggaaagaggauuuuaaauauugugggaguucucccacccuaagucuuacauaaugccaccaguccauccaaaaccuauauaucaccuauacuauauauaucauauauauaguugaauggcaguauucaggcucaacguacaguuugauccugaguaugcuugguguuugccuucagaaaaaaaaaaauacauuguaaauaaccucagcugggaugaggagugacagaauaucaaaauaauuuguggcuguggauuuuuuuaacugcuaguaguggaauacuggaaaagcuucauuucugaagaugaauuuuauuuuuaaaaaauacaugcacacucaaaacuuuuagcuuugaucacaaguggacaaauuucugaaaccaaaggcaacuaaguugcuguguuagcucuugcuggauuuugagccuagguccuacugucugccaguacucaugugaguuguaugugcccccagugcuacauacgcagguaugcguaaguguguaugcuuguuuuaaacaaacacucaacguacauauguacauaaucuacacauauuuauaucacauaucuaguuuuauuacuauagacuauacgaauuggugguuaacaugaaauguuaccuuuuaacagacuguuuuuaaaaauuaaaaauguauguauagguuuugaaauuuuuuuaaaaggggagaaagacuguuaagaggaggcuauuugaugacauaacacuugaauauuuuaugccucauucuguuuaucaguucucgcaaucuguauaaaugcauuuuagaacugauagacaguaaacuugaauuuaucuuugauaagaauacaugccacuguacauucagauauuauuuaaauuugcaaacacauuguucuauauguaaggguacuguauguaaaacucuguauuaaaacuauuccacauauccuaaaauuucagcuugccuuuuugcggccuuauauuuugauguaaagauuaaaagaaugugcaaaacagucagaaauuuuuauugccuuuugagauucuccaacuugacaaaugugccaaagaucaacagacagaaaauaucauccuguguauuuacuugucauacuuuaacuuugugaaagaucuuacugauaaaugaaaagcuuuagcagaggugguauugugggguaauugcuuaaauuuacauaucaaaguaaaaaaguagugccuguauuccauguguggaguaaauuugcuaaugucuauauuuuaugauugauacuauuauuuuuccuuugcauuuuaaaauaguggcucuaauauuuucccugucauggcuacauucuagacauugaauuuauaucuucuuuuuuucagauacggagcaaauagcauccuuaaccuaugaauaaugguguugccuagauucuugucacacacacagaagacccuuuguaccuaguaacauucauccucuugauuccuggugaacacgguuaaauucaugcacauuuguucuuguaguuucuaaaaauuagaucaauuuauuuguuagccagcaaauugaaaauuccauuauuagauuaaugaaauuuuugcucugcuuauauguauacgaacuggaaaucugaauuuuuaaauuuagaucuuuaaaucaaauuauuuuuaugcauauuuucauuuaauauagaguauaccaaucgauugaagccuuucacaaguagugcgcugagcuuuucuuauugaagagagugaauuaguuucugagaagucagucuauugugaaaaguuucagaugagauuauuuucuuuuagucuuuuuaaauaucacuauauguauuuaaauagaagcaauaaacuagagagaguguuucuugaaaagacaauguuuuauuugccaccaggcagaacagaaugagcauugguagagaaggcucccucuugguauguuacugauaaacuuguacuuccucauacuuguuugugguucuacugacuuauuuccaaacuuaagaguaauguacuucgaaaacaacuugguuauucuuuaaauuucagguaaaaccccuuuuccuaacacucaucuuauuuccacugucuuauuuccucucagauguucauauuucacauguucaaaaugaagcguacuauuuccccuccaauaaacgaagucuccugccaa

SEQ ID NO: 461 - RNA, 1775 nt, Homo Sapiens
uggcggguacggcacccgauggcuauucgagcucucgaucucggagacuggagcgggccauucagaggcgcggggccgggcccggcggacgcuuguuguuguccggccgggggaggcggaggucgcucgcucgcucgcucggcucgcugacucgccggagcgcucuguggcggucggcggcaggucggucgcgagagcgggcucuguggaagggggcgaggcuaugucgcgguggcagcccggaugggccggcagggccgggaguaacgggacgucgccgcggagcuucuucccccggauacagugcggcccgagcggaggccgcggcgccgcccuccgaucuugaagagcccgcgcugcgcggagcccgcccccgccugcgcaccggcaccgacgcggagcgacccagcccagccagacccggcccggcgcggccugaucuaacccagccaggcaggcaauacuagccccucuggagcacggagcuccuuccccaaagacaugaagcuauuggagaacucgagcuuugaagccaucaacucacagcugacuguggagacuggagaugcccacaucauuggcaggauugagagcuacucauguaagauggcaggagacgacaaacacauguucaagcaguucugccaggagggccagccccacgugcuggaggcacuuucuccaccccagacuucaggacugagccccagcagacucagcaaaagccaaggcggugaggaggagggcccccucagugacaagugcagccgcaagacccucuucuaccugauugccacgcucaaugaguccuucaggccugacuaugacuucagcacagcccgcagccaugaguucagccgggagcccagccuuagcuggguggugaaugcagucaacugcagucuguucucagcugugcgggaggacuucaaggaucugaaaccacagcuguggaacgcgguggacgaggagaucugccuggcugaaugugacaucuacagcuauaacccagacuuggacucagaucccuucggggaggaugguagccucugguccuucaacuacuucuucuacaacaagcggcucaagcgaaucgucuucuuuagcugccguuccaucaguggcuccaccuacacacccucagaggcaggcaacgagcuggacauggagcugggggaggaggagguggaggaagaaagcagaagcgggggcaguggggccgaggagaccagcaccauggaggaggacagggucccagugaucuguauuugaugaggaggagccgaggccccagcuucauccagcuucaaccaaugccuggaccuguccaccugagaggccccuggggccuccccagcugcuggccagacccuggcgcugccacaguccuggcacugcccaaggccauaccugccuagcccuuuggcuccauccuguggaugcccacucaccccucagacuccugcugcccaugcuguggccggacuugucagcagggggccuggugggaggagcgacugcccugcccaaaugaacugccacagcagggacagcuggaccgcagaguuuauuuuuguauuucuacugggccugcacacuccagcccaaagggucuguggccggaggccccacgagcaggccccagcagucaccggcucuggucuugggccggccccggugcccaccuguacccccaccucgcccauuuggccgcgugcacugagugucacuuugcugcagcucguuucuuuccaauaaaaguuucugugacuuag

SEQ ID NO: 462 - RNA, 7868 nt, Homo Sapiens
ccgugucaguuuggggcaucuccgcgguccggcccggggccccgggaucucggcuguccuuccucccggcauaagaugcacauuuuucugcucuggagccgggaaugaaauauucuugaguucuuacaacuuuaugacgagacccauguguggugcuauugagaaauucauugggaaguuggaagacauuucaaucaacagguuguuuugguuucuauaguacaauugggguggcauucuguuuugugaaaggaggaaggacuuaggccagaaaacucauaugcuaugguuaacugguucccagccuccgagaaucuuguuuuccaugguguaaaacuuacucagcaucaggauaagggauaacgacucuauggauauacagaauccuucaccaugguaaaacucgcaaacccgcuuuauacugaguggauuuuggaggccaucaaaaaagugaaaaagcagaaacagcguccuucagaagaaaggauaugcaaugcugugucuucaucccauggcuuggaucguaaaacuguuuuagaacaauuggaguugaguguuaaagauggaacaauuuuaaaagucucaaauaaaggacucaauuccuauaaagauccugauaauccugggcgaauagcacuuccuaagccucggaaccauggaaaauuggauaauaaacaaaauguggauuggaauaaacugauaaagcgggcaguugagggcuuggcagagucugguggcucaacuuugaaaagcauugaacguuuuuugaaaggucagaaggaugugucugcauuauucggaggcagugcugccucuggcuuucaccagcaguuacgauuggcuaucaaacgugccauuggccacggcagacuccuuaaagauggaccucuuuaucggcucaacacuaaagcaaccaacguggaugggaaagagaguugugagucucuuuccuguuuaccuccagugucccuucuuccacaugaaaaggauaagccgguugcugaaccaauccccaucuguaguuucugucuugguacaaaagaacaaaaccgagaaaagaagccagaggaacucaucuccugugccgacuguggcaacaguggccauccauccuguuuaaaguuuuccccugaacuaacgguucgagugaaggccuuacgguggcagugcaucgaguguaaaacaugcagcuccugucgagaucaaggcaaaaaugcggauaacaugcucuuuugugauucaugugaccgagguuuucacauggaguguugugauccgccacucacccguaugccaaaaggcauguggauaugucaaauaugucgaccuaggaaaaaaggacgaaaacuucuacaaaagaaggcagcacagauaaaacggcgcuauacuaauccaauaggacguccaaaaaacagguuaaagaaacaaaacacgguaucaaaaggucccuucagcaaaguucgaacuggcccuggaagggguaggaaacgaaaaaucacucuuuccagccaaucagcaucaucaucaucagaagaaggauauuuagagcggauagauggcuuggacuucugcagagauagcaaugucuccuugaaguucaacaagaaaaccaaagggcucauugauggccuuaccaaauuuuuuaccccuuccccugaugggcggaaagcucggggggaagugguggacuacucugagcaauaucgaaucagaaagaggggcaacaggaaaucaagcacuucagauuggcccacagacaaucaggauggcugggauggcaaacaagaaaaugaggagcgacuuuuugggagccaggaaaucaugacugagaaagauauggaauuauuucgugauauccaagaacaagcacugcagaaaguuggagugacuggucccccugauccacaaguccgcugucccucugucauugaguuugggaaguaugaaauucacaccugguacuccuccccauauccucaagaauacucaaggcugcccaaauuguaucuuugugaauuuugucuaaaauauaugaaaaguagaacuauucugcagcagcacaugaagaaaugugguugguuccauccuccugccaaugagauuuacagaaagaauaauauuucugucuuugagguugaugggaaugugaguaccauuuauugucaaaaccugugucuuuuggcaaaguuguuucuugaccacaaaacccucuauuacgauguggagccauuucuuuuuuauguacuaacacagaaugaugucaagggcugccaccuuguuggcuacuuuucuaaggaaaagcacugccaacagaaguacaauguuuccuguauaaugauucuuccucaauaccagcguaagggcuauggcagguuucucaucgauuucaguuauuuguuaucaaagcgugaaggccaagcagggucuccagagaaaccguuaucugaucugggucgucuuuccuacauggcauauuggaaaaguguaauauuggagugccuuuaucaccaaaaugacaagcagaucagcauuaagaaguuaagcaaguugacuggaaucugcccucaagacaucacuuccacacuccaccaccuacgaaugcuggacuuccguagugaccaauuugugauuauccgccgggaaaaacuuauccaggaucacauggcaaagcuucagcugaauuugcgaccuguagauguagauccagaauguuugcgcuggacuccagucauaguguccaacucuguggucucagaggaggaagaagaggaggcugaggaaggagaaaacgaagagccacagugccaggaaagagaauuagagaucagugugggaaagucugugucucaugagaacaaagaacaagauucuuauucaguagaaagugaaaagaaaccagaaguuauggcuccagucaguucuacacguuugagcaaacaaguccuuccucaugauagucuuccugcaaauagccagccaucucggaggggccgcugggggaggaagaacagaaaaacccaggaacguuuuggugauaaagauucuaaacugcucuuggaagagacgucuucagcuccucaggaacaauauggagaauguggggagaaaucagaagccacccaggaacaauacacugaaagugaagaacagcugguggcuucugaggagcagccaagccaggacgggaaaccugaccuucccaagagaagacucagugaggggguugagcccuggcgaggacagcucaagaaaagcccugaggcucugaagugcagauuaacagaaggaagugagaggcugccccgucgcuacagugagggugacagggcuguccucaggggcuucagugagagcagcgaggaggaggaggagccggaaagcccucggucaagcucgccaccaauucucacaaagcccacgcugaagcgaaagaaaccauuucuccaccgaaggaggagaguccgaaagcgcaaacaccacaauagcaguguagucacagaaacuauuucugagaccacugaaguguuagaugaaccuuuugaagauucugacuccgagaggccaaugccaagauuagaacccacguuugagaucgaugaagaagaggaggaagaggaugaaaaugaacuuuucccuagagaauacuuccgucguuugucuucgcaggauguacucaggugucaguccucuucuaagaggaagucuaaagaugaagaagaagaugaagagucagaugaugcugaugacacuccuaucuuaaagccaguaucucuuuugcgaaaacgugaugugaagaauucuccucuugagccagauacauccacaccuuugaaaaagaaaaagggauggcccaaaggcaagagccgcaaaccaauccacuggaagaaaagaccuggucgaaaaccaggauuuaaguugagucgggaaaucaugccaguuucuacucaagcaugcgucauugagcccaucguuuccauuccuaaagcuggacguaaacccaagauccaggagagugaagaaacuguugagccaaaagaagacaugccccuacccgaggagaggaaggaggaggaggagaugcaagcagaggcagaagaggcugaagagggugaggaagaggaugcagccagcagugaagucccagcagccucuccagcagacagcagcaauaguccugagaccgaaaccaaggagccugagguggaggaggaagaagagaagccccgugucucagaggagcagaggcagucagaggaggagcagcaggaauuagaggagccagagccagaggaggaggaagaugcagcugcagagacugcccagaaugacgaccacgacgcugaugaugaggaugauggccaccuggaguccacaaagaaaaaggagcuagaggaacagcccacgagggaagaugucaaggaggagccugguguucaagagucuuuuuuagaugcuaauaugcagaagaguagggaaaagauaaaggauaaagaggaaaccgagcuggauuccgaagaggagcagccuucccaugacacguccguggugucagagcagauggcugggucugaggacgaccacgaagaagacucccacacuaaggaagaguuaaucgaauuaaaagaggaggaagagauuccucauagugagcuggaucuggaaacuguacaggcagugcagucuuugacucaagaagaaagcagugagcaugagggcgccuaccaggacugugaggaaacucuugcggcgugucagacccugcagaguuacacccaggcugacgaggacccucagauguccaugguugaagacugucaugcgucagaacauaauagcccuaucuccuccguucagucucaccccagccagucaguccguucggucagcagucccaacgugccugcccuugagaguggcuacacccagaucagcccagaacaaggaucccuguccgcacccucuaugcagaacauggagaccagccccaugauggaugugccuuccguaucagaccacucucagcaggugguggacagcggcuucagugaccugggcagcauugagagcaccacugaaaacuaugagaacccaagcaguuacgacuccacgaugggcggcagcaucugugggaacagcucuucccagagcagcugcuccuacggugggcugucguccuccagcagccucacccagagcagcuguguggucacucagcagauggccagcaugggcagcagcugcagcaugaugcagcagagcagcguccagccugcugccaacugcagcaucaagucaccucagagcugcgugguggagaggccucccaguaaccagcagcagcagccgccaccaccgccuccacagcagccacagccgccgccgccacaaccacaaccagcaccacagccuccaccaccccagcagcagccgcaacagcagccgcagccucagccccagcagccuccacccccacccccuccccagcagcagcccccgcugucacaguguaguaugaauaacaguuucaccccagcuccuaugaucauggagauaccagaaucuggaagcacugggaacauaaguaucuaugagaggauuccaggggauuuuggugccggcagcuacucucaaccaucagccaccuucagccuagccaagcugcagcagcugaccaacaccauuauggacccucaugccaugccuuauagccauucuccugcugugacuuccuaugcaaccaguguuucucuguccaauacaggacuggcucagcuggcuccaucucaucccuuagcugggacuccucaagcacaagccaccaugacgccacccccaaacuuggcauccacuaccaugaaccucacaucuccucugcuucagugcaacaugucugccaccaacauuggcauuccucacacgcagagauugcaagggcaaaugccagugaaggggcacauuuccauccgcuccaagucugcgccacugcccucugcggcugcucaccagcagcagcuguauggccguagcccaucggcaguugccaugcaggcuggcccucgcgcacuggcuguucagcguggcaugaacauggggguuaaucugaugccuacucccgccuauaaugucaauuccaugaauaugaacaccuugaaugccaugaacagcuaucgaaugacacagcccaugaugaacagcaguuaccauaguaacccugccuacaugaaccagacagcacaguauccuaugcagaugcagaugggaaugauggggagccaggccuauacccagcagccuaugcagccuaacccucaugggaacaugauguacacaggccccucccaucacagcuacaugaacgcugcuggcgugcccaagcagucacucaacggaccuuacaugagaagaugagcaagaugaacuugcaaucaaaaacuuaaauauauauaaauaaaggaaccuuuuauacugacaaaccagagaaaaauggaccuuuuuccaguuaaaauauugcuguagauuuagaggaauuuuucuuugguuuauuuuauuuuuuagaaaaccugaucuucucuuuuuuuggguucauuuuguucuggguuuugguuuucuucacaaucuugaacauuuuacaguagaacucaucuaaaaauggauuuggggauggggaaacaugcacaaaaucuuuucauaauuaaaaagagccuuacuuucuuuacauaccacauggacagaauuuguguaaaagugaauuaucuuuauuuuaaaauguauguuuccccucacuguuugcagcucccaauguugucauuuuuaaauguuauauacaucucaaggguuaaccagacccuuuccuccaaacccaaccuuucauuuccuacuucauuccagcaggaggcacuuaggggagacucggauggggacauggagaacaacccaagcuccuuaaacuuauuauuauuguuaauauuauuauuauuauuauuaauaaagugaggcaggaaaaugcuucuccuuuuaaaauccccuccacuccucacacacacacaccucuugaaacccuuccccaagaauguuucuuuauagacggacuucauugaaaucuuuguuguucuugaaucaaguguaauauaauuuuuuucuucuuuuuuaaaauauucccacucagcacucagagacacaaaaauacuguaagucucaauuaacagcagaaucucagagaaaagcuguuugcaauccaaauccagccuuuggaggaauagagauggucaauuaacaaucaaaaagaggagauuaaccucuuguuuuuuuaccaccuggugaaucagccauaacgcacacacacgccacccagccucuuguuucuaguauguacuuugaaaugcuaacugagggucuugaugcuugagccuuugacugauaaaacucaaauagcaguccccagugauuugccucuuagguucuuucuuaaauuguugguggaugacuguacauuuuagugauuugaaaaauaacugacaaaccauugaaacaguuuauuuuauguuggaagagauggcgcagaugugugucagaagggagaucacggugugaguuucguagcuauuuaagugauacauaccucuaguuuuuguaugucuuuugagauccugaguucauccccugugaaucagagugcacaagcaccucuccugugaguggcuaaugagaagagggacagaccgaccaccagcacaguagggcagaucuggacagcagaauguuauaacgcaaguucauguguugcucccaacuccauucucuuuucucucgugcaaccaguuugcccauucucuuccuauuacuugcuccagggauagguaaaaaaaaaa

SEQ ID NO: 463 - RNA, 6655 nt, Homo Sapiens
gucgacaauaacaaaccaagccgcggcgguguccgcggcccugccgagcccucggcguugccucagaaucccccagucgccugggccccucggcucugacaggccgcggccuucugucccccggccccagacccagagccgaggggccugcucgcguccuuguccgcccggaccccucccugccuccuagaguucggggccgcggcgggcgggcgcccgggacgccggcgguugugucggcuuagcggugccgaaugggcgguugguaaccgcugccgaggacuaggcggcggcggaagauggugccgggggucgcuggcucugcugcugccgccggcgaaggaggaggcguugccgguuuucugaguuuaaccaguaaugccauucaguugccaaucucaagcaaagcaaacauaagccaguuuuaaucuacuuuuuaagaaaagugguaguccuuuucacagugccugacguaacuguaucagagggugagguauaagcucacagaauucagauaaaucaucaugaaguuauauguauuucugguuaacacuggaacuacucuaacauuugacacugaacuuacagugcaaacuguggcagaccuuaagcaugccauucaaagcaaauacaagauugcuauucaacaccaggugcugguggucaauggaggagaaugcauggcugcagaucgaagaguguguaccuacagugcugggacggauacaaauccaauuuuucuuuuuaacaaagaaaugaucuuaugugaucguccaccugcuauuccuaaaacuaccuuuucgacagaaaaugacauggaaauaaaaguugaagaaucucuuaugaugccugcaguuuuucauacuguugcuucaaggacacagcuugcauuggaaauguaugaaguugccaagaaacuuuguucuuuuugugaaggucuuguacaugaugaacaucuucaacaccaaggcugggcugcaaucauggccaaccuggaggacuguucaaauucauaccaaaagcuacuuuucaaguuugaaaguauuuauucaaauuaucugcaguccauagaagacaucaaguuaaaacuuacucauuuaggaacugcaguuucaguaauggccaagauuccacuguuggagugccuaaccagacauaguuacagagaauguuugggaagacuggauucuuuaccugaacaugaagacucagaaaaagcugagaugaaaagauccacugaacuggugcucucuccugauaugccuagaacaacuaacgaaucuuuguuaaccucauuucccaagucaguggaacauguguccccagauaccgcagaugcugaaaguggcaaagaaauuagggaaucuugucaaaguacuguucaucagcaagaugaaacuacgauugacacuaaagauggugaucugcccuuuuuuaaugucucuuuguuagacuggauaaauguucaagauagaccuaaugauguggaaucuuuggucaggaagugcuuugauucuaugagcaggcuugauccaaggauuauucgaccauuuauagcagaaugccgucaaacuauugccaaacuugauaaucagaauaugaaagccauuaaaggacuugaagaucggcucuacgcccuggaccagaugauugcuagcuguggccgacuggugaaugaacagaaagagcuugcucagggauuuuuagcuaaucagaagagagcugaaaacuuaaaggaugcaucuguauuaccugauuuaugccugagucacgcaaaucaguugaugauuauguugcaaaaucauagaaaacuguuagauauuaagcagaaguguaccacugccaaacaagaacuagcaaauaaccuacaugucagacugaagugguguugcuuuguaaugcuucaugcugaucaagauggagagaaguuacaagcuuugcuccgccucguaauagagcuguuagaaagagucaaaauuguugaagcucuuaguacaguuccucagauguacugcuuagcuguuguugagguuguaagaagaaaaauguucauaaaacacuacagggagugggcuggugcuuuagucaaagauggaaagagauuauaugaagcagaaaaaucaaaaagggaauccuuugggaaauuauuuaggaagucuuuuuuaagaaaucgucuguuuaggggacuggacuccuggcccccuuccuuuuguacucaaaagccucgaaaguuugacugugaacuuccagauauuucauuaaaagauuuacaguuucugcaaucauuuuguccuucggaaguucagccauuccucaggguucccuuacuuugugacuuugaaccucuacaccagcauguacuugcucuacauaauuugguaaaagcagcacaaaguuuggaugaaaugucacagaccauuacagaucuacugagugaacaaaagccuuucuuucuguuuuccaggcaucugugagucagacauccccacagucugcuucuucaccaaggauggaaaguacagcaggaauuacaacuacuaccucaccgagaacuccuccaccacugacuguucaggaucccuuauguccugcaguuugucccuuagaagaauuaucuccagauaguauugaugcacauacguuugauuuugaaacuauuccccauccaaacauagaacagacuauucaccaaguuucuuuagacuuggauucauuagcagaaaguccugaaucagauuuuaugucugcugugaaugaguuuguaauagaagaaaauuugucgucuccuaauccuauaagugauccacaaagcccagaaaugaugguggaaucacuuuauucaucaguuaucaaugcgauagacaguagacgaaugcaggauacaaauguaugugguaaggaggauuuuggagaucauacuucucugaauguccaguuggaaagauguagaguuguugcccaagacucucacuucaguauacaaaccauuaaggaagaccuuugccacuuuagaacauuuguacaaaaagaacagugugacuucucaaauucauuaaaauguacagcaguagaaauaagaaacauuauugaaaaaguaaaauguucucuggaaauaacacuaaaagaaaaacaucaaaaagaacuacugucuuuaaaaaaugaauaugaagguaaacuugacggacuaauaaaggaaacugaagagaaugaaaacaaaauuaaaaaauugaagggagaguuaguaugccuugaggagguuuuacaaaauaaagauaaugaauuugcuuugguuaaacaugaaaaagaagcuguaaucugccugcagaaugaaaaggaucagaaguuguuagagauggaaaauauaaugcacucucaaaauugugaaauuaaagaacugaagcagucacgagaaauaguguuagaagacuuaaaaaagcuccauguugaaaaugaugagaaguuacaguuauugagggcagaacuucaguccuuggagcaaagucaucuaaaggaauuagaggacacacuucagguuaggcacauacaagaguuugagaagguuaugacagaccacagaguuucuuuggaggaauuaaaaaaggaaaaccaacaaauaauuaaucaaauacaagaaucucaugcugaaauuauccaggaaaaagaaaaacaguuacaggaauuaaaacucaagguuucugauuugucagacacgagaugcaaguuagagguugaacuugcguugaaggaagcagaaacugaugaaauaaaaauuuugcuggaagaaagcagagcccagcagaaggagaccuugaaaucucuucuugaacaagagacagaaaauuugagaacagaaauuaguaaacucaaccaaaagauucaggauaauaaugaaaauuaucaggugggcuuagcagagcuaagaacuuuaaugacaauugaaaaagaucaguguauuuccgaguuaauuaguagacaugaagaagaaucuaauauacuuaaagcugaauuaaacaaaguaacaucuuugcauaaccaagcauuugaaauagaaaaaaaccuaaaagaacaaauaauugaacugcagaguaaauuggauucagaauugagugcucuugaaagacaaaaagaugaaaaaauuacccaacaagaagagaaauacgaagcuauuauccagaaccuugagaaagacagacaaaaauuggucagcagccaggagcaagacagagaacaguuaauucagaagcuuaauugugaaaaagaugaagcuauucagacugcccuaaaagaauuuaaauuggagagagaaguuguugagaaagaguuauuagaaaaaguuaaacaucuugagaaucaaauagcaaaaaguccugccauugacucuaccagaggagauucuucaagcuuaguugcugaacuucaagaaaagcuucaggaagaaaaagcuaaguuucuagaacaacuugaagagcaagaaaaaagaaagaaugaagaaaugcaaaauguucgaacaucuuugauugcggaacaacagaccaauuuuaacacuguuuuaacaagagagaaaaugagaaaagaaaacauaauaaaugaucuuagugauaaguugaaaaguacaaugcagcaacaagaacgggauaaagauuugauagagucacuuucugaagaucgagcucguuugcuugaggaaaagaaaaagcuugaagaagaagucaguaaguugcguaguagcaguuuuguuccuucaccauauguagcuacagccccagaacuuuauggagcuugugcaccugaacucccaggugaaucagauagauccgcuguggaaacagcagaugaaggaagaguggauucagcaauggagacaagcaugaugucuguacaagaaaauauucauauguugucugaagaaaaacagcggauaaugcuguuagaacgaacauugcaauugaaagaagaagaaaauaaacgguuaaaucaaagacugaugucucagagcaugucuucaguaucuucaaggcauucugaaaagauagcuauuagagauuuucaggugggagauuugguacucaucauccuagacgaacgccaugacaauuauguguuauuuacuguuaguccuacuuuauauuuucuacauucagagucucuaccugcccuggaucucaaaccaggugagggugcuucaggugcaucuagaagacccuggguacuuggaaaaguaauggaaaaagaauacugucaagccaaaaaggcacaaaacagauuuaaaguuccuuuggggacaaaguuuuacagagugaaagccguaucauggaauaagaaaguauaacuuauggacaaaauuaauacauucuaugacauuuuuuucugauuuguccugcagugcucauucaucacuccaaaaacagcaggccaucuuuuuaugcaaaagucagcgugacaauauacuucacugguguacaucguuuacuuuuuaacuggcuucauuuuaggaauaauaaauucaucagaauccuuggcugaauuaaaaugguuuuuguuuuuugguuuuuuuuuuuacccagacaacucuagaaaugcggaccaaacuacuucauuuucucaaagggcauaccuugugcauuguggcuuaugaugagccauauuaauugccuguuaaauauacacuagcuugaacuuagauguuaaauguuauuauuaccagcauuuguccuuuugugaaaucaguaucagaauacuugcacucuuuaacacauucuuuauaaaauguauaaauuauucagaacuauuuaaaauaaagaggaguguuauugcaugcugauaaucauuuugaguuugccucaguagauacuaaagcaaauuguuucaguuuuuuuaaaugcccuuugauguuucaaaaaaaaaaaggaacuguaauuugauugacugauuuuaagaucagccauaaguaaucagcaaucuucaaaagcacuuucaguggauuggucaucuggguucuaaagggaagagucugugcuacuaaccauuucaaaugcagacucaaaccuucccaacaucuuuaugacucuagaauaaucauauugaugaaaucguaauucaugguugaguuucagaacaaaagauauucauugcacauuaaccauuuagaggucauuuaaauaacaaaauauuguauuguaaaagaacuguacaauuuuaaaacaauaaagauuugaaccuguaaaugugugugccuuuuaaagaaggauacauuuuuaauauauuugagugauugcugggaagugugaaaauauuguuauguaucauaucaaagagaaacauguuuauuacaaaaauguucuuuaacuauauacuauguaacaggguaaacaguguuauguagaauagaauuguguaaacuagaucuuuagagaaguugccauugagcaaaguuauuuaaaugaguuaguugaguuggaugagaauuguuugagguuuguugcuagagaacaauaauaaaauaauucuuuuucagaaaauauuuaauuucuucauaaaaauaaguuaaauauuuuuuuaaauauguauaucuaauaguacaaaauggaauaaacaucauaguguauagaaaacugaauuugacaaguuaaugaauaaaugaacaaaugauuucaca

SEQ ID NO: 464 - RNA, 6495 nt, Homo Sapiens
agcugcccgggcgcgcgcagccggcaggcgggugaagucuucccaggugcugcaggcggugcugaggcacagggucugcugcaggagcagcggcccgaacccgcuccagcggcccgccgccgccagcgguucccgcgucgcguguguacccccgcgcacugaaggagguccgccagcccucaccagcccccgcggaccgugcaauggcccagcguaagaaugccaagagcagcggcaacagcagcagcagcggcuccggcagcgguagcacgagugcgggcagcagcagccccggggcccggagagcaagcucugguaggcaagugcaugcagugugccuaaaaccugccagcaguacuuuugaguuuuuuuuuuuguuuuguuuuacuuuagcauuuauuauucauggauugaagaaaucaaaauggcugaagauaaagagacaaagcauggaggacacaagaaugggaggaaaggcggacucucaggaacuucauucuucacgugguuuauggugauugcauugcugggcgucuggacaucuguagcugucguuugguuugaucuuguugacuaugaggaaguucuagccaaagcaaaggacuuccguuauaacuuaucagaggugcuucaaggaaaacuaggaaucuaugaugcugauggugauggagauuuugauguggaugaugccaaaguuuuauuaggcaauggugccugaccaaagauggcaguaaugaaaauauugauucucuugaggaaguccuuaauauuuuagcagaggaaaguucagauugguuuuaugguuuccucucauuucucuaugauauaaugacuccuuuugaaaugcuagaagaagaagaagaagaaagcgaaaccgcagaugguguugaugguacgucacagaaugaagggguucagggaaagacuugugucauauuggauuuacauaaccaguaaccuugauucagggacugaagucauuggcuaaugaacaccugaagcagccuccuuuuucuuuucuuuccuuggcuuaugcagggcuuaaugugcaguggggugguugugaucuuaccgugcaagucaaccaugugaucuugcccaguacagcuacuagcuagucccuugcucgcucagcucccccaacuucuauugaagaaaaugguacuccucauucuuguagucagcuacaaaguacacugaaaaugauguucuuggugguauaauugguuucuguaucguuuuguuucaacucauguauucacugaacuaaauuuggacacuuaacagcaaauuguguugugguuaacccuugaugcuugucuuucuaacacacuauuaauuaugaugauucuaauggauuucauuauaaaaauauuucuggcaugauuuuuaaguuaaaugcuucucuguucuuuaacaugacugauguauaaaaugaugguucuuuacuaagcugauauuuuuuauuguaauuuguuuagguuugucagauagguucauacaaauuucuauguaaaauucuguguuaauggugcuuuuaaaauaauuuaaaaauaacuccauguuuuugccuuagaguaaguuaacuuacuguuuucagauaguagcaugacauauuucugucugugaaagcaaaauuuauuuuaaauuuuauuuccaaauauacauccagagaaaguaauuuguauuuuuuuuaaaguaggcauauuacacaagagggaacaugugaauauguaucuuaauguuguacauauuaaaauuauucauccuaaaaggacccagugggguagccaagagaaaaacuaaggcuaaaguuaaagaacucacuaaagaagagcucaagaaggagaaagagaaaccugagucaaggaaggaaaguaagaaugaagagagaaaaaaggggaagaaagaggauguccgaaaggauaagaaaauugcugaugcagaccuauccaggaaggagucuccuaaggguaaaaaggacagagaaaaagagaaaguggaccuagaaaaaagugcuaaaaccaaggaaaauaggaaaaaaucaacaaauaugaaggauguuucuaguaaaauggcaucccgagacaaagaugacagaaaggaaaguagaaguucuaccagauaugcacacuuaacaaagggaaauacccagaaaagaaacggcuaaagcucuggcaucaucaucccagaacauggucauguuccagauugcaguuuguuacaaaaaagcauggaaaauguaauauugcucugauuggugaggguguguaaauuagccauugaauguaucauuggugcuuagcaaguaaauuaccugaaauuuaaauauaccgucucauacuucuaaauguaaaaacauuuuaaaaaugucauagaauaugauguaauaacuucuauuuauugaucauguauucagauaaauguauauguaucaugaauuuuuauggauuaauauauugaauacuuucauugacguuaaauaagaauauuaagauuuuaaauguuauuucugugcauaaugccuuguaacuuuuucaaguaugcuaaauacucagggagauggauuugcucguuguuuucuucccuccuuccccuuccugcuucccuguuuuucucuuucguggacaccuccccaggcucaugugccaccaccuucccuccucuccagcccucccagcccucccgcagccuuugacuuaaagagagaucuacuucagagccagcagucccgccagaagaggcugagccacacacugagcccgaggagcagguuccuguggaggcagaaccccagaauaucgaagaugaagcaaaagaacaaauucagucccuucuccaugaaaugguacacgcagaacauguugagggagaagacuugcaacaagaagauggacccacaggagaaccacaacaagaggaugaugaguuucuuauggcgacugauguagaugauagauuugagacccuggaaccugaaguaucucaugaagaaaccgagcauaguuaccacguggaagagacaguuucacaagacuguaaucaggauauggaagagaugaugucugagcaggaaaauccagauuccagugaaccaguaguagaagaugaaagauugcaccaugauacagaugauguaacauaccaagucuaugaggaacaagcaguauaugaaccucuagaaaaugaagggauagaaaucacagaaguaacugcucccccugaggauaauccuguagaagauucacagguaauuguagaagaaguaagcauuuuuccuguggaagaacagcaggaaguaccaccagauacuuaaagcuucaaaaagacugccccuaccaccacaggaggaccagccuaaccauacgcuccaaaagauggcugugauagaucuugugaagcaauuacugagcagaucaagaucuuugggaaggaacacuaaagauguuuugaaugaauuauaguccacuggcauuuuaguguauuuuuuuuucuuuuuagaaacacacauuucuaaaaaugucauguuacauuccugcaugucccuuuugauagcauuaguggauccauuggauuucuuuuuucuuuuugugagacagcuuuuagucuuaccugaauuuauguguguuuuuccgacagugguuaauaauuauauuggugauguagcagcaauuguguuggcaggguuuucauauauuauuaguaauuaacacuaacuguuggacugacuuguguacacuguguuaaacaugauuuaaaagcuauuaagaguacuuuguguuagcacucuuaaaaacgcuaacagagaucaucauuagcugugaagauuugaguuguauauaccugcacugauauucuuaucaaaaauuucuacauuagcuuuaaguguucagauuaacacuuuugaaauuuuuguagcuuuuagcugauuaauuagaaaaauuuaauauuucagugaaaguuuuaaauuaucauuuauuuauuuuuuuaaaugagaggggaaagcugaaauuccuuguuaagacacaaggaaaaagaauggcccuacuauuaucaugcaaaaaugcuuuguuggcaccucagauuaaucauauaauagcuauagucucuucagcauuuguuuaaauuuuagaaaaccuguauaaauuacuggugcauaacuuaaagauuauucugccuuuggcuaauugaguaauuccccuccagcacuagagaccgcucagugcucuuacuagaugaacucaguaacgccuugagcuggguugauugaggaugugugaaaagcucacagagcccgaugccugcugcuauuucacggcaaugagccuuuuucuuucuacacugaagauuuucuucuuauuuaaugugguuuauuuugggcucagaaauaauugcucuguugaaaauaauccuuugucagaaaagaagguagcuaccacaucauuuugaaaggaccaugagcaacuauaagcaaagccauaagaagugguuugaucgauauauuagggguagcucuugauuuuguuaacauuaagauaaggugacuuuuucccccugcuuuuaggauuaaaaucaaagauacuucuauauuuuuaucacuauagaucauaguuauuauacaauguagugaguccugcauggguacucgauguguaaugaaaccugaaauaauaagauaauaagaaaagcaauaauuuucuaaagcugugcugucggugauacagagaugauacucaaauuauaauaaaacucuucauuuugugaauuauagaagcuacuuuuuauaaagccauauuuuuuuagggaaacuaaggagugacauagaacugaugaaugaguaaaaguaaguuuugcuggauuuuuguagaacucuggacguugaggauucauuaugcugugguuaacuuuaaauauuuuugaauuccaaauaucugaauuaaugagccuugucuuuacaaauaugugccauugugcaacaucgguggauuuucuaaaaauaauguaaaugucuucuauuaaauguugagugcaauaaaauacagaagaauucucuaaaacaaauagaaaaacagaugauccagaacaaaaagcaaaaguuaagaaaaagaagccuaaacuuuuaaauaaauuugauaagacuauuaaagcugaacuugaugcugcagaaaaacuccguaaaaggggaaaaauugaggaagcagugaaugcauuuaaagaacuaguacgcaaauacccucagaguccacgagcaagauaugggaaggcgcagugugaggaugauuuggcugagaagaggagaaguaaugaggugcuacguggagccaucgagaccuaccaagagguggccagccuaccugaugucccugcagaccugcugaagcugaguuugaagcgucgcucagacaggcaacaauuucuaggucauaugagagguucccugcuuacccugcagagauuaguucaacuauuucccaaugauacuuccuuaaaaaaugaccuuggcgugggauaccucuugauaggagauaaugacaaugcaaagaaaguuuaugaagaggugcugagugugacaccuaaugauggcuuugcuaaaguccauuauggcuucauccugaaggcacagaacaaaauugcugagagcaucccauauuuaaaggaaggaauagaauccggagauccuggcacugaugaugggagauuuuauuuccaccugggggaugccaugcagaggguugggaacaaagaggcauauaagugguaugagcuugggcacaagagaggacacuuugcaucugucuggcaacgcucacucuacaaugugaauggacugaaagcacagccuugguggaccccaaaagaaacgggcuacacagaguuaguaaagucuuuagaaagaaacuggaaguuaauccgagaugaaggccuugcagugauggauaaagccaaaggucucuuccugccugaggaugaaaaccugagggaaaaaggggacuggagccaguucacgcuguggcagcaaggaagaagaaaugaaaaugccugcaaaggagcuccuaaaaccuguaccuuacuagaaaaguuccccgagacaacaggaugcagaagaggacagaucaaauauuccaucaugcaccccgggacucacguguggccgcacacagggcccacaaacugcaggcuccgaaugcaccugggcuuggugauucccaaggaaggcugcaagauucgaugugccaacgagaccaagaccugggaggaaggcaaggugcucaucuuugaugacuccuuugagcacgagguauggcaggaugccucaucuuuccggcugauauucaucguggauguguggcauccggaacugacaccacagcagagacgcagccuuccagcaauuuagcaugaauucaugcaagcuugggaaacucuggagagaggcugccuuucugguuccaucuccuugggugugaggauagaauuucgaacaccaagagucaa

SEQ ID NO: 465 - RNA, 4474 nt, Homo Sapiens
agcuccucccccugcgucucuggccucgccggucuuggggggaugguuccaucauggcgucaaugcagaccacaggaaggaggguggaaguaugguuuccagcugcuaugaauagaaacgacuacagaaagaacuguuggcuuugcaaaaugacccaccuccuggaaugaccuuaaaugagaagaguguucaaaauucaauuacacaguggauuguagacauggaaggugcaccagguaccuuauaugaaggggaaaaauuucaacuucuauuuaaauuuaguagucgauauccuuuugacucuccucaggucauguuuacuggugaaaauauuccuguucauccucauguuuauagcaauggucauaucuguuuauccauucuaacagaagacugguccccagcgcucucaguccaaucaguuugucuuagcauuauuagcaugcuuuccagcugcaaggaaaagagacgaccaccggauaauucuuuuuaugugcgaacauguaacaagaauccaaagaaaacaaaauggugguaucaugaugauacuuguugaugccacuguuaucauccuccuagcagaagauaguccuacugagaaaaugagcacuuugaucauucagucuuugaacuuuaaccuuugacuggaagugaccuauaggcaaugaagacuacuuccuuuuacugcauuuuuacucgugugcauucugggcgcauguugaucgcugguucaguccaggcaacugacaugcuuuuauuagucauacaguauuaaugcaggugucaggaaaugucaaauauaauuccauuuuuuauuuuuauuuuuuuaagcuuuuggaaaagcuccagguccucauguauugugcaauaacaaugacuuccuuggcgguuuugguacguucauugccggcaaugggcguuguaacaggaaaaguuuucauuaacuccugccauucaaugauuaaugcaugauagggccuaugaaaugaacuuacugguuauagugggaauauaaauaaagugagggauccaacauuacuuuaaaagucaccccaacuguuuauauuuggauucuaugcacugugauccuaagguuaacagcaugaauuaacaugcgucuuuaaaggacuguaaugaaagaucauugcauauuuauugaauuguuuauaucuacugucaaguuguuuugacauggaagauuuucaaguaacauuggcagagagguacaguauguuaucccuauggugaaaauaaauuaauuuguuguauauaguuccucaaucucugaaguaaagguaugaguaauauaggguaugaaugguuuaaucaaggcuuuauuuuggaaguaagaaaaauggcagugaugauuaaauugcugcaguccauaauuugggcuuguuauuuguacauuaaagauuuuuuccaaguaaguuacacucuguuaacuuccugcuagccaucagcaugagcccuacugccuaaacacuauuucauuuauuuauguuuggaaaccccguaaacauuuuuguuugcaaucuuguuucuuuuguuauaagucaaguuugaauguuacaauacuuuuauugaaacuuuuguuaaguuuuuucuuguaaauuuucuuuacuugugaguaucaucuuguccuuuaauccuguacccuaaaauaagaaauacauuuuugacagaggcuuaauguuuuaacaaaagaguguggacauuuuuauuuuaaaauuuaggcaaaagucacuaucaaaugguugcuuauuugucucacacagccauauaguuuuuccuggaggguuuuguuuuguuguuguugaaaagacuuugcuuacagcuagaugaaacuuucuauagaaaaaaaaaauuguugaaagguccaguucucaguaccaugugaguuaaugauacuacaacuaaguucuuuuuaaaaagugauuaauguauuuuauaaauuaccuuuucacauaugcaaaaucuguuucuacuacaauguuauuuuuacuaaugccuuauuguugcacucuuuuugaaauauccugcagugaauauaugaaucaauuugggcuuaaaacugaaagccaguuggcugaaagguuugaaauacguaccccaguaaaaccauucaaucaauaauugguaaauaauauuuuaaaauuguuuuuaaucuguauagaugacauuuuguagcuuuguacauguuguuaauuaagggcauauaauuuuacacucaaaguauaauugcugaacucagggguggguagacuucaaaaauaugucugcuauagaaauaacuugaaaaaaaaaauuaaaaccguggccagccaccaaauuguggacacuguuuauauacugcuaguuaacaauuaccacuuuuaaaaaauuauaaccguuuuuguucuaucuugacuagauaaauucucacaaugaucucugucaguuuuauuaguuggccuguuuaaccaagacagaaagucuuugaauuacucauaguuuuaaacugcuuuuaauaugaaaauugcagcuguaaauuauguauuuucauauuuugcguaacugcucuacacuacuguuugacuugaucuucuucuggggguuagggagaaaucugucuccauauugcugguucucuuaccaaaaugcuuuuauaaagaaaugaccggugacauuuauucaccaaaggaauuaauauacugagucaaagauuaacaaugcuauacuauagaguaauaggucauauauagccucaauugaguuuuuuaugacaauauuuuaacauaccucucucucuacauauaaauaccauaaaguaaacuaaaaugacacagaggaaaguagaggaaaaugaaauaauuucgguacaucuuaugguuuaaagaguagaaaauaagaugaaauauccuaaaauauaggagcacagacauuuaaaauucauaaucaggcuaacaacacucucuugaauuuaggaaucauugaaaacuccuugcacuuagauuuaauuuauauguuaguuacauuauuaaaagucauaaggcauuuaucugagucauugcucuacagagagcaauuaauggcuuguaauaauaaaaagaauauuucucuguaaugcauuguugaaagacaaccagaauaucaagaaaauguauauaggaauaugcuacuugccuccucccugcauuuccucguggggcacuauuugcgacauaggccuacagaauuagacuuucauacuuagaagauaagguacacucuucuucuuuuauuuauuuauuuauuuauuuuuaggccauucuucugguuugccaaauucuauuaagacagugauacauuugcuuccuuauuuaugcaugcuuagaucaugaacaugaugcccuucuuuuuuuuuuuuuucuuuggucaaguagggauuaaugccauagguuuagagagaaggauuguuuucaguuuuuaagagaauuuuuuaaaaauacauuuuaugguucucuuaaggaauuaauauucacuucugaaggacuuacuuguaauauauaauuuaucauuuuagccagcagggaaauaaaucauuuuuaauccccagaagaaagugcuggaaauagcuucuauauagucagcaguucaccuggagaaagaucuuaauuccuuguuguuuugacuaggaauaucaauauuugguauaaaauaacuagaauaguuuauuaccuuuucccucaugaaauuuuaaauauaugcaaauauauauaucauuagauuccugugguggauaauaauuucuucagauucuaaaacaggugucuagugacugcuuaauuguuuccaaguugcaucaaagaugaauugguaaauaauggaaaugaguagugauaugaaaaugguuauguaacuacauauuacuuguuucugguaaucaagucuuauuuuuuaaaagccuauuguuuuucagaauugagauauuuaaaacuuguuauaacuucuuccuaaaaauagaagagaagaggagguacuguguguuacaaaaauuuuuuuaaauaaagaauucagugucacuaguucuaaaacugaaaucugccuucauacuaucuauuacggauugaaucauguccuccaauaagauguguugaagucuuaacucccaguaccucaaauugugacccuauuuggaaauagagucauugcagaugucauuaguugaggugagguuauaccgaaguagaauguggccuuaauccaauauaacugguguccuaagaauuggagaagagacucagacacauggggagaagaccaugcagucauggggugauguaucaacaagccagcaaaugccagggauugcugggaacaucagaggcuggaagaggcagggaaauguucuucccuagagcugugggagagaacaugauucugcugacaccuugaucauggacuuccagccuccagaacugugagacaauaaaugucugguuucuuuuaaguc

SEQ ID NO: 466 - RNA, 2269 nt, Homo Sapiens
agcggcagcagaggcagcagcaguagccaccacuccgccgaggccgcaaccccggcucggccuccccaggccccgccgcugccgcagucauggcugcugaugggguggacgaacgcucgccucugcugucagcaucccacuccggaaaugucacucccaccgccccaccguacuugcaagaaagcagccccagagcggagcucccaccuccauauacagccauugccaguccagacgccagugguauuccaguaauaaacugccgugugugccaaucacuaaucaauuuggauggcaagcuucaccagcaugugguuaagugcacaguuugcaaugaagcuacgccaaucaaaaaccccccaacaggcaagaaauauguuagaugcccuuguaauugucuucucauuuguaaggacacaucucggcgaauaggaugcccaagacccaacuguagacggauaauuaaccuuggcccaguaaugcuuauuucugaagaacaaccagcucagccugcauugccaauccaaccagaagguacaagggucgugugugggcacuguggaaacacauuccuguggauggaacugagguucaacacucuggcaaaaugcccacacugcaaaaaaaucuccucaguggguagugcacuuccacgaagacgcugcugugcauauauuaccauuggaaugauauguauuuucauuggaguuggguuaacuguuggcaccccagauuuugcaaggcgauuucgagcaaccuauguuucuugggcaauugcuuaucuccuaggauugaucugccuuauccgagcuuguuauuggggagccauaagagucaguuauccagaacacaguuuugcauaagcuuguuuaugauucaguaaugcaggugagagugucuagcaguucuugguaagcuacucuggacaucuuuaaauuauuuauccuaauggauuccauucugguuuauguauaaucguuucaagacuuugggagucuuuuaugaacaaaugcucauugcacuauauuauaugcaaauuguuuugcugcuagguuuucaaaauuugaauaauaaagccuuuucauguucuuuuacaucucuuauagauauuuuuggauuuguuaccaaacauuacauuuacucucacccuuuuauuauuuuuaaauaaguuauuucauuacuugcugauacaugaguauuccuaaguguuuauaaauauuucuauaauaguuucacauuuauauuuacauuuuaauuaaacaguaucaaaauugcuugcuuaaaaccuaagcaauaugcauuuugcuugaacugcuuacuguaacuuuaaccuaagauuauagugaccuuauucaggaaaaaaaaaaaaauuuaguguaacuucaaagacuugacauucuugucagaggaaaaaaaauuucuagauacuguuugcuuguuuuuuguuguuuguagaaagauaaaauauuuugguaguaauuuaaaauacaagaacgaauauuuauuuguccacaguuggagauguuggauaaaugucuuuucucaaagaucacaggacuuuugucuuucauuuuugccuuuuuauuuaccauuuauaaaagaucuggucuggauuauggaauuuaauguuuaucagcucuauguauuccuuuauagaggcuugaggaaguauuucacauaacauguuuuauaauacuuaaccauuuauccaaagauauauuuacauuggguugugccccuuucccuuagaucaugguaaauuuuucuuauugagguaauuauguacuacuuauauuugaaggaagcuuaugacauuuuacaguagcuaaaauguugagauuagagguacuuuuacuauucuucucaaagguaacugaucagauaauuacccaaauuauucaagaaaauagaucagaaauaaagaacaacauaauuuucuaagaauucauugaaauuuauggaaucagcucucgcacugcccaucuuugcaguuuugaaaaagaaauugcuuaaucacaaauguucuacagucuuuaaauguaguagaauuagacagugagaucaucugaguaaauugauuggugauuccagagauaagacuaauauuuuaaauuauuuaugauacugauuaguauaaaaacguacucaucacagaauuugaagcaaaauacauguacacuucaaagaguaaaugacaaauguauaaaugcuguagcucaggauuauauguaccuuuaaaaauacacuaauaaagauuauuguucaaaaa

SEQ ID NO: 467 - RNA, 348 nt, Homo Sapiens
augacaaagaaaagaaggaacaacggucgugccaaaaagggccgccaccacgcgcagccuauucgccgcacuaacugugcccgaugugugcccaagggcaaggccauuaagaaauucgucauucgaaacauaguggaggccgcagcagucagggacauuucugaagcuagcgucuucgaugccugugugcuucccaagcuguaugugaagcuacauuacugcgugaguugugcaguucaccgcaaaauagucaggaaucgaucucgugaagcccgcaaggaccgaacacccccaccccgauuuagaccugcgggugcugccccacgucccccaucaaagcccauguaa

SEQ ID NO: 468 - RNA, 4354 nt, Homo Sapiens
cuucucacacuuucaggcucugaucgcggccgcaguuuuuccuuuuuucuucugccgucgccuucucugccucuucucauccuuucucgcucugcugcucugcagugugacgaguccgaauccucuucccacccagcccgcgccuuucuucuuuugccugcgcuguucuauuucuccuucggccgccgccgccacugcugcacacagcuggugucggugccgcgcuuuuacccccaagucguucccgcagccuauggcccaggccgccuuggguauuucugcucaagguaaccacaucccucuuuaaaaauuccgccgaaaaagagaagacgcuuuacccgacucuuugggccguuaucucacggcgaacuuucugaccaaguauacaacuacccagagggccuaggagaagugcuguauagagagcaguucgacuucaacgcugagccaccuugggaaccuagcugaugauagggggguuccaucucccaacuuguccauggaggucuucacuucagaaauccaagacucauauucauccagcuuggugucaagugggcuguugcugccagaauuaucuugugauuauuugagagauguaucaguuucuucugaaguacaaucaacuguagaagccuuuguagcaguuuguugcauauucuaaggacccagacauaggcuugguggcccgucucuugucuuuccugguuuaugacuuucggcuuuguggaauacggcugagaugaaaggauuuauugaugaugcaaacuacuccguuggccuguuggaugaaggaacaaaccuuggaaauguuauugauaacuauguuuaugaacauacccugacagggaaaaaugcauuuuuugugggagaucuuggaaagauugugaagaaacacagucaauggcagaauguaguggcucagauaaagccauucuacacagugaagugcaacucugcuccagcuguacuugagauuuuggcagcucuuggaaccggauuugcuuguuccaguaaaaaugaaauggcuuuagugcaagaguuggguguaccuccagaaaacauuauuuacauaaguccuugcaagcaagugucucagauaaaguaugcagcaaaaguuggagugaauauccugacaugugacaaugaaauugaauugaagaaaauugcacguaaucacccaaaugccaaggucuuacuacauauugcaacagaagauaauauuggaggugaagaggguaacaugaaguuuggcacuacccugaagaacuguaggcaucucuuggaaugugcuaaggaacuugauguccaaauaauugggguuaaauuucauguuucgagugcuugcaaagaaucucaaguauauguacaugcucuaucugaugcucgauguguguuugacauggcuggagaaauuggcuuuacgaugaacauguuagacauugguggaggauucacgggaacugaauuucaauuggaagagguuaaucauguuaucagcccucuguuggauaucuacuuuccugaaggaucugguguuaagauaauuucagaacccggaagcuacuaugugucuucugcauuuacacucgcaguuaauaucauagcaaagaaaguuguugaaaaugauaaauuucccucuggaguagaaaaaaccggaagugaugaaccagccuucauguauuauaugaaugaugguguuuaugguucuuuugcaaguaaacugucugaggacuuaaauaccauuccagagguucacaaggcaacuaaauacaaggaagaugagccucuguuuacaagcagccuuugggguccauccugugaugagcuugaucaaauuguggaaagcugucuucuuccugagcugaaugugggagauuggcuuaucuuugauaacaugggagcagauucuuuccaugaaccaucugcuuuuaaugauuuucagaggccagccauuuauuacaugaugucauucagugauugguaugagaugcaagaugcuggaauuacuucagacucaaugaugaagaacuucuucuuugugccuucuugcauucagcugagccaagaagacagcuuuuccgcugaagcuuaaacaggcauuaacgcuucuuuagaucugaaguugcagguuaagcuugucuggucaacauuccaguguggaaaaauaauuuaaacaaucuuauucucuuaauucuuuuggcaacaaaaacuauuaguaauagcuauuugggaccagacaaaaucagcuuucaucuauaauucauuggggauaaugggagauuuagauaauguauccagauuuaaaccuaccaguuuguccuaccccuuaagcguuuaaaauaaaauaugcaacaaaauggaugacuuaguggagauggaagcccauuaauuggguuccccauuaaaucguuuacauacaagaacacaguuuuuauacuaaggauuuguguuuaaagucuuguaaaguucaugucuuucacccagauauaucaaauguuagaagaccagugugacuucauuagauaacguuuaguguauuuagaauguguaaauuugugcuuugaacuguaguuuaauaaauguaaaauugcaucauaguauuuguugaccuaauguaacccuuguaugauugcaauaaaauuuuguguagauuuuacuguuuuuucaggcuaaaacuuugggaaaggggcuagcuagcaaagguaguuuugaaauagauguguauauggacuguuuugaaggguuuuuuucuuuauagcccaguuaaguuuuguuuggcucggugcauuuuucauuuauuuaauuaguaauuuaaguaaaguguuugguaaaucauugugaaguucagauucauuauggagaguugaugugcaguaagcaugauguuuaacaauuuuaacaccaaaaauguuaauccugcauaaaucaacuguaauaauaaauagguguuucuguauagauagaaugcauagaguaccuuaguaaaucuuugaaucacaaucuuuuggcugaaauggaagauucuguuaaauacuuugaauaaacuuggggggagggaaauaaaauugcagaaaacugcagagcacuaaaacuuaaagaagggcuacaucuuuauccagaaaccuguugcucuuuugcacggaauguuuaaauucagaguugggauggggguuggggugaagcacacuuauuaucuucaguugcagugauuucaaauuuaggauuuuuuguuguugguuugaacuguccccuuaguuucuuguuauuuccaauuuguucugcuuagucauuacuuuuaauucuuuucuuacuaaaauuuuauggugguugggggaagggaguuagcaucacuaaccugacaguuguugccaggaauuugcuuuguuuacugcuaguauauuagaaauccuagaucucagaaucacaauaguaauaaacaacaggggucauuuuuuccuaacuuacucuguguucagguguggaauuucugucucccaagaggaaaugugacuucacuuuggugccaauggacagaaaauucuaccugugcuacauaggagaaguuuggaaugcacuuaauagcugguuuuuacaccuugauuucgagguggaaagaaauugaucaugaaucucuaauaaauuuaaaucucuuaaaccaguaggugcuuaauauuuuuugauuugauuaaugcccauuuaaaucucauggguucuauuaaaaauauauauauauagggccccaauccauugccaucaaauugcccuuggacuuuuccaagguauauuaugggguuuuaugcaaaauuccaagcuaccauguaacuuuuuuuaaccauuuaacaaggagggggaacuguuuccuaccuucuuuacauguugugcauuguugugguccagaaaugccaaaccuuuuuaaagauggugcaacuuugaguccuuggcuugacuauacaggccuugaacuucauggcauaucaacuuugccauaucugcaggagagcuguucuauaagaaauagcucagaguugcaaauaucacaugugaaugauacgguaacuuuuaagaaaugucuguauuguauuugaagacuguuugccauaaaucugaaauuugaaccuauguauuucaauuugguaugcuaaaaaguucugaauuaauguaaaguuuuuuguuauaauauuguaaucucaguucaaaaguuaacugcaaauauaaaacccaaugauuucuauauaguaaauugaacuguaaagguaacuugugugugauucugaauacauagauaaauguuuuuauuccucauguuuuacuuuggcuucuaucugaaauagagguaaaauuuuacauauca

SEQ ID NO: 469 - RNA, 127 nt, Homo Sapiens
aggauauaucaaagagacuuucuggggcugggaaaccaggaucucguaaugcuaugaccaaagauugaaguuuugcauaggauaccguagucacucaguagugcuguuuuccugaggaaauacaaga

SEQ ID NO: 470 - RNA, 2655 nt, Homo Sapiens
ugucuuuuucugcuauucugucucccuuuuccucuuugucucaaauuccuuacauuuacagaaucuugacuuugauagucaagaucuuguucaagacuuggcacuugaucuuuuuguaaaccuaguauuauguuauggucaagugggaagcaugaauuuaaauguaguauuuaaaagauuacuuggucuuggcuuuccaaucugugggaguguuuggaucauuuuauacacacacacacacacacacacacacacacacaccuuuuuuuuuuuuuugauaugaggucuuacccugucacccagacuagagugcaguggcgcaaucuuagcucacugcaaccucugccuaccuggcucaagggauccucccaccucagccuccagaguagcugggacuacaggcacaugccaccaagcccagcuaauuuuucauauuuuugguagagaugggguuucacucuguugcccaggcuggucucaaacuccugagcucaagugauccacccaccuuggccuuccaaagugcugggauuacaggugugagcuacugcaccugguacauuauuauaauuuaauaauagugacaggaaaagguaaaaauugcaagcaacaauaauaaccaauaaugcagaaauacauauaaaauguuaacuguaaaggcagauauuguugccuauaucagccaauguagaucuucugguuuuauacuuacugguauacuauaaaugaaauuuagugacagcauacuguauaccaaacuagaguuuacccauuguuauuucuuauuuagauuuuuagauacauugucuuuugauucuaacauuggcauuaucuuaauuuaaucucuguauauuuuucuucuuuuuggaaauaugcguuuguaaaagcuuaccuuauaagcuacuauggugaccuuggccuaucagauggguguucucuuaaaccguuuuauacugcuuuauaccagacucaaaauugccaacauaguuaucugcuaauucucaauaacuuaaagccacauuauuuuugcuagaguaauuaguacuacauuguuuauuucuagaugcacuuuaauauucaugucaccagaguaauuuaguuuuacuguuuuauuaaucugauugauuaagucuaucccaauaugucucugcaguugggugacccaauaugucucugcaguugggugacccaauaugucucugcaguugggugacuacagaaauaauucaugcagauuaccucgcuauuuguaucauauuauauacaaaugacauacucuagugcauuugaaauguaauuuaauggaaucuuguaguuuacaaaauuaagauugucuuuaaaguaaaucauuauuccuuuaauuuacuccucucaugaccccuguaacuguuuuucacuucaguucaacauacauuuaugccuugccuccuguauaccagccaguaggugcugggguugcaaaauaacuaagauacaacccauacaugcuggaagcucucaaucuaguaggagaggauagacacgaaagcucauaauuuuguuuuguuuuguuuuugagacagggucagucucugucgcccaggcuggagugcagcggcaugaucucagcucacugcagcuuugaccucccaggcugaagugacccuuucaccucaguacccaaaaguagcuggaauuacaggugcccaccugccagaaaacucaguuuuacuuaaauuauuuauuuucaacguguagcucaugaagauacuaacuuuaaauggcagggaguagauugagaaucaucauggaagaccuuuuuuuuuuuuucuugagauggagucucacuccgucacccaagcuggagugcaauggcaugaucuuggcucacugcauucuccacuucuggguucaagugauucuccuaccucagccucccgaguagcugggauuacaggcaugcagcaccacacccagcuaauuuuuuuauuuuuaguagagaugggguuucaccauguuggccaggcuggucuaaaacuccugaccucaggugauccaccugccucagccucccaaagugcugggauuacaggugugggccaccacaccuggcccaucauggaagacuuucugauggugauguuugaauuggguuuuggagagugaauuagaauguuuugaacuaauacaguaaaggacaguagaaagaaggaacaacauggacagagaccuuaaggcaugaaaugucauucuguauucaguuagacguuuagucuugauagaaggauuuuuuccuuagaacagauuacaccuauaugauaagauuuuauuuuguuuuuauuuaauaauaguucaguuaaaauauaagcccaaaauugcuccauaaaauuuggcagcaguuaugcuauugacagcauauaaaaagcacucaaucgagcuaggugcaguggcucauggcuguaauuccagcacuuugggaggccacagcaaaaggaucacuugauucaaggaauuugagaccagucugggcaacauggcaagacucuaucuguaugaaaaaaaaaauuuuuuaauuagcugggaauagugaugugugcccuugcagugagcugugauuugcucuacugcacuccaccuugaguagcagagugaaacugucuuugaaaaaaaaaaaaa

SEQ ID NO: 471 - RNA, 1337 nt, Homo Sapiens
gcgggcagccggagcgcacccggccggaagccgcugucggggagccggcgguggggcuggacgcagcaggugcaacugacaugggugaaccccagggauccaugcggauucuagugacagggggcucugggcugguaggcaaagccauccagaaggugguagcagauggagcuggacuuccuggagaggacuggguguuugucuccucuaaagacgccgaucucacggauacagcacagacccgcgcccuguuugagaagguccaacccacacacgucauccaucuugcugcaaugguggggggccuguuccggaauaucaaauacaauuuggacuucuggaggaaaaacgugcacaugaacgacaacguccugcacucggccuuugaggugggcgcccgcaaggugguguccugccuguccaccuguaucuucccugacaagacgaccuacccgauagaugagaccaugauccacaaugggccuccccacaacagcaauuuuggguacucguaugccaagaggaugaucgacgugcagaacagggccuacuuccagcaguacggcugcaccuucaccgcugucauccccaccaacgucuucgggccccacgacaacuucaacaucgaggauggccacgugcugccuggccucauccacaaggugcaccuggccaagagcagcggcucggcccugacggugugggguacagggaauccgcggaggcaguucauauacucgcuggaccuggcccagcucuuuaucuggguccugcgggaguacaaugaaguggagcccaucauccucuccgugggcgaggaagaugaggucuccaucaaggaggcagccgaggcggugguggaggccauggacuuccauggggaagucaccuuugauacaaccaagucggaugggcaguuuaagaagacagccaguaacagcaagcugaggaccuaccugcccgacuuccgguucacacccuucaagcaggcggugaaggagaccugugcuugguucacugacaacuacgagcaggcccggaagugaagcuggaagacaggaucaggugccagcggaccaucggcuggcagagcccagcggccaccacccgucaacccugccaggagcugagggcaccacccagcaaccugggccugcauuccauccgcucugcagccccaagcaucuuuccaguggggcccccauucacguugguccucagggaaaccagggucccgggcaggcccggcgcuuugcuccccacaccagcccccugcgcguguccacucugauccugcaucccacucccugggagccaauaaagugcauuuucacagg

SEQ ID NO: 472 - RNA, 1066 nt, Homo Sapiens
cgcugaccgagcgcaccccgcccccggcgccaucuucccgaccgcgagccguccagccaggucucagugcugugccccccccagagccuagaggauguuucaugggaucccagccacgccgggcauaggagccccugggaacaagccggagcuguaugaggaagugaaguuguacaagaacgcccgggagagggagaaguacgacaacauggcagagcuguuugcgguggugaagacaaugcaagcccuggagaaggccuacaucaaggacugugucucccccagcgaguacacugcagccugcucccggcuccugguccaauacaaagcugccuucaggcagguccagggcucagaaaucagcucuauugacgaauucugccgcaaguuccgccuggacugcccgcuggccauggagcggaucaaggaggaccggcccaucaccaucaaggacgacaagggcaaccucaaccgcugcaucgcagacguggucucgcucuucaucacggucauggacaagcugcgccuggagauccgcgccauggaugagauccagcccgaccugcgagagcugauggagaccaugcaccgcaugagccaccucccacccgacuuugagggccgccagacggucagccaguggugggugucccucccagccaggcagagccccgcagugcccgagacccucccagccaggcggagccccgcagugccccugaggcccucagcccccacaugcccugugcugcacucccaggcugcagacccugagcggcaugucggcgucagaugagcuggacgacucacaggugcgucagaugcuguucgaccuggagucagccuacaacgccuucaaccgcuuccugcaugccugagcccggggcacuagcccuugcacagaagggcagagucugaggcgauggcuccugguccccuguccgccacacaggccguggucauccacacaacucacugucugcagcugccugucuggugucugucuuuggugucagaacuuugggggccgggccccuccccacaauaaagaugcucuccgaccuuc

SEQ ID NO: 473 - RNA, 5285 nt, Homo Sapiens
cugcaggaaggagagaggaagaggagcagaagggggcagcagcggacgccgcuaacggccucccucggcgcugacaggcugggccggcgcccggcucgcuuggguguucgcgucgccacuucggcuucucggccggucgggccccucggcccgggcuugcggcgcgcgucggggcugagggcugcugcggcgcagggagaggccugguccucgcugccgagggaugugagugggagcugagcccacacuggagggcccccgagggcccagccuggaggucguucagagccgugcccgucccggggcuucgcagaccuugacccgccggguaggagccgccccugcgggcucgagggcgcgcucuggucgcccgaucuguguagccgguuucagaagcaggcaacaggaacaagaugugaacuguuucucuucugcagaaaaagaggcucuuccuccuccucccgcgacggcaaauguucugaaaaagacucugcaugggaauggccugccuuacgaugacagaaauggagggaacauccaccucuucuauauaucagaauggugauauuucuggaaaugccaauucuaugaagcaaauagauccaguucuucagguguaucuuuaccauucccuugggaaaucugaggcagauuaucugaccuuuccaucuggggaguauguugcagaagaaaucuguauugcugcuucuaaagcuugugguaucacaccuguguaucauaauauguuugcuuuaaugagugaaacagaaaggaucugguauccacccaaccaugucuuccauauagaugagucaaccaggcauaauguacucuacagaauaagauuuuacuuuccucguugguauugcaguggcagcaacagagccuaucggcauggaauaucucgaggugcugaagcuccucuucuugaugacuuugucaugucuuaccucuuugcucaguggcggcaugauuuugugcacggauggauaaaaguaccugugacucaugaaacacaggaagaaugucuugggauggcaguguuagauaugaugagaauagccaaagaaaacgaucaaaccccacuggccaucuauaacucuaucagcuacaagacauucuuaccaaaauguauucgagcaaagauccaagacuaucauauuuugacaaggaagcgaauaagguacagauuucgcagauuuauucagcaauucagccaaugcaaagccacugccagaaacuugaaacuuaaguaucuuauaaaucuggaaacucugcagucugccuucuacacagagaaauuugaaguaaaagaaccuggaagugguccuucaggugaggagauuuuugcaaccauuauaauaacuggaaacgguggaauucaguggucaagagggaaacauaaagaaagugagacacugacagaacaggauuuacaguuauauugcgauuuuccuaauauuauugaugucaguauuaagcaagcaaaccaagaggguucaaaugaaagccgaguuguaacuauccauaagcaagaugguaaaaaucuggaaauugaacuuagcucauuaagggaagcuuugucuuucgugucauuaauugauggauauuauagauuaacugcagaugcacaucauuaccucuguaaagaaguagcaccuccagccgugcuugaaaauauacaaagcaacugucauggcccaauuucgauggauuuugccauuaguaaacugaagaaagcagguaaucagacuggacuguauguacuucgaugcaguccuaaggacuuuaauaaauauuuuuugacuuuugcugucgagcgagaaaaugucauugaauauaaacacuguuugauuacaaaaaaugagaaugaagaguacaaccucagugggacaaagaagaacuucagcagucuuaaagaucuuuugaauuguuaccagauggaaacuguucgcucagacaauauaauuuuccaguuuacuaaaugcugucccccaaagccaaaagauaaaucaaaccuucuagucuucagaacgaaugguguuucugauguaccaaccucaccaacauuacagaggccuacucauaugaaccaaaugguguuucacaaaaucagaaaugaagauuugauauuuaaugaaagccuuggccaaggcacuuuuacaaagauuuuuaaaggcguacgaagagaaguaggagacuacggucaacugcaugaaacagaaguucuuuuaaaaguucuggauaaagcacacagaaacuauucagagucuuucuuugaagcagcaaguaugaugagcaagcuuucucacaagcauuugguuuuaaauuauggaguaugugucuguggagacgagaauauucugguucaggaguuuguaaaauuuggaucacuagauacauaucugaaaaagaauaaaaauuguauaaauauauuauggaaacuugaaguugcuaaacaguuggcaugggccaugcauuuucuagaagaaaacacccuuauucaugggaauguaugugccaaaaauauucugcuuaucagagaagaagacaggaagacaggaaauccuccuuucaucaaacuuagugauccuggcauuaguauuacaguuuugccaaaggacauucuucaggagagaauaccauggguaccaccugaaugcauugaaaauccuaaaaauuuaaauuuggcaacagacaaauggaguuuugguaccacuuugugggaaaucugcaguggaggagauaaaccucuaagugcucuggauucucaaagaaagcuacaauuuuaugaagauaggcaucagcuuccugcaccaaagugggcagaauuagcaaaccuuauaaauaauuguauggauuaugaaccagauuucaggccuucuuucagagccaucauacgagaucuuaacaguuuguuuacuccagauuaugaacuauuaacagaaaaugacauguuaccaaauaugaggauaggugcccugggguuuucuggugccuuugaagaccgggauccuacacaguuugaagagagacauuugaaauuucuacagcaacuuggcaaggguaauuuugggaguguggagaugugccgguaugacccucuacaggacaacacuggggagguggucgcuguaaaaaagcuucagcauaguacugaagagcaccuaagagacuuugaaagggaaauugaaauccugaaaucccuacagcaugacaacauuguaaaguacaagggagugugcuacagugcuggucggcguaaucuaaaauuaauuauggaauauuuaccauauggaaguuuacgagacuaucuucaaaaacauaaagaacggauagaucacauaaaacuucugcaguacacaucucagauaugcaaggguauggaguaucuugguacaaaaagguauauccacagggaucuggcaacgagaaauauauugguggagaacgagaacagaguuaaaauuggagauuuuggguuaaccaaagucuugccacaagacaaagaauacuauaaaguaaaagaaccuggugaaagucccauauucugguaugcuccagaaucacugacagagagcaaguuuucuguggccucagauguuuggagcuuuggagugguucuguaugaacuuuucacauacauugagaagaguaaaaguccaccagcggaauuuaugcguaugauuggcaaugacaaacaaggacagaugaucguguuccauuugauagaacuuuugaagaauaauggaagauuaccaagaccagauggaugcccagaugagaucuauaugaucaugacagaaugcuggaacaauaauguaaaucaacgccccuccuuuagggaucuagcucuucgaguggaucaaauaagggauaacauggcuggaugaaagaaaugaccuucauucugagaccaaaguagauuuacagaacaaaguuuuauauuucacauugcuguggacuauuauuacauauaucauuauuauauaaaucaugaugcuagccagcaaagaugugaaaauaucugcucaaaacuuucaaaguuuaguaaguuuuucuucaugaggccaccaguaaaagacauuaaugagaauuccuuagcaaggauuuuguaagaaguuucuuaaacauugucaguuaacaucacucuugucuggcaaaagaaaaaaaauagacuuuuucaacucagcuuuuugagaccugaaaaaauuauuauguaaauuuugcaauguuaaagaugcacagaauauguauguauaguuuuuaccacaguggauguauaauaccuuggcaucuugugugauguuuuacacacaugagggcugguguucauuaauacuguuuucuaauuuuuccauaguuaaucuauaauuaauuacuucacuauacaaacaaauuaagauguucagauaauugaauaaguaccuuuguguccuuguucauuuauaucgcuggccagcauuauaagcagguguauacuuuuagcuuguaguuccauguacuguaaauauuuuucacauaaagggaacaaaugucuaguuuuauuuguauaggaaauuucccugacccuaaauaauacauuuugaaaugaaacaagcuuacaaagauauaaucuauuuuauuaugguuucccuuguaucuauuuguggugaauguguuuuuuaaauggaacuaucuccaaauuuuucuaagacuacuaugaacaguuuucuuuuaaaauuuugagauuaagaaugccaggaauauugucauccuuugagcugcugacugccaauaacauucuucgaucucugggauuuaugcucaugaacuaaauuuaagcuuaagccauaaaauagauuagauuguuuuuuaaaaauggauagcucauuaagaagugcagcagguuaagaauuuuuuccuaaagacuguauauuugagggguuucagaauuuugcauugcagucauagaagagauuuauuuccuuuuuagaggggaaaugagguaaauaaguaaaaaaguaugcuuguuaauuuuauucaagaaugccaguagaaaauucauaacguguaucuuuaagaaaaaugagcauacaucuuaaaucuuuucaauuaaguauaagggguuguucguuguugucauuuguuauagugcuacuccacuuuagacaccauagcuaaaauaaaauaugguggguuuuguguguguguguguguguguguguguguguguguguguguuauuuauacaaaacuuaaaauacuugcuguuuugauuaaaaagaaaauaguuucuuacuuua

SEQ ID NO: 474 - RNA, 112 nt, Homo Sapiens
ggcggauccaaagguagugaguuaucucaauugauuguucacagucaguuacagaucaaacuccuuguucuaugcuuuccccucuucccauuacugcacuaagaauaaauaa

SEQ ID NO: 475 - RNA, 69 nt, Homo Sapiens
aagagcuuagcuuaauuaaagugguugauuuguguucaauugaugcagaauagagucuugcaguccuua

SEQ ID NO: 476 - RNA, 1465 nt, Homo Sapiens
cucuccgcucccgugaguaacuuggcuccgggggcuccgcucgccugcccgcacgccgcccgccacccaggaccgcgccgccggccuccgccgcuagcaaacccuuccgacggcccucgcugcgcaagccgggacgccucuccccccuccgcccccgccgcggaaaguuaaguuugaagaggggggaagaggggaacauggacaugaagaggaggauccaccuggagcugaggaaccggaccccggcagcuguucgagaacuugucuuggacaauugcaaaucaaaugauggaaaaauugagggcuuaacagcugaauuugugaacuuagaguuccucaguuuaauaaauguaggcuugaucucaguuucaaaucuccccaagcugccuaaauugaaaaagcuugaacucagugaaaauagaaucuuuggaggucuggacauguuagcugaaaaacuuccaaaucucacacaucuaaacuuaaguggaaauaaacugaaagauaucagcaccuuggaaccuuugaaaaaguuagaaugucugaaaagccuggaccucuuuaacugugagguuaccaaccugaaugacuaccgagagagugucuucaagcuccugccccagcuuaccuacuuggauggcuaugaccgagaggaccaggaagcaccugacucagaugccgagguggaugguguggaugaagaggaggaggacgaagaaggagaagaugaggaagacgaggacgaugaggauggugaagaagaggaguuugaugaagaagaugaugaagaugaagauguagaaggggaugaggacgacgaugaagucagugaggaggaagaagaauuuggacuugaugaagaagaugaagaugaggaugaggaugaagaggaggaagaaggugggaaaggugaaaagaggaagagagaaacagaugaugaaggagaagaugauuaagaccccagaugaccugcagaaacagaacuguucaguauugguuggacugcucauggauuuuguagcuguuuaaaaaaaaaaaaaagguagcugugauacaaaccccaggacacccacccacccaaagagccaaagaauaguuccugugacauuccgccuuccuuccauguagucccucuugguaaucuaccaccaagcuuguggacuucaccccaacaaaauuguaagcguuguuagguuuuuguguaagauucuugcuguagcguggauagcugugauuggugagucaaccgucuguggcuaccaguuacacugagauuguaacagcauuuuuacuuucuguacaacaaaaaagcuuuguaaauaaaaucuuaacauuuugggucuguuuuuucaugcuuugcuuuuuaauuauuauuauuauuuuuuuuacauuaggacauuuuaugugacaacugccaaaaaaguauuuuuaagaauuuaagcgaaauaaacaguuacucuuugguaaa

SEQ ID NO: 477 - RNA, 3946 nt, Homo Sapiens
ggaaguucugccuugucuccgccgcgggucaggggugagagcuggaaucucugcacgggccuuggaaaacgacugucuucuucugccaaaaugucaggaauuggaaauaaaagagcagcuggagaaccuggcaccuccaugccuccugagaagaaggcagcuguugaagauucagggaccacaguggaaacaauuaagcuaggaggugucucuucaacggaggaacuagacauuagaacacugcaaaccaaaaaucgcaagcuggcagaaauguuggaucagcggcaggccauugaagaugaacuucgugagcacauugaaaaacuggaacgacgacaggccacugaugaugccucacuauugauugucaaccgauacuggagucaguuugaugaaaacauccguaucauccuuaaacguuaugaucuggagcagggcuugggagaccuacucacagaacgaaaagcccuuguugugccugaaccagaaccagacucugauagcaaucaggagcguaaagaugaccgagagagaggcaagugggaagggcaagagccagcuuucucuuuccuugcuacuuuggccagcaguuccagugaagagauggagucucagcugcaggaacguguggagucuucccgccgagccgugucccagauugugacuguuuaugauaaauugcaagaaaaaguggagcucuuaucccggaagcuaaacaguggagauaaucugauaguggaggaagcagugcaggagcugaacucuuuccucgcacaggagaauaugaggcuacaggaauugacagaucuucuucaggaaaagcaucgcaccaugucucaggaguucuccaaguugcagaguaaaguggagacagccgaaucacgagugucuguccuggaguccaugauugaugaccugcagugggauauugacaaaauucgaaagagggaacagcgacucaaccgacacuuagcagaaguccuagaacgggugaauuccaaagguuauaagguguauggagcggggagcagucuguauggcggcacaaucacuaucaaugcucggaaguuugaggaaaugaaugcagagcuugaggagaacaaagaguuggcucagaaccgucucugugagcuggagaaacuucggcaagacuuugaggaggucacuacacaaaaugaaaagcugaagguggaauugcggagugcaguggagcaagucguuaaggaaacuccagaauaucgcugcaugcagucacaguucuccgucuuguauaaugagagccuacaguugaaagcacacuuggaugaggcucggacccugcuucauggcaccagaggaacccaccagcaccagguugagcuuauugagcgagaugagguuagucuucauaagaagcugaggacugaaguaauucagcuagaagauacauuggcccagguccgcaaggaguaugaaaugcugaggauagaauuugagcagacccuugcugccaaugaacaagcaggcccuauaaacagggagaugcgccaccucaucaguagccuccagaaucacaaucaccagcugaaaggggagguccugagauauaagcggaaauugagagaagcccagucugaccugaacaagacacgccugcguagugguagugcccuccugcagucccagucuaguacugaggacccgaaggaugagccugcggagcuaaaaccagauucugaggacuuauccucccaguccucagcuucaaaggcaucucaggaggaugccaaugaaaucaagucuaaacgggaugaagaagaacgagaacgagaaaggagggagaaggagagggaacgagaaagagaacgggagaaggagaaggagagagaacgagagaagcagaagcuaaaagagucagaaaaagagagagauucugcuaaggauaaagagaaaggcaaacaugaugauggacggaaaaaggaagcagaaauuaucaaacaauugaagauugaacucaagaaggcacaggagagccaaaaggagaugaaacuauugcuggauauguaccguucugccccaaaggaacagagagacaaaguucagcugauggcagcugagaagaagucuaaggcagaguuggaagaucuaaggcaaagacucaaggaucuggaagauaaagagaagaaagagaacaagaaaauggcugaugaggaugccuugaggaagauccgggcaguggaggagcagauagaauaccuacagaagaagcuagccauggccaagcaggaagaagaagcacuccucucugaaauggaugucacaggccaggccuuugaagacaugcaggagcaaaauauccguuugaugcagcaauugcgggagaaggaugaugcaaauuucaagcucaugucagagcguaucaaguccaaucagauccauaaguugcuuaaagaagagaaggaggagcuggcagaccagguguugacucugaagacucagguugaugcccagcuacagguaguaaggaaacuggaagagaaggagcaucuguuacagagcaacauuggcacaggggagaaagagcugggucuuaggacccaagccuuagagaugaauaaacgcaaggcaauggaggcagcccagcuugcagaugaccucaaagcacaacuggaguuggcucagaagaagcuacaugauuuucaggaugagaucguggagaacaguguuaccaaagaaaaggacauguucaauuucaaacgagcccaggaggacaucucuagacuucgcaggaagcuggagaccacaaagaaaccagacaauguacccaagugugaugagauucugauggaagagauuaaggauuacaaggcacgcuugaccuguccgugcuguaacaugcguaaaaaggaugcuguucuuacuaaguguuuucaugucuucugcuuugagugugugaagacacgcuaugacacccgccagcgcaaaugucccaaguguaaugcugcuuuuggugccaaugauuuucaucgcaucuacauugguugaucuaagucaagagaagaagaggagcuggcuagucaggaacuuauucauuaaccaccaaaccucuaccucuucucuccuugacugucaccuguaggacaguuuaucagucaacuaccuuuccuccagacuuuacuuccaggcucuccucuucaguagcuggaugacuuuagcagaaaggacugguaaauacaagccuuggguuucagaaugaauuagaaacaaauaacucuuacugucuucccucccagcuuuguuuauuuugugcuuuuagacuuuucaguguuuucuuuuuccagcccacuguauaaacuuggauuguccauuccuccugaagaaaucaaguugguauuuuugauguggaaaagggaacaaaaguggaaacauggcuacuuuuggggagugauauuuuaaaaaauaaguugucuaugggcacaaaguuuucuucauuuguguagcaaacuucuugugaauguggauuacaaaaugguauaauugugcuacucuccccugggugguuugcagcccuaaugaaauuaugucuaggaugauucagucuauuucccauuuacuagcagaguaacuuguuaagaucagcuggcuuucuuguuaaaguuauuuaaguuuugaaugcucuacuacuucaagucuuuaaauuucuugagacuagaauaauuuuaaauaauaugacccuuugucuucuaaugaaauaaagauugaagagguugagucaggacugagcuggugaagaaaucuuguggguauucuggaaauuugauacggagagaacuuggugagcuaugaauuacucucagucuccuuuuuacaggguuguugugaucccucuuuuccagaaaauucuguggaauguuucuguaggacuuuguucuccacaagcuugaauuaaagcaggauucaguuugca

SEQ ID NO: 478 - RNA, 107 nt, Homo Sapiens
gugcucacuuuggcagcauauacacuaaaauuggaacaauacagagaagauuagcauugucccugagcaagcaugacacacaaauucaugaagcauuucauauuuuu

SEQ ID NO: 479 - RNA, 3225 nt, Homo Sapiens
aggggcggggauaaaugcggagggacgguccagcuuuagcucucugcucgccgccgccgcugucgccgccaccuccucugaucuacgaaagucauguuacccaacaccggcuuccuaaauuaaagaggcuggcaggauguacaguuuuuaucacaggugcaagccguggcauuggcaaagcuauugcauugaaagcagcaaaggauggagcaaauauuguuauugcugcaaagaccgcccagccacauccaaaacuucuaggcacaaucuauacugcugcugaagaaauugaagcaguuggaggaaaggccuugccauguauuguugaugugagagaugaacagcagaucagugcugcaguggagaaagccaucaagaaauuuggaggaauugauauucugguaaauaaugccagugccauuaguuugaccaauacauuggacacaccuaccaagagauuggaucugaugaugaacgugaacaccagaggcaccuaccuugcaucuaaagcauguauuccuuauuugaaaaagagcaaaguugcucauauccucaauaucaguccaccacugaaccuaaauccaguuugguucaaacagcacugugcuuauaccauugcuaaguaugguaugucuauguaugugcuuggaauggcagaagaauuuaaaggugaaauugcagucaaugcauuauggccuaaaacagccauacacacugcugcuauggauaugcugggaggaccugguaucgaaagccaguguagaaaaguugauaucauugcagaugcagcauauuccauuuuccaaaagccaaaaaguuuuacuggcaacuuugucauugaugaaaauaucuuaaaagaagaaggaauagaaaauuuugacguuuaugcaauuaaaccaggucauccuuugcaaccagauuucuucuuagaugaauacccagaagcaguuagcaagaaaguggaaucaacuggugcuguuccagaauucaaagaagagaaacugcagcugcaaccaaaaccacguucuggagcuguggaagaaacauuuagaauuguuaaggacucucucagugaugauguuguuaaagccacucaagcaaucuaucuguuugaacucuccggugaagaugguggcacgugguuucuugaucugaaaagcaagggugggaaugucggauauggagagccuucugaucaggcagauguggugaugaguaugacuacugaugacuuuguaaaaauguuuucagggaaacuaaaaccaacaauggcauucaugucagggaaauugaagauuaaagguaacauggcccuagcaaucaaauuggagaagcuaaugaaucagaugaaugccagacugugaaggaaaauauaaaaaaaaagucgacugcuaugcucaaaaaguaaaaaaagcucaacaguuaaaaucuaauguuuguuuucuuuccuguuauauuauaaggauaugcacguuuguucuggaaaagauagaauuugucucuaaaagacuugaaauuguaauuaaaauggcaagcuaaucaaacauaagcuucauuaagugggauucuaagacagucuguguuuuuauauuucaaggguuuaacccuuugagccuuacaucucauucacugucuuucuccaagaaaaguauuuugggcggacagucagaucaagcaguaaaauuagcucuuucaaaucuucuugucauguaaaaugaagcuagucuguuuuaaaauuuuuaguuuuggauuguauacuaaugaaaaucuuaaugauguuuuugauuuuuauauacuuauuuuaaagaaaaucuuauauaguacauuuuacaaaaauuauaaaaaaugaauuaguacuggcgaggacuaaaugaaacaauaauuuuucauuuugauaacuagcuuuccagguggacuuagccauaggaaaauauuacuaauguaauuuaacaaauugcugcauguauuccauuuaaaaauauguuuaaauuguccuaaaacaaaauaauuuucucccuaggaguaugcauuuggcuacaguguuuugaaacagaaaccuuagaauaggucauugguaugggcugaacuguguaucccccaauucauuuguugagguccuaacucccauuucuuuugaaugugacuguucggagaugaggccuuuaaagaggugacuuaaguucaaaggaggcuguuagucuaauccaacaugguguccuuuggacauaagagauaccagcaaugugugcacagaacaaagaccaggagaggacacagugagaaggcaguuaucugcaagcaaagagagaggcuucagaagaaacaaaaucaccagcaccuugaucuuugacuucuaaucuccagaauagugagaaauaaauuucuguuguuaagccguccacugugggaggccgacgcaggaggauugcuugaggccaggaguucaaggccagccuggacaacauaguaagacccuaucucuaccccccuaauaaauuaauuuaaaaagccccccaaucugugguauuuuauuauggcagcccuagcaagcuaauacagugguuugagaggcugggaggguugaggggaagauaaacuuuuaaaaagcucuuaucuuucauuucaaucaguuaaaaauacuugcucaguguaacaauuuugcuucucagcuuccacucuaauauuguugugccauuaagcaauuuagcuaauccugacauuucuuagauucauaauguuaggagcauuuaaucuguauuuuacaaguuaggaagcagaggaucagagaugggaaaggacuagcccaaggccaacauuaacaagcccucuaacaaaaacuuuacaauacauuuauguugaauggaacuccaagaucucaccucuccauccaggaauggaguccauguaaucaaagugaacuuaaaaauaggacaguuucaacaagucaggagauucacagcaacugaucaaagggaguccagucaacgugagcaagcgugauuaugaugaggaagcccccucugcuuuaauccacacaaggaacguaaccugaaguaaccugauguuaaccaaucugcugugucuacuaugcuguuuccuuguuccugcuagugcugcuuuacaaaugcagaccauucuaucauaccuggcggggcuucuguuuuauuuuguaggcuggaugcuacccaguucaugaaucgcuaauaaaagccaauuagaucuuua

SEQ ID NO: 480 - RNA, 6164 nt, Homo Sapiens
ggcggaggggggacagggcgguuugggaggcccaggcggcggagccuccgggacggcgagcggcgggcggcggaggaggagacggcaggucgggcauuaaaaaauauuuaaucauucauguguugagacucauucuugaguuauggaugacaaggcuucuguuggaaaaaucagugucucuucagacucaguaucuacucuuaauagugaagauuuugucuugguuuccaggcaaggagaugagacaccaucuacaaauaauggaagugaugaugagaaaacaggacucaagauuguagggaauggaagugaacagcagcugcaaaaagagcuagcagauguacugauggauccuccaauggacgaccagccaggggaaaaggagcuugugaaaaggucacaacuggauggugaaggagaugggccucuuucuaaucagcucuccgcuucauccaccauuaacccugugccauuaguagggcuccaaaaaccagagaugagccuaccagugaaaccuggacaaggagauucugaagcuucaaguccuuucacaccaguggccgaugaggacagcguaguuuucaguaaacugacuuacuuaggcugugccucgguaaaugcucccaggagugaaguggaagccuuaaggaugauguccaucuuaagaagccagugucagauuucacuagauguuacccuuucagugccgaaugugucugaaggaauugugagacucuuagauccucagacaaacacugaaauagcaaacuacccuaucuacaaaauccucuucugugucagagggcaugauggaacuccugagagugacuguuuugcuuucacugaaagucauuacaaugcagagcucuucagaauacacgucuuccggugugaaauacaagaagcuguaaguccucaagagaaaacucucugcaaaugaaacuucaccagugcccucacuagguugaaaugauuaugguauuuauuaugaucacucauaagccagaugaaauucucugcuauuguuuuagugauucuagccucaugggccaaaauauaaauuaacuaaaaauuugauuaacuagaacuuuguuacuacuacuaagaaugucagaggagaucuguuggcuacuuuugauuggguuaaguaggcauucugguucuaacauugacagauuugcaaaccauucuuuuaaaucaaaacuuguuaggacuguuuucauuguaauaucuucagauaguuucuaacaauuuaggaagugauuuuuaaauuggauuuauagugcuuacaaccauuucuuuuuuaaaaccccuugucuggacauuuuuaguguugcuugcuuuauaggccuaacaaauuagguaauuuaccaaaagaaauaagugggauaaagauaauuauugcccuccaaaguagguaaucuuccagccuuaauaaagguauuuuauaucuuuugauaacagcccauuuccuaacaugucugguuguagguaagccggauacuuuacaguuuugccacugccuuccgccguucugccaagcagaccccacuuucagccacugcugcaccccagacuccugacagugacaucuuuaccuucucugugucuuuagaaauaaaagaagaugaugguaaagguuauuuuagguagggaaucuuauuuuauucauguauuaacaugcugugguucaggggaaauucuaggucagauuauaacuuucauaccauaaaaugauggcuuuuaaagggagggcuuuuaaaaaaaaucuggaugauaaaggcauauaaauacauaaauuuaacagaggcaaaguuugaagaauuuuaaagcaauuaaaaaaauugucauauugggaacauguugcuaccuucuuuuagucagauaccaaguggcuaacugcucacaaaaauauggccaaaccgccaggcgcuguggcucacaccuguaaucccagcucuuuggguggcugaggcggacggaucaccugaggucgggaguucgagaugagccugaccaacauggagaaaccuugucucuacuaaaaauacaaaauuagccgggcgugguggugggugccuguaaucccagcuacuugggaggcugaggcaggagaaucgcuugaacccggcaggcagagguugcagugagccgagauccugccacugcacuccagccugggcaacgagaacgaaacuccgucucugcaguucccaaagauaaggacagacagugcuuuaaacuacgccaaggaauugauaagaagauugucaucuaugugcagcaaacaacuaauaaagaacuugccauugaaagguguuuuggucuucuccuuaguccaggaaaagauguacgaaauagugacaugcacuuauuagauuugaauuuauuuuuauuagaaagaaucuaugggcaaaaguucagauggaaagucguauguuauuacggggagcuggaauccaaaauccccacauuuucaaguuguaaaugaagaaacuccuaaagauaaaguccuguuuaugaccacagcuguagauuugguaauaacagaaguacaggagccuguucgauuucuccuggagacaaaaguccgcguuugcucaccuaaugaaagauuauucuggcccuucagcaaacguaguacuacugaaaauuucuuuuugaaacuaaaacagauaaagcaaagggagagaaagaauaauacugacacuuuauaugaaguuguaugcuuggaaagugaaucagaaagagagaggaggaaaacuacagccaguccuucaguucgccugccacagucuggaucgcaaaguucagugauaccuucuccuccagaagaugaugaagaggaagauaaugaugaaccucuccugaguggaucuggugauguauccaaagaaugugcagaaaaaauucuugaaacauggggagaacuguugucaaaauggcaucucaacuugaaugugagaccgaagcaguugucauccuuaguaagaaacggugucccugaagcucuucgaggagaagucuggcagcugcuagcaggcugucauaacaaugaccaccugguagagaaauaccgcauucuuaucacaaaggagucuccccaggacagugcuaucacccgggauauuaaccgaacauucccagcccaugacuacuuuaaggacacaggaggagauggacaagauuccuuauauaaaauaugcaaggcuuauucuguguaugaugaagagauugguuauugccagggccagucauuucuugcugcugugcuccuucuccauaugccugaagaacaggcauucaguguucuggucaagaucauguuugacuaugggcucagggaacuuuucaagcaaaacuucgaagauuugcauugcaaauuuuaccaguuggagcgccucaugcaggaauacauuccugaccuguacaaccacuuccuggauauaagccuugaagcacacauguaugccucccagugguuucuuacucuuuucacugcaaaauucccucucuacauggucuuccauaucaucgaccugcuuuuaugugagggaauaaguguuauuuuuaaugucgcccuuggauuauuaaagacuucgaaagaugaccugcuguugacagacuuugaaggugccuugaaguucuuuaggguucagcuuccuaagagauaccgcucagaagaaaaugcaaaaaaacuaauggaauuagccugcaacaugaagauuagucagaagaaguugaaaaaauacgagaaagaauaucacaccaugagggaacagcaggcccagcaagaagaccccaucgagcgauuugagcgggagaauaggcgucuacaagaagcuaacaugagguuggaacaggaaaacgaugacuuagcccaugagcuggugaccagcaagauugcacuacggaaggaccuggauaacgcugaggaaaaggcagaugcucugaauaaggagcugcugaugaccaaacagaaguugauugaugcagaagaagagaaaagacggcuggaagaagagucugcucaguuaaaagaaaugugccgucgggaacucgacaaggcagaaucugagauuaaaaaaaacaguucuaucauuggugacuauaagcagauuuguucucaguugagugaaagauuggagaagcagcagacagccaauaagguggaaauugagaaaauucggcaaaaaguggaugacugugagcggugccgggaauuuuucaacaaagaagggcguguaaaaggcauaagcucaaccaaggagguuuuagaugaggacacggaugaagagaaagagacgcucaagaaccagcugagagaaauggagcuagaacuggcacagaccaaacuccagcugguggaggccgaguguaagauacaggacuuggaacaccauuuagggcuugcccucaaugaggugcaggcagccaagaagacgugguuuaaccgaacacugagcuccauaaagacagcaaccgggguucaagggaaagagacuugcugagagcagcugccgccucccgacaccuucagaaaacacgacaccuuuuguugccuucuuuggccagaugugugauucugugacuugucccaggaccagaauguaccuaagucagauccauagacgcauguugguaggucacuggaccagagcuugugaagcaggcaaccucugggguaagacuacugauacuaacaggccugcuagcucagccgacgcucuggacacucuagaaaucacuccucagugugaccucccaggccucuuccccguguacgucaacaccucacccagccuaaaggcugaguuuacaugaucagaguuaggggauccuucagucuguugauuuuuuuucuaaaccuuuuuuuuuuaauauacauauauauauauauauauauauauauauauauauauauauauauauauaguggggguggggcaagggaucagaaauucaaauaauucuuuucugcuucaaugccagcagaaggucccccagguagacauggagaagcacuuuguuuuaaauaggaggguuucauaguugcaucugaagccaccugguucuguuaaacuguauggugcagguuuuggguuuggcauuauucauguuucugaucaauucuaugcaacucucauaguuccuguuacuuuuuagcauuagcugccaaaugacuucaaaaggcuggggugggugacuugacugugagacuggauuauaacauggacaaaucuuauuuugcuuaauguguuuguguguguguguguguguguguguguguguguauguauauauauauauaaauaucuuucccaauaugccccguugacaguguuuaaauuccagacuaggacugcugaucugcacaauuuaauuaugugguuauucgagcacuuaauuucacucaagguucauugggcucugcucuccucccugccauuacgggagcuguggacagagcucccucacuucaagauuccuaguguuuuugcacaacagguuguccaagugagaaagacugaguugcgugucuguaaaugucugcgcagggugcacaugcugcgaggucuccauccuccgggccugucccucccagaugggcugggccuuugggcccuccucagaguaugccuggguacaaaccucacuguucagaugggcuguaaguucucacuucaaagcuauggaauggauuuuagcaccuuuaaaaaaaaaaaaaacuuugacuuuuaauuuauauagugauaugcugacaggcugacacgcagaugguuuuguccucuuuucugcguucaguguugaggcggcugcuuacaagaggcacugguuuuguauauaaagacacucggguuguuuuguagcucuuuuucuuauuggcuguacuaacgcuugcugagguuaucuguaauaagggagguaacaaguggcaacccccuccccaccaaccauccccuuugcugcuuucugugucuuucuuguucaguuaccaaaauagcuguaagccuaucuaaugcuagguguguggacauugugcuaagguaguuucagugugucaacuuuaugaauugaaauauaaaccaguaaaauuguauuacuguuucuuuuguugguuuuauuuuaacagcauauugauuaaauauuuugguacaaacaaa

SEQ ID NO: 481 - RNA, 2054 nt, Homo Sapiens
gugugacuggugagagauuaacuccauucagaucgggcagcagcaauuaauugugccuugccgcaugaggaugugucaggaggauuaacaugaccacagaaccgaaacauucucucccugaaguucacuucacgucuccgcagacgaaguacgcuguguaacuccuuagagcaacucuuuuuggaaagcaaagucccuauuucuguacaguuuuagguuagguguuucauuuauaacagaugcagaaaucaauuaagauaaagugauaugugaagaaaucuuuuacaguaaaauauauccugaauucauauaggcuuguucauaauugagucucuucuugagcuaccuuuucaauauuagacaaugugaagacagugacagcguccuuuucuagagauauuuagccuguuauuacaaacugugaagacaaagaauuuuauacuuuuacuaauguuugugguuuuaaacaguuauuuucauucuaaucaguucucuacccucuaauuucuacuaaagcuguaaauacauuuagaaauuauauuuguaaauacaguauauggagacaaguuaauuuuuuggucaguggaaaaagccucccaaccaauuggcccugccuuggcaguuguguuuuuuguuguuguuguuguuguuuuaguuuaguuuuuuuuuuuaaacagcagaaaggauacugucgguucacuguugagcagaauauacuguagaacgaaaaugauaauuuuuaaaucuuccagagcaugaguaaaugucuuuucuaaugauagcaaauauaaccaacucuuuguuuuucccuuagcccagaccauauagaccugcguauuuugugugugguuuuguuuuuauuuuuguucuuacagccuagacccuaggaaaaauuugcaggaacacgaaacaagggcuggggggaaaaucaucuaugugaaugagcuuuacuuuaaagagaucaauguauuuuauuuuaucaacuuuuucucuuaguuacugugauuuuuguuguuguuguccucguuauuguuaaauucuguaaugguuuccugugaagccuccacugaaagggacucaaauaugcaacaccuaaacuauuuuccaagggcacaugccccuugaauggugcuucuagacuggucaggguuauuuauuaaauuuuauauaugaaaguauuggggaauuauguaaauucuuuauaugaaacuaucuaguucauaaaucauagauuucauauuacucagugcaacugaacuaaaaguucagaaaagucauucacauuguuccaaauuuguaaugguugucacaugucacaugcgucuuuuucaguaagugccagaguguucccacuguuucugcccagugcuugacuucucggcccggaagagaaccugcuuucucugguuuccuuccugagucuggcacagacggggcuauuguaguucuugaucaaguccuggagucagccuugccuggcucuccuuguagcagauucaguccacagaccucuugcugccccucagugacaaguaugcugugaauucaaccuuuggacuugcugcccaagccuuugguugcugcccugacuauuguaagagguaaacuuaccugguuuguuugagaaugaccauuuuccuaaugugaaaaccaucucucucaccacuuuuauuaguagggcuaacauuuuuuuccguuauaaaugguugagcaauuugaaugacuuaacacagugucauuaucuugcaauauaaacugguaaccucacaacuccacacuucaucaccauaugaaguaaaugaagcuagcuaagcggaugcuguaucaacuaguaacuugccauuaaggauuauuuuauagcaugaauuuaagacuauuuauucaaaugauauuuuacucuuguauucacuuuguuuuagauuugugacaugaauauuucagugcugcuuaauuuuguucugaauucuuguuucuugcuuguaaauggcuuuuuuaugguauaaauaaagucaauggacauugcuguuuguaaauaaaaaugcugcuagagcaaa

SEQ ID NO: 482 - RNA, 72 nt, Homo Sapiens
uaggauaugguuuaauagguagcauggagaauuuuggagucucagggauagguucaauuccuauaguuccag

SEQ ID NO: 483 - RNA, 69 nt, Homo Sapiens
aaggacuuagcuuaauuaaagugguugauuugcguucaacugaugcagaauagaguuuugcaguccuug

SEQ ID NO: 484 - RNA, 74 nt, Homo Sapiens
uagauugaagccaguugauuaggguauuuagcuguuaacuaaauuuuuguggguuugaauuccaccgaucuagc

SEQ ID NO: 485 - RNA, 4148 nt, Homo Sapiens
gagggagugaaaugcuuaauucaggaauggauuuuggaguuucugggugcugaagaaauagggccuuuccgccugcgggcccagugagucgacacggugggggcccgcgauccccgggacuuaccacugaauaaauccaguccagcgugcgacgacuuacuggcuucauggggucgcagccgccgcuggggucuccgcugucucgcgaggagggugaagcgcccccgccugcucccgcuucggaggguaggcggagaagucgccggguacgccuucgcggauccugccgacaccgaccuagcuuucugggcugccgggagcucgcggcgagcgccccagccaggccugcgccggcauccuccgagauaauggcaucagcugcuaaggaauuuaaaauggacaacuuuucaccuaaagcuggcacuagcaaauugcaacagacaguaccagcugaugcaucuccugauucuaaguguccuauaugcuuggauagauuugauaaugugucuuacuuagaucgcugcuuacauaaguucuguuuucgcuguguacaggaguggucaaaaaacaaagcugaaugcccacuauguaaacagcccuuugauucuauuuuccauucugugagggcagaagaugacuucaaggaguauguccuaaggccuucguauaaugguucuuuugucaccccugaucgacgauuucgcuaccguacaacucugacaagggaacgaaaugcuucuguguauucaccuagugguccugugaacagaagaacaacaacuccaccggauaguggaguacuguuugaaggguuaggcauuucaacaagaccuagagauguugaaauuccucaguuuaugagacagauugcaguaaggaggccaacuacggcagaugaaagaucuuugcggaaaauucaagaacaagauauuauuaauuuuagacgaacucuuuaucgugcuggugcucgaguuagaaauauugaagaugguggccgcuacagggauauuucagcugaauuuuuccguagaaauccagcuugccuucacagauuaguccccugguuaaaacgugaacuuacaguucuuuuuggagcucauggaucuuuagugaauauuguccagcauauuaucaugaguaauguuacucgcuaugacuuggagagucaggcauuugugucugauuuaagaccauuuuuacuuaaucgaacugagcauuuuauacaugaauuuaucaguuuugcccgaucuccuuuuaacauggcagccuuugaccagcaugccaauuaugauugcccugcuccuucauacgaagaaggcagccauucugauucuucagucauaacaauaucuccagaugaggcugagacccaagagcuggauauuaauguagccacuguuagucaggcaccaugggaugaugaaacuccaggaccaucuuacucaagcucagagcagguacacguuacuaugucuucucuuuuaaauacuucugacaguucagaugaagaacuugucacaggaggagccacgucucagauacaaggaguacaaaccaaugacgaccuaaauaaugacagugaugauucuucagauaauugugucauuguuggguuuguuaaaccacuagcugagaggaccccagaacuuguugaacuguccucugauucugaggacuuagguucuuaugagaaaauggagacagugaagacacaagaacaggagcaaucuuacaguucuggugauagcgauguuaguagaugcucaucuccacacucuguccuuggaaaggaugaacaaauaaauaaaggucauugugauucuaguacaagaaucaaaucaaagaaggaagagaaacgaucuacaucauugucaucucccagaaaccugaacucaucuguaagaggagacagaguauauucuccauauaaccauagacacagaaagaggggaagaucaagaaguucagauucacguucucagaguagaagugggcaugaucagaagaaucauagaaagcaucaugggaagaaaagaaugaaaaguaaacgauccagaagcagggaaaguagcagaccuagagggagaagagacaaaaagagaucaagaacuagagauagcaguugguccagaagaagccaaacucugucucuaaguagugaaagcacaagcagaucaaggucucguagcagugaucaugguaaaagaagaucacggagcagaaauagagaucguuauuauuuaagaaauaauuauggaagcagauacaaaugggaguauacuuauuacaguagaaacaaggacagggauggguacgaaucaucuuacaggaggaggacucuguccagagcucauuauucuagacagucuucaaguccagaauuuagaguucaguccuuuucugaaagaacaaaugcuaggaaaaaaaauaaucacagugagaggaaguauuacuacuaugaaaggcacagaucaaggagccugucuaguaacagaucaaggacugcaucuaccgggacugaccgggugagaaaugaaaagccuggagggaaacgaaaauacaaaacacggcauuuggaggguacuaacgaaguggcucagccaucucgugaauuugcuucuaaagcaaaggacagucauuaccaaaaaucuucaucaaaauuggauggaaacuacaaaaaugagagugauaccuuuucagacagccgaucaucagacagagagacaaaacacaaaaggagaaaaaggaagacccggagccuaaguguagagauaguuuaugaaggaaaagcuacugauacaacuaaacaccauaaaaagaaaaagaagaaacauaagaagaagcauaagaaacaccauggagauaaugcuucacguuccccaguuguaauuaccauugacagugacagugauaaggauucugaaguaaaggaggauacagaaugugacaauagugguccucaagacccucuacaaaaugaguuuuuggcuccuuccuuggaaccauuugaaacuaaagauguaguuacaauagaagcugaauuuggugugcuggacaaggaaugugauauugccacacuuaguaacaacuugaauaaugccaacaaaacuguagauaauauuccaccucuggcagcuucaguugaacaaacucucgauguaagagaagagagcaccuuuguuucugauuuggagaaccagcccaguaacauugugucucuucaaacugagccaucaaggcaauugccaucgccacggacaucauuaaugucaguaugucuugguagagacugugauaugucuuaaaacugccaaagcauuucauugagaauuaugauguuauaaaaaggaaaaaggaagaaugucgucuacugcagucuauuuaaagaugacauuuggugaaaacucucuuccuccuuacaauauuuuaaaugauuuuuuuuuugguguuaauuuguaaaaaucauuauuuguucaaaauguaugucccacccucaaagauaugcacuuuuaagugaagaaaaugauacugcuagcagcuuauuuaaaacuugggguccuuuuuaaauaagaaaaauuauauaaauuuuagaaguuauuucauaaagccauacgguauugacauauuuuuaagguagucaaugaguauuuuugaauuuuuuuuuuuugagaguuauucuggaaauguguuauaagcuaggagaaucccuuuggacagucuuuauuuuucuucuuaaaaauuuauaugauucaaaaccauuucuucagguuaaauugaggcauuuuaaucugcacaguuuaucuucugccaaaauaaaaauuuacuauuuccuuuauauacuuguuuaucuggacugccaguaaaacaaauguguauucaacaaaagaaaaaaaauaaaacaguaacacuuuaaaacaagaaucagacauuuuccuaugcaguauuuuuuuuuaaaguuuauuuuaguaaaguuaaaaucuugaaaguagcuaagggcauaauuaugucauaaauacugaacuucaggugaacaaauacuuuauaguuuuaauuauuuucuuugauuuugaggaguaucuuauuugcuuucuaucaucaguaaaaacagcauuuaacuugcuaaauaaacaugaaaaacccuugucaua

SEQ ID NO: 486 - RNA, 7183 nt, Homo Sapiens
cagacgccgacccaagcggaagugacguuagguguccgccggaggugucguugguguguugcgcgacuggccuugagggagagcuggggccugcucccggagagauacggcuaugucgaucgaaaucgaaucuucggaugugauccgccuuauuaugcaguacuugaaggagaacaguuuacaucgggcguuagccaccuugcaggaggagacuacugugucucugaauacuguggacagcauugagaguuuuguggcugacauuaacaguggccauugggauacuguguugcaggcuauacagucucugaaauugccagacaaaacccucauugaccucuaugaacagguuguucuggaauugauagagcuccgugaauugggugcugccaggucacuuuugagacagacugaucccaugaucauguuaaaacaaacacagccagagcgauauauucaucuggagaaccuuuuggccaggucuuacuuugauccucgugaggcauacccagauggaaguagcaaagaaaagagaagagcagcaauugcccaggccuuagcuggcgaagucaguguggugccuccaucucgucucauggcauugcugggacaggcacugaaguggcagcagcaucagggauugcuuccuccugguaugaccauagauuuguuucgaggcaaggcagcugucaaagauguggaagaagaaaaguuuccuacacaacugagcaggcauauuaaguuuggucagaaaucacauguggagugugcucgauuuucuccagauggucaguauuuggucacugggucuguugauggauucauugaaguauggaacuuuacuacuggaaaaaucagaaaggaucuuaaguaccaggcccaagauaacuuuaugaugauggaugaugcuguccucugcauguguuucagcagagauacagaaauguuagcaacuggggcccaagauggaaaaaucaagguguggaagauucagaguggacaauguuuaaggagauuugagagggcacacaguaagggugucaccugucuaagcuuuucuaaggauagcagucagauccuuagugcuucuuuugaccagacaauuagaauucaugguuuaaaaucugggaaaacccugaaggaauuucguggccauuccuccuuuguuaacgaagcaacauuuacacaagauggacauuacauuauuagugcauccucugauggcacuguaaagaucuggaauaugaagaccacagaauguucaaauaccuuuaaaucccugggcagcaccgcagggacagauauuaccgucaacagugugauucuacuuccuaaaaacccugagcacuuuguggugugcaacagaucaaacacgguggucaucaugaacaugcaggggcagauugucagaagcuucaguucugguaaaagagaagguggggacuuuguuugcugugcccucucuccccguggugaauggaucuacuguguaggggaggacuuugugcucuacuguuucaguacagucacuggcaaacuggagagaacuuugacagugcacgagaaggaugugauugguauugcacaucacccucaucagaaccugauugcuaccuacagugaagauggacuccuaaagcucuggaaaccauaauucaacuuuucuuuuuaaaucagcucgaaagcauguacuuaaaugaagcauauucauguaaugugcuuuuuuuuuuuuuugccagcuuuucuaagcaaauagauugucugaauuagucacagaauaauuuugugaaaauucauguuuaaguagcaacuacccuuucuuuuuuuauauauuuuuaagguauuaguuuaucuucuucuaacuggugcagucacuuaauguuuucauuaaucuucgaccuggagagugaaauacugauauuucuagaaaaaaauucuacuccucugauuauuugaaaugcugaggaaaaugucccucccauaguaaaacuuguaaauaaggaacuauaucauauucaguagcuguguucuguuccaucuuuuuuuuuuuuuuugagauggaguuuugcuuguugcccaggcuggagugcagcggcacgaucuugguucacugcaaccuccgccucccagguucaagcgauucucuugccucagccucccgaguagcuggggacuacaggugugcgacaccaugccuggcuaauuuuuuuguauuuuuaguagagaugggguuucaccauguuggccaggcuggucucaaacuccugaccucaaaggauccacccgccuuggccucccaaagugcugggaucacaggcgugagccaccaugcccggcccaucuuuuuuuuuuuuuuuuuuuuuaaagauguuaauaaacuuuauaccuuucuggagacuuuguucuaaaauguacauaaaugcucaucuaguuaacauauuuacuuagaaugugggaggaggagucacauuauuaucccugaaucucaaguacagcagaagugaauuccugggauaguaggauagacuaacauguaaaaaggccaggugaugcauagguucucauuucacugcccucagccuuccucuccuucugagcugugccuucucacauguucagucaacuccagggaauauugucuccaucuucuggauagaacuaguugcaggauccguuacaagaauucagaguuuuggcaucuccccuuuguauguuguaggagaagguuuggcauugaaaaugugcuguuguuccaaagaaaaauuagcaaaggacuugagauuuagaaaagucuccuuuguaaugugcaucauuaccaguuaucuaaagaaaaacauguaaaagccaacaaaacccuugaaaauauuuugcauauggaugucuguuucacguuucaacugaagauguauagagcaccucugaugaugaggaagauaccaugcuaggcaguacuuucaagaacgugaguucuuauuucugcaggccuuuugugcccccuuuuaaauguuagcauuuauuagguacaaacuaguggggaagguuuuuuuaaaaaguuuugcagucuuguaauuuaccuuuuuaaaaaauuuauuuuauuuuucugagauggagucuugcucuguugcccaggcuggagugcaguggugccaucucagcuaacugcaacuuccacuucccagguucaagcgauucuccugccuuagccucccaaguagcugggacuacaggcgcaugccagcaugccuggcuaauuuuuguauuuuuaguagagcggggguuuugccauguuggccaggcuggucuugaacuccugaccucaggugauccgccugcccuggccucccaaagugcugggauuacaggcaugagccacugcgcccagccuuguaauuuaccuuugauggugaccugaaaugcaguaugauccuauauguggcacguaguaauguucaguguuugcugaauuaauucugggcagcacuaagaaaucccucuuucccagucauauucuauaacacauuucccauuugccacaaaaccugcagcuuuuugguccagguaaugacauuugcugccauuuugaugauuuaaaaauggucgugggaguugaacauagucaugaauucaggauuccugagcauguagacagucaucccaguggaaagacacguucacuuaagagaaguuuaaguuagaggaaacaguuuaugcuaaaaaaauuuuuagaaaaguccuugagaauuuuugauuuagucuugaccucaugaagcugguaguuaugaugugcauaguuuguaucaccguuuaugaagauggagaaucuagucagcacguguugguuuauucuaggaauuuuuagggaacacuucuguugcuggcaccaggugaugaauaugguuaaaaaaagacucguuucugccuaaacauagggaagaagagcaaauuaaaaggaguaauuaaaacugauaaaagcucaaguuaccuuugugaugaugaggcgggcaguuaacgcgaaaggguugggaaaggcuuccuggagggacuagggggcggucuaagcacagggaaccuaaccggggacuccaguguggcacagcggcaagguaugugcugggcaaaaugauaggugucuugggagaccaggcaaagagagcuggauuaggagccguuaaguauauauuuuucuucuuuuuaaauaaaauaaugcacugggugaacauguaaacgcuaaguugaaaaucugccuuucccagguaacccuuguuaaucuuucuacaacuucauuucguacaaaccugaaaaacacacugauuuugucuuuaaaugggcacacgcugcuuacacuccucggcgccuagccuuucugaagccccacgcggccgucccuccagcauugaaggcuggggcagcccagcuccccuccagcgcccuuacagccagaccgcggcggggucgggccgcgcacgcgcagggcggacggccggaucuggggcgccgcugcuccggguggucggagguaggagucccaucuuggguccagggccgguagagccccuuaccggggguagggagacugcgcacccgcuagagccaacugucagggccugcagacgucgggugacgucacuguuacaaaauuggcggucacaucgucuuaagggccgguggcagcggcugcgcgaacgggaguuggcugccgggaaucagugcucacuuccuucugaauugggcgugugcagucgguuccuagggaagugcucugcugcagccaccagauuuaacggaugcugcucucuagcacuuaacauagaagcuaaacuaccuggcguuaaaauuaauuccaugagcauaaggacauuuguccuauccccuauucugcuguugaauuaaugacuggaaaacauugcgcggagguauuugggaguaguauggcuuuuuuuuuuuuuuuuuuuuuaacagcaaaugguauaaaucucagguacaauucaguaucuucuucaccaguuguuuuuuuucagcauguauuauuacuaccacuaacggccucuguugagcccuuccuugcuauguaagcagccauauuuaauucucagaacaauguaaugagggugcgcaaaugcacaugaagaaacagguuuccagacgugaggcaccuaacucaguccaacuugcacgaagcucgcauugaaaaccagaugugacuccgaagcuagguuuuuuuucucucuugccucacucucaauauugcugucaguuccuccucaaucuuuagguuugggcagggacaaagaauacauggauuguuccuccacaugcugcaaacacauucaccuaagcagagcacagguagugagaugaguagagagaacugaauuagaggauucuggaugucagucuuugcugucacuucuuuuggcuugugcuagaacagugguucuuacaagugucacgugauagacacauucuaagguccuaucccagaccuacagaaucagaaauuggugguggggcccagcaagcgugcucaaauuugagagcagguagacuacaggguaguuuccgcauauacaaaagguguuuuaauucuugcugucagucucagaaguuucaugcugagauaaccaaauuuaaaugauaaaggugcaagacugacucuuaaaaucacauuuuuucaaauugccauagcuugcuaguguucucauucacugugcuuuuacagcuucauuuuccacuauuuuaagagaagaaauugcuaugaaguguauguccaagugaggaaguucccuggucugagguuguuuaaaacuuacaauaggccgggcacgguggcucaagccuguaaucccagcacuuugggaggccgagguggguggaucacgaggucaggaguucaagaccacccuggccaacauggugacacccugucucuacuaaggauacaaaauuagccgggcaugguggcacacgccuguagucccagcuaccuaggaggcugaggcaggagaauagcuggaacccgggaggcagagguugcagugagcugagacugugccacugcacuccagccugggugacagagcaagacuuggucucaaaaacaaaaaacaaaaaaaccaaacuuggaauagcaagggcugcccauuauuuaaccuuccacggcaauuuuaacagugguauucuguuccaagugguuaauauuaaauccaugugucaguguugguggcuuucaaccuuggcugcgcauaaucauuuugaugcuuaggcuacacccagccgaguuauacagaaucccuggagggugggaccugaugaguguuuuaauguuucccggguaauuccaaugguagccaagguuaagaaccaguaccguacguacaaaaaaguugagaagcuaauuucacguacagaaaauuugccacuguuccaagagcacucucaagcgacauaauuggccucuacuccuauucccuacaaguaugaaugggcaggagaagcaucacagagaaagcagaguuagugcuggaacuuguauuuuuguggaugaugaccuugguuaauguuuuuucauaggcucuguuucauaggcuuuguuuuuucauaggcucucccucauuacauuguucugagaauuaaauauggcugcuuacauaguaaugaaggguucaacagaggcuguuagugguaguaauaauacaagcugaaaaacuacacagacaaaccuaucaguuucugccucuucaggauauaacuauuagguuagugcaaaaguaauugcgguuuuugccauuaaaaguaauggcacauuacuuuugcaccaaccgaccuaauaugacuuucuuuuaguguucuuaggauuuuuaauuguaaaacauguaacaaauuuuccuaaacaauugugcaauucaguggcauuauuuacgauguuacgcaaccacuauuguauuuccaaaaugucaucacccuaaacagaagcccuguaacauugucaauuaacuucuccuucccuuccccucagccuuugguacuguuucugccucaaugcauuugucuaaguuuaguucauauaagugaaauuauacaauacuuguccuuuuuuaucuggcuuauuucauuuagcauguuuuaaagguucauccauguaucaaacaguaaagugcuucauauuugggggaaguauaaaaag

SEQ ID NO: 487 - RNA, 5285 nt, Homo Sapiens
gagucgucuacccgcgcgcccgagcgcggaaaccgaggggcaggcucgcgcucugccugcuucguggcgcuugguucgucccucgcccgaggagcgcgguggcggcgugggagggagccucugacggcgucugggaacucuauuuuaagaaccucucaaaacgaaacaagcaaaucauggagaagaauggaaauaaccgaaagcugcggguuuguguugcuacuuguaaccgugcagauuauucuaaacuugccccgaucauguuuggcauuaaaaccgaaccugaguucuuugaacuugauguugugguacuuggcucucaccugauagaugacuauggaaauacauaucgaaugauugaacaagaugacuuugacauuaacaccaggcuacacacaauugugaggggagaagaugaggcagccaugguggagucaguaggccuggcccuagugaagcugccagauguccuuaaucgccugaagccugauaucaugauuguucauggagacagguuugaugcccuggcucuggccacaucugcugccuugaugaacauccgaauccuucacauugaagguggggaagucagugggaccauugaugacucuaucagacaugccauaacaaaacuggcucauuaucaugugugcugcacccgcagugcagagcagcaccugauauccaugugugaggaccaugaucgcauccuuuuggcaggcugcccuuccuaugacaaacuucucucagccaagaacaaagacuacaugagcaucauucgcauguggcuaggugaugauguaaaaucuaaagauuacauuguugcacuacagcacccugugaccacugacauuaagcauuccauaaaaauguuugaauuaacauuggaugcacuuaucucauuuaacaagcggacccuaguccuguuuccaaauauugacgcagggagcaaagagaugguucgagugaugcggaagaagggcauugagcaucaucccaacuuucgugcaguuaaacacgucccauuugaccaguuuauacaguugguugcccaugcuggcuguaugauugggaacagcagcugugggguucgagaaguuggagcuuuuggaacaccugugaucaaccugggaacacgucagauuggaagagaaacaggggagaauguucuucauguccgggaugcugacacccaagacaaaauauugcaagcacugcaccuucaguuugguaaacaguacccuuguucaaagauauauggggauggaaaugcuguuccaaggauuuugaaguuucucaaaucuaucgaucuucaagagccacugcaaaagaaauucugcuuuccuccugugaaggagaauaucucucaagauauugaccauauucuugaaacucuaagugccuuggccguugaucuuggcgggacgaaccuccgaguugcaauagucagcaugaagggugaaauaguuaagaaguauacucaguucaauccuaaaaccuaugaagagaggauuaauuuaauccuacagauguguguggaagcugcagcagaagcuguaaaacugaacugcagaauuuugggaguaggcauuuccacagguggccguguaaauccucgggaaggaauugugcugcauucaaccaaacugauccaagaguggaacucuguggaccuuaggaccccccuuucugacacuuugcaucucccuguguggguagacaaugauggcaacugugcugcccuggcggaaaggaaauuuggccaaggaaagggacuggaaaacuuuguuacacuuaucacaggcacaggaaucggugguggaauuauccaucagcaugaauugauccacggaagcuccuucugugcugcagaacugggccaccuuguugugucucuggaugggccugauuguuccuguggaagccaugggugcauugaagcauacgccucuggaauggccuugcagagggaggcaaaaaagcuccaugaugaggaccugcucuugguggaagggaugucagugccaaaagaugaggcugugggugcgcuccaucucauccaagcugcgaaacuuggcaaugcgaaggcccagagcauccuaagaacagcuggaacagcuuugggucuugggguugugaacauccuccauaccaugaaucccucccuugugauccucuccggaguccuggccagucacuauauccacauugucaaagacgucauucgccagcaggccuuguccuccgugcaggacguggauguggugguuucggauuugguugaccccgcccugcugggugcugccagcaugguucuggacuacacaacacgcaggaucuacuagaccuccaggaacagacauggaccuucucuccagagcuccugaguggaaucaaguucuugucuuuaggaugaccguuucuuaacaaucaaaucugguauugaacugcaggugacuuuggcagagaaauguuuucacuuuuggucuccucuuccagagucaccuuuccccacuccuauuuuuguagaugcuauucuuucugaugucuucuuacuaggggucauuuuagcucaaacccuguaaguuacagucacaauuuucugugccaaagcagcuacaauaauagagaggaagccuucuuagaacucugcuuacuaauguauuaauaccacugagaccuucaggccuugccugggauaucacuucauccugaaguuugcauuaauaauccuuccaggccgggcacaguggcucacgccuguaaucccagcacuuugggaggccgaggcgggcggaucacgaggucaggagaucgagaccgcccuggcuaacauggugaaacauggugaaaccccgucucuacuaaaaauacaaaaaauuagcugggugugguggcgggucccagcuacucgggaggcugaggcaggagaauggcaugaaccagggaggcggagcuggcagugaacugagaccgcaccacugcacuccagccugggugacagagcaagacuccaucucaaaaauaauaauaauaaauaauaauaauaauaauaauaauaauaauaauccuuccagcugggcgcaguggcucacgccuguaaucccaacauuuugggaggccgagaugggcggaucaccugaggucaggaguucaagaccagccuggccaacauggugaaaccccaucucuacuaaaauacaaaaauuagccgggcgugguggcaugugccuguagucccagcuacucgggaggcugaggcaggagaauugcuugaacccgggaggcggagguugcagugagccgagaucaugccacugcacuccacccugggugacagagcgagacuccgucuacacacacacacacacacacacacacauccuuccuccucuaaccccaaacuaagaucacagaaggugauccagucagagaacagagggaaaucuuaccaggaagggcuuaaguacacuuuuuuuuaaaacagcuuuauuguuuuuaaagccuacaauuugauaagccuugacauauguauaccugugaaagcaucaccacaaucaagacacuggacauaucuaucacucccccaucucagauauccccccuaauccuggauaccauuuguugaaagauguuauuacucuagcugaacuuacaagagacuuuagaccagggaucuaaauuacaguggccuuagugaccuuguccuuaucuucuuaggacagcugagaagccacugggacuuagagccuuuaaaaggagauuaacugucccaaaaggaucuuugcuacugaccagcagacacuucuuccuucaguagccuuucauacuguguugaguaacacccuaggguguccauuaaaguuuugaguuuuaccuagagcccagagccaugaaucaggauucugucuacaugauucguguuuucauuggugucaaaauacaaaagccaaaguucuggcuaugaauuguuaacuuggaagaaauacuaacugccaccacuuauuaagugccuacugugugccaggcucugaacuaggugcuucauauacauuauccuaaauuaucucaacauaugagguagguguuuuaauuuuuauuuuauagaacuugguguguuugacuguuaagcuauggggcuagagagaggguuugaucccaggucccucugugcuuuugcugcugagccacacaaccucucauuucaaaaacacuuucaaaaugcuaacauauucuaauucacucuaggccaccaaaaacuuuaauacuaauaucugauuuguaaaugacuuaauguauccuugacccuaucagcugaauuuaaugaaauauuccucucugcugugaaauuuuaccaguauaguauuuggucuagugacagguguucuauuuuuuugagacgggucucacucugucacccaggcuggagugcaguggcucaaugcaaccucugccccccaaguucaagugauucuccugccucagccucuugaguagcugggauuacaggcacaugcaccacgcccggcugauuuuuuuuuguauuuuuaguagacaggguuucaccauguuggccaggcuggucuugaacuccugaccucaggugauccgcccgccucugccucccaaagugcugggauuacagguguaagccaucacaccuggcccuagugacagguuuuuauggguacuuuuagaugaucuaagaaaucaugugcauauaucuuucagauuucuauuuugggaaaaugaagguuucuacaacauauuguuucaguguucaaauaaacugaaggacucaacauuacauuugaacuauauccuuccuaguggguuagugugaaaaagaguuuggcugauuccuaaaacucugccagcccugcaguaaucuccagggccugguuauuguucagacauuccauggugauuccugggaaggaagcuuggcugcucaguuucugagucuggggugagauaauguucugggaagggacaucuguucuuugguguaaucucucauggugaaaucugcucuguacaucagacaauugcauugcuaccaaguuucauaccaaauauuugaaaggaugguauugaaucuaaaaccaaauauuaguuuuuauuaaacucaugggaaggcuaauauauuccaacguaaauuauuacauaugguuaaguaauugcauguuaauuuauuuuaauguaaauauuuuuguuacuguucugagccaaauucuaaagaaaaaauaaauacauuuccuuguugaaauccuguugaaaaaaaa

SEQ ID NO: 488 - RNA, 2984 nt, Homo Sapiens
ucccccucccguccuguccccaucaguguugaaauguaugcuacaguuauuaugguuguaauuuguuaugccauguugaucuucuugugcuuuucauaucagaacaaugcauuuuuaacauucugacuuucuuuuucucucaauugguaacugacuauauagaaaauuuauauuuauggauacuauuucuuuuuuaauaaguucaagggaaaacauugauaaaggaaaauuuauccuuucaacuuucuuuaggugccagcauuauuuucauauuaggaagcaggagaaaguuaaggaacucuaagcaauacuagaaugguuauauauauauuuaaguuuguauuaaaccuguuggaaugguaaagaaauuuacugacauauuuaaccauacaaaauaguguugcuaaaagacuaguuuuucucuuuauucugugcauauguauauauaugaauguguguuuuuuuuuuaagaaauuuuaaaaaaacuuaaucugccagcuuuucucuauuggaauuugcaaacaacuuguaaaauuggaauuacagaauauuagaauagucaguuauggaaagucacuucauuauccuugugucacuaaauaacguauaaaguuaaaucagaaguguauuaaucucugaauuucuaaucaguuguuuuuaguuugcagaaaaaacuucagcaugugccaggaacacaaccucaccuugaucagaguauuguuacaaucacauuugaaguaccaggaaaugcaaaggaagaacaucuuaauauguuuauucaguugauacagaaucuccugugggaaaagaaugugagaaacaaggacaaucacugcauggaggucauaaggcugaagguacaguuuacuguugcagacuuuuggacaaaguccuuuucuuggcuguuauaaaaacuauauuugguuuuaaacagaaacacugguuuuaguacaaaucaucuuugucuacuuucauuuuucuuuauuauuuucaugacugaaaaggagcuuuggaaaucacugcauaaggcuugauuuauuugcacaacuuucuuuaggguugcagcuagaacaaaccugugcgcuuugaaauguuaccuucugcucucuguucccaaguacagagaaauaauguugcaaaucucacuucugcugaacauuaugcuuccugaugcauuuagcagacacuaaacauuugucauacucuaaacaaaguuacaaaggacuagaagaauucuuguucuguauuuagaaacccacucacauuacuugauauuuggguauuuaagucaugaaagguauuucuucuaggaagcagugauucuaaaguguaugcuuaaccagucaguugagugucuacucuuguguguucacaaguguacacaaaguuuuugguaaauuaagaauauuauuucaaauaaauuaauuucauccccauaggagccaguuuaucagauaauucguuucucauuucugcaaaucaguacacaaugagcucauauucagauaaauauaauaguuuuucuuuauuucaacauuguucauugauugcaacccauuucuaaaacaaauuauuuaauauaaccaaacuccuuuaacuucucaacuuuucccacuaaaacugugaaacauuauauaaaaucuuuaaucaauaggauaugauacauauuucaucauuuuguuucagguuuugguugugauaaauaacacugaaaaaccauccuaauauauguauuaacuuuaucauuagaaaaggggauuguucaaaaaaaaaacaauacacagaaaccuuuuuugaaaauuaaaaacauuaagaaacuucuuguaauucacaaauaauugaaauuaaguaauuuucucagcuuaagaguuuguauuuuuuaagugaauaucaguaauuaauccauuaacauugaugcucuauuucugcuuuuaaguuugaacugaggcugaucaauguucagucaauucuccuuugagcagggauuggugucaaucaaagacaaaucacaacaagugauuguccaggguguccaugagcucuaugaucuggaggagacuccagugagcuggaaggaugacacugagagaacaaauugauugguccucauugguaagucucaaaggauucacaguuuuaaaacaaagugaaaaauauauuugaaagggauaucaugugccacuuaaacagauuaaccauucagguccucuuuuaaaacuaaauaagcuuguggucaauguuucaucuuuaucauguuacaacguucguaaaagcuuguuaggacuuuuguucuucuucaguuuuagaaaagugguuaauccaaggaccaaugugacuuugauguacugaccuggaaaguuaaagauggaaucacucaauugcuauucuuuuuguaaauuucuaaacaccauaaagcauuuaaugaacuggaauugauaggugaacugugucauuuuaauaagcauaauguaaucacgucauauuuuguuuuguuugcaggcagaaauuuagauaaggauauccuuaaacagcuguuuauagcuacugugacagaaacagaaaagcaguggacaacacauuucaaagaagaucaaguuuguacauaacacuaguggcauuucuuaucaaaaggauuggauaauaaaaauaaguuucuacuguguauauuucaagcauuuauuuauuacuuuaguuacgaauuccaguauacuuuaaaaugguauuuguuuuacagcauacauaaaauguagcaaaucaguacuguaaaacauuuaacauucauacaauuauauauaauauccuuuuuuuuaaagaaugguauuucacaaaaauaucuuuugaaauuggcuuuggaguuuacauauacugaacaugaaaguuuauaauaaugaugauacaacuuucaacauugucauuuuuucuuagaacuucagcugauugcagagauauaaugauuacauuguuauuaaauuuuuuuaacacaa

SEQ ID NO: 489 - RNA, 2099 nt, Homo Sapiens
ucuaucagaaccaaauugcugagccagucaccuguguuccaggagccgaaucagaaaugucauccucaggcacgccagacuuaccuguccuacucaccgauuugaagauucaauauacuaagaucuucauaaacaaugaauggcaugauucagugaguggcaagaaauuuccugucuuuaauccugcaacugaggaggagcucugccagguagaagaaggagauaaggaggauguugacaaggcagugaaggccgcaagacaggcuuuucagauuggauccccguggcguacuauggaugcuuccgagagggggcgacuauuauacaaguuggcugauuuaaucgaaagagaucgucugcugcuggcgacaauggagucaaugaaugguggaaaacucuauuccaaugcauaucugaaugauuuagcaggcugcaucaaaacauugcgcuacugugcagguugggcugacaagauccagggccguacaauaccaauugauggaaauuuuuuuacauauacaagacaugaaccuauugguguauguggccaaaucauuccuuggaauuucccguugguuaugcucauuuggaagauagggccugcacugagcuguggaaacacagugguugucaaaccagcagagcaaacuccucucacugcucuccacguggcaucuuuaauaaaagaggcaggguuuccuccuggaguagugaauauuguuccugguuaugggccuacagcaggggcagccauuucuucucacauggauauagacaaaguagccuucacaggaucaacagagguuggcaaguugaucaaagaagcugccgggaaaagcaaucugaagagggugacccuggagcuuggaggaaagagcccuugcauuguguuagcugaugccgacuuggacaaugcuguugaauuugcacaccaugggguauucuaccaccagggccaguguuguauagccgcauccaggauuuuuguggaagaaucaauuuaugaugaguuuguucgaaggaguguugagcgggcuaagaaguauauccuuggaaauccucugaccccaggagucacucaaggcccucagauugacaaggaacaauaugauaaaauacuugaccucauugagagugggaagaaagaaggggccaaacuggaauguggaggaggcccgugggggaauaaaggcuacuuuguccagcccacaguguucucuaauguuacagaugagaugcgcauugccaaagaggagauuuuuggaccagugcagcaaaucaugaaguuuaaaucuuuagaugacgugaucaaaagagcaaacaauacuuucuauggcuuaucagcaggaguguuuaccaaagacauugauaaagccauaacaaucuccucugcucugcaggcaggaacagugugggugaauugcuauggcgugguaagugcccagugccccuuugguggauucaagaugucuggaaauggaagagaacugggagaguacgguuuccaugaauauacagaggucaaaacagucacagugaaaaucucucagaagaacucauaaagaaaauacaagaguggagagaagcucuucaauagcuaagcaucuccuuacagucacuaauauaguagauuuuaaagacaaaauuuuucuuuucuugauuuuuuuaaacauaagcuaaaucauauuaguauuaauacuacccauagaaaacuugacauguagcuucuucugaaagaauuauuugccuucugaaaugugacccccaaguccuauccuaaauaaaaaaagacaaauucggauguaugaucucucuagcuuugucauaguuaugugauuuuccuuuguagcuacuuuugcaggauaauaauuuuauagaaaaggaacaguugcauuuagcuucuuucccuuagugacucuugaaguacuuaacauacacguuaacugcagaguaaauugcucuguucccaguaguuauaaaguccuuggacuguuuugaaaaguuuccuaggaugucaugucugcuugucaaaagaaauaaucccuguaauauuuagcuguaaacugaauauaaagcuuaauaaaaacaaccuugcauga

SEQ ID NO: 490 - RNA, 4503 nt, Homo Sapiens
gugggcggggcgccgcgcugacguugcccgggaugcggacagguuccgccgccuccagcgccgccgccgcagcugccgccgccgccgccuccgccucgccugccaccgggguuuguaugaaaacaccgggcggcgggcggcgagggauccgccgugauccaggugcugagccgggugcugcggcucugcgcgguccccgccagcgccccauccugagccgauuaucugcaauuaugaaaugaaguaacucaagaugagcaaguuaaaagugauaccagaaaaaagccuuaccaauaauucuaggaucguaggacuccuggcucaacuggagaagaucaaugcugagccuucagaaucagacacugcccgauauguuacaucaaaaauucuucaucuggcucagagucaagaaaaaacaaggagagaaaugacagccaaagguucuacaggaauggaaauucugcugucaacauuagagaacacaaaagaucuucaaacuacacuuaauaucuuaagcauucuuguugagcuggugucagcugguggaggucgaagagugaguuucuuagucaccaaaggugguucacaaauauuguugcaguuacuuaugaaugccagcaaagaaucucccccacaugaggacuuaaugguacagauucauucuauucuugcaaagauuggaccaaaagauaaaaaauuuggaguaaaggcuagaauuaauggggcucugaauauaacccugaauuuggucaagcagaauuugcagaaucaucgcuugguucuaccuugccuucagcuuuuacgaguauauucugccaacucugugaauucaguauccuuagggaaaaauggaguuguggaacugauguuuaaaaucauuggaccauuuaguaagaagaauuccagucuuauaaagguugcuuuagacacucuugcugcauugcuaaaaucaaaaacaaaugccaggagagcuguagacagaggauauguccaagugcuuuuaacaauuuauguagauuggcaccgccaugauaaccggcauagaaacaugcucauucggaaaggaauuuuacagaguuuaaaaaguguuacaaacaucaaguugggaagaaaagcauuuauugaugccaaugggaugaaaauucuguauaauacuucgcaagaaugucuggcagucaggacucuggauccucuugucaauaccuccagucugauaaugaggaaguguuucccaaaaaaucgacugccacucccaacaauuaaaaguucuuuucauuuccaguugccuguuauuccugugacugguccuguggcucagcucuacagcuuaccuccugaaguggaugacguaguagaugaaagugaugacaacgaugauauugauguagaagcugaaaacgaaacugagaaugaagaugaccuagaucaaaauuuuaagaaugaugauauugaaacagauauuaacaaacuaaaaccccagcaagaaccgggacgaacaauagaagaucuaaaaauguaugaacaccuuuucccugagcuuguugaugauuuucaggacuaugauuuaaucuccaaagaaccaaagccuuuuguauuugagggaaaaguacgugguccuauuguuguuccuacggcaggcgaggaaacaucugggaauucuggcaauuuaagaaaaguuguaaugaaggagaacauaucuucuaaaggagaugaaggugaaaagaagucuaccuuuauggaucuagcaaaagaagauauuaaagauaaugauagaacauuacaacagcagccaggugaucaaaauagaacuauuucaucaguccaugguuuaaacaaugauauuguaaaggccuuggaccgaauuacauugcagaauauuccuucucaaacagccccagguuuuacugcagaaaugaagaaggacugcagucuuccucuuacuguccuuaccugugcuaaagcauguccacacauggcuacuuguggaaauguucuguuugagggaagaacaguucagcuagggaagcuuugcugcacuggaguugaaacugaagaugaugaagauacugagucaaauucaucgguagaacaagcaucgguugaaguaccugauggaccaacacuccaugacccagaccucuauauugagauugugaaaaauacgaagucugucccagaauauucagagguggcuuaucccgauuauuuuggucacauuccgccuccauucaaagagccuauuuuagaaaggccuuaugguguacaaaggacaaaaauugcucaagauauugaaaggcuaauacaucagagugauaucauagaucgugugguauaugacuuggauaacccaaauuacaccauuccagaagagggagauauuuugaaauuuaacuccaaauuugagucugggaaucugcgcaaaguaauucaaauuagaaaaaaugaauaugaucuuauucugaacucagacauaaacagcaaucauuaucaucagugguuuuacuuugaagucaguggaaugcgaccagguguugcuuacagguuuaacaucauuaacugugaaaaguccaacagucaguuuaauuaugguaugcaaccacucauguauucgguucaggaagcauuaaaugccagaccaugguggauucguauggggacugacauuuguuacuauaaaaaucauuucucaagaaguucaguugcugcaggugggcaaaagggaaaauccuacuauacaauuacauuuacugucaauuuuccacauaaagaugauguuugcuacuuugcuuaucacuauccauauacguauucaacuuuacagaugcaucuucaaaaauuggaaucagcacacaauccucagcaaaucuauuuucggaaagauguguuaugugaaacccugucuggaaacagcugccccuuggugacuauaacagcaaugccagagucuaauuauuaugaacauaucugccauuucagaaaucgcccuuacguuuucuugucugcucggguacauccuggagaaacuaaugcaaguuggguuaugaaaggaacguuggaauaucucaugagcaauaaccccacugcucagagcuuacgagaaucuuauauuuuuaaaauugucccuauguuaaauccagauggugucaucaauggaaaucaucgcuguucuuuaaguggagaggauuugaauaggcaguggcaaaguccaaguccggauuuacauccuacaauuuaccaugcuaaggggcuguugcaauacuuggcugcagugaagcguuuacccuugguuuauugugauuaucauggccauucccgaaagaagaauguauuuauguaugguugcagcaucaaagagacaguguggcauaccaaugauaaugcaacuucaugugauguuguggaggauacgggauacaggacauugccuaagauacugagccauaucgccccagcauuuugcaugagcagcuguagcuucguaguggaaaaaucuaaagaauccacagcacguguuguaguuuggagggaaauaggaguacaaagaaguuauaccauggagaguacuuuauguggcugugaucagggaaaauacaaggguuuacagauugguacccgagaacuggaagagaugggagcaaaauuuuguguuggucuuuuacguuugaaaagacugaccucuccauuggaguauaaucugccuuccagccugcuugacuuugaaaaugauuuaauugaaucaagcugcaaaguaacuagcccuaccacuuaugucuuggaugaagaugaaccucgauuccuugaagaaguugauuacagugcagaaaguaaugaugaguuagauauugaguuggcugaaaauguaggagauuaugaaccuucugcucaagaagaaguacuuucugacucugaauuaucaagaacauaccuaccuugagcccgcugccaucucuuguuaacugcaaagaauaaaugaaauaucuugguuuuuauuucccaggaagcuugagagaaaugaguuuauacagagcugacucaaaaagacaaaaaguaacuugggccaguuugguuucaagauaauaaauguguuauuaauuaaugauaaaauuggcgcuuguuuuauuuucgauauucaaugcacuuuauguagcauugaaugaucaaauauuggauuuaccuuuaaaaaaaaaaccugaguaucauugcaugaauuuuuaucucccuaugguuauauccugcaucaaguggauaauuuugaaguguguucagaauauaaaauugaaauuuuagaguuguugaaaauccugacuuguugaaaacuaauauauauguacauggauuucuauagauguguuuguuuagaaguggguagauauugcagauaagacuguucuucagaaucauguuaacuauuggguugugacugaaguaguccaggguuugccuugaaaccauuacauucuacauuuaccaaauuaaacaaauaaaaacuguauuaaauguugc

SEQ ID NO: 491 - RNA, 2267 nt, Homo Sapiens
acguagcgcggcgcucggaacugaccuacuaacacacaucucuccgcgcggccacggcgcccgcggacccggcgcgcccgcccgccucccgcgccgcgcccucgccgccgcccgccucccgccgcggccccggaggcccggcccggcccgagccccgagcgccggcggcccgacucccggccgccccuuucuuucuccucgccggcccgagagcaggaacacguaguuuagguauuugggaacuuauuuccuuuuugaaaaugcuaacuuguugaaagaaagaacuguggccaugccucaucugugcuuguaugcccuaaaugcuuagcauauuuccuuguacauaauuuguaauaaacauuuauccagugaauaacugguuuuuuuuuuauucauguauugcagauaacgaaggaggcccaacuucauucaauaaggagccugacggauuuaucccagacgguagaacaaaaggaagaauauugauggauuuuaaaccagaguuuuuaaagagcuugagaauacggggaaauuaauuuguucuccuacacacauagauaggguaagguuguuucugaugcagcugagaaaaaugcagaccgucaaaaaggagcaggcgucucuugaugccaguagcaauguggacaagaugaugguccuuaauucugcuuuaacggaagugucagaagacuccacaacaggugaggagcugcuucucagugaaggaaguguggggaagaacaaaucuucugcaugucggaggaaacgggaauucauuccugaugaaaagaaagaugcuauguauugggaaaaaaggcggaaaaauaaugaagcugccaaaagaucucgugagaagcgucgacugaaugaccugguuuuagagaacaaacuaauugcacugggagaagaaaacgccacuuuaaaagcugagcugcuuucacuaaaauuaaaguuugguuuaauuagcuccacagcauaugcucaagagauucagaaacucaguaauucuacagcuguguacuuucaagauuaccagacuuccaaauccaaugugaguucauuuguggacgagcacgaacccucgauggugucaaguaguuguauuucugucauuaaacacucuccacaaagcucgcuguccgauguuucagaaguguccucaguagaacacacgcaggagagcucugugcagggaagcugcagaaguccugaaaacaaguuccagauuaucaagcaagagccgauggaauuagagagcuacacaagggagccaagagaugaccgaggcucuuacacagcguccaucuaucaaaacuauauggggaauucuuucucuggguacucacacucucccccacuacugcaagucaaccgauccuccagcaacuccccgagaacgucggaaacugaugauggugugguaggaaagucaucugauggagaagacgagcaacagguccccaagggccccauccauucuccaguugaacucaagcaugugcaugcaacugugguuaaaguuccagaagugaauuccucugccuugccacacaagcuccggaucaaagccaaagccaugcagaucaaaguagaagccuuugauaaugaauuugaggccacgcaaaaacuuuccucaccuauugacaugacaucuaaaagacauuucgaacucgaaaagcauagugccccaaguaugguacauucuucucuuacuccuuucucagugcaagugacuaacauucaagauuggucucucaaaucggagcacuggcaucaaaaagaacugaguggcaaaacucagaauaguuucaaaacuggaguuguugaaaugaaagacaguggcuacaaaguuucugacccagagaacuuguauuugaagcaggggauagcaaacuuaucugcagagguugucucacucaagagacuuauagccacacaaccaaucucugcuucagacucuggguaaauuacuacugaguaagagcugggcauuuagaaagaugucauuugcaauagagcaguccauuuuguauuaugcugaauuuucacuggaccugugaugucauuucacugugaugugcacauguugucuguuuggugucuuuuugugcacagauuaugaugaagauuagauuguguuaucacucugccuguguauagucagauaguccaugcgaaggcuguauauauugaacauuauuuuuguuguucuauuauaaaguguguaaguuaccaguuucaauaaaggauuggugacaaacacagaa

SEQ ID NO: 492 - RNA, 11258 nt, Homo Sapiens
agagcacaggcuuugaccgauaguaaccucugcgcucggugcagccgaaucuauaaaaggaacuagucccggcaaaaaccccguaauugcgagcgagagugaguggggccgggacccgcagagccgagccgacccuucucucccgggcugcggcagggcagggcggggagcuccgcgcaccaacagagccgguucucagggcgcuuugcuccuuguuuuuuccccgguucuguuuucuccccuucuccggaaggcuugucaagggguaggagaaagagacgcaaacacaaaaguggaaaacaguuaaugaccagccacggcgucccugcugugagcucuggccgcugccuuccagggcucccgagccacacgcugggggugcuggcugagggaacauggcuuguuggccucagcugagguugcugcuguggaagaaccucacuuucagaagaagacaaacaugucagcugcugcuggaaguggccuggccucuauuuaucuuccugauccugaucucuguucggcugagcuacccacccuaugaacaacaugaaugccauuuuccaaauaaagccaugcccucugcaggaacacuuccuuggguucaggggauuaucuguaaugccaacaaccccuguuuccguuacccgacuccuggggaggcucccggaguuguuggaaacuuuaacaaauccauuguggcucgccuguucucagaugcucggaggcuucuuuuauacagccagaaagacaccagcaugaaggacaugcgcaaaguucugagaacauuacagcagaucaagaaauccagcucaaacuugaagcuucaagauuuccugguggacaaugaaaccuucucuggguuccuguaucacaaccucucucucccaaagucuacuguggacaagaugcugagggcugaugucauucuccacaagguaagcugaugccuccagcuuccucaguagggcugauggcaauuacguugugcagcuacuggaaagaaaugaauaaacccuuguccuuguaaugguggugaaggggagggagguaguuugaauacaacuucacuuaauuuuacuucccuauucaggcaggaauugccaaaccauccaggaguggaauaugcaaccuggcgucaugggccagcugguuaaaauaaaauugauuucuggcuuaguauuuuugcaaggcuaccaguuacauuugacaagucugugcaauggaucaaaaucagaagagaugauucaacuuggugaccaagaaguuucugagcuuuguggccuaccaagggagaaacuggcugcagcagagcgaguacuucguuccaacauggacauccugaagccaauccugauggaugugacaugugaugacauugcacaugggcaguuaacugugccaagaagugcagcaguagcagcaaccggagaugcaaagcccaacaugauggggagagaaacucuucuuucaauaugugcuucuguaccaaaaguggaauuucacgagagacauauuuugaaacauuucuccuuuugugugugcgugaguguuucccuguuuccagccaaggguauugugaguuucuccugggccuccuucagaaucugggugcucuggaaagcaguguuuuggcaacauggggaaaguauggcagugugggagggucagcugggucuggguuugaauauugcauuugaauauuuuaccagcauugaugucggauaaauuauuuagucccuguaagccucaguuuucucuucuucuacauacacauaauauauuugacucuuuguugugauuauugguuacacauaugaagagccugguguggggccuggcacacaauaggugcucaauaaauagaaguugauaauuuagaacacuaaacucuacaucucccuucccgagcaaggagcuggcugaagccacaaaaacauugcugcauagucuugggacucuggcccaggagcuguucagcaugagaagcuggagugacaugcgacaggaggugauguuucugaccaaugugaacagcuccagcuccuccacccaaaucuaccaggcugugucucguauugucugcgggcaucccgagggaggggggcugaagaucaagucucucaacugguaugaggacaacaacuacaaagcccucuuuggaggcaauggcacugaggaagaugcugaaaccuucuaugacaacucuacaacuccuuacugcaaugauuugaugaagaauuuggagucuaguccucuuucccgcauuaucuggaaagcucugaagccgcugcucguugggaagauccuguauacaccugacacuccagccacaaggcaggucauggcugaggugaacaagaccuuccaggaacuggcuguguuccaugaucuggaaggcaugugggaggaacucagccccaagaucuggaccuucauggagaacagccaagaaauggaccuuguccggaugcuguuggacagcagggacaaugaccacuuuugggaacagcaguuggauggcuuagauuggacagcccaagacaucguggcguuuuuggccaagcacccagaggauguccaguccaguaaugguucuguguacaccuggagagaagcuuucaacgagacuaaccaggcaauccggaccauaucucgcuucauggagugugucaaccugaacaagcuagaacccauagcaacagaagucuggcucaucaacaaguccauggagcugcuggaugagaggaaguucugggcugguauuguguucacuggaauuacuccaggcagcauugagcugccccaucaugucaaguacaagauccgaauggacauugacaauguggagaggacaaauaaaaucaaggauggguacugggacccugguccucgagcugaccccuuugaggacaugcgguacgucugggggggcuucgccuacuugcaggaugugguggagcaggcaaucaucagggugcugacgggcaccgagaagaaaacuggugucuauaugcaacagaugcccuaucccuguuacguugaugacaucuuucugcgggugaugagccggucaaugccccucuucaugacgcuggccuggauuuacucaguggcugugaucaucaagggcaucguguaugagaaggaggcacggcugaaagagaccaugcggaucaugggccuggacaacagcauccucugguuuagcugguucauuaguagccucauuccucuucuugugagcgcuggccugcuaguggucauccugaaguuaggaaaccugcugcccuacagugaucccagcgugguguuugucuuccuguccguguuugcuguggugacaauccugcagugcuuccugauuagcacacucuucuccagagccaaccuggcagcagccugugggggcaucaucuacuucacgcuguaccugcccuacguccuguguguggcauggcaggacuacgugggcuucacacucaagaucuucgcuagccugcugucuccuguggcuuuuggguuuggcugugaguacuuugcccuuuuugaggagcagggcauuggagugcagugggacaaccuguuugagaguccuguggaggaagauggcuucaaucucaccacuucggucuccaugaugcuguuugacaccuuccucuauggggugaugaccugguacauugaggcugucuuuccaggccaguacggaauucccaggcccugguauuuuccuugcaccaaguccuacugguuuggcgaggaaagugaugagaagagccacccugguuccaaccagaagagaauaucagaaaucugcauggaggaggaacccacccacuugaagcugggcguguccauucagaaccugguaaaagucuaccgagaugggaugaagguggcugucgauggccuggcacugaauuuuuaugagggccagaucaccuccuuccugggccacaauggagcggggaagacgaccaccaugucaauccugaccggguuguuccccccgaccucgggcaccgccuacauccugggaaaagacauucgcucugagaugagcaccauccggcagaaccugggggucuguccccagcauaacgugcuguuugacaugcugacugucgaagaacacaucugguucuaugcccgcuugaaagggcucucugagaagcacgugaaggcggagauggagcagauggcccuggauguugguuugccaucaagcaagcugaaaagcaaaacaagccagcugucagguggaaugcagagaaagcuaucuguggccuuggccuuugucgggggaucuaagguugucauucuggaugaacccacagcugguguggacccuuacucccgcaggggaauaugggagcugcugcugaaauaccgacaaggccgcaccauuauucucucuacacaccacauggaugaagcggacguccugggggacaggauugccaucaucucccaugggaagcugugcugugugggcuccucccuguuucugaagaaccagcugggaacaggcuacuaccugaccuuggucaagaaagauguggaauccucccucaguuccugcagaaacaguaguagcacugugucauaccugaaaaaggaggacaguguuucucagagcaguucugaugcuggccugggcagcgaccaugagagugacacgcugaccaucgaugucucugcuaucuccaaccucaucaggaagcaugugucugaagcccggcugguggaagacauagggcaugagcugaccuaugugcugccauaugaagcugcuaaggagggagccuuuguggaacucuuucaugagauugaugaccggcucucagaccugggcauuucuaguuauggcaucucagagacgacccuggaagaaauauuccucaagguggccgaagagagugggguggaugcugagaccucagaugguaccuugccagcaagacgaaacaggcgggccuucggggacaagcagagcugucuucgcccguucacugaagaugaugcugcugauccaaaugauucugacauagacccagaauccagagagacagacuugcucagugggauggauggcaaaggguccuaccaggugaaaggcuggaaacuuacacagcaacaguuuguggcccuuuuguggaagagacugcuaauugccagacggagucggaaaggauuuuuugcucagauugucuugccagcuguguuugucugcauugcccuuguguucagccugaucgugccacccuuuggcaaguaccccagccuggaacuucagcccuggauguacaacgaacaguacacauuugucagcaaugaugcuccugaggacacgggaacccuggaacucuuaaacgcccucaccaaagacccuggcuucgggacccgcuguauggaaggaaacccaaucccagacacgcccugccaggcaggggaggaagaguggaccacugccccaguuccccagaccaucauggaccucuuccagaaugggaacuggacaaugcagaacccuucaccugcaugccaguguagcagcgacaaaaucaagaagaugcugccugugugucccccaggggcaggggggcugccuccuccacaaagaaaacaaaacacugcagauauccuucaggaccugacaggaagaaacauuucggauuaucuggugaagacguaugugcagaucauagccaaaagcuuaaagaacaagaucugggugaaugaguuuagguauggcggcuuuucccugggugucaguaauacucaagcacuuccuccgagucaagaaguuaaugaugccaucaaacaaaugaagaaacaccuaaagcuggccaaggacaguucugcagaucgauuucucaacagcuugggaagauuuaugacaggacuggacaccaaaaauaaugucaaggugugguucaauaacaagggcuggcaugcaaucagcucuuuccugaaugucaucaacaaugccauucuccgggccaaccugcaaaagggagagaacccuagccauuauggaauuacugcuuucaaucauccccugaaucucaccaagcagcagcucucagagguggcucugaugaccacaucaguggauguccuuguguccaucugugucaucuuugcaauguccuucgucccagccagcuuugucguauuccugauccaggagcgggucagcaaagcaaaacaccugcaguucaucaguggagugaagccugucaucuacuggcucucuaauuuugucugggauaugugcaauuacguugucccugccacacuggucauuaucaucuucaucugcuuccagcagaaguccuauguguccuccaccaaucugccugugcuagcccuucuacuuuugcuguauggguggucaaucacaccucucauguacccagccuccuuuguguucaagauccccagcacagccuauguggugcucaccagcgugaaccucuucauuggcauuaauggcagcguggccaccuuugugcuggagcuguucaccgacaauaagcugaauaauaucaaugauauccugaaguccguguucuugaucuucccacauuuuugccugggacgagggcucaucgacauggugaaaaaccaggcaauggcugaugcccuggaaagguuuggggagaaucgcuuugugucaccauuaucuugggacuuggugggacgaaaccucuucgccauggccguggaaggggugguguucuuccucauuacuguucugauccaguacagauucuucaucaggcccagaccuguaaaugcaaagcuaucuccucugaaugaugaagaugaagaugugaggcgggaaagacagagaauucuugaugguggaggccagaaugacaucuuagaaaucaaggaguugacgaagauauauagaaggaagcggaagccugcuguugacaggauuugcgugggcauuccuccuggugagugcuuugggcuccugggaguuaauggggcuggaaaaucaucaacuuucaagauguuaacaggagauaccacuguuaccagaggagaugcuuuccuuaacaaaaauaguaucuuaucaaacauccaugaaguacaucagaacaugggcuacugcccucaguuugaugccaucacagagcuguugacugggagagaacacguggaguucuuugcccuuuugagaggagucccagagaaagaaguuggcaagguuggugagugggcgauucggaaacugggccucgugaaguauggagaaaaauaugcugguaacuauaguggaggcaacaaacgcaagcucucuacagccauggcuuugaucggcgggccuccugugguguuucuggaugaacccaccacaggcauggaucccaaagcccggcgguucuuguggaauugugcccuaaguguugucaaggaggggagaucaguagugcuuacaucucauaguauggaagaaugugaagcucuuugcacuaggauggcaaucauggucaauggaagguucaggugccuuggcaguguccagcaucuaaaaaauagguuuggagaugguuauacaauaguuguacgaauagcaggguccaacccggaccugaagccuguccaggauuucuuuggacuugcauuuccuggaaguguucuaaaagagaaacaccggaacaugcuacaauaccagcuuccaucuucauuaucuucucuggccaggauauucagcauccucucccagagcaaaaagcgacuccacauagaagacuacucuguuucucagacaacacuugaccaaguauuugugaacuuugccaaggaccaaagugaugaugaccacuuaaaagaccucucauuacacaaaaaccagacaguaguggacguugcaguucucacaucuuuucuacaggaugagaaagugaaagaaagcuauguaugaagaauccuguucauacgggguggcugaaaguaaagaggaacuagacuuuccuuugcaccaugugaaguguuguggagaaaagagccagaaguugaugugggaagaaguaaacuggauacuguacugauacuauucaaugcaaugcaauucaaugcaaugaaaacaaaauuccauuacaggggcagugccuuuguagccuaugucuuguauggcucucaagugaaagacuugaauuuaguuuuuuaccuauaccuaugugaaacucuauuauggaacccaauggacauauggguuugaacucacacuuuuuuuuuuuuuuuuguuccuguguauucucauugggguugcaacaauaauucaucaaguaaucauggccagcgauuauugaucaaaaucaaaagguaaugcacauccucauucacuaagccaugccaugcccaggagacugguuucccggugacacauccauugcuggcaaugagugugccagaguuauuagugccaaguuuuucagaaaguuugaagcaccauggugugucaugcucacuuuugugaaagcugcucugcucagagucuaucaacauugaauaucaguugacagaauggugccaugcguggcuaacauccugcuuugauucccucugauaagcuguucugguggcaguaacaugcaacaaaaaugugggugucuccaggcacgggaaacuugguuccauuguuauauuguccuaugcuucgagccaugggucuacagggucauccuuaugagacucuuaaauauacuuagauccugguaagaggcaaagaaucaacagccaaacugcuggggcugcaagcugcugaagccagggcaugggauuaaagagauugugcguucaaaccuagggaagccugugcccauuuguccugacugucugcuaacaugguacacugcaucucaagauguuuaucugacacaaguguauuauuucuggcuuuuugaauuaaucuagaaaaugaaaagauggaguuguauuuugacaaaaauguuuguacuuuuuaauguuauuuggaauuuuaaguucuaucagugacuucugaauccuuagaauggccucuuuguagaacccugugguauagaggaguauggccacugccccacuauuuuuauuuucuuauguaaguuugcauaucagucaugacuagugccuagaaagcaaugugauggucaggaucucaugacauuauauuugaguuucuuucagaucauuuaggauacucuuaaucucacuucaucaaucaaauauuuuuugaguguaugcuguagcugaaagaguauguacguacguauaagacuagagagauauuaagucucaguacacuuccugugccauguuauucagcucacugguuuacaaauauagguugucuugugguuguaggagcccacuguaacaauacugggcagccuuuuuuuuuuuuuuuuuaauugcaacaaugcaaaagccaagaaaguauaagggucacaagucuaaacaaugaauucuucaacagggaaaacagcuagcuugaaaacuugcugaaaaacacaacuuguguuuauggcauuuaguaccuucaaauaauuggcuuugcagauauuggauaccccauuaaaucugacagucucaaauuuuucaucucuucaaucacuagucaagaaaaauauaaaaacaacaaauacuuccauauggagcauuuuucagaguuuucuaacccagucuuauuuuucuagucaguaaacauuuguaaaaauacuguuucacuaauacuuacuguuaacugucuugagagaaaagaaaaauaugagagaacuauuguuuggggaaguucaagugaucuuucaauaucauuacuaacuucuuccacuuuuuccagaauuugaauauuaacgcuaaagguguaagacuucagauuucaaauuaaucuuucuauauuuuuuaaauuuacagaauauuauauaacccacugcugaaaaagaaaaaaaugauuguuuuagaaguuaaagucaauauugauuuuaaauauaaguaaugaaggcauauuuccaauaacuagugauauggcaucguugcauuuuacaguaucuucaaaaauacagaauuuauagaauaauuucuccucauuuaauauuuuucaaaaucaaaguuaugguuuccucauuuuacuaaaaucguauucuaauucuucauuauaguaaaucuaugagcaacuccuuacuucgguuccucugauuucaaggccauauuuuaaaaaaucaaaaggcacugugaacuauuuugaagaaaacacaacauuuuaauacagauugaaaggaccucuucugaagcuagaaacaaucuauaguuauacaucuucauuaauacuguguuaccuuuuaaaauaguaauuuuuuacauuuuccuguguaaaccuaauugugguagaaauuuuuaccaacucuauacucaaucaagcaaaauuucuguauauucccuguggaauguaccuaugugaguuucagaaauucucaaaauacguguucaaaaauuucugcuuuugcaucuuugggacaccucagaaaacuuauuaacaacugugaauaugagaaauacagaagaaaauaauaagcccucuauacauaaaugcccagcacaauucauuguuaaaaaacaaccaaaccucacacuacuguauuucauuaucuguacugaaagcaaaugcuuugugacuauuaaauguugcacaucauucauucacuguauaguaaucauugacuaaagccauuugucuguguuuucuucuugugguuguauauaucagguaaaauauuuuccaaagagccaugugucauguaauacugaaccacuuugauauugagacauuaauuuguacccuuguuauuaucuacuaguaauaauguaauacuguagaaauauugcucuaauucuuuucaaaauuguugcaucccccuuagaauguuucuauuuccauaaggauuuagguaugcuauuaucccuucuuauacccuaagaugaagcuguuuuugugcucuuuguucaucauuggcccucauuccaagcacuuuacgcugucuguaaugggaucuauuuuugcacuggaauaucugagaauugcaaaacuagacaaaaguuucacaacagauuucuaaguuaaaucauuuucauuaaaaggaaaaaagaaaaaaaauuuuguaugucaauaacuuuauaugaaguauuaaaaugcauauuucuauguuguaauauaaugagucacaaaauaaagcugugacaguucuguuggucuacagaaa

SEQ ID NO: 493 - RNA, 2757 nt, Homo Sapiens
ccugucgccgccgccucgggcgggugggcugacuggcggcaggcucgccgcggcgcggagucccggcugcgggauagaccgagggccauggccgccucucccggacccgccggcguuggcggcgccggagcagucuacggcuccggcucuucgggcuucgcccucgacucgggacuggagaucaaaacucgcucgguggagcagacgcuacucccgcugguuucucagaucaccacgcuuauuaaucauaaagauaauaccaaaaagucugauaaaacucugcaagcaauucagcguguaggacaagcugucaacuuggcaguuggaagauuuguuaaaguaggagaagcuauagccaaugaaaacugggauuugaaagaagaaauaaauauugcuuguauugaagcuaaacaagcaggagaaacaauugcagcacuuacagacauaaccaacuugaaccaucuggaaucugaugggcagaucacaauuuuuacagacaaaacaggagugauaaaggcugcaagauuacuucuuucuucagugacaaaaguguuguugcuggcagaccgaguagucauuaaacagauaauaacaucaagaaauaagagacuaacaauauauaacuuaagacacaguuaaaucaguggaaaugauaauuauccacaacuacaaaauuucuguacucagagucccuaaauguuacugaauaaucucaaaacuuacagaacagauuuaaacucuuccaguccagaaguuaaucucucagaugauggucaugguucucgcaacuauggaaagacuagagaaagugaauagcuuucaagaguuuguccaaauauucagucaauuuggaaaugaaaugguggaguuugcacaucugaguggagauagacaaaaugauuugaaagaugaaaagaaaaaggcaaaaauggcagcagcuagggcaguucuugaaaaguguacaaugaugcuucucacagcuucaaagacaugucugaggcauccuaacugcgaaucagcccauaaaaacaaagaaggaguauuugaccguaugaaaguggcauuggauaaggucauugaaauugugacugacuguaaaccgaauggagagacugacauuucaucuaucaguauuuuuacuggaauuaaggaauucaagaugaauauugaagcucuucgggagaaucuuuauuuucaguccaaagagaaccuuucugugacauuggaagucaucuuggagcguauggaggacuuuacugauucugccuacaccagccaugagcacagagaacgcaucuuggaacugucaacucaggcgagaauggaacugcagcaguuaauuucuguguggauucaagcucaaagcaagaaaacaaaaagcaucgcugaagaacuggaacucaguauuuugaaaaucagucacagucuuaaugaacuuaagaaagaacuucauaguacagcgacacagcuggcagcagaucuauuaaaauaccaugcugaucaugugguucuaaaagcauuaaaacuuacuggaguagaaggaaauuuagaagcuuuggcugaauaugccuguaaacucucugaacagaaagagcagcuuguugagaccugucgauuguuacgacacauaucugggacagaaccucuggaaauaaccuguauacaugcagaggagacauuucaggugacuggccaacagauaauuucugcugcugaaacauugacauugcauccaucuaguaaaauugcuaaagaaaaccuagauguauuuugugaagcuugggaaucccaaauuagugacaugucaacacugcugagagaaaucaaugacguguuugaaggaagacgagcaucaauccuggccagcugauucuccucuuuaccagaacaccauugagcuuaguacaggagagaaguauggcuaccuuucacuuccaaagccaaugaagaauaaugcaaaccugaaaucauuaaagccagacaagccugacucugaggagcaagccaagauagcaaagcuuggacuuaagcuggguuugcucaccucugacgcugacugcgaaauugagaagugggaagaucaggagaaugagauuguucaauauggacggaacauguccaguauggccuauucucuguauuuauuuacuagaggagaggggccacugaaaacuucccaggauuuaauucaucaacuagagguuuuugcugcagaggguuuaaagcuuacuuccaguguucaagcuuuuucaaaacagcugaaagacgaugacaagcuuaugcuucuccuggaaauaaacaagcuaauuccucuaugccaccagcuccagacaguaacuaagacuucuuugcagaauaaaguauuucuaaagguugacaaguguauuacgaagacaagauccaugauggcucucuuaguccaacuucuuucacuuuguuauaaacugcugaagaagagugaaaccagauacuaauugucuuaacucuuuccagcuucagauggaaaauaacggaugggucucaguuacaaauaaggacacuauggauaguaaaacuugagaagcuuuuggggucagaucucuggaacaucaugugaugaagcugacauuuuuaaaaaucaaaugauccuuuaucuuuucagaaauucaucaauuuuauaaagaaaacaauauugaaauuuugcucuauuuucugaucaugaaacugauuguaaagcuuuuugacaacuaauaaaugucuugguaauugcuagauucu

SEQ ID NO: 494 - RNA, 6389 nt, Homo Sapiens
caacaugggagccgccacucccaaagaaguccggacugcuuugccgggucuucccaacccuucacaaccagcucuuucuagccucacgccgacuucuccaccgucacacuccgcccaguguuaugaggguucugcucacucccgaggaccucggcgcugcccaggcugcagccucgaauccccacaauccuuaccucccuaggcugugcccacucgcggacggaagugcccggagcccaaggggcggggccuggucuggccaauggaagcacagagugcaggcucaguggucacguguccagcgggcgggaauuuuaccccaggaagagaugcaggaggcgauuuuuaccucagauguugaaauuuacacugcuuugaaagaaagaagauauguuuucagcauugaaauaucaugcaauagacuauuuauaugagaaugugguuagaaagaaguuuuacagagaugcuuuauugcuucgaaucccuucauguuuauaucaagaugaaaguuaccauguagcaguuacugauaauaaauuuaggaggccauggacgagagaaagaagaaagugcuucaagaaggaaguaguaguccaauguguugggcuccuguuaaaagcucaaguuaugugaggauagugaguugaccauuagcuugacuaaauucucagcuguuucaguuccgggaaugacagauaccucagucuuggaccaauggaaagcaaguuucuuuguggaggauuuccuugagaaaaaaacaauuacaagaauggugacccagauuaauugugaauuugaggaaguuguuccaaguucaaauccagacucccaaauugaaguagaggaggucaguuuauacacccacauggacuacaaugaagucuuuaccccugucaguuguuuagaaaaauguucagcacuucaaaaccagaaccaagaaagaaacccagacaaggcaggguggagaccgagaggagaaauuuauuccagaaauuaacuguuagcaguaguguuucuuaauacauaagcuauaucauacuccucaaguagauucuuugcuuaaaacuuucacuguaaauaauuuuauagcaaccaugugaauaacuuaagaauaauagaaucagucucauuuguaggcacuguagaccaucuccauucccuacaugucagagacucugggggaugaauuggagauauuaagagguaaaaugaugcagagaagaccaaggucagcagaagucaaauacuucuauuucuuuaaaauuuugcuuaggcuacgccuggcuauuuugaaguauuuauuuauugaugauaaaggaauacuuuuuguaaguaguagaaaacaccuaccaacuuugccuacucucuugaguagacuaaaacuguuuuugguaaaggauccucuuuuagauuucaaaggacagaucuucacagaagcuaauuuuuccagggaauguuucucucuucaagaaacuuuggaagcuuuugugaaagaagauuuuuguauggauaaagugaacuuuugucaagagaaacuagaagauacaauauguuuaaaugagccgucaaguuuucuuauugaguaugaauucuuaauaccuccaagccucaaaccagaaauugauauuccaucacucucagaacugaaggaguuauuaaacccagugccagaaauaauaaacuauguagaugaaaaggaaaagcuuuuugaaagagaucuuacuaacaagcauggaauugaggauaucggggauauaaaauucagcuccacagagauuuugaccauucaaagccagagugaaccagaagagugcaguaaaccaggagaguuagaaaugccacuaacuccucuauuccuaacaugccaacauucuucagugaauucauuacguacagaacuucagacauuuccauuaucuccgguuuguaaaauuaauuugcuuacugcugaagaaucagcuaaugaauacuacaugauguggcaauuagaaagauguagaagcccuuugaacccauuuuugcuuacagugccaagaauucaagagccccacagccaauauucaguuacagauuugaaaaagauauuuucuguuaaagaagaaagccuugugauuaaucuggaaaaggcagagugguggaaacaagcaggacuaaaucugaaaaugauggaaacauuggaacaucugaauacauauuuaugucaugauaauuugucuucuaaugacacuaaaauugagauauuuuugccuacgaaagugcuucaauuagaauguaaguacaucacaguaaauauuaguuauguaaacauuuucagaaugugaaaauguuagauucuggauuuccucuagguaauugggaaaaucacuagguucuagcauuccauauaggcccuggcucugccagaauuuaugacuuuggauuucucuaggucccauuuucuugaaaaaaugaugaaguuugacuagcuaacccuaaaaucuuguuauguccuaaaauucuauagucucaguuuuuaaauuucuagccauuuucauuuaaagugacuuuguuuccuuuuauaaaugauuaaauugcuagcaguuuccguucacauuggccuagacgcaaaccagcauuuugcaguaacuguuuuuugaccuaacagcugaacauuagcauucaauaauaucacucuuuaacaaucaugucuagaacauaaaagucauucuucaccuauugcacuuauugaugaaaaaucuacaaaugcucauuuaucacuuccacaaaagaguccaucucuggcaaaagaaguaccagaucuauguuuuucugaugacuauuucucugauaaaggagcagcaaaagaagaaaaaccaaagaaugaccaagaaccaguaaacagaauaauccaaaagaaagaaaauaacgaucacuuugaacuugacugcacaggaccaucuauuaaaucaccuuccucuucaauaauuaaaaaagcaucuuuugaacauggcaaaaaacaagagaaugauuuggaccuuuugagcgacuuuauuaugcugcgaaauaaauauaagacuugcaccucaaagacugaagucacaaacagugaugaaaaacaugauaaagaagcauguucuuugacacuucaagaagaaaguccuauuguucauauuaauaaaacccuggaggaaauaaaucaggaaaggggaacagauagugucauugaaauucaagcgucagauagccagugccaagcauuuugccuccucgaagcagcagcuucuccuaucuuaaaaaaccuuguauccuuguguacccucccuacugcuaauuggaaauuugccacuguuauuuuugaccaaacaagguuucucuuaaaggaacaagaaaaaguaguaagugaugcuguucgccaagguacaauugaugaaagagaaaugacuuucaagcaugccgcucucuuacaucuucugguaacaauuagagauguccuuuuaacaugcagcuuggacacagcauugggauauuugucgaaggcaaaagauaucuacaacagcauuuuaggccccuauuugggugacauuuggagacagcuggagauuguacaguuuauuagggggaaaaagccugaaaccaacuacaagauacaagaauugcaaugucagauacuaaguuggaugcaaagucaacagcaaauuaagguacugauuauaauaagaauggacucagacggugaaaaacauuuucucauuaaaauucuuaacaaaauagaagguuuaacacugacuguccuucauucaaaugaaagaaaagauuuucuggaaucugaagguguuuuaagggguacaaguuccuguguaguuguacauaaucaauauauuggagcagauuuccccuggaguaauuucucauuugugguggaauacaauuauguggaagacucuuguuggacuaaacacugcaaagaguugaauauuccuuacauggccuuuaaagugauucuuccagacacaguuuuagaaagaagcaccuugcuggauagauuuggagguuuucuuuuggaaauucagauuccauauguguuuuuugcaucugaaggacuucuuaauacuccagacauacuucagcugcuagaauccaacuauaacaucucacuaguagagagaggcugcagugagucauugaaacucuuuggaaguucagaguguuauguaguggugacaauugaugaacacacugccauaauuuugcaggaucuagaagaauugaauuaugagaaggcaucagacaauaucauuaugaggcugauggcauuaucauuacaguacagauauuguuggauaauuuuauauaccaaagaaacauuaaauucagaguaucugcuuacagaaaagacacuucaucaccuagcacugauuuaugcagcuuugguuucauuugggcuaaacucugaagaacuggauguaaagcuuauaauugccccaggaguagaagcaacugccuugauaauucgacaaauugcugaccacaguuuaaugaccucaaagagagauccucaugaaugguuggauaaauccuggcuuaaaguuucaccaucugaggaagaaauguacuuacuugauuuuccauguauuaacccauugguggcucagcucaugcuaaauaaaggaccuucacugcauuggauauuauuagcaacucugugucaacuucaggaacuccuaccugaagucccagaaaaaguguuaaagcauuuuuguagcaucacuucccuauucaagauugguucuucuuccauaacaaaaucaccgcaaauuucgucaccucaggaaaauaggaaucagauuaguaccuugucuucucaaaguucagcuucugauuuagacucugucauucaagaacauaaugaauauuaucaguauuuaggauuaggagagacagugcaggaagacaaaaccaccauuuugaaugacaacucuuccauuauggaacuaaaagaaaucucaaguuuuuuaccaccugugacuucauacaaucagaccagcuacuggaaagacuccagcuguaaaucuaauauagggcagaauacuccuuuucuaauuaauauagaaucaaggagaccggcuuauaacuccuuucuaaaccacagugauucagagucagaugucuuuucuuugggucuaacacaaaugaacugugaaacuauaaaaucaccaacugacacucagaagagagugucaguugucccccguuuuauaaauucucagaaaaggagaacacaugaagcaaaagguuucauaaauaaagauguaucggacccuaucuuuucacuagagggcacucaaucuccucuucauuggaacuuuaagaaaaauauaugggaacaagagaaucacccguucaacuuacaauauggugcacagcagacugcauguaacaaauuguacucucagaaagguaauuuauucacugaucagcaaaaaugucuaucagaugagucugaaggccucacaugugaaaguucaaaagaugagacuuucuggagagaauuaccaucuguccccaguuuggauuuauuucgugcuucugauucuaaugcaaaucaaaaagaauucaacagccuuuauuucuaccaaagagcuggaaaaaguuuaggacagaaaaggcaccaugaaucuucauuuaacucaggagacaaggaaucauuaacagguuuuaugugcucacaacuaccacaauucaaaaaacgacgucuagcauaugaaaaagucccugguagaguugaugggcagacucggcugagguuuuuuugaaggaggagaagagcaauguuacaugccauauuccacuguuuuugaugcuaauccacuagcgcaauuauuuagauuugcucauacacuaaagaaaacacaauuguucauauaugucucaguauuucuguauuaaauauucauaauauguauucugcccuaugguuugcaucuuuguaaguuaaauauucuaauuuaucaauuagcagaauaauuaucauaagauccaaaaugucuuccagacaccccugcacacaggccauuuaaaugagucuccaucacagucugacccuuugagucaggaagugaagaucaucacaguuaacccucccacaucaagaaaguuaaaaccuaggacaaaauugaaguuagaaaacuuccaacuuaaaguaucauuuucuguaaacacaauuuaagaacaaauuacuaagaggaaauauuugcaacccagauaauaggaaaaaaaguuuacauuucucauauauaaagaauuccuacaaauugauagaaagaagacaaccugauagaagaacgggcaaaauauaugaacagauauuuccucagaaaaaaacaaaaauugucaauaaacauuugaaacac

SEQ ID NO: 495 - RNA, 3908 nt, Homo Sapiens
acagcacagacagauugaccuauugggguguuucgcgagugugagagggaagcgccgcggccuguauuucuagaccugcccuucgccugguucguggcgccuugugaccccgggccccugccgccugcaagucggaaauugcgcugugcuccugugcuacggccuguggcuggacugccugcugcugcccaacuggcuggcaagaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagacacugaucugcuagugcuguaauauuguaaauacuggacucaggaacuuuuguuaggaaaaaauugaaagaacuuaagucucgaauguaauuggaaucuucaccucagaguggaguugaaacugcuauagccuaagcggcuguuuacugcuuuucauuagcaguugcucacaugucuuugggugggggggagaagaagaauuggccaucuuaaaaagcggguaaaaaaccuggguuaggguguguguucaccuucaaaauguucuauuuaacaacugggucaugugcaucugguguaggaaguuuuuucuaccauaagugacaccaauaaauguuuguuauuuacacuggucuaauguuugugagaagcuucuaauuagaucaauuacuuauuuuaggaaauuuaagacuagauacucguguguggggugaggggagggaguauuugguauguugggauaaggaaacacuucuauuuaaugcuuccagggauuuuuuuuuuuuuuuuuaacccuccugggcccaagugauccuuccaccucagucucccagcuaauugagaccacaggcuuguuaccaccaugcucggcuuuugcauuaaucuaagaaaaggggagagaaguuaauccacaucuuuacucaggcaaggggcauuucacagugcccaagagugggguuuucuugaacauacuugguuuccuauuuccccuuaucuuucuaaaacugccuuucugguggcuuuuuuuaaaauuauuacuaaugaugcuuuuauagcugcuuggauucucugagaaaugauggggagugagugaucacugguauuaacuuuauacacuuggauuucauuuguaacuuuaggauguaaagguauauugugaacccuagcugugucagaaucuccaucccugaaauuucucauuagugguacuggggugggaucuuggauggugacauugaaacuacacuaaauccccucacuaugaauggguuguuaaaggcaaugguuugugucaaaacugguuuaggauuacuuagauuguguuccugaagaaaagaguccagguaaaugguaugaucaauaaaggacaggcuggugcuaacauaaaauccaauauuguaauccuagcacuuugggaggccaaggcggguggaucacaaggucaagagauagagaccaucuuugccaacauggugaaacuccaucucuacugaaaauacaaaaauuagcugggcgugguagugcaagcugaaggcugaggcaggagaaucacucgaacccgggaggcagagguugcagugagccgagaucacaccacuguacuccagcccggcacuccagccuggcgacaagagugagacuccaccucaaaaaaaaaaaaaagaauccaauacugcccaaggauagguauuuuauagaugggcaacuggcugaaagguuaauucucuagggcuaguagaacuggaucccaacaccaaacucuuaauuagaccuaggccucagcugcacugcccgaaaagcauuugggcagacccugagcagaauacuggucucaggccaagcccaauacagccauuaaagaugaccuacagugcuguguacccuggggcaauaggguuaaaugguaguuagcaacuagggcuagucuucccuuaccucaaaggcucucacuaccguggaccaccuagucuguaacucuuucugaggagcuguuacugaauauuaaaaagauagacuucaa

SEQ ID NO: 496 - RNA, 1867 nt, Homo Sapiens
ccgcgacggcgcgcccccggcggcugcugcggcggcgggagcgaggcgaccgcugaggccgcggagagugacggcggcccggccgacgggagccggggcggggcggcggcccagcgaaggagcgcgcgggcggucuggccccgcccccuccccgcccgccuucccggugaccuucaggggcccggguggcgggcgcaggccccugcggcggcggcgggauguucgugcaggaggagaagaucuucgcgggcaaggugcugcggcugcacaucugcgcguccgacggcgccgaguggcuggaggaggccaccgaggacaccucgguggagaagcucaaggagcgcugccucaagcacugugcucaugggagcuuagaagaucccaaaaguauaacccaucauaaauuaauccacgcugccucagagagggugcugagugaugccaggaccauccuggaagagaacauccaggaccaagauguccuauuauugauaaaaaagcgugcuccaucaccacuucccaagauggcugaugucucagcagaagaaaagaaaaaacaagaccagaaagcuccagauaaagaggccauacugcgggccaccgccaaccugcccuccuacaacauggaccgggccgcgguccagaccaacaugagagacuuccagacagaacuccggaagauacuggugucucucaucgagguggcgcagaagcuguuagcgcugaacccagaugcaguggaauuguuuaagaaggcgaaugcaaugcuggacgaggacgaggaugagcguguggacgaggcugcccugcggcagcucacggagaugggcuuuccggagaacagagccaccaaggcccuucagcugaaccacaugucggugccucaggccauggaguggcuaauugaacacgcagaagacccgaccauagacacgccucuuccuggccaagcucccccagaggccgagggggccacagcagcugccuccgaggcugccgcgggagccagcgccaccgaugaggaggccagagaugagcugacggaaaucuucaagaagauccggaggaaaagggaguuucgggcugaugcucgggccgucauuucccugauggagaugggguucgacgagaaagaggugauagaugcccucagagugaacaacaaccagcagaaugccgcgugcgaguggcugcugggggaccggaagcccucuccggaggagcuggacaagggcaucgaccccgacaguccucucuuucaggccauccuggauaacccgguggugcagcugggccugaccaacccgaaaacauugcuagcauuugaagacaugcuggagaacccacugaacagcacccaguggaugaaugauccagaaacggggccugucaugcugcagaucucuagaaucuuccagacacuaaaucgcacguagguggcguuguuccacucggcuaucaggccacagcagcccccuggugcggcccgagaccgggcagaguggaccucaccuggaaacucaccuucagcgccucagcccuggacuguuagaggugcugcagcugcuccugcucucugaucuuauugcuuauaaacuuuggugacgguaguguguaaggccguauuuuuagcaucugacagguguuuacaaaaaagugguugucgcacugggaaguggagugauggccucgucuccagugcuccucugggcucuugaguugcugcuugaauugccguguagacauuugcuuggagaguccacuuguuauuugacggagguagguuucaacccagaguuaaugucaagcaugcuaauuuaacuagucacucacagaugacuuuucuuuaauaaagucccuuuuccua

SEQ ID NO: 497 - RNA, 74 nt, Homo Sapiens; identical to SEQ ID NO: 30

SEQ ID NO: 498 - RNA, 4283 nt, Homo Sapiens
cuccugcauagaggguaccaguucucuugacacuucaguguuagggaacaucagcaagacccaucccaggagaccuugaaggaagccuuugaaagggagaaugaaggagucaucuuugcaaaauagcuccugcagccugggaaaggagacuaaaaaggaaaacauguuccuucagucgucaaugcugaccugcauuuuccugcuaauaucugguuccugugaguuaugcgccgaagaaaauuuuucuagaagcuauccuugugaugagaaaaagcaaaaugacucaguuauugcagagugcagcaaucgucgacuacaggaaguuccccaaacggugggcaaauaugugacagaacuagaccugucugauaauuucaucacacacauaacgaaugaaucauuucaagggcugcaaaaucucacuaaaauaaaucuaaaccacaaccccaauguacagcaccagaacggaaaucccgguauacaaucaaauggcuugaauaucacagacggggcauuccucaaccuaaaaaaccuaagggaguuacugcuugaagacaaccaguuaccccaaauacccucugguuugccagagucuuugacagaacuuagucuaauucaaaacaauauauacaacauaacuaaagagggcauuucaagacuuauaaacuugaaaaaucucuauuuggccuggaacugcuauuuuaacaaaguuugcgagaaaacuaacauagaagauggaguauuugaaacgcugacaaauuuggaguugcuaucacuaucuuucaauucucuuucacacgugccacccaaacugccaagcucccuacgcaaacuuuuucugagcaacacccagaucaaauacauuagugaagaagauuucaagggauugauaaauuuaacauuacuagauuuaagcgggaacuguccgaggugcuucaaugccccauuuccaugcgugccuugugaugguggugcuucaauuaauauagaucguuuugcuuuucaaaacuugacccaacuucgauaccuaaaccucucuagcacuucccucaggaagauuaaugcugccugguuuaaaaauaugccucaucugaaggugcuggaucuugaauucaacuauuuagugggagaaauagccucuggggcauuuuuaacgaugcugccccgcuuagaaauacuugacuugucuuuuaacuauauaaaggggaguuauccacagcauauuaauauuuccagaaacuucucuaaacuuuugucucuacgggcauugcauuuaagagguuauguguuccaggaacucagagaagaugauuuccagccccugaugcagcuuccaaacuuaucgacuaucaacuuggguauuaauuuuauuaagcaaaucgauuucaaacuuuuccaaaauuucuccaaucuggaaauuauuuacuugucagaaaacagaauaucaccguugguaaaagauacccggcagaguuaugcaaauaguuccucuuuucaacgucauauccggaaacgacgcucaacagauuuugaguuugacccacauucgaacuuuuaucauuucacccguccuuuaauaaagccacaaugugcugcuuauggaaaagccuuagauuuaagccucaacaguauuuucuucauugggccaaaccaauuugaaaaucuuccugacauugccuguuuaaaucugucugcaaauagcaaugcucaaguguuaaguggaacugaauuuucagccauuccucaugucaaauauuuggauuugacaaacaauagacuagacuuugauaaugcuagugcucuuacugaauuguccgacuuggaaguucuagaucucagcuauaauucacacuauuucagaauagcaggcguaacacaucaucuagaauuuauucaaaauuucacaaaucuaaaaguuuuaaacuugagccacaacaacauuuauacuuuaacagauaaguauaaccuggaaagcaagucccugguagaauuaguuuucaguggcaaucgccuugacauuuuguggaaugaugaugacaacagguauaucuccauuuucaaaggucucaagaaucugacacgucuggauuuaucccuuaauaggcugaagcacaucccaaaugaagcauuccuuaauuugccagcgagucucacugaacuacauauaaaugauaauauguuaaaguuuuuuaacuggacauuacuccagcaguuuccucgucucgaguugcuugacuuacguggaaacaaacuacucuuuuuaacugauagccuaucugacuuuacaucuucccuucggacacugcugcugagucauaacaggauuucccaccuacccucuggcuuucuuucugaagucaguagucugaagcaccucgauuuaaguuccaaucugcuaaaaacaaucaacaaauccgcacuugaaacuaagaccaccaccaaauuaucuauguuggaacuacacggaaaccccuuugaaugcaccugugacauuggagauuuccgaagauggauggaugaacaucugaaugucaaaauucccagacugguagaugucauuugugccaguccuggggaucaaagagggaagaguauugugagucuggagcuaacaacuuguguuucagaugucacugcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacauuucuuaugacaccaaagaugccucuguuacugacugggugauaaaugagcugcgcuaccaccuugaagagagccgagacaaaaacguucuccuuugucuagaggagagggauugggauccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaacugacguuaagucaugauuucgcgccauaauaaagaugcaaaggaaugacauuucuguauuaguuaucuauugcuauguaacaaauuaucccaaaacuuagugguuuaaaacaacacauuugcuggcccacaguuuuugagggucaggaguccaggcccagcauaacuggguccucugcucagggugucucagaggcugcaauguagguguucaccagagacauaggcaucacuggggucacacucaugugguuguuuucuggauucaauuccuccugggcuauuggccaaaggcuauacucauguaagccaugcgagccucucccacaaggcagcuugcuucaucagagcuagcaaaaaagagagguugcuagcaagaugaagucacaaucuuuuguaaucgaaucaaaaaagugauaucucaucacuuuggccauauucuauuuguuagaaguaaaccacaggucccaccagcuccaugggagugaccaccucaguccagggaaaacagcugaagaccaagauggugagcucugauugcuucaguuggucaucaacuauuuucccuugacugcuguccugggauggccugcuaucuugaugauagauugugaauaucaggaggcagggaucacuguggaccaucuuagcaguugaccuaacacaucuucuuuucaauaucuaagaacuuuugccacugugacuaaugguccuaauauuaagcuguuguuuauauuuaucauauaucuauggcuacaugguuauauuaugcugugguugcguucgguuuuauuuacaguugcuuuuacaaauauuugcuguaacauuugacuucuaagguuuagaugccauuuaagaacugagauggauagcuuuuaaagcaucuuuuacuucuuaccauuuuuuaaaaguaugcagcuaaauucgaagcuuuuggucuauauuguuaauugccauugcuguaaaucuuaaaaugaaugaauaaaaauguuucauuuuacaa

SEQ ID NO: 499 - RNA, 2808 nt, Homo Sapiens
augaacauacaucacaaugugaacaguggucaucuccagauaguagaauuucagauauguuucuuuccauuuuucugacaguuugaauuuucuguaauaauuaauugacuuuuauacaauggaaacaacuuuuuuguuuuggaaaaaagaaagaugcugccgcuaaucaguggaugaaaaggaaaaugugaaacaauuugcuucuggaaacaggacagccggggccguguuccugcaacagcagaccaagcaccgcggcggacccaggcaagcacggaacaagcugagacggugauggugccucaaagcaguaacuuuuugcuuagagcuugagagucaaaguuaaggacccacauguauacuucggcucuagcgagucuaaggaugauaauauggauacaaaaucuauucuagaagaacuucuucucaaaagaucacagcaaaagaagaaaaugucaccaaauaauuacaaagaacggcuuuuuguuuugaccaaaacaaaccuuuccuacuaugaauaugacaaaaugaaaaggggcagcagaaaaggauccauugaaauuaagaaaaucagauguguggagaaaguaaaucucgaggagcagacgccuguagagagacaguacccauuucagauugucuauaaagaugggcuucucuaugucuaugcaucaaaugaagagagccgaagucagugguugaaagcauuacaaaaagagauaagggguaacccccaccugcuggucaaguaccauaguggguucuucguggacgggaaguuccuguguugccagcagagcuguaaagcagccccaggauguacccucugggaagcauaugcuaaucugcauacugcagucaaugaagagaaacacagaguucccaccuucccagacagagugcugaagauaccucgggcaguuccuguucucaaaauggaugcaccaucuucaaguaccacucuagcccaauaugacaacgaaucaaagaaaaacuauggcucccagccaccaucuucaaguaccagucuagcgcaauaugacagcaacucaaagaaaaucuauggcucccagccaaacuucaacaugcaguauauuccaagggaagacuucccugacugguggcaaguaagaaaacugaaaaguagcagcagcagugaagauguugcaagcaguaaccaaaaagaaagaaaugugaaucacaccaccucaaagauuucaugggaauucccugagucaaguucaucugaagaagaggaaaaccuggaugauuaugacugguuugcugguaacaucuccagaucacaaucugaacaguuacucagacaaaagggaaaagaaggagcauuuaugguuagaaauucgagccaagugggaauguacacaguguccuuauuuaguaaggcugugaaugauaaaaaaggaacugucaaacauuaccacgugcauacaaaugcugagaacaaauuauaccuggcagaaaacuacuguuuugauuccauuccaaagcuuauucauuaucaucaacacaauucagcaggcaugaucacacggcuccgccacccugugucaacaaaggccaacaagguccccgacucugugucccugggaaauggaaucugggaacugaaaagagaagagauuaccuuguugaaggagcugggaaguggccaguuuggagugguccagcugggcaaguggaaggggcaguaugauguugcuguuaagaugaucaaggagggcuccaugucagaagaugaauucuuucaggaggcccagacuaugaugaaacucagccaucccaagcugguuaaauucuauggaguguguucaaaggaauaccccauauacauagugacugaauauauaagcaauggcugcuugcugaauuaccugaggagucacggaaaaggacuugaaccuucccagcucuuagaaaugugcuacgaugucugugaaggcauggccuucuuggagagucaccaauucauacaccgggacuuggcugcucguaacugcuugguggacagagaucucugugugaaaguaucugacuuuggaaugacaagguauguucuugaugaccaguaugucaguucagucggaacaaaguuuccagucaaguggucagcuccagagguguuucauuacuucaaauacagcagcaagucagacguaugggcauuugggauccugaugugggagguguucagccuggggaagcagcccuaugacuuguaugacaacucccaggugguucugaaggucucccagggccacaggcuuuaccggccccaccuggcaucggacaccaucuaccagaucauguacagcugcuggcacgaggcaagucuuccagaaaagcgucccacauuucagcaacuccugucuuccauugaaccacuucgggaaaaagacaagcauugaagaagaaauuaggagugcugauaagaaugaauauagaugcuggccagcauuuucauucauuuuaaggaaaguagcaaggcauaauguaauuuagcuaguuuuuaauaguguucucuguauugucuauuauuuagaaaugaacaaggcaggaaacaaaagauucccuugaaauuuagaucaaauuaguaauuuuguuuaugcugcuccugauauaacacuuuccagccuauagcagaagcacauuuucagacugcaauauagagacuguguucauguguaaagacugagcagaacugaaaaauuacuuauuggauauucauucuuuucuuuauauugucauugucacaacaauuaaauauacuaccaaguacagaaaugugga

SEQ ID NO: 500 - RNA, 7751 nt, Homo Sapiens
cggugacgugacgugcugacggcgggcccgugccggggagcugggccgcuuuuugucagcuccgagcucggccccuccucccucccuccgcccgccccaccagccggagcccggcccagugcuccagagaaaggccggccugcagcacccgccaccgucgccggccgcccgcacguccguccggguucuugcuauauugccccaggcuggucucgaacuccugggcucaagccguucucccgccucccacugcccgccugucacugccgucuguucccugagcugugcuuuacgcugggaaagacauagaagaacuauuaagaagauagaauuguuuugcugcgcaguacagcaacaguggauguucaagauuaagauuagagucaaguugugugauuaagacagacagucuuccucugucauccaggcuggaaugcagugcaguggugcaaauuuggcucacugcagccucugccuucuguguucaagugauucuucuucugccucagccucucgaguagcugggauuacaggagcugugacugaugagaauuaaaggccauggaugaagaugggcuugaauuacaacaagagccaaacucauuuuuugaugcaacaggagcugaugguacacacauggauggugaucaaauuguuguggaaguacaagaaacuguuuuuguuucagauguuguggauucagacauaacugugcauaacuuuguuccugaugacccagauucaguuguaauccaagauguuauugaggacguuguuauagaagauguucagugcccagauaucauggaagaagcagaugugucugaaacggucaucauuccugagcaagugcuggacucagauguaacugaagaaguuucuuuagcacauugcacagucccagaugauguuuuagcuucugacauuacuucagccucaaugucuaugccagaacacgucuugacgggugauucuauacaugugucugacguuggacauguuggacauguuggacauguugaacaugugguucaugauaguguaguggaagcagaaauugucacugauccucugacuaccgacguaguuucagaagaaguauugguagcagacugugccucugaagcagucauagaugccaaugggaucccuguggaccagcaggaugaugacaaaggcaacugugaggacuaccuuaugauuuccuuggaugaugcuggcaaaauagaacacgaugguucuucuggaaugaccauggacacagagucggaaauugauccuuguaaaguggauggcacuugcccugaggucaucaagguguacauuuuuaaagcugacccuggagaagaugacuuagguggaacuguagacauuguggagagugagccugagaaugaucauggaguugaacugcuugaucagaacagcaguauucguguucccagggaaaagaugguuuauaugacugucaaugacucucagccagaagaugaagauuuaaauguugcugaaaucgcugacgaaguuuauauggaagugaucguaggagaggaggaugcugcagcagcagcggcagccgccgccgugcacgagcagcaaauggaugacaaugaaaucaaaaccuucaugccgauugcaugggcagcagcuuaugguaauaauucugauggaauugaaaaccggaauggcacugcaagugcccucuugcacauagaugagucugcuggccucggcagacuggcuaaacaaaaaccaaagaaaaggagaagaccugauuccaggcaguaccaaacaggugagggcgcacgaguuccauggcgcagcgugcucugcgagcucucagaggaaacucuacaauaauuauuggcccugauggacauccuuugacugucuauccuugcaugauuugugggaagaaguuuaagucgagagguuuuuugaaaaggcacaugaaaaaccaucccgaacaccuugccaagaagaaauaccgcuguacugacugugauuacacuaccaacaagaagauaaguuuacacaaccaccuggagagccacaagcugaccagcaaggcagagaaggccauugaaugcgaugagugugggaagcauuucucucaugcaggggcuuuguuuacucacaaaauggugcauaaggaaaaaggagccaacaaaaugcacaaguguaaauucugugaauacgagacagcugaacaaggguuauugaaucgccaccucuuggcaguccacagcaagaacuuuccucauauuuguguggagugugguaaggguuuucgucacccgucagagcucaaaaagcacaugagaauccauacuggggagaagccguaccaaugccaguacugcgaauauaggucugcagacucuucuaacuugaaaacgcaugucaaaacuaagcauaguaaagagaugccauucaagugugacauuugucuucugacuuucucggauaccaaagaggugcagcaacaugcucuuauccaccaagaaagcaaaacacaccaguguuugcauugcgaccacaagaguucgaacucaagugauuugaaacgacacauaauuucaguucacacgaaagacuacccccauaagugugacaugugugauaaaggcuuucacaggccuucagaacucaagaaacacguggcugcccacaagggcaaaaaaaugcaccaguguagacauugugacuuuaagauugcagauccauuuguucuaagucgccauauucucucaguucacacaaaggaucuuccauuuaggugcaagagauguagaaagggauuuaggcaacagagugagcuuaaaaagcauaugaagacacacaguggcaggaaaguguaucagugugaguacugugaguauagcacuacagaugccucaggcuuuaaacggcacguuauuuccauucacacgaaagacuauccucaccggugugaguacugcaagaaaggcuuccgaagaccuucagaaaagaaccagcacauaaugcgacaucauaaagaaguuggccugcccuaacaauacuucuacagaacguuuguagagauauuggccuugaagcagaaaauucauuuuaaagccaaucagucucauucacauacaauacuguauauugauuuaugcuguguacaaauagaauuauuacuucuaguugacuuuuuuuuaaauauacauuuugcucaguaguguguucugaauucuauucaguuuguuuaauaaauagggaaaacuggcaacaugcuaguuacuuuuaauaaaguaaucccugauucuauaccgaaguuuuauaucuuagaauuuuauauuuauuuaaauauuuaccuugcuuaccuugaugguacucuucuaagaccauuaacuuaagguaacuuuauauugguaacucugaaaguauucauguugacucauuuuuuuccccauacauuucucacaauaaaauugucagagacaucuacuaauauaaaugggagauuuuacagucaggucuaauuaucauaacauggaagucauuuacuugucuugcuuaauauuuucagaccacuugacagugaaaguuuccauuugagcuguugcgucccuggcuuugcugaguaaagagcaguggcuggguucguguuuacuuuucaaauauacuucuuuuggcuuucuuuggauuauuuacaucuuuugucagcguagcaaacuuuuagaaaaccuuauugaaaaacugugcuugcucauguuguauuuugauuauucugucugugcggcuucaucuuggaaugguugugugcuacaaaugacacuuacugaggacugcauuuuggaaucuccuagagguaacucauggcuuauaggaucuuuugcaacuuuauguauguaaauguacccugaauuauauauauacacauauauaucauguaccuguguguauugcuuauuuuacauauuuauacacacaaccccaaguaguaguuguuuaaaaucuauaaugaaaaguauuaaauuuacaauaacaugaaagauccagggaugcaugagagagcauuuuguaagucaugcucuucagagagacuacucaggugaagaauuagaaggaaaauaaggacacuaguauuuuuaaagaguaaagauauuuucuuuuaaauaucuuugguaauugaaacauagagguuaagauguuucuagguagaauguuuucauacaauuucaccuccaugucuuuauguuuuucugaaaagcaaaugaguauccagacaugacucccacaguucucuuugagaagccugagagggaacucugucuuaccuagugagggggauggaaaagaagugauggcucuguggaccagagaacgggugcuaauuaugacuucacacucggcaaguucaggcugaucuguuauuucucaguuacaguuagcaaacuuuaaaaacuuaacacucaaguuggcuuugauuaaaagguaaagauguguuuuaaguggauaaggaaagucugaggccuuauuuggaacaucacuaagucuuccacagguuuuuuguuuguuuguuuuuuuuuguuguuuuuuuuucuuaagacggagucuugcucuguugcccaggcuggacugcaguggugugaucacugcaaccucugcagcucacugcaaccucugcuuccuggguucaagcaauuaucugccucagccucucgaguagcugggauuacaggcgcccaccaccacgcccggcuaauuuuuuguauuuuuaauagagaugggguuucaccaucuuggccaggcuggucuugaacccugaccucgugauccaccugccucggccuuccauagugcuggguuuacaggcgugagccaccgugcccagacaccacauaggucugaaucagugucauacauucauaaaacaaacucgguuaauuagaacuugguuauguuaagacgaaucugggagaacagaaaacaguuuuuggggucccuucaguuggcuauugguccguaugcaucuagcacauuguaggagauuuagaaauugucuucccacccgauagcugccuugucaccucauuauggugcuccauccccugugugcuuagguuuuuaccuuucaucuuucucuuugccauugauguuuguauucaagaguuauauuuuuaggguuagaaaucaaaauauuugguguuuggcaaaccucugaagugcuagacugauuuagucuaguuuuaaaccaagugcuuuaggcaggugugaacuccagcccaaaugccagucaaagucaaggcauggguuuuccuagccuaucuuauaggaaauuccuguaccuucuuggcccccauaauguguuuuuuuuuuuuuuuuuuuuuuaaacuaacuuacaauuuugugauccgugauucauugcccugcgauucuugaaagcucugucuguuuuuuugugagaaccuuuaaaaucucccuuaauuuuuauuuucccagaaauaauguaaaaacacuuaaaugaaaguggaaauguauuaauuuuaaauccuauaaaauuaauacagaaaauauaaaugauugggucauuuaacuauauuuuuuuaaauaaacugaaagauaaagaacacaacacuucacacauuuuauauuucucuuacauacuccggaaucauacacaguucuuuuuaaagcacaacauuaaaaccuuuaaaagguauuuaaggguuuggucaagugaauaugauaaaacauacuugucuguauaaagagaaaaugaaauuguagucacuguuauguacugacauuaguuacaaccuaguuuuaauucuuaaaacaauuuugauuagcaaagcuaaaaaaaaauggauguuucaguuaaauguuuuaaagagguacagauuuuuacaaggacauaauauaaguuauuguucuguagaaauauccuauuaaauauuguaugucccucccucuguacacuuuguaaagaaaguaaaauacauaaaaagaaaaucauauagggaugugugacauuauuguaauuguguacuugagaauaacgugcaaaaauaaaaaucagaauauuuuccuguuauugaauguuuagucuauuugauaccaguacuaaguuaaugcuuuuucucaaggaaaaaaaauguacaguuuuuguaaaccuaauaaacaucaaaagcaguggauuauuuucauccccccauuucuuaauuucuuuuucacagcaguggaaugcaaagugcuugauugcuuugaauuuugugacucggaugcaaauacugguaauauuucaguucugugaauuugcaaguaauauuucagagaaguuaagaggugauuggugaguccuuugaugagcauguccuuggaauucauuuuuucuuuuaucuucauaaaggauuuguuuuauuagcaucuccaauuccccugagauaaauuacucaugcauaaagugguuuuugagagcacuuaaaguucauuucaguauuaauuuacagcauauuuaaucaguggggacuguuaccaccuccacaacagaaaucaugcccucgaguuaccccacugcgcccaguuuagaggacuaguagaugcuaacauacuagggaauggucauugccacaguuaaaaaucggcaguuaaguaaaugucaggagucaaaagagauagaguugugccaucuuugauuuuauagacaagauucugcaguucuuccaacuguaugaacaaacguuugccuaauaguugaaacaauaaauuaaaauuuuagguaaaugacgaagggaauguggugaaugucacuguccagagccauaaaucagacaaaaccauacauagcaugcugaaaaacuuuuguaauggaacacccaacaaaugacaccuaaccugucugugauccaacaaguccgauaacaugcugcuguauuuguauucucugggaaucucaguauuaauaauuucauuucccacaaauucuagcauucauguaaggaaaaacauggcuaaucaauaucuuaaaggggcaaucuuucagagcagugguuuucaaaguauggccggacagcauuggcagcaucuuaaucuccugggacuuuguuaaaaaugcaaauucucagccccacccuaguccuacugaauugggaaacuggcgugggacccagcagucuuuguuuuaacauguucuccaagugauucugaugccuguucaaacuugggaaacacuuuuagagcacuugaggaaccuaaaagaugacugguucagcauuuugugugguagauaagaaagaaauuaucacaaaaaaucagaaaugaacagugagagaaaaauaggaccccagacaguuuauaccuuccauuugcuguuuuaaaagugugagccugccaagucaacaaguaugccuuuagcgcacauguaaauagccugcacuuccuaaaucucguguggccucccaugguuacauucuucaaagguaaacugaguugagaggaagauucagcauuuaaaagagaaggguugaaaaagauuguguguguguguguguguguuuaauuggcccaggguuacuuaaauaaaucauaaccauuuugccacauucuguaacuguuuagcuaaggucaaauuaaguuuacccuauggauuuuguuucaucuuuuguuucguguauauacuguuugccuuuuucauaaaaaucuuggauuuguuauauauuguuccuguuauuuuugacaucuuugcuauuguaaauaaauuacuauuuuguuuuaaguua

SEQ ID NO: 501 - RNA, 3803 nt, Homo Sapiens
ggggugcugggccuggcgggcaaacuaaggcugcggaccguugggcgguuccgcggggcguuguccggagagcugcgaggccgggguucccaggguucacgccacacucuaggaagugccugagcuagugagcuggccaacgagcuccgcgggcugggaccaugggcugcuucuucuccaagagacggaaggcugacaaggagucgcggcccgagaacgaggaggagcggccaaagcaguacagcugggaucagcgcgagaagguugauccaaaagacuacauguucaguggacugaaggaugaaacaguaggucgcuuaccugggacgguagcaggacaacaguuucucauucaagacugugagaacuguaacaucuauauuuuugaucacucugcuacaguuaccauugaugacuguacuaacugcauaauuuuucugggacccgugaaaggcagcguguuuuuccggaauugcagagauugcaagugcacauuagccugccaacaauuucgugugcgagauuguagaaagcuggaagucuuuuuguguugugccacucaacccaucauugagucuuccucaaauaucaaauuuggauguuuucaaugguacuauccugaauuagcuuuccaguucaaagaugcagggcuaaguaucuucaacaauacauggaguaacauucaugacuuuacaccugugucaggagaacucaacuggagccuucuuccagaagaugcugugguucaggacuauguuccuauaccuacuaccgaagagcucaaagcuguucguguuuccacagaagccaauagaagcauuguuccaauaucccggggucagagacagaagagcagcgaugaaucaugcuuagugguauuauuugcuggugauuacacuauugcaaaugccagaaaacuaauugaugagaugguugguaaaggcuuuuuccuaguucagacaaaggaaguguccaugaaagcugaggaugcucaaaggguuuuucgggaaaaagcaccugacuuccuuccucuucugaacaaagguccuguuauugccuuggaguuuaauggggauggugcuguagaaguaugucaacuuauuguaaacgagauauucaaugggaccaagauguuuguaucugaaagcaaggagacggcaucuggagauguagacagcuucuacaacuuugcugauauacagaugggaauaugaagugcaauguggaaccaggacuugguauuaagccuuucccaacuugugaauauagaauuugauaauacacuuuuguguauuagcaaugguuuuuacuaaugcuaaaacuuuuaaaguuuauuuuuuaauaaauuguugaguauuacaucauuuacuugagguucaaaaauaauucauuuuaaauuaaguaguuuuaaucagcuuaaaagcuauuuaacccauuuuaauaagcuugcaguuuuguuucucugcauaugauauucuuauuagaaaacagaaguagcuaaaaguuuauuauuuuaauccuauuuaaauguucuuucaaaucucuaauaauuuaaacuuuccucagugcuccaugauacuuuuuuugagacuccauaucauugcuuauuuuaccuuuuucaauuuagagggauuuguuacuagucgaucaauuagaaugaaccuaugcacauuuuuauguacacauauccaguuauauaauugcuuccuaguugcauuauauggcaaaugagauuuuguacauggaguugacauaauacuuuguaaauugaauuuuuuaaagaaauaggcauuugauaaccagcuuggcaaguaacucuacuaacagauguugguauagcuauuuaaagacuacuucguaaguaguaugauuauuugaauaaauuacacauuguuuaguuuuuuaauacaacugcuauaugacucuucugcuuccugauaagaaaagguauaugcaaugcuaaaacuguagaagcccaaucaccagcaguuuuuaaaaaggugauaacuuuuauuagcucuugugggcuaucaagagaauuggaacaaaaccuugugacuuuuagguaagaaauaggcaugaugauaagcuaugcagauuauuaaaaagcuugauacauuugauuuuucauuagauaugccauucauaucaaguaauguucaaguaugauaaaauuauuuugguugcuuuaaagcacuguuucccaaaucuaccugaucauaauaauuuaccaggaagcagaggagagcuacuuguuuaaaaauccacauucuuggacccaauccucagaugcacggauucagucuucaggggaaacucuguuuuaagggguauguuguaaucuaaaguaauugguucaggaggugucaauagguugaacuugugagaaggcacugaaucugccauccacaucacauauagcagcuauuaugaaaucagcuuucauaggccuauuuuuaaaaggaaucugaaauuuaauucuauuuugauaaaacuaagacugaaaauaaccacuuguaaacauuccuaugauuguuacuaaaauguauuuucauguuuaaaauguuuuuggauauuuuuggguuaauaacuacuacauugaauugcauguuaaggugcagaaauaauacauuaaaagauuuucacuuuaaauuaauuaguaauauugagcgcucacccugugcguggccuugugcuaaccauuagcacugcaucauuucaauucuuuuauaagggcauucaauacuacaaaaucaacaugauuucauaaggugcaaauaaaaguuggugacagauuuaauauaauuuugaucacaauuuacaaaugaucuuugcaaauaguggucagacggcauuaguuuuucccuuaguuaagcuaaauuaaagggacuccauccuguuaugauuauauuauuauuauuauuauuauuauuuuugagguggaguuucacucuuguugcccaagcuggagugcaauggcgcgaucucggcucaccacaacauccgccuccuggguucaagcgauucuccugccucagccuccugaguagcugggaauacaggcaugcgccacuacaccuggcuaauuuuuguauuuuuaguugagaugggguuuuuccacguuggucaggcuggucucgaacuccugaccucaggugauccguccaccucagccucccaaagagcugggauuacaggugugagcuaccgcgccuggccaugaugauauuauuaaacaccauuauucacauuucaaauaauaacaauacuuuuuguuuuucaaaaauaaaaugcaauguuauauaaagcuauaaacuaaguucuuuaugauauuugagcaacaacucaggaauauaacauauaagggagauguuaauuuaaaaauuuccacuacacuuauuaucuauuaaccaaagcuuaaaauuuuguauucuucuguuagauaagaccuuuuacccauuuaauuugucuuuaaggacagucauuuggcuucugaauguuugaaacgauuuuaaaaaauaaguagugcuaugguuguuucuauaauucuaaccuuugauaguaaucagaauguauuacauuucauuucugaauagcuuuugaauuuaugaaaaauuauuaacaaugaaaaauugguaauuuuauuaaguuauauguguuuaaauauuauauuagcuuauuucucuugcauuaauaguacugcuguuuuuguuuugcuucuuuauauuuaugucuagcuuuuauauguaauuuaucuaguguuuauaaaaugugauuuguaauaaauguuguuaaaaugaaaa

SEQ ID NO: 502 - RNA, 1511 nt, Homo Sapiens
uuucgucggcccgccccuuggcuucugcacugaugguggguggaugaguaaugcauccaggaagccuggaggccugugguuuccgcacccgcugccacccccgccccuagcguggacauuuauccucuagcgcucaggcccugccgccaucgccgcagauccagcgcccagagagacaccagagaugccugucuacucagcuuggccugcggaacccaccauggcccccuuugagccccuggcuucuggcauccuguuguugcuguggcugauagcccccagcagggccugcaccugugucccaccccacccacagacggccuucugcaauuccgaccucgucaucagggccaaguucguggggacaccagaagucaaccagaccaccuuauaccagcguuaugagaucaagaugaccaagauguauaaaggguuccaagccuuaggggaugccgcugacauccgguucgucuacacccccgccauggagagugucugcggauacuuccacaggucccacaaccgcagcgaggaguuucucauugcuggugaggcaccguccccgcgcccugugccacaccaaccagucccuggggcgcggccuagcaaccacgagggggcgaggcucugaugggaauggucccacuggaaauggggaccaccccaauuucagucuaucagaaggccgggccuuuggcagcuuggcagcucagccaaucacaagcugcuugucgguccccgccccgccuuucuccuuaggaaaacugcaggauggacucuugcacaucacuaccugcaguuuuguggcucccuggaacagccugagcuuagcucagcgccggggcuucaccaagaccuacacuguuggcugugaggaaugcacagugagugccuggacccugaccuccaacgggagauccuucccggggccauucccuaaaucgugggcuuguuucuugcucccucuggcuauucugugucccuguggcugcuccccaacccuaagggcugucccugaucucucuugcuauuuccccaagcccgagacugcucccuuacaaauucuggcugcucccuuucccuguguccaauaccgugugaucaccugucccucccuggucccucuaauucucccuugugacuauucuguaaucccacuccccguuccugagcccccgggauuguuucuugguuccccagaauguucuccaagaacccaaagugcuguucccuaaucccaguguuucccuguuuauccauccccugcaaacugcagaguggcacucauugcuuguggacggaccagcuccuccaaggcucugaaaagggcuuccagucccgucaccuugccugccugccucgggagccagggcugugcaccuggcagucccugcggucccagauagccugaauccugcccggaguggaagcugaagccugcacaguguccacccuguucccacucccaucuuucuuccggacaaugaaauaaagaguuaccacccagcaga

SEQ ID NO: 503 - RNA, 72 nt, Homo Sapiens
agcugauguagcuuaauucaauaaagcaagccacugaaaaugccuggaugaauucaugugacuucauaaaca

SEQ ID NO: 504 - RNA, 291 nt, Homo Sapiens
ggauuugacauggaagugaaagguugggguggagaagauguucaucuuuaucgaaaauacuuacguggugaccucauuguuauucggaauccaguuccuggucuuuuccaccucuggcaugaaaagcacugugcugaugagcugacccccgagcaguaccgcaugugcauccagucuaaagccauggaugaggcuucucgcucccaccugggaaugcuggucuucagggaggaaauagagacgcaucuucauaaacaggcauacaggacaaacagcgaagcuguugguuga

SEQ ID NO: 505 - RNA, 2207 nt, Homo Sapiens
cgccgggcgggaauguaagauggcggaguagcaacgcaaagcgcuugguauugagucuguggccgacuucgguuccggucucugcagcagccgugaucgcuuaguggagugcuuaggguaguuggccaggaugccgaauaucaaaaucuucagcggcagcucccaccaggacuuaucucagaaaauugcugaccgccugggccuggagcuaggcaagguggugacuaagaaauucagcaaccaggagaccuguguggaaauuggugaaaguguacguggagaggaugucuacauuguucagagugguuguggcgaaaucaaugacaauuuaauggagcuuuugaucaugauuaaugccugcaagauugcuucagccagccggguuacugcagucaucccaugcuucccuuaugcccggcaggauaagaaagauaagagccgggcgccaaucucagccaagcuuguugcaaauaugcuaucuguagcaggugcagaucauauuaucaccauggaccuacaugcuucucaaauucagguaucaguggaagcuaaauauugguguuugaaaggugggaggaaaggacugaugaugcugaagacugcagagaagccaaaaauuaugcccaaguacaucugaaauaaacuagauaucaacaacaggcuuuuuugauaucccaguagacaauuuguaugcagagccggcuguccuaaaguggauaagggagaauaucucugaguggaggaacugcacuauugucucaccugaugcugguggagcuaagagagugaccuccauugcagacaggcugaauguggacuuugccuugauucacaaagaacggaagaaggccaaugaaguggaccgcauggugcuugugggagaugugaaggaucggguggccauccuuguggaugacauggcugacacuuguggcacaaucugccaugcagcugacaaacuucucucagcuggcgccaccagaguuuaugccaucuugacucauggaaucuucuccgguccugcuauuucucgcaucaacaacgcaugcuuugaggcaguaguagucaccaauaccauaccucaggaggacaagaugaagcauugcuccaaaauacaggugauugacaucucuaugauccuugcagaagccaucaggagaacucacaauggagaauccguuucuuaccuauucagccaugucccuuuauaauagaguaacuucugaggcuuuuugagaauaaaauccaccccacccuuguuuccccuugguauuugaugacaaauucagcagaagacccggcuugcuccaguguagcuuucuacaucccacaucagguauauuagagcuuauccgaacuggggaaagacggauugagauuaacugcugggaccuccuaccugcauuaucucauucuggcuuccuugauaauucugugggccuugcagcuuuaacuauagcucagcugcugcaagauuucagacuuuugaggauguugugugaggguguuugacugugacuggggaagcucagacuacuuuguaugugaaugcuucaggguuuucuuuguugagaacaacuagcaacaaaggcaacccaugugugaccaguucuccccaaggucuaugcuaaauuauagcaagagcccugggcaaccccaaaccuaguccugguagcugagcacccuguaaggcaggagcaggcagcucagcuugagcagacauugggugggggguggggggugguugaggggggaggcagcacagugcagcaaauguuucuugggaggaagaagccugauccaucaccaucugcuugacuauguagcuuggauucuccuuuguaccuaucccuuucgauuuggcuuuaccuucaucuaucuugauccuuuccuggccaaauauccucuugggcccaaaugaacauuguaccauagucuucuggaaagcaaacaugcuuccugcuauguaauugcuaacauucauauuagaugaugugcuguagcuugaucuuccuuagccuacugccacugaggcaguagguuuuaggugguaucguagugccuuuugauuaauuuaaguauuuaauuuucaucuuccuucuuuggaucuauuuggccucucaaaugaacugagauuccuguuaaaaaagauugauguuauugucucuuguagaggaaacuaauaaaguguguguaccugugugauu

SEQ ID NO: 506 - RNA, 4024 nt, Homo Sapiens
gcagccgagcagccuggcaacggcgguggcgcccggagcccgagagaguuuccaggauggcuucugcaucaacuucuaaauauaauucacacuccuuggagaaugagucuauuaagaggacgucucgagauggagucaaucgagaucucacugaggcuguuccucgacuuccaggagaaacacuaaucacugguaaggaccugcugacauaagauuugcauaacuugaggagaagucuggcaggaucagguggcuucagucccgcuuacucuuuagcagucaggcuuagacaaauaggcuaccuuuguuuagaagcguuaacacagaacucucugcaucccuuucuugauuaaagaguucuuucgagagcuucaugcucacaaggguagugauauucuugugucuguaccaaagacugagaaugauuuaggggaaaaaaauguggauuaucucuugaaagucucucauuggagccauaagcucucaugguuuaagguuuuaagagcaaaaugauuuccagucaaugaugcaugcuuuaaaaugauaaacuuaaaggcuugaaggcuuaaucauucuccucuuugaaauauaggagaacauauugcuuuaaaauauacaaagaaguuauuuacauauguccuuucaauggccccauuaagggaagaguuuacaucacaaauuaucgucuuuauuuaagaaguuuggaaacggauucuucucuaauacuugauguuccucugggugugaucucgagaauugaaaaaaugggaggcgcgacaaguagaggagaaaauuccuauggucuagauauuacuuguaaagacaugagaaaccugagguucgcuuugaaacaggaaggccacagcagaagagauauguuugagauccucacgagauacgcguuuccccuggcucacagucugccauuauuugcauuuuuaaaugaagaaaaguuuaacguggauggauggacaguuuacaauccaguggaagaauacaggaggcagggcuugcccaaucaccauuggagaauaacuuuuauuaauaagugcuaugagcucugugacacuuacccugcucuuuuggugguuccguaucgugccucagaugaugaccuccggagaguugcaacuuuuaggucccgaaaucgaauuccagugcugucauggauucauccagaaaauaagacggucauugugcguugcagucagccucuugucgguaugagugggaaacgaaauaaagaugaugagaaauaucucgauguuaucagggagacuaauaaacaaauuucuaaacucaccauuuaugaugcaagacccagcguaaaugcaguggccaacaaggcaacaggaggaggauaugaaagugaugaugcauaucauaacgccgaacuuuucuucuuagacauucauaauauucauguuaugcgggaaucuuuaaaaaaagugaaggacauuguuuauccuaauguagaagaaucucauugguuguccaguuuggagucuacucauugguuagaacauaucaaggcaacacucguuuugacaggagccauucaaguagcagacaaaguuucuucagggaagaguucagugcuugugcauugcagugacggaugggacaggacugcucagcugacauccuuggccaugcugauguuggauagcuucuauaggagcauugaaggguucgaaauacugguacaaaaagaauggauaaguuuuggacauaaauuugcaucucgaauaggucauggugauaaaaaccacaccgaugcugaccguucuccuauuuuucuccaguuuauugauuguguguggcaaaugucaaaacaguucccuacagcuuuugaauucaaugaacaauuuuugauuauaauuuuggaucaucuguauaguugccgauuugguacuuucuuauucaacugugaaucugcucgagaaagacagaagguuacagaaaggacuguuucuuuauggucacugauaaacaguaauaaagaaaaauucaaaaaccccuucuauacuaaagaaaucaaucgaguuuuauauccaguugccaguaugcgucacuuggaacucugggugaauuacuacauuagauggaaccccaggaucaagcaacaacagccgaauccaguggagcagcguuacauggagcucuuagccuuacgcgacgaauacauaaagcggcuugaggaacugcagcucgccaacucugccaagcuuucugaucccccaacuucaccuuccaguccuucgcaaaugaugccccaugugcaaacucacuucugaggggggacccuggcaccgcauuagagcucgaaauaaaggcgauagcugacuuucauuuggggcauuuguaaaaaguagauuaaaauauuugccuccauguagaacuugaacuaacauaaucuuaaacucuugaauaugugccuucuagaauacauauuacaagaaaacuacaggguccacacggcaaucagaagaaaggagcugagaugagguuuuggaaaacccugacaccuuuaaaaagcaguuuuugaaagacaaaauuuagauuuaauuuacgucuugagaaauacuauauauacaauauauauuuugugggcuuaauugaaacaacauuauuuuaaaaucaaaggggauauauguuuguggaauggauuuuccugaagcugcuuaacaguugcuuuggauucucuaagaugaauccaaaugugaaagaugcauguuacugccaaaaccaaauugagcucagcuuccuaggcauuacccaaaagcaagguguuuaaguaauugccagcuuuuauaccaucaugaguggugacuuaaggagaaauagcuguauagaugaguuuuucauuauuuggaaauuuagggguagaaaauguuuuccccuaauuuuccagagaagccuauuuuuauauuuuuaaaaaacugacagggcccaguuaaauaugauuugcauuuuuuaaauuugccaguuuuauuuucuaaauucuuucaugagcuugccuaaaauucggaaugguuuucggguuguggcaaaccccaaagagagcacuguccaaggaugucgggagcauccugcugcuuaggggaauguuuucgcaaauguugcucuagucaguccagcucaucugccaaaauguagggcuaccgucuuggaugcaugagcuauugcuagagcaucauccuuagaaaucagugccccagauguacauguguugagcguauucuugaaaguauuguguuuaugcauuucaauuucaaugguguuggcuuccccuccccaccccacgcgugcauaaaaacugguucuacaaauuuuuacuugaaguaccaggccguuugcuuuuucagguuguuuuguuuuauaguauuaagugaaauuuuaaaugcacaguucuauuugcuaucugaacuaauucauuuauuaaguauauuuguaaaagcuaaggcucgaguuaaaacaaugaaguguuuuacaaugauuuguaaaggacuauuuauaacuaauaugguuuuguuuucaaugaauuaagaaagauuaaauauaucuuuguaaauuauuuuaugucauaguuuaauuggucuaccaaguaagacaucucaaauacaguaguauaauguaugaauuuuguaaguauaagaaauuuuauuagacauucucuuacuuuuuguaaaugcuguaaauauuucauaaauuaacaaagugucacuccauaaaaagaaagcuaauacuaauagccuaaaagauuuugugaaauuucaugaaaacuuuuuaauggcaauaaugacuaaagaccugcuguaauaaauguauuaacugaaaccuaacacuguuuucagggcugugagugugcauguguuggaaaugugcaugguggccaucugauuucuuugcccgggucugcuucauguacuuuuuaucucaccggcaaccuugcagggcucucccaaaauuucagcaagauugggcauuuaaguguauuaaacagugcagauuuuaagaguca

SEQ ID NO: 507 - RNA, 126 nt, Homo Sapiens
ugcaucuauuugacagaccuggaacaguuauuuuuugccacuaagauuucuacuacagaugcaagaaagaaguguccuugcauuuccuuucugauuguggcagccaacauugaaugggggaauaca

SEQ ID NO: 508 - RNA, 502 nt, Homo Sapiens
ggccccgccgacccacggcccacgacccaccgacccacgaaucggcccggcccccgcguucaccaugucuggcuucuccagcgucgccgcuacgaagaaagugguucaacagcuccagcuggaggccgggcucaacagcguaaaaguuucccaggcagcugcagacuugaaacaauucugucugcagaaugcucaacaugacccucugcugacuggaguaucuucaaguacaaaucccuucagaccccagaaagucuguuccuuuuuguaguacaaugaaucuuucaaagguuucccaaaccacuucuuaugauccagugaauauucaagagagauacauuugaagccuguacaaaagcuuaucccuguaacacaugugcuguaauauacaaaauucuacuuuugucuguccuuaacaucuaccucugaauuuuuaugaauuucuacuucacaaggguaauuguuuuauauacauuggcagcagcauacaauaaaacuuagu

SEQ ID NO: 509 - RNA, 1903 nt, Homo Sapiens
cgcgggcgggcaaacggacggcuccgcccagccgccggcuccuuuaccccgccccacuacccccgccuucgcggcgcucguuuccuggcgcuccccaccuuuagcgagaccaacgagagaacaccgccugcagcuagaacagccuggucaggagcguaacggaguggugcgccaacgugagaggaaacccgugcgcggcugcgcuuuccuguccccaagccguucuagacgcggaugaagugcaaaacaaacuucuccauagaggaguuguugcaaaguuccaguuuauaccaaacaguaaucagauuccauuggaagcuaaagauuuugagagccuuuuguacuauaugcaacuaacuugauuucaagcuugggaaccuuuuaaaaaaaacauuaaaagcaaaaugaaaaaugcuuucugaaagcagcuccuuuuugaagggugugaugcuuggaagcauuuucugugcuuugaucacuaugcuaggacacauuaggauuggucauggaaauagaaugcaccaccaugagcaucaucaccuacaagcuccuaacaaagaagauaucuugaaaauuucagaggaugagcgcauggagcucaguaagagcuuucgaguauacuguauuauccuuguaaaacccaaagaugugagucuuugggcugcaguaaaggagacuuggaccaaacacugugacaaagcagaguucuucaguucugaaaauguuaaaguguuugagucaauuaauauggacacaaaugacaugugguuaaugaugagaaaagcuuacaaauacgccuuugauaaguauagagaccaauacaacugguucuuccuugcacgccccacuacguuugcuaucauugaaaaccuaaaguauuuuuuguuaaaaaaggauccaucacagccuuucuaucuaggccacacuauaaaaucuggagaccuugaauauguggguauggaaggaggaauugucuuaaguguagaaucaaugaaaagacuuaacagccuucucaauaucccagaaaaguguccugaacagggagggaugauuuggaagauaucugaagauaaacagcuagcaguuugccugaaauaugcuggaguauuugcagaaaaugcagaagaugcugauggaaaagauguauuuaauaccaaaucuguugggcuuucuauuaaagaggcaaugacuuaucaccccaaccagguaguagaaggcuguuguucagauauggcuguuacuuuuaauggacugacuccaaaucagaugcaugugaugauguaugggguauaccgccuuagggcauuugggcauauuuucaaugaugcauugguuuucuuaccuccaaaugguucugacaaugacugagaagugguagaaaagcgugaauaugaucuuuguauaggacguguguugucauuauuuguaguaguaacuacauauccaauacagcuguauguuucuuuuucuuuucuaauuugguggcacugguauaaccacacauuaaagucaguaguacauuuuuaaaugagggugguuuuuuucuuuaaaacacaugaacauuguaaauguguuggaaagaaguguuuuaagaauaauaauuuugcaaauaaacuauuaauaaauauuauaugugauaaauucuaaauuaugaacauuagaaaucuguggggcacauauuuuugcugauugguuaaaaaauuuuaacaggucuuuagcguucuaagauaugcaaaugauaucucuaguugugaauuugugauuaaaguaaaacuuuuagcuguguguucccuuuacuucuaauacugauuuauguucuaagccuccccaaguuccaauggauuugccuucucaaaauguacaacuaagcaacuaaagaaaauuaaagugaaaguugaaaaau

SEQ ID NO: 510 - RNA, 3201 nt, Homo Sapiens
uuccccggcucuagcaggccggcuucucuguccaaugcccacccggagcugggaggaggagucugcguaaugugcgugugaagagacugggggagcuggccggggcucacgguguuugacccgucggucgugcgugagaggaaagggaaggaggaggucccgaauagcggucgccgaaauguuccgguguggaggccuggcggcgggugcuuugaagcagaagcuggugcccuuggugcggaccgugugcguccgaagcccgaggcagaggaaccggcucccaggcaacuuguuccagcgauggcauguuccucuagaacuccagaugacaagacaaauggcuagcucuggugcaucagggggcaaaaucgauaauucuguguuaguccuuauugugggcuuaucaacaguaggagcuggugccuauuugugcagucucaucaccuaggauccccuucuagaucacuagcaucuacaggugcuucugggaaagauggcagcaaccuaguguacuucuuaauuguaggagcaacagucacuggggcaggaguuuauuaugccuacaagacuaugaaagaggaugaaaaaagauacaaugaaagaauuucaggguuagggcugacaccagaacagaaacagaaaaaggccgcguuaucugcuucagaaggagaggaaguuccucaagacaaggcgccaagucauguuccuuuccugcuaauugguggaggcacagcugcuuuugcugcagccagauccauccgggcucgggauccuggggccaggguacugauuguaucugaagauccugagcugccguacaugcgaccuccucuuucaaaagaacugugguuuucagaugacccaaaugucacaaagacacugcgauucaaacaguggaauggaaaagagagaagcauauauuuccagccaccuucuuucuaugucucugcucaggaccugccucauauugagaauggugguguggcuguccucacugggaagaagguaguacagcuggaugugagagacaacauggugaaacuuaaugauggcucucaaauaaccuaugaaaagugcuugauugcaacaggagguacuccaagaagucugucugccauugauagggcuggagcagaggugaagaguagaacaacgcuuuucagaaagauuggagacuuuagaagcuuggagaagauuucacgggaagucaaaucaauuacgauuaucggugggggcuuccuugguagcgaacuggccugugcucuuggcagaaagggcccaggcuggagugcaauggugugaucucugcucaccacaaccuccgccucccagguucaagcgauucuccugucucagccucuggaguagcugggauuacaggcaugcaccaccacaccuggcuaauuuuguauuuuugguagagacaggguuucuccauguuggucaggcuggucuugaacucccaaccucaggugauccacccaccucggccacccaaagugcugggauuauaggugugagucacugcaccuggccaacagcaauacuuucuuuccuuucuuuuccucuacccucuaugccaggacuccuuagaaauaaaauauuaaggaaagugaguuaugaagaugauaagggcaaugcagacuacagaauuaugggugucuuugaacugcugcuuccuguaaaaugccaaaaacuucuuugggcacaugaugguucccagcuugagagaucugugagcuccaguuggaauguuucauggcaacuaguuuucuuaauguucuuuuucagauauaugaaaucagggcaucuuuucaggaggaugcuuccuauucagagguugcaaagcacuuauguaagccuuaggugacugcauggguggaagugcacagaguucaccaucugaagcuuaaucuggggccagcaguucugauaccuguuguauuugcguuacaaaugaacuugagcaccgaggcccucaugcccacuguccuguaagugggcgcucggccuggauugcagcucugcccugucuguagugagggcugccugcugcuccuuuacuucucuuccuguauuccuaggauugacuuuugcuuccugcuguaacuacucuguuucuucuucccagcucgagccuugggcacagaagugauucaacucuuccccgagaaaggaaauaugggaaagauccuccccgaauaccucagcaacuggaccauggaaaaagucagacgagaggggguuaaggugaugcccaaugcuauugugcaauccguuggagucagcaguggcaaguuacuuaucaagcugaaagacggcaggaagguagaaacugaccacauaguggcagcugugggccuggagcccaauguugaguuggccaagacugguggccuggaaauagacucagauuuugguggcuuccggguaaaugcagagcuacaagcacgcucuaacaucuggguggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucuggagugauuugggccccgauguuggcuaugaagcuauuggucuuguggacaguaguuugcccacaguugguguuuuugcaaaagcaacugcacaagacaaccccaaaucugccacagagcagucaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagaucauuaaggacggugagcagcaugaagaucucaaugaaguagccaaacuauucaacauucaugaagacugaagccccacaguggaauuggcaaacccacugcagccccugagaggaggucgaauggguaaaggagcauuuuuuuauucagcagacuuucucuguguaugagugugaaugaucaaguccuuugugaauauuuucaacuauguagguaaauucuuaauguucacauagugaaauaaauucugauucuucuaaauuaaa

SEQ ID NO: 511 - RNA, 1244 nt, Homo Sapiens
uuccggcgacgccuuagcgcugacccccacgcaacccagcgaaacuccgcggagcgcgcgcggcacgauggacggucgggugcagcugaugaaggcccuccuggccgggccccuccggcccgcggcgcgucgcuggaggaacccgauucccuuucccgagacguuugacggagauaccgaccgacucccggaguucaucgugcagacgagcuccuacauguucguggacgagaacacguucuccaacgacgcccugaaggugacguuccucaucacccgccucacggggccagcccugcagugggugauccccuacaucaggaaggagagcccccugcucaaugauuaccggggcuuccuggccgagaugaagcgggucuuuggaugggaggaggacgaggacuucuaggccgggagacccuugggccugggggcgggugcucugggaagaguucgcugugccaguggccaccgcuagggucuccacaggcgcccucccuccgcgccucccucccccucgagccgccgcgauguccccugcgcuccuguccccucccgcguagugcuugccuuuguuccaggaauagcgcuccaggcuccugcugcagcuccugggccgcacucuagagcgcgcugccuccgcccucuuuugccagcccagccccuccaugcacauuuggacgcuguccugcacuucaggugcaagcugggcuccuguuacauacuggacagaccacccacagccgcugcugccaacccaccuccacuccuccagacugccagccaacuacaucauucugcccacagaccuacgcuaccacugccaucgccauccaccgcaucucaccaacagacuguggcuccuagugauguggacucaccucggagguauccgagcuggacacagccccuggacagugauccagacagcuggccgucccccaaggagccugucaccuucagcgagacccauuuccuccccauccccagagaccucuuguguuccugccacauagcugccagggcuuaagugugccuggcaaccaaaucgaaucucucauuuucuccuguggaccaguuaguuuugccuagaauccuguuuucuucugaauuugcagcugucucucugaugggugccuuuuguucaacacaguaagcccugcucccuucccugcucuaauacacuaccuguacaaagguuuuuuccuuauuuuuaauaaaugucagacacuauuaaauagaaa

SEQ ID NO: 512 - RNA, 2740 nt, Homo Sapiens
auuuaaauguuagaucacgaggaagaaggaaaacgauuucaagagcugcacuuaagcaucuagaauuuucugcgucacaccucuugagagaagagacuggcuccaggucugacucaguccacuacaagcuagacggucuucuuaaagcaccaacauuacuugagucuuuggauaaaauugagaaaagagucuacaaguauuguggacucuacaggaggcaggaggcugacaacuggcaguaaagacaaagaugucaggccugcggcccggcacucaaguggacccugagauugagcuuuuuguaaagaugugccuuucaccuucuuccaugauugugaggccuucccagccacguggaacugcuggaagugauggagagaguauuggaaacugucccuuuugccaacgccuuuucaugauccucuggcuuaaaggaguuaaauuuaaugugacaacuguugacaugaccagaaagccugaagaacuaaaggacuuagccccagguaccaauccuccguuccugguguauaacaaggaguugaaaacagacuucauuaaaauugaggaguuuuuagaacaaacccuggcuccuccaagguacccucaccugagucccaaguacaaggagucuuuugaugugggcuguaaccucuuugccaaguuuucugcauacauuaagaauacacaaaaggaggcaaauaagaauuuugaaaaaucucugcucaaagaauucaagcgucuggaugacuacuuaaacaccccacuucuggaugaaauugauccagacagugcugaggaacccccaguuuccagaagacuauucuuggauggggaccagcuaacacuggcugauuguagcuuguuacccaagcugaacauuauuaaaguugcugccaagaaauaucgugacuuugacauuccagcagaauucucaggagucuggcguuaucuccacaaugccuaugcccgugaagaauuuacccacacguguccugaagacaaagaaauugaaaauacuuacgcaaauguggcuaaacagaagaguuaggagagcucuuacaggagaaaaggcuauauuugugaucagauuuuacuuauugacauauuagaaagguuuuugcaaauaagaauaugaaaaauacuguuucuucuauccaacucucuuaugaaaaggaacucuguauuuucuauuagccauaaauaaucuguccacuguauuuuacaggucuucauacuuuuacuuaauuuucuuuaucuguauggcaaaccacugcaauccugaaugacauggaaagcaucacaaucuuuugcccuuugcuugaauuccuggaaugcauacauauaagcuaaacagaugucugcaguuauaaaugucauaaguagagguacaaucucacccugcuccuuagaaacauuuccauauaaaucgcuaaaauaauuucacauuuuuguuaguuuaauauauacaugaguuuauuucugauauaaauaauaaauacagagagugagcauaucagagaggcaaauucuuaaagaaugauuuuuaaaaucagcucuaggaagagcucaagaucaauuggucauagaacagcauuugacgccuagaacuaugaccaccucauggucagagaugagaauguagccuuugugaccagauuauauuauuuuuaaaugaagaagcacucauuaaauaaaacauaauuuuaaaaaacaauauaagaaacaaagucaacugaaucuuuuauucauagaaaugaaaaggaaaauaaaaacuguggcugaccaaaaggucuucuuguuguccauaaaaggauaagguaaacaguccuuagauaauuacaaaacuuucuacaaaaguuaaaauguuacauuacuauacguauucagauucacuuguuaaaguacucuuaaaucauucaaaucuggaaacaaaagcugaacuuaacucuugcucccucaaaagagaaacacaagcauaagugcagcuucaaaaaaggaaaauauuuuaggcuuugguggaaggguggaguuuagauaaaauuuaaaugaaguagcguuuuaauagguucaaagaaaaguaaggcaaugagcaaacucaaaguacuguccuugaaaaccauagagucaagauaaauguauaguguaugguuagguggcagagaaaugcaaucauguugauaaucuuugagauacauccugucaucaguauauuucagaauacaugcaaugcacuagcaaguuacaauugauagaauacauuugaaauguuaaaugaaauaagccaggcacagaaagacaaacaccacaugaucucacucauauguggaauuuuaaaaaguugaucucacucauauguggaauuuuaaaaaguugaucucacacaaguagaggguagaaucgugguuaccaggggcuagggagagaaagaaggcagaggcacugaaagauguuggucaauggguauaaaguuacaccuaggaagaauaaauuuugguauucaccacaguagggugacuauagcaaauaauaauguagcauguauuucaagauagcuagaaaagcagguuuuuaaaugucaccacaaagaaauaacaaauguuuauagugguggauaugguaauuacgccuauuugaucauuauacuguguguacaugcauugaaacaccacauuguaucccauauauauguacaauuaugugcccauuauacauuuaaaaaauaaauuuuaaaaaccuucaa

SEQ ID NO: 513 - RNA, 1536 nt, Homo Sapiens
aggcuucugagaagacuggugggagagaaggagagccugcagacagaggccuccagcuuggucugucuccccaccucuaccagcaucugcugagcuaugagccaaaccagggauuuacagggaggaaaagcuuucggacugcugaaggcccagcaggaagagaggcuggaugagaucaacaaggcaauuccuagacgaucccaaauauagcagugaugaggaucugcccuccaaacuggaaggcuucaaaggugagggggaaacuguaggcgguggagacagggcuggggguaggaggguuaggauuuccacaagaacaaggcaggaacagcagagauaaaaaguuuacuuuugugguagcaaaaggggaaccugccuuuauugcccuccugccacacugcggucccuuucccgggccugccucucucagcauccccucuagcuccuuacacccuagcggggccccucaacuccccaaccccacuuccucugccugccccuccuccuccuuccacguugucuccuccaccuagcaguugguuggcaaccccuuccucaguccccugcugaaaacccuccagucagcgcuuaucccuucugcucucuccccucacccagagaaauacauggaguuugaccuuaauggaaauggcgauauuggugagaaacgggugauuugcgggggcaggguggugugcaggccuaagaagacagaggucucuccuacaugcuccauuccucaugauuugggagggggcccaccuaccacagugggaggaaggagaauggggaugcggaagugggagaggagagagagggucuccccaccuucuccccauccccauccucugcccccagauaucaugucccugaaacgaaugcuggagaaacuuggaguccccaagacucaccuagagcuaaagaaauuaauuggagagguguccaguggcuccggggagacguucagcuacccugacuuucucaggaugaugcugggcaagagaucugccauccuaaaaaugugagugucaauuuccaaccuccccuguacuuaccuguuuucuccucccccaucccuacccuuguccacaggcucaacauuucuacacguugcccaucaucccuucuuccauccuuagagggacccuuccaaggucccgaccccaucccuauccauaguccugguccccagaaacuccaaccccugcccuuccucuucccccuuccacccucacauccccauccccuucuagccuuuccuagcacccuaugauuuauucccuugagaggaguguucccugaucccugugccucuucccaucucaaccaggauccugauguaugaggaaaaagcgagagaaaaggaaaagccaacaggccccccagccaagaaagcuaucucugaguugcccugauuugaagggaaaagggaugaugggauugaaggggcuucuaaugacccagauauggaaacagaagacaaaauuguaagccagagucaacaaauuaaauaaauuacccccuccuccagaucaa

SEQ ID NO: 514 - RNA, 1278 nt, Homo Sapiens
ccuauaacuuggaauguggguggagggguucauaguucucccugagugagacuugccugcuucucuggccccugguccuguccuguucuccagcauggugugucugaagcucccuggaggcuccugcaugacagcgcugacagugacacugauggugcugagcuccccacuggcuuugucuggggacacccgaccacguuuccuguggcagccuaagagggagugucauuucuucaaugggacggagcgggugcgguuccuggacagauacuucuauaaccaggaggaguccgugcgcuucgacagcgacgugggggaguuccgggcggugacggagcuggggcggccugacgcugaguacuggaacagccagaaggacauccuggagcaggcgcgggccgcgguggacaccuacugcagacacaacuacgggguuguggagagcuucacagugcagcggcgaguccaaccuaaggugacuguauauccuucaaagacccagccccugcagcaccacaaccuccuggucugcucugugagugguuucuauccaggcagcauugaagucaggugguuccugaacggccaggaagagaaggcugggaugguguccacaggccugauccagaauggagacuggaccuuccagacccuggugaugcuggaaacaguuccucgaaguggagagguuuacaccugccaaguggagcacccaagcgugacaagcccucucacaguggaauggagagcacggucugaaucugcacagagcaagaugcugaguggagucgggggcuuugugcugggccugcucuuccuuggggccgggcuguucaucuacuucaggaaucagaaaggacacucuggacuucagccaacaggauuccugagcugaaaugcagaugaccacauucaaggaagaacuuucugccccggcuuugcaggaugaaaagcuuuccugcuuggcaguuauucuuccacaagagagggcuuucucaggaccugguugcuacugguucggcaacugcagaaaauguccucccuuguggcuuccucagcuccugcccuuggccugaagucccagcauugauggcagcgccucaucuucaacuuuugugcuccccuuugccuaaaccguauggccucccgugcaucuguauucacccuguaugacaaacacauuacauuauuaaauguuucucaaagauggaguuaaaaaaaaaaaaaaaaaaaaaaaaaaaaaaaaaaaaaaaaaaaaaaaaaaaaaaaaaaaaaaaa

SEQ ID NO: 515 - RNA, 1536 nt, Homo Sapiens; identical to SEQ ID NO: 513

SEQ ID NO: 516 - RNA, 22 nt, Homo Sapiens
ugagguaguagguuguauaguu

SEQ ID NO: 517 - RNA, 22 nt, Homo Sapiens
ugagguaggagguuguauaguu

SEQ ID NO: 518 - RNA, 22 nt, Homo Sapiens
ugagguaguagauuguauaguu

SEQ ID NO: 519 - RNA, 23 nt, Homo Sapiens
aaaagugcuuacagugcagguag

SEQ ID NO: 520 - RNA, 21 nt, Homo Sapiens
gugggcgggggcaggugugug

SEQ ID NO: 521 - RNA, 20 nt, Homo Sapiens
gugucugggcggacagcugc

SEQ ID NO: 522 - RNA, 22 nt, Homo Sapiens
cggaugagcaaagaaagugguu

SEQ ID NO: 523 - RNA, 23 nt, Homo Sapiens
cuggagauauggaagagcugugu

SEQ ID NO: 524 - RNA, 22 nt, Homo Sapiens
cuuggcaccuagcaagcacuca

SEQ ID NO: 525 - RNA, 21 nt, Homo Sapiens
cuagacugaagcuccuugagg

SEQ ID NO: 526 - RNA, 23 nt, Homo Sapiens
uuaaugcuaaucgugauaggggu

SEQ ID NO: 527 - RNA, 23 nt, Homo Sapiens
caaagugcuuacagugcagguag

SEQ ID NO: 528 - RNA, 21 nt, Homo Sapiens
ugguucuagacuugccaacua

SEQ ID NO: 529 - RNA, 23 nt, Homo Sapiens
uaaggugcaucuagugcagauag

SEQ ID NO: 530 - RNA, 23 nt, Homo Sapiens
uaaggugcaucuagugcaguuag

SEQ ID NO: 531 - RNA, 23 nt, Homo Sapiens
cccaguguucagacuaccuguuc

SEQ ID NO: 532 - RNA, 22 nt, Homo Sapiens
acuguaguaugggcacuuccag

SEQ ID NO: 533 - RNA, 23 nt, Homo Sapiens
agcuacauugucugcuggguuuc

SEQ ID NO: 534 - RNA, 22 nt, Homo Sapiens
ugucaguuugucaaauacccca

SEQ ID NO: 535 - RNA, 21 nt, Homo Sapiens
aucacauugccagggauuucc

SEQ ID NO: 536 - RNA, 21 nt, Homo Sapiens
aucacauugccagggauuacc

SEQ ID NO: 537 - RNA, 22 nt, Homo Sapiens
ugccuacugagcugaaacacag

SEQ ID NO: 538 - RNA, 22 nt, Homo Sapiens
ccuguucuccauuacuuggcuc

SEQ ID NO: 539 - RNA, 21 nt, Homo Sapiens
uucacaguggcuaaguuccgc

SEQ ID NO: 540 - RNA, 21 nt, Homo Sapiens
uucacaguggcuaaguuccgc

SEQ ID NO: 541 - RNA, 21 nt, Homo Sapiens
uucacaguggcuaaguucugc

SEQ ID NO: 542 - RNA, 22 nt, Homo Sapiens
uagcaccaucugaaaucgguua

SEQ ID NO: 543 - RNA, 23 nt, Homo Sapiens
ucaagagcaauaacgaaaaaugu

SEQ ID NO: 544 - RNA, 21 nt, Homo Sapiens
aggggugcuaucugugauuga

SEQ ID NO: 545 - RNA, 22 nt, Homo Sapiens
gcugacuccuaguccagggcuc

SEQ ID NO: 546 - RNA, 22 nt, Homo Sapiens
cggguggaucacgaugcaauuu

SEQ ID NO: 547 - RNA, 22 nt, Homo Sapiens
cuuaucagauuguauuguaauu

SEQ ID NO: 548 - RNA, 22 nt, Homo Sapiens
agacccuggucugcacucuauc

SEQ ID NO: 549 - RNA, 21 nt, Homo Sapiens
gcgacccacucuugguuucca

SEQ ID NO: 550 - RNA, 22 nt, Homo Sapiens
uuaugguuugccugggacugag

SEQ ID NO: 551 - RNA, 22 nt, Homo Sapiens
ugagaaccacgucugcucugag

SEQ ID NO: 552 - RNA, 24 nt, Homo Sapiens
acuggcuagggaaaaugauuggau

SEQ ID NO: 553 - RNA, 23 nt, Homo Sapiens
uggaagacuagugauuuuguugu

SEQ ID NO: 554 - RNA, 22 nt, Homo Sapiens
aggcagcgggguguaguggaua

SEQ ID NO: 555 - RNA, 23 nt, Homo Sapiens
agguugggaucgguugcaaugcu

SEQ ID NO: 556 - RNA, 23 nt, Homo Sapiens
caaagugcuguucgugcagguag

SEQ ID NO: 557 - RNA, 402 nt, Homo Sapiens
augagugagagcaucaacuucucucacaaccuaggccagcuccugucuccccccagguguguggugaugccaggcaugcccuuccccagcaucaggucuccagagcugcagaagacgacggccgacuuggaucacacucuugugaguguccccaguguugcagagagccuccaccaccccgagaucacauuucucacugccuuuugucugcccaguuucaccagaaguaggccucuuccugacaggcagcugcaccacugccuggcgcugugcccuuccuuugcucugcccgcuggagacgguguuugucaugggccuggucugcagggauccugcuacaaaggugaaacccaggagaguguggaguccagaguguugccaggacccaggcacaggcauuag

SEQ ID NO: 558 - RNA, 457 nt, Homo Sapiens
auucaaaugggcccugcugccaagccuuuuuuuuuuuuuuuuaacaaugccaucucuucauauuguuccauuuaacaaaacugcagcccuucaucuauccuuaagucccuuggccagugguacagagccagaguaugcuacucccuagcaggaaaucaacaggaugaccuacuaaacaccauucagaagaugcuaagacccaugaauugcaacaggaaagaaaagacagagaauuagucagacaggaaucaagguucccuagagaaauggcugacuccauguauggugcaguauauugauccuggaacaucuguuuugccagaaagcaaggaagccaucaaaguccaacaggaucacuucaaaaagacaugaaagucaacuugaagagauaauuauuaaccuagaugagacaaucuaagcauccaaaacaauaaagacugcaauggccugaaauaca

SEQ ID NO: 559 - RNA, 472 nt, Homo Sapiens
ccgugaggugcccagaagaucaugcagucaucagucccacggagcagccugcgaggcugaggcuccucccacuggaccgccccccaacuggcaccacugcugccccugccccuacucucagccucacgugacucucgggcagaagcagugguggggcagccagggcagcgucaagagucugagccagcugcaggacaaguucgagcaucuuaaaaugauucaacaggaggagauaaggaagcucgaggaagagaaaaaacaacuggaaggagaaaucauagauuuuuauaaaaugaaagcugccucugaagcacugcagacucagcugagcaccgauacaaagaaagacaaacauccugauccauaugaauuccucuuauuaagaaaaauaaagcauccaggauucaaugaagaacugacuaucaccuuguuaaucauucagaaacauguugcaggcuuaagccauuuuuga

SEQ ID NO: 560 - RNA, 711 nt, Homo Sapiens
cgcaggcucggcggcacgcccccugacgugugugccucaggcuuauaauagggccggugcugccugccgaagccggcggcugagaggcagcgaacucaucuuugccaguacaggagcuugugccguggcccacagcccacagcccacagccaugggcugggaccugacggugaagaugcuggcgggcaacgaauuccaggugucccugagcagcuccaugucggugucagagcugaaggcgcagaucacccagaagaucggcgugcacgccuuccagcagcgucuggcuguccacccgagcgguguggcgcugcaggacagggucccccuugccagccagggccugggccccggcagcacgguccugcuggugguggacaaaugcgacgaaccucugagcauccuggugaggaauaacaagggccgcagcagcaccuacgagguacggcugacgcagaccguggcccaccugaagcagcaagugagcgggcuggagggugugcaggacgaccuguucuggcugaccuucgaggggaagccccuggaggaccagcucccgcugggggaguacggccucaagccccugagcaccguguucaugaaucugcgccugcggggaggcggcacagagccuggcgggcggagcuaagggccuccaccagcauccgagcaggaucaagggccggaaauaaaggcuguuguaaagagaaa

SEQ ID NO: 561 - RNA, 869 nt, Homo Sapiens
gguuuauaggucccggcccgagccuccggccgcccgccggguuugucccgcgauccccgaccaugcccgccgaccucagcgguacuuggacccugcucagcagcgacaacuucgagggcuacaugcuggcccuagauggagucucgcucuguugcucaggcuggagugcaguggugugaucuuggcucacugcaaccuccgccuccuggguucaagcaauucuccuacuucagccuccaaaguagcugggauuacagguaugugccaccaugcccggcuaauuuuguauuuuuaguagagaugggguuucuacauguugaucaggcuggucucaaacuccugaccucagguauugacuuugccacucguaaaauagccaaguugcugaagccacagaaagugauugagcagaauggggauucuuuuaccauccacacgaacagcagccuaaggaacuacuuugugaaauuuaaaguuggagaagaauuugaugaagauaacagaggccuggacaacagaaaaugcaagaguuugguuaucugggacaaugacaggcucaccuguauccagaagggagaaaagaagaacagaggcuggacccauuggaucgaaggagacaaacuccaccuggaaauguucugugaaggucaagugugcaaacagacauuccagagagccugauccacauccagcagcagagcccacuuguggcugcagcuuuaugccaaauuauauugcagacugaacagacguuuaucuaucccauuuggcgacgaggacucguggcuggagagagccacacagcguguaaccugaagucaucuagauuauggggaaacugcucagcuucaauaaaccuguccaaauga

SEQ ID NO: 562 - RNA, 17810 nt, Homo Sapiens
cucccaccucgaugcggugccgggcugcugcgugauggggcugcggagcggcgcccugcggcucgcggcggccgcugcucgcgcugaggugcgucggugcccggccccccgcgcccccgcgcgccgcggcuccuguugacccgguccgcccgucggucugcagcgcggcugagggaggcugcuugagcaagcuagucauuguucaugcaacacaaaacauucccgccccuaacgccagaauggagcuuccagaucccuuuuuuuuuuuuuccuugauugcuaaaugagcuuccaagggauucuuuucacacaguaguguuggcuuuguucuguugggagggaaacuauuccucuaaaaaauguucacauuuuuccuauuacuucauucaguagugaaauguaaugauuugacucugccaugagucaguggcauaucugagggaucuuugaaguuaaaggaaauuggccaggcgcagugacucacgcuuauaaucccagcacuuugggagaccgaggcaggugaaucugaggaaacuuggcuguaacuucaaaagaagauuugauucuuuauuucuggacugcauauauauauauaacaaggccauuaaaaugucgggagccucagugaagguggcuguccggguaaggcccuucaauucucgagagaccagcaaggaauccaaaugcaucauucagaugcaaggcaacucgaccaguauuauuaacccaaagaauccaaaggaagcuccaaaguccuucagcuucgacuauuccuacuggucucauaccucacccgaagaucccuguuuugcaucucaaaaccguguguacaaugacauuggcaaggaaaugcucuuacacgccuuugagggauauaaugucuguauuuuugccuaugggcagacuggugcuggaaaaucuuauacaaugauggguaaacaagaagaaagccaggcuggcaucauuccacaguuaugugaagaacuuuuugagaaaaucaaugacaacuguaaugaagaaaugucuuacucuguagaggugagcuacauggaaauuuacugugaaagaguacgagauuugcugaauccaaaaaacaaggguaauuugcgugugcgugaacacccacuucuuggacccuauguggaggaucuguccaaguuggcaguuacuuccuacacagacauugcugaccucauggaugcugggaacaaagccaggacaguggcagcuacaaacaugaaugaaacaaguagccguucccacgcuguguuuacgauuguuuucacccagaagaaacacgauaaugagaccaaccuuuccacugagaaggucaguaaaaucagcuugguggaucuagcaggaagugaacgagcugauucaacuggugccaaagggacucgauuaaaggaaggagcaaauauuaauaagucucuuacaacuuugggcaaagucauuucagccuuggccgagguggauacuaggauaacugcacuagcaaguaagaaaaagaguaaaaagaagaagaaaacagauuuuauucccuacagggauucuguacuuacuuggcuccuucgagaaaauuuagguggcaauucucggacugcaaugguugcugcucugagccccgcggauaucaacuacgaugagacuuugagcacucugagauaugcagaucgugcaaaacaaauuaaaugcaaugcuguuaucaaugaggaccccaaugccaaacugguucgugaauuaaaggaggaggugacacggcugaaggaccuucuucgugcucagggccugggagauauuauugauaaagccuaccuucagauaagauucaccuuugaauggcccccuccuccuguaaaaugcuggagugccccgugcugccuaugaacauaugaaggggaaaaguucaauuccuaugaaguucaagaacuacacuuccagagaguauuguuuuacaauguuguauuaaaauuuaucuuaaaaaaucuccgugaugugccuauccaguggcuuauucagaaguucucuuaagugaguaaaauggauucauauaggaauagaauaugguagaauauggguuaguuuaguaaagcauuuuuuuuuaguguaaaguuaaacuuauauuccuugaaguucuaauaagauuuucaaggccucuucuaguuuaauucuucuuauugauuagaguccgaguuuagaugaauaccguuuguaaaaaugauaccguauucuaaguauuaacuuuuccaucuccccaaaugccaaaaacugcucuguucccucucugugucacugcugaaccugaacuuugacccuucucguauuuucccuccugcuuaccuucaguugauccauugaucgaugauuacucuggaaguggaagcaaauaucugaaagauuuucagaacaauaagcauagauacuugcuagccucugagaaucaacgcccuggccauuuuuccacagcauccauggggucccucacuucauccccaucuuccugcucacucaguagucaggugggcuugacgucugugaccaguauucaagagaggaucaugucuacaccuggaggagaggaagcuauugaacguuuaaaggaaucagagaagaucauugcugaguugaaugaaacuugggaagagaagcuucguaaaacagaggccaucagaauggagagagaggcuuuguuggcugagaugggaguugccauucgggaagauggaggaacccuagggguuuucucaccuaaaaagguaggaaacaaugcugugaaaccuaaucagacagagacacuuuuuguuugucuuuguuacuggggcacuucaugucuuucaggaccuacucucccccuuauuaucuugauacuugccuuaauuucagauauuucugauuucaucuuagagcauggucuuauaguacaaaggcagccuauuucuaaaaugccuaucuuguuuacuguuuacaaaccccacaucuuguuaaccucaaugaagacccacuaaugucugagugccuacuuuauuacaucaaagauggaauuacaaggguuggccaagcagaugcugagcggcgccaggacauagugcugagcggggcucacauuaaagaagagcauuguaucuuccggagugagagaagcaacagcggggaaguuaucgugaccuuagagcccugugagcgcucagaaaccuacguaaauggcaagagggugucccagccuguucagcugcgcucaggaaaccguaucaucauggguaaaaaccauguuuuccgcuuuaaccacccggaacaagcacgagcugagcgagagaagacuccuucugcugagacccccucugagccuguggacuggacauuugcccagagggagcuucuggaaaaacaaggaauugauaugaaacaagagauggagaaaaggcuacaggaaauggagaucuuauacaaaaaggagaaggaagaagcagaucuucuuuuggagcagcagagacuggacgcggauucugauagcggggacgauucugacaagaggucgugugaagagagcuggaaacugauuacuucucugagagaaaagcuaccucccagcaaguugcaaaccauuguuaaaaaauguggccucccaagcagugggaagaaacgugaaccaauuaaaauguaucagauaccccaaagaaggcgcuugaguaaagauuccaagugggucacaaucucagaucuuaaaauucaggcugucaaagagauuugcuaugagguugcucucaaugacuucaggcacagucggcaggagauugaagcccuggccauugucaagaugaaggagcuuugugccauguauggcaagaaagaccccaaugagcgggacuccuggagggcaguggccagggacgucugggauaccgucgguguuggggaugagaagaucgaagacgucauggccacugggaaaggcagcacugauguagaugaccucaagguucauauagacaagcuggaagauauuuugcaagaagucaaaaagcaaaauaacaugaaagacgaggagauaaaagucuuaagaaauaaaaugcucaaaauggaaaaagucuugccacugaucggaucucaggaacagaaaagcccaggaagccacaaagcaaaggagccuguuggugcugguguuaguagcaccucugagaauaauguaaguaaaggagacaauggagaacuugcaaaagaagaacguguuucccagcugaugaauggggauccagcuuuuagacguggacgucugcgcuggaugaggcaagagcaaauucgguuuaagaacuugcaacagcaggagauaacaaagcagcuucgucggcagaauguaccucauagguucaucccuccugagaaccggaagccccgcuuccccuuuaagagcaacccuaaacacagaaacucuuggaguccugggacacauaucaucauaacagaagaugagguuauagagcuuaggauuccaaaagacgaugaagcaaggaaagggaauaaagaagagagccaagaaaaaggggguaaaggagcuuuuaaggauccccaguuuccauggggcucucaaggaaugagaagucaagaucacauccaaguuagcaagcagcacauuaauaaucagcaacagccaccucaacuacguuggagaagcaauucucucaauaauggccagccgaaaaguacgcgcugccaggcaucugccuccgcggagucauuaaacucccacaguggucaccccacugcugauguacagacuuuccaggcaaagcgccauauucaucaacaccgucagucuuacuguaauuauaacacuggaggucaguuagagggcaaugcagccacuuccuaucagaagcagacugacaaacccagccacuguagccaguuugugacaccuccgcggaugaggagacaguucucagcacccaaucucaaagcuggucgagaaaccacaguauaaaucaguuacuggacaaacuugaaaucaugguggaagaaacagacaguguuagcucaugauuugauuugguucuaccuuuggccuugaguucuuauuauuuacauuauaaauauuaacugguuuuauauuguuaagacaaaacacugguaaaaguuucaacaccucccuuuugcuuguauaccauaaaugggcaguuucugaaauuuuggauaaagcaucaagaacuccuuuuucugaaacguuccuccuuuuuuagugccuaauuaauauacuuacuuacacagacuugucccaucuugauguaaguuuguuauguuuuuauaaugccuauaaauuaaucugacauccagaaagaccugccucuuaguuuaugcagacauucaaaaggagaauuugauaagcagaauuaaaugucuguuauucauaaauguuagaaauugguuuaaaaauaauaacaugcaacugggugggcacagcuuuggauuucucauccacgucuguucccuucuuuaaauaugauuagaauuuucguaagccaaaacuaaaggucuucaaacauaucuugcaauacauagcuuugcaucuuccacacaacuuccacgucuucuuuuauucuguauuuuacaaaaaacucauauaaugguuuuuucuuuugaauguaucagaauauguaugaaauuugucauaucagaaucuauaaauuggcacugugucugggauucuguuugugguuugcauuuugaaguucaauguaucauuugacacacaugcacacaaagugaacuauucaccaaaaucaugccaacagaaauaccaacaaaaaacuuguguagcuuguaaggagguuauuuggcuugagagggaagaggugggacagacaugggggacaaagcuacagcauauggcucuguggugcugcuuuuuuccaauaguugaugaaauagugaaauaaaaguuaacuuugguugggcuuggaauaaaggagaugauacauaauaaacuauucuuugguuagcauuaguaaugcuuguagacacucaaacaaggaaggcgaaguccugaugaugauuuauuguaucaauaccucauuuuauuugguuguggucucaguuugccucacuggagaauccacuaagaaagauggauuuuaaugggaagaaaagaauuauuuucuacaucguuccucaucucuugaguuugucaaaaaguuuucuaagaggcagugugaagagccagagauguccgaaauugccugacuucauguuuuggaagauuccuaagucacaugaaaucaucuaucaaacacuugucuuccaaacggugugaaaaacuacagccaagauagcaguuagcauucaaggaagccuuaaagauugugauuauguuuuuuuuuccuuugcgugugggcacuaugcuuuauuagaacacauuauuuuuaaucauaguauuuuuucuuugccucuaagaaaauacuuucuuaaugcucagaaaguugcuuccaauuaauguuuuuuuccccuuaaaaagagaagcuuugagagauauuuuugcuuucauagcuagaacaguugaagucuucaacugagguuuuauagcagauuagacauggguaaaugaugucuguaauggguugaguuacugagaugacaaucuccugugccauuugguuugaauguacuugauaggcugcuucaaaucagucacuucaaugcauuuuguguaaacccaguuguccuuuuuuauuccucuuuagacauaaaugugcuaacuauuccuuucuauacacaauuuauuuucuaagauuaaaaauaauaauugcuagguuugguggcacaugcguacagccccagcuacuuaggaggcugaagcaggaggaucccuagagcccaggaguucugggcugugguacacuaugccaguuggguguaaguuuggcaucaauauggugaugucccugaagcaggaaaccacaaacuugcaucaggacgggugaacccagcccagguuggaaauggagcaggccaaaacucccaggcugaucaguaaugggaucuugccuaugaauagccagugcacugcagccaggacaacagagugagaaccugucuuuaaaaaaaaaaaaaaaaaaaaaaaaaaagguaauauuuauuauauuauucagguuucaacucuguagcaaaaaugggcucucauuucccuaacuugagauaacauaggguagguccauauauuuucauucuuacaguggucuuuucaugggagugaaugaguuacucuccacuggugauuagguaauacuguagaaugaagaguuguauaauauauucauuuacagcuguggauugugguaaggacuauguccacagugauauuccaaagaauuggguuuauauuugugcuucaucuguuaaucccagguguccucauguugcugaaauauuuagauagcuaaaauaucccuuaauuucacagaugaccaggaagaaauuaaccaagguuuuauugacugccauguaugucccaugaugcauuucugagcaaaugcuuauccuagagaauaacucuguaugaauaaaauugcuuaauugagucucuuacuaaauaaguaacuagugccaugcuuuugugagcucuugguauggcccauauuacuuuguuuuuuguuuuuguuauuguuguuuugugauagucuugcucugucgcccaggcugcagugcaguggcacaaucucagcucacugcaaccucugccuccuggguucaagcaauucuccugucucagccuccuggguagcugggacuacaggugcaugccaccaugccuggcuaacuuuuguauuuuuaguagagacaggguuucaccacguuggucaggcuggucucgaauuccuaaccucaggugauccaccugccuuggccucccaaagugcugagauuacaggcgugagccaccgcgccuggccuguuuguuuuuuuaacaugauuuuucucuaagcuuaaauaccacaaggccaaagagaaauggucauaauuuaaaccauuauuauauuguugagguaucccuagcuauuauuauagcaaagugggaaaaaaguguuuauucuauugaaguuauguaaugauccgacauuaaugggaauauagaggaguccuaauuaauugguauaauuucacaaagcggaaugguauuccuuggagaguuaaagacauucucuuuaguaaguguaaaccaaagggcauuuucuuuauuccugcuucuaauuccuucuagcccagugaauuauuucucuuuucacugguaaugugaugaaugggaauuguuuauuacauugaagugacuugaagugaccuuuugugcuuuaggugcagguugacacugaaaaaaaaacaaaacacugaauuuuucacaccuaugucugcauuaaaggcuguuuuacuaccggaaguuacauagacuuccugcagucagcugcugugccccagugccuuacugguccuuuguagauuugccuuaaugauuuguacaaaugacugggaggcggggaugcugccuguguccuggugaaccuuaaugaaggggccgucuuaggcacagugcaaaacaagcauuuguccuguacuguuagagccaaaauugugaugagcaauacugauaauuguccaguuuaugucaucuuucccagauuuuaaaaucuguucuagauauucuuagcuugaaccacuuuugauugugaaauguauuagguguugucccauuauuacuguaaaaugaaguuuugaaucuucuuguuaauaaacuguggauuuccccucucaauuucuuaaacaacaacaaaaaaaugcuugaagauugucuuugaguguaagaucugccuuuucagaaagggaguguuaguuuguaauguuaaaaaauaaagaccucauucaauaaaaguugaagucaucuuuuaagacuaugagaguaaauugcaggccuugcagaagcagguugaaacccgaucucuggcugcagaaacaacugaagaggaggaagaagaggaagaaguuccuuggacacagcaugaauuugaguuggcccaaugggccuuccggaaauggaagucucaucaguuuacuucauuacgggacuuacucuggggcaaugccguguaccuaaaggaggccaaugccaucaguguggaacugaaaaagaaggugcaguuucaguuuguucugcugacugacacacuguacuccccuuugccuccugaauuacuucccacugagauggaaaaaacucaugaggacaggccuuucccucgcacagugguagcaguagaaguccaggauuugaagaauggagcaacacacuauuggucuuuggagaaacucaagcagaggcuggauuugaugcgagagauguaugauagggcaggggagauggccuccagugcccaagacgaaagcgaaaccacugugacuggcagcgaucccuucuaugaucgguuccacugguucaaacuuguggggagcucccccauuuuccacggcugugugaacgagcgccuugccgaccgcacacccucccccacuuuuuccacggccgauuccgacaucacugagcuggcugacgagcagcaagaugagauggaggauuuugaugaugaggcauucguggaugacgccggcucugacgcagggacggaggagggaucagaucucuucagugacgggcaugacccguuuuacgaccgauccccuugguucauuuuagugggaagggcauuuguuuaccugagcaaucugcuguaucccgugccccugauccacaggguggccaucgucagugagaaaggugaagugcggggauuucugcguguggcuguacaggccaucgcagcggaugaagaagcuccugauuauggcucuggaauucgacagucaggaacagcuaaaauaucuuuugauaaugaauacuuuaaucagagugacuuuucgucuguugcaaugacucguucuggucuguccuuggaggaguugaggauuguggaaggacagggucagaguucugaggucaucacuccuccagaagaaaucagucgaauuaaugacuuggauuugaagucaagcacuuugcuggaugguaagaugguaauggaaggguuuucugaagagauuggcaaccaccugaaacugggcagugccuucacuuuccgaguaacaguguugcaggccaguggaauccucccagaguaugcagauaucuucugucaguucaacuuuuugcaucgccaugaugaagcauucuccacggagccccucaaaaacaauggcagaggaaguccccuggccuuuuaucaugugcagaauauugcaguggagaucacugaaucauuuguggauuacaucaaaaccaagccuauuguauuugaagucuuugggcauuaucagcagcacccacuucaucugcaaggacaggagcuuaacaguccgccucagccgugccgccgauucuucccuccacccaugccacuguccaagccagucaugauugcuuuucaagauaguaggcuaaauauuagggucuacaguuuauaaaugaggagacagacucccagagguuaagcagcuuaacuaaagucacauagcaucaguacaguuaagaauauggaguuuaaaucuggccggaaaagauacugauuucuuuauuuuccuuguucucugaauguagagauaacuaauaacuuacaaaguuuauauugguguuucucugggucuuuugcauugaaaucuuuccucugacucuugcugccuuucccaaguaugucuuuaaagacugacauuagagaagcuuguauuuuugcugaguagucuuggaccagauuuugacauacucuaaaaacuuuuaaaaguuccagccaccaaguuaaacacgaugagcaaaaccagccuuggccagagcaugagcaaguaugaccuccugguuugguuugagaucagugaacuggagccuacaggagaguauaucccagcugugguugaccacacagcaggcuugccuugccaggggacauuuuugcuucaucagggcauccagcgaaggaucacagugaccauuauccaugagaaggggagcgagcuccauuggaaagauguucgugaacuggugguaggucguauucggaauaagccugagguggaugaagcugcaguugaugccauccucucccuaaauauuauuucugccaaguaccugaagucuucccacaacucuagcaggaccuucuaccgcuuugaggcugugugggauagcucucugcauaacucccuucuucugaaccgagugacacccuauggagaaaagaucuacaugaccuugucggccuaccuagagcuggaucauugcauccagccggcugucaucaccaaggaugugugcauggucuucuacucccgagaugccaagaucucaccaccacgcucucugcguagccucuuuggcagcggcuacucaaagucaccagauucgaaucgagucacuggcauuuacgaacucagcuuaugcaaaaugucagacacagguaguccagguaugcagagaaggagaagaaaaaucuuagauacgucaguggcauaugugcggggagaagagaacuuagcaggcuggcggccccguggagacagccucauccuugagcaccagugggagcuggagaagcuggagcuccuacaugagguauccaggggcaggguuguucagaugcaagaacucucggacaagauugccaaaguaucagucuuccuccccgcugcugcaugugaucauagcuuuucacuuuucucuccugaggucuuaacgagcuuuguguuugcuauagcaguaguauugaucuucucagguggaaaaaacccgccacuuuuugcugcugcgugagagacuuggugacagcauccccaaaucccugagcgacucguuaucccccagccucagcagugggacccucagcaccuccaccaguaucuccucucagaucucaaccacuaccuuugaaagcgccaucacaccuagcgagagcaguggcuaugauucaggagacaucgaaagccugguggaccgagagaaagagcuggcuaccaagugccugcaacuucucacccacacuuucaacagagaauucagccaggugcacggcagcgucagugacuguaaguugucugauaucucuccaauuggacgggaucccucugaguccaguuucagcagugccacccucacucccuccuccaccugucccucucugguagacucuaggagcaacucucuggaucagaagaccccagaagccaauucccgggccucuagucccugcccagaauuugaacaguuucagauugucccagcuguggaaacaccauauuuggcccgagcaggaaaaaacgaauuucucaaucuuguuccagauauugaagaaauuagaccaagcucaguggucucuaagaaaggauaccuucauuucaaggagccucuuuacaguaacugggcuaaacauuuuguugucguccgucggccuuaugucuucaucuauaacagugacaaagacccuguggagcguggaaucauuaaccuguccacagcacagguggaguacagugaggaccagcaggccauggugaagacaccaaacaccuuugcugucugcacaaagcaccgugggguccuuuugcaggcccucaaugacaaagacaugaacgacugguuguaugccuucaacccacuucuagcuggcacaauacggucaaagcuuucccgcagaugcccgagccagucgaaauacuaagugacucugccgagugcccucacucgccuucgagagauaaagaaagcguuaccucucauuucucuuugugauucuugacggugacucuuguauguaauccuguggcuuaacuacuucucccuccuuguccagcacuuuucuagcucucccguuccccaucuccauugcucuguacucuuuucuuuuuucuugugcugagaaucucguuaguagcauguggccuaacaaaaggaaaaaauguuuuuaaacacacacacacacacacacacacacacacacauacacagacaaaaacacaaaaacucugaggggaucuggugaaucuccaaauuauuguggguguacuuuggcuuccuuuuguaugauagguccccaucaugaccaccucugaugucugugcugcugucaccaggcaccuuuguuuuucaagacaacauacuuuuuuuuucuuuucucuguuugugauaucacuuuaauuuuucuuggguggcuuagagacuaagggaggagacaucuggccuuuuuagaaccugagaggaaaaaaagagucuuuuuuuccccucugucucuuuuugccauggcuaaucccugcauuuccauucagggaaaaggugguagugagcauagaacugcaacaguuauauucugagucaaaguuggggcuuuuuacggcauaauuauggaauuuuuauuuacugguagagaggagacgagaggcuuuuucagugggccugggacaguggcugcucuugacuuugugugaagggaaaugccaaggaugcuucugguggacuucaggggaccccaggguuuggccgugggccgugauggcagcaggcggugggaugcuuguagcuccucacagcaggauuccugcccacuguuuuuucucuguugggagggaagcucuuuucuaggagugucucaguucugcuuuuggcauuagugaugguggugguacaguuggaauuagugccaugucauacacaaauguuccacaaggcgggaguguuucacuuucuggugauaaacuugauggucauuguuaugauuaagauaaugccgggcaggccgggcacaguggcucacgccuguaauccaagcacuuggggaggccgaggcgggcagaucacgagaucaggaguucaagaccagccuggccaauaugaugaaaccccgucucuacuaaaaauacaaaauuagucggguaugguggcacaugccuguaauuccagcugcuugggagccugaggcaggagaacugcuugaacccaggaggcagagguugcagugagccaagaucgcgcuauugcacuccagccugggugacagagcaagacucugccucagaaaaaaaaaaaaauaauaaugcuggguagugaccuugugauuguuacagcucccuuugaucaaagaaauauagcuuucaggcauaaaccuggaagucucccucugaauccagcaguuguuuucauugaugcuugucagguugaagaugcuuucagugaugcucucuauacucauaaauaagcaaauguggcaggcuuugcuuucuggaucccaggauuaaaacuaaccgugaccacuacuccaaacaaaacacaauaugccuaggggcacggaugaacguccagggagcccgggccccaggcuuuguugcguguucccugcuccucuccaucugguguggaaacacugcccagggagaaaggaggaagcucacuguggacagucuucuuuccuucugacagaccaggucaucuggcuuccgagaucaucagagaagauaagucugucucuuucagcugccaguaaguuuuccaggaugagaggggaaaaagaaagccuccagugacuucaguugcuuugccaguugucuugggauuguuuuacaccauccuuuacuucccuugcucagaccucucuguuucaccauugcucaggcauucaggaaaguaucugcucacucccacuuggugaguccucggccuugagguugcugacucucaggcguuaggcagcuggaugacuucccgcuucacgcagcaaaggccaggggcuugcgcgccucugcagaguuguugcuagggagacuugugucaucauccacaaccuuguuucucacuuccugguugggcucaucucugaagaacaggucucccagcuucgcuccuuaucacugcauugugaagaggaggaaaagugaaucacggagagagaaaggaaaggauagaaucacaggcugcgucugcaccugaaaagugacccgcggaaacucuauggcggauuuuuuuuuuaacuuucuucuuccuguuaaaacauaggucacuaacugugauguuauuuguuuucuaagugguaugugagauuuucuaauguaguuagaaguuucauugucugauggacacaauaugcccuuccgguucuauucaaaccagcaggaucugucggugcuuagagauggcugccuggacuggaaucaaaucuaauuucagggaaaugaagauggaauuugaaggucacuuuuaaaauuaagucauugaugcugcuguuacagagugugacagaggauccaugucugugacacaggacggugggaagccugagagagagugaaauuaugugauacacugaaaugacuuuuguuuuucuucuaacucauacaaaacugguuuggaaagucuuugcuuuggaagcgucagacauuagaacaggccaaacuggacugucuguucauagcgugccugaauaagaaggccucuuagggagccagagggagcagaguggucguguccugcgugcucuucacccucuggggcgccccugcugcggcuggcaggugcagacagccuuugcugguccccagcacguccagggugggugcucccuugcccgacagaaccauccccacugugaggcugugagagauuuguggcaggaacuguuuaugaggcucuaguuguugcuguuguggcgggaaaguuaagaaacauagcccuuaaggaaaccaccuuuauguauuuucuuaaagcacgccuuuaaauaagcaaaaacuuuaaaaggcaggaaagagaauucuuaggcaaauucagagaaauaagugcuaguuaauacuaaucaccuccuccucugucucucauccuccuuucucccaucaaagcaaaauauggccucaccaccagccccaaaucagugcucagacccucucugugucugugugcccuccugggagucagucagcgcucaggccaggacugugcagggccagccagcccaugcgcuagucaggagcacaggcaaggggugcuuguggcaguggccgggcaccugagccccagcucguuguuaaacgugcugacggcaaggggcaauggagugaguuucccaacuaagaaaccacuauuauauauuuuuucccuucagucacauagacuucagacaacucuccuauuuuuuauggauuuuucagcucauuucagaugaaggaacuaagucauugugaacugucucuugagaucuaaaaacaagaugacuuuuccuggcacauauuccaaagcaaagacuuuguugccugcugcuuauugucuaauuuacagggauauuuaauuuugucaggucuauguauauuuauccagcuauacuuacuugcacaguggauuggagagaaaggauucuccagugugcacacucaucgguacucuuucugcauuucccucgugcugugucccgcucggguuccaauggacaguaucagggcuuguuugacuuaggucuuucaguuuuccuuucgguucccuuuuaaaaaugugauuguuaaccugccucuugaaagauucaaccgggugugguggcucacgccuguaaucccagcacauugggaggccaaggcagguggaucaccugaggucagaaguuugagaccagccuggccaacauggugaaaccccgucucuacuaaaaauacaaaaaguagccaggcgugguggcgugugccuguagucccagcuacuugggaggcugaggcaggagaauagcuugaaccugggagguggaggcugcagugaguugagacugcaccauugcacuccagccugggugacaaagcaggacuccgucucaaaaaaaaagaaaagauucaugaugcugcugcucccagaagguuugcuggauguguuuacauaggacucuaacuugugugcacuacaguuguucaccagggccagugauucaccccaguguguggccagaccaugacuguguagcaggaauguuuuaauuugugcuuccuuaguaaauugaaauaucagcugagagauuauuugcugcuguuauucaaaaggccauuuaugaaguuaguauuugagccccauaagaucuuuaaaaagccuccaaucauuuaaaggaagaaaucagaguugcuauaaaauucaguaaaaagcucauagccaaacggcugugcucagauggaaagucugagcugagguuggucucuugccaaaccguggcuguuguguguuguucuucaugucuucgaguucauuuuuuuucauucugccuauucuggcaucagcucacuugaggagucccucagccuucuuguauuuaaggcaucgucuuagacuuuguggcucuaaaguaccugucuguugagauuucaagucucuugucaccauccucacacaugacaacaaaacccauaaugcauaaguggccuuuuugaaccaagacuuugcaaacugaucucucccccgugaaggaguugagcacauuagcaacaauguacauuaauuuuggauuuucauuuucauguuuuauuuuguaaauauuaucugauguuuggagcuugaguauacagacuguaaauauaguucuuguauuuguacuaauucugauucuuuugcuguauagccuuagaugugcaaugcagacacuaucuaacugugugugguaaccuugcgucacggagcuguuagugaacgagguaaaaauaauaaagguacagccagugcaucagaa

SEQ ID NO: 563 - RNA, 2971 nt, Homo Sapiens
acagccagagggacgagcuagcccgacgauggcccaggggacauugauccgugugaccccagagcagcccacccaugccgugugugugcugggcaccuugacucagcuugacaucugcagcucugccccugaggacugcacguccuucagcaucaacgccuccccagggguggucguggauauugcccacggcccuccagccaagaagaaauccacagguuccuccacauggccccuggacccugggguagaggugacccugacgaugaaaguggccagugguagcacaggcgaccagaagguucagauuucauacuacggacccaagacuccaccagucaaagcucuacucuaccucaccgggguggauggagucucacccugucacccaggcuggagugcaauggcaugaucucggcucacugcaaccugcgucucccagguucaagcgauccuccugcuucagcgucccuaguagcugggacuacaggcgcuugccaccacgccuggcuaauuuuuguauuuuuaguagagauggaguuucaccauguuggccaggcuggucucgaacuucugaccucaggugaucugccugccucaggcucccaaagugcucggauuacuggcaugaaccacugcgccaggcccucuauuccuuuuugauaccucaaauaucuauaacaaaaaguagauaaugacacugucuuauacaagaauauagauaguguuccucaaauuccauuauuuauaucucaucuucaccauuucugccauaucaaugauccaccuauacucauauuuauguaauguucuucuuuaaauaaaauccauucuuaaacuuaaaucuccuugugcgcagacaucacccgcaccggcaaagugaagccaaccagagcugugaaagaucagaggaccuggaccuggggcccuuguggacagggugccauccugcuggugaacugugacagagacaaucucgaaucuucugccauggacugcgaggaugaugaagugcuugacagcgaagaccugcaggacaugucgcugaugacccugagcacgaagacccccaaggacuucuucacaaaccauacacuggugcuccacguggccaggucugagauggacaaagugaggguguuucaggccacacggggcaaacuguccuccaagugcagcguagucuugggucccaaguggcccucucacuaccugaugguccccgguggaaagcacaacauggacuucuacguggaggcccucgcuuucccggacaccgacuucccggggcucauuacccucaccaucucccugcuggacacguccaaccuggagcuccccgaggcugugguguuccaagacagcguggucuuccgcguggcgcccuggaucaugacccccaacacccagcccccgcaggagguguacgcgugcaguauuuuugaaaaugaggacuuccugaagucagugacuacucuggccaugaaagccaagugcaagcugaccaucugcccugaggaggagaacauggaugaccaguggaugcagacucacucccacaggaugaaauggagaucggcuacauccaagccccacacaaaacgcugcccguggucuucgacucuccaaggaacagaggccugaaggaguuucccaucaaacgcgugaugguaccugcaugggguggggagggggcacagcugccgaaacccucuugucuugagacucccuccuuuuagccugccuuccccgcccgcgccuguagcugaguagcccagugcaaggagguggaauuccuaccaaagugggagcauguagguggggcuuguagaaacugaggcucagaguggagaaguuggaauucaaacccggccaguccggcuuggguccagauuuuggcuauguaacucgagggccccaaacaggggguaucaguggacuggacuccuuugggaaccuggaagugagccccccagucacagucaggggcaaggaauacccgcugggcaggauucucuucggggacagcuguuaucccagcaaugacagccggcagaugcaccaggcccugcaggacuuccucagugcccagcaggugcaggccccugugaagcucuauucugacuggcuguccgugggccacguggacgaguuccugagcuuugugccagcacccgacaggaagggcuuccggcugcuccuggccagccccagguccugcuacaaacuguuccaggagcagcagaaugagggccacggggaggcccugcuguucgaagggaucaagaaaaaaaaacagcagaaaauaaagaacauucugucaaacaagacauugagagaacauaauucauuuguggagagaugcaucgacuggaaccgcgagcugcugaagcgggagcugggccuggccgagagugacaucauugacaucccgcagcucuucaagcucaaagaguucucuaaggcggaagcuuuuuuccccaacauggugaacaugcuggugcuagggaagcaccugggcauccccaagcccuucgggcccgucaucaacggccgcugcugccuggaggagaagguguguucccugcuggagccacugggccuccagugcaccuucaucaacgacuucuucaccuaccacaucaggcauggggaggugcacugcggcaccaacgugcgcagaaagcccuucuccuucaagugguggaacauggugcccugagcccaucuucccuggcguccucucccuccuggccagaugucgcuggguccucugcaguguggcaagcaagagcucuugugaauauuguggcucccugggggcggccagcccucccagcaguggcuugcuuucuucuccugugaugucccaguuucccacucugaagaucccaacaugguccuagcacugcacacucaguucugcucuaagaagcugcaauaaaguuuuuuuaagucacuuuguacauga

SEQ ID NO: 564 - RNA, 3014 nt, Homo Sapiens
ccgggccucacucgggccccgcggccgccuuuauaaggcggcgggggugguggcccgggccgcguugcgcucccgccacuccgcgcccgcuauccuggcuccgugcucccacgcgcuugugccuggacggacccucgccagugcucugcgcagagaaacucccgguguggcagcugagauggcccaggaaagaacuauauuaccuucaaaaagagagguacaugcgauguuugagguggcaugaagcucagugguguuauauuggaaugagugagugaccauccuggagccuuccugaaagaggauuggaacaucaguuaacaucugaccacugccagcccacccccucccacccacgucgauugcaucucugggcuccagggauaaagcaggucuuggggugcaccaugauuucaccauucuuaguacuggccauuggcaccugccuuacuaacuccuuagugccagagaaagagaaagaccccaaguacuggcgagaccaagcgcaagagacacugaaauaugcccuggagcuucagaagcucaacaccaacguggcuaagaaugucaucauguuccugggagaugggaugggugucuccacagugacggcugcccgcauccucaagggucagcuccaccacaacccuggggaggagaccaggcuggagauggacaaguuccccuucguggcccucuccaagacguacaacaccaaugcccaggucccugacagugccggcaccgccaccgccuaccuguguggggugaaggccaaugagggcaccguggggguaagcgcagccacugagcguucccggugcaacaccacccaggggaacgaggucaccuccauccugcgcugggccaaggacgcugggaaaucugugggcauugugaccaccacgagagugaaccaugccacccccagcgccgccuacgcccacucggcugaccgggacugguacucagacaacgagaugcccccugaggccuugagccagggcuguaaggacaucgccuaccagcucaugcauaacaucagggacauugacgugaucaugggggguggccggaaauacauguaccccaagaauaaaacugauguggaguaugagagugacgagaaagccaggggcacgaggcuggacggccuggaccucguugacaccuggaagagcuucaaaccgagauacaagagcacucccacuucaucuggaaccgcacggaacuccugacccuugacccccacaauguggacuaccuauugggucucuucgagccaggggacaugcaguacgagcugaacaggaacaacgugacggacccgucacucuccgagaugguggugguggccauccagauccugcggaagaaccccaaaggcuucuucuugcugguggaagaacagcccuugcccaccgcaguuccucauguugcccugcuaacaucgguauguauacacacacaugcacacacgugaacauguuugcacauaugcuccccacgcauacacacaugcucagcgccuccgccuuccagaggugagcguccgccagcccagcuuggcugcuuucuugccaaaccccgggguucccacucgagcacagcggucuuggccuggccccgaacaggccucugacgccaaggagccagccagaaaccagcgguggaggcagaauugaccacgggcaccaugaaggaaaagccaagcaggcccugcaugaggcgguggagauggaccgggccaucgggcaggcaggcagcuugaccuccucggaagacacucugaccguggucacugcggaccauucccacgucuucacauuugguggauacaccccccguggcaacucuaucuuuggucuggcccccaugcugagugacacagacaagaagcccuucacugccauccuguauggcaaugggccuggcuacaagguggugggcggugaacgagagaaugucuccaugguggacuaugcucacaacaacuaccaggcgcagucugcugugccccugcgccacgagacccacggcggggaggacguggccgucuucuccaagggccccauggcgcaccugcugcacggcguccacgagcagaacuacgucccccacgugauggcguaugcagccugcaucggggccaaccucggccacugugcuccugccagcucggcaggcagccuugcugcaggcccccugcugcucgcgcuggcccucuacccccugagcguccuguucugagggcccagggcccgggcacccacaagcccgugacagaugccaacuucccacacggcagccccccccucaaggggcagggaggugggggccuccucagccucugcaacugcaagaaaggggacccaagaaaccaaagucugccgcccaccucgcuccccucuggaaucuuccccaagggccaaacccacuucuggccuccagccuuugcucccuccccgcugcccuuuggccaacaggguagauuucucuugggcaggcagagaguacagacugcagacauucucaaagccucuuauuuuucuagcgaacguauuucuccagacccagaggcccugaagccuccguggaacauucuggaucugacccucccagucucaucuccugacccucccacucccaucuccuuaccucuggaaccccccaggcccuacaaugcucaugucccuguccccaggcccagcccuccuucaggggaguugaggucuuucuccucaggacaaggccuugcucacucacucacuccaagaccaccagggucccaggaagccggugccuggguggccauccuacccagcguggcccaggccgggaagagccaccuggcagggcucacacuccugggcucugaacacacacgccagcuccucucugaagcgacucuccuguuuggaacggcaaaaaaaaauuuuuuuuucucuuuuugguggugguuaaaagggaacacaaaacauuuaaauaaaacuuuccaaauauuuccgaggaca

SEQ ID NO: 565 - RNA, 4157 nt, Homo Sapiens
gggaucccaggguggcagcgccgggcggcggcggggacccuggcugggagcgcggcggugccggcgggaggccgagcggggcucgacagagcaggcaagauaugcucugagauuccucacuguucucugagagagaagagcuacugggcccauccaaaagacagucugcaccuggaacucggcacccaggaggucaccccugcaggaccuguagaggagccuguguccugguggccuuagguggcugcauuacuggaucgagaugaccacagccaccccucugggggauaccaccuucuucucacugaacaugaccaccaggggagaagacuuccuguauaagaguaagguucuggagccauuguugcugccguuguggugguugucaucaucaucuucaccgugguucugauccugcugaagauguacaacaggaaaaugaggacgaggcgggaacuagagcccaagggccccaagccaaccgccccuucugccgugggcccaaacagcaacggcagccaacacccagcaacugugaccuucaguccuguugacguccagguggagacgcgaugaccucuacccuggcgcuaucuccaccacuguccaaagagccucuccagagucaagacccagaggcacacucucuggcagcuucacaaugagcuucuucuggucaggucgacagagacaucuuugacgcaaucucugaugcuuccagcaauccucaaccuugucugcccugcccuaccccaacuguguccacaucccugccgccaccccaccaaaaagcugcagaacauucuuuugucaucugaugagguagagcuauguugggaauccaccaaugugggcuuggcuuucccccacacuguaguuagacagauagacagauagcccaggagccaggugucagggagcacugcugagaguaucacaauaggaucugucacgggguucauaucagaugaagcgccguauccacugcuucacagagcaaaacauucaaucccauaaccaggcacaggggaacuaacuuggacuaacuaaccagaaaaccuuguuaacguauaacuuguuccaguacuacaucucugccugcuggcucaugacaauugcucagcacauuuuccccucuugaagaaagguugcaagaagaacuaaauuauccucaaaagauuucugcuucauuaguaaagagucagugauggaauagggugacucugcagaauaguggccucuaggguaggagcuuguuguguuguccgugggccuggaaugauccugguggcugaucaggguccuucucccacucugggcuguaucaacccugacggucuuggucuuuggcuccccuuuaucuggauucugagcacgcugacuguccuguuaaugccuucccuccaaggaccaguauuuggagauuaauuagauuacaacucuaucuauguuaccuuuguccuuccuggucaccuugcagauucaagacauguucaaagcaacacauucacaacccauuucuauucuauagcaaccucgucugugacuccuuagccuggagaacaaucuaccaagaagagaaaguaucuggaauuaagaaguccuaccauccaagcccuacuuccugguuguguggccuuggaaaagugacucaaccucuuuauauucaguuuccuaaccaugaaguggaaaugauaacaccugccucauuggggcacuauaacaagugaaggacuuaggaaaacaucuggaguauagcgccuggcacccaggagaugcuuaauaaaugggaaccaggauucuuuuucuuuucuuuuuucuuuucuuuuuuuuuuuuuuuugagacagagccucaaucugucaccugggcuggagugcaguggcacgcucacagcucgcugcagccuugaacuccugggcucaagggaugcucccuccucagccuccagaguagcugggacuacagguaugugucaccucaccaggcuaauuuuuuuauuuuuuauuuuuguagagauggggucucgcuguguugcccaggcuggucuugaaccccuggccucaagugauccuucugcuuuggccucccaaagugcugggauuacaggcauggacuauggugcccagccuaggagccaacauuauuauuauuauaggcuuuuuuuucaauugcaagauagacauuucuucacauuuuaaugauucugaaaucagaacauaucuugcaauugauggguucauuaauauaauuguaguucuuuacuuccucucaaaaacuugugaucuuauaauugauggcaucuuggaaacaagguaauaaaucucuauucuguuaaagaaagugacacacuuugacauuuaaccucaaauuuuaggagucucucccucuuggggucagaaaucccuucugaggccaggugucguggcucaugccuguaaucccagcacuuugggaggcugaggcaggcgggucacuugaggucaggaguuugagaccagccuggccaacauggcaaaacccugucucuacuaauaauacaaaauuuagcugggcaugguggcaugcaccuguaaucccacuacuagggaggcuguggcaugagaaucacuugaaccuggaaggcagagguugcagugagccaagaucgugccacugcacuccagccugggcaacagagugaaacugcaucucaaaaaaagaaaaauccauuaugaggggaaaucaagagucagggagguaagaggucuuacccagggucacacagcucaugauaucccacuguaaaaauacucuguggaauagcucuggagaaauacuggcacauucuuccucucuggucauuauuucuuccuacuguguuuaaauauccaccaagugucaaggacuuuguaagaugcuuucacauaaauuaucucauaggauuaaauuuucccaaaaaccuggggaggaauuauuuuuuccaaaacagaugauaauuucugauucaaagagaaagaaaacaaaguacuuuuccaaagucacacagcuaguaagucacaaagacaagacucaaaaccaggucucuugacuccaaagucugucuuuuuugugaagucacacuccucugcuggcccagcucaaagcagcacagauucuuuaugggcugaacaaggggaguacggguuuguccauguguuugaguagagaucaggguucuggcuuccaggcugaaggugagggaaaagccacuucuaacuccuuugggcauccaugcucacggccaaaagagccccuucucaacacauccaagugcuaaggauuccugcuucauucaagcuacuacuuaggcccaaggagcaagggguagaauggcaucuaaccagagcaaagccauuucuuugagggcucaagccauaaacaaauaugcuccccuaaacauauucggcuugaaaaaguuguuuuggggcagcugugguggugcaccccuguaaucccagcccuuugggagucagaggcagucagucacuugagcccaggaguucaagacuagccugggcaacacggcgaaaccucgucucuacaaaaaauacaaaaauuaaccaagcgugguagugcacgccuguauucccagcuacuugggaggcugagguaggaggauggcuugagccugggaggcagagguugcagugagcugagaucgcgccacugcacuccagccggggugacagagccagacccugucucaaagcauauuucaacccuaaaacuagacucuucugcccacagugcagucuucuaaggguuacccucugguauauguucuuuugcuaaaugaaggcuuggaguuggagggaagaaggggagauggaguggugagggcgagucaaauaaaaggauuugagugucucguuuuugacuaaugaagaugauucaauaaacauccuguaagaaggguuccuaugugcaaguugaggugcuacuaaguacauuaagacacaauugcugcucucaaggaguuagcagcuggucucaugcagggaucucaccacgugguuauguauuuuguuucugaugaggugccuuucuuagcagaugcugccuuauuuggccacugaaacaaucaaagcuaauaaaugcuuaaagaaaaauaucugacaauaaaaagguuuaaaucaaa

SEQ ID NO: 566 - RNA, 3003 nt, Homo Sapiens
uuggagagaggggugaugccuggugcugguggaaccccugcacagagacggacacaggaugagcucuaaguacccgcggucuguccggcgcugccugccccucugggcccuaacacuggaagcagcucucauucuccucuucuauuuuuuuacccacuaugacgcuuccuuagaggaucaaaaggggcucguggcauccuaucaaguuggccaagaucugaccgugauggcggccauuggcuugggcuuccucaccucgaguuuccggagacacagcuggagcaguguggccuucaaccucuucaugcuggcgcuuggugugcagugggcaauccugcuggacggcuuccugagccaguucccuucugggaagguggucaucacacuguucaguauucggcuggccaccaugagugcuuugucggugcugaucucaguggaugcugucuuggggaaggucaacuuggcgcaguugguggugauggugcugguggaggugacagcuuuaggcaaccugaggauggucaucaguaauaucuucaacacagacuaccacaugaacaugaugcacaucuacguguucgcagccuauuuugggcugucuguggccuggugccugccaaagccucuacccgagggaacggaggauaaagaucagacagcaacgauacccaguuugucugccaugcugggcgcccucuucuuguggauguucuggccaaguuucaacucugcucugcugagaaguccaaucgaaaggaagaaugccguguucaacaccuacuaugcuguagcagucagcguggugacagccaucucagggucauccuuggcucacccccaagggaagaucagcaagacuuaugugcacagugcgguguuggcaggaggcguggcuguggguaccucgugucaccugaucccuucuccguggcuugccauggugcugggucuuguggcugggcugaucuccgucgggggagccaaguaccugccgggguguuguaaccgagugcuggggauuccccacagcuccaucaugggcuacaacuucagcuugcugggucugcuuggagagaucaucuacauugugcugcuggugcuugauaccgucggagccggcaauggcaugucacucggcuggaaccuggcuguaaaaauggcugaagcaggugaugaggagcugaugcguuuggacgugucucagagaaaucauggaggcgcugcgguuccuaccgguucuuggaugccuucuacagagacaaccauagccccaaauuauagggaucacauaucagugggauuggcuuccagguccuccucagcauuggggaacucagcuuggccaucgugauagcucucaugucuggucuccugacagguuugcuccuaaaucuuaaaauauggaaagcaccucaugaggcuaaauauuuugaugaccaaguuuucuggaaguuuccucauuuggcuguuggauuuuaagcaaaagcauccaagaaaaacaaggccuguucaaaaacaagacaacuuccucucacuguugccugcauuuguacgugagaaacgcucaugacagcaaagucuccaauguucgcgcaggcacuggagucagagaaaauggaguugaauccuuucucugccacucuuugaggagaaucucaccauuuauuaugcacuguagaauacaacaauaaaauacagccauguaccacauaacaacaucuugguaaacaacagacugcauauaugaugguggucauccaguaagcuaagguuaauuuauuauuauuccuuguuuuuuuuuuuuuuuuuuuuuuuuugagauguagucuuacucugucacccaggcuagagugcaauggcaccaucuuggcucacugcaaccucuaccuccuggguucaagcaaaucuccugccucagccuccaaaguagcugggauuacaggcacccaccacaucuggcuaauuuuuuguauuuuuaguaaagaugggguuucaccauguuggccaggcugaucucaaacuccugaccucaagugaucugcccgccucggccucccaaagugcuggaaccacaggccugagccacugugcccagccuuguuugcuuuuuuaacagauaacagugugcucauagaaacugcuuugacaugacugcaaucaugugcuucauagaaacuuaauuagauuauaccacuagagucuucagauuuuuauacuuuuuuuuuuugaaacggagucucacucugucaccaggcuggagugcagugccgcaaucucggcucacugcaaccuccgccucccagguucaagcaauucuccugccucagccucccgaguagcuggaauuacaagugcgcacuaccacacccagcuaauuuuugcauuuuuacuugacaggguuucaccauguuggcuaggauaguuucaccaggaucucuuggccucaugaucagccugccucggccucccaaagugcugggauuacaggugugagccaccgugcccagccuauacuucccuuuuugaauaccauuugguguuuugaagaauuaacagcuuugugaacguggcagugcuugugauucaggcuuccauugagaccaaggggagaaccugguugcaggacaaacagacggacagcguguggcaguguuuaaaugcucuucugaaggcugauacgacagcucucugugcacugauugcauaugcaucccaagauuauauuauuguuuucuacugcuaugugucacacuuugccaaacaggauguggaaaaugaauaagcgguuuucuuaggcacuucuuaacagacaauuggucaaaaugaacuccauugcuuaagaaacacauaaacaccauuuagucacugaacauagcuauauguaugguuguuacuaugggaaaucuuguuuugccaauuuucuuugaaaauucuggcagaccaagguucuuuuuguuuacauaauacuugaaaaauaaaaaugaacaagcuaacaaacua

SEQ ID NO: 567 - RNA, 270 nt, Homo Sapiens
cagugaggaccagaugcugguugaagagcuccccagagucuuguugggauaacugcagucucugcuuucuguagaggaugugacaagggugaacaccaguguggagccaggagaagccguucaccugugaaugauaacagggccagcaccaacuccuacugacugagcauuucugugucagaccaaggggucugugcuuuacacacucacuucauaccucaagaugacugugugagcuuuauugaggcauaaugaacaaauaaaaauuau

SEQ ID NO: 568 - RNA, 1673 nt, Homo Sapiens
gccauuuucgagugauaccugaucucaucaaucuagcggaagagacaggauaaccuauccaagaguauagcgccacuaugacuccgccggaaaaauuacuuuaaaaaucgccaaaaauuacuuggagcaaagggcaguaggcggagcuucgccaaggcuggcgcagucgguuuugaccuguagcagagaaccaauucuggagaacagccucacuucuuugauugaauacucacauaaugcuuuggaacaggacaugagauuaagguuuaauaaugauagaaugaagaccauaauaaaagagaccucuacuuaccucagcaauucuuaccuuucuuaccuauuugaugaagaugucuuuugaaagguguacugcaaggaacaaaauguuuguaaauucugcuuuuaccaagguuucuuuuuuaguugaugccaaagaguuccaauauugaacaucuuaagucuguuacuuggaguauggauugaguuuggagcuuacucagaggacuacaggagaguauccaggagguggauaauuacuguaccuuccucauggaaaaaguuuuauuuaaaguguuauuucucguugaauacuaucaaaaaggaaaaaaaaaugaccuaaacuuuugagacagauuuggcucuaguaaguauuuagauauaucgcuugcauaucugggagaagaaauaagagacuaucaucaauacauucccaucuacuaaaaaauuuuauuuuacacaugucaagggauuacuuauaacuuccauugucuuuuuuuuaagccuauaugcaaugaaaaauauauuggcaaaauaaauauuuaaaccuuuuauguuaaaauuacugugaaagaugacaaguuagcugcuguuuuugucuacauuauacugaaauuaaauguuuauaauuuauauuuuggguuuauuuauuuauaaaucauggaauuuaugcaaaaaacaugaguaguacagauucuccucuaauucuguaggacuuugaauaaugugauauuuuucuuauaguuggacccuuguguuuugaagaaaugccaacugcuugaagaauuuccuuguuauuuguauuauuugcuauaggguuagauguugagaaauucuucugacaaaaaauuuuaagccaguuuuacacuaaauauuccuuagucugauuaauuuguuauuggauguauucuguaucuuucuuuuguaauuuguaacuuuuauccacuuagcacgaaugauucuauugaagaaaaucuuuaggaagugguagaaacuuuaaaucgccccauaguuugccuguuuccacauuuuauuaucuuauaaucuuugggagugcuuacacuuauggagcuaacauuuucagagauacagguucucauaguacuacuaaaacuuuuuuccucuuuggacugaauaccuaugauuauaacuauacaguaguuuaaguuuccuugugauuagucaaaaauaccauuuuaguaugaagcaaugaagucuauuauuuguugucccauaauugagaaacuuagauacaccuuuuauuaagaguuuguaaauucuagcuuagucuacacagauuuuuauaucaauuuguuuauauuuuuauuaaugucauuucuggaauugugaaaauguuaauguucgacaagcaacauuaaaaauagauuugaaacauu

SEQ ID NO: 569 - RNA, 78 nt, Homo Sapiens
cccuaaagggccagacacuauacgagucauauaagggaaggcauuauaggacucauauagugccagguguuuuguggg

SEQ ID NO: 570 - RNA, 390 nt, Homo Sapiens
uggcacuuccgaggucauucauaaacaggcacagaggagcaaaaaauuggagucaccccacgggcauguucccaggcacugggacaacucuuuuccaaagaaagacccaaaaaucguacaaauaaguccaaaugaagcaugaugggaaaucagggacuaauucugcuuggaggacagggaaggcuuucaaagcucuuacaaugaaacauggcaauaaacaaaaucucauuuacuguuggaaagaucugggagcaauguuagaagaaaaguuaacaaaaagguaaaaggauuuuaggagccaauauaacuacuaauaaugaaaauaccugugagaaaauuauucccaacuagaugacuaccuauuacaaauaaauauuuuucucuaaccua

SEQ ID NO: 571 - RNA, 1222 nt, Homo Sapiens
auucccagaaucacuaggcgccggcgccuccgaggcaguguguuuccgcccagagcuggagucucccagcugccagccgaccccgaacccgcacucccgccaaccgcgcuuuuugugggcggucggaaaccacagccuccguuggauauguucggugcauguuauaaacaaccacuuaaacccuccggaucugagccucccgcagaggaaugcagaaugacgccacggcacgcaggaugugaugucaccgagaugcagaggauacucagucaaccaacauuuacugagcaucuacuucgugccguauguacgaagcuagcaaauauguacagcaccaguacugauugcagggagcacuguagaagaggaaugaaggccaaacaauuaaaagcggaggcggggagauugacucuuuucgccgacaccuuguauuucgucuggcaaccuuacucaccccucaaccauuuguuugaguuguuuagaguuauggauauaguuaaaguacgaagccaaaugugugggaauaauaacgccaaauucaagauagugguuucaauggagcacgaaggagaaaaacaccaucaggggucuugucaacggaaaggggucccuauccagaccccaagagagcauucuuggaucucuugcaagaaagaauuugaggcgaauccauagaguaagcaaggcaaguuacuucuauauagaagggugcacccuuacagaucaaacaaugcuuagugaugugugucagaccucugagcccaagcaaagccaucauauccccugugaccugcauguauacauccagauggccugaagcaagugaagaaucacaaaagaagugaaaagggccgguuccugccuuaacugaugacauuccaccauugugauuuguuccugccccaccuuaacugagcgauuaaccugugaacuuccuucuccuggcucagaagcuuccccacugagcaccuugugacccccgccccugccugccauagaacaacccccuuugauuguaauuuuccuuuaccuacccaaauccuauaaaacggccccaccccuaucucccuucgcugacacucucuuuggacucagccugccugcaccuaggugauuaaaaagcuuuauugcucacgcaaaauggaguuuugcucuuguugcccagguuggagugcaguggugugaucuugacucacugaaaccuccgccuccugaguucaag

SEQ ID NO: 572 - RNA, 10240 nt, Homo Sapiens
cagugcagacaggcuuggcuuugaacagcauccagcuccacgauucuaucagcuaaauuuuuuuuuuguacuuuaagaaauagggauagucauaguguuuacuguacgcaguuguucugaggagaaauuaggaaaagaaaguuaguggcaguuggcaugcugccagcugaguuuuuuugcugcuuugagucucaguuuucuuucuuuccuagagucucugaagccacagaucucuuaagaacuuucugucuccaaaccguggcugcucgauaaaucagacagaacaguuaauccucaauuuaagccugaucuaaccccuagaaacagacuuucccaaccucugguaaccaccaugcuacucucugccuccaugaaaucaacuuuuauuuuaagcuuccacgugugagugagaacaucacaggauuucuuucuacuuacuuugaguuuaauugguauuuuuucugacuuuuugaagugaaagucuauauaauuaauuuucagccuuucuccauuucuaauacauauguuuaaacuuauaugauuuuuguaacauuuuaucuucauuguauaaguuuuaacaaguaucuuuugucauuuaauuaaauuucauuaugauuucuuaugugaauaauggauuauuucaaauuauauuuuuuauuuuccaauguaugaggggaucuacuaguuaucuucuuguuaaaaaaauucuggcauauacugucuguucaauauuauaguacuuugaaaauuuuugagacuugcuugcuuuuuaagguuuguagaauaucucuucuauauucuuuuucuuuuauucuuguuuucugguucauauaucuuaacuaauuuuacuguauccuuuaaucccuuuugcccuuuucucuuuuuauucuuuuuuugucucaauacuucaguugguaaauuuucuucuaauucuuuaugccuaccuugcaguuaaauguauucauuuaauuauuaauuucagauauauauuuuuacauagcaaaucucuuuuugacuucuuauuguauucauuuuacuguaaaucauucaaucuuaccuuuuagcuguuugaacauauuaaacauaguaauuuaaaaaucucuauggguaacuccaguauaaguauguguuuguuucuagugugugcuuuuuccucuugguuuucuaucauguuguuucauuuaccuccaaacaugaauguguuuaugaugaaugagagucacugaauauuuaaaaaaucauagagauauuuugaagcuggaagaauguucuuuucauccagacaagauuuauuuuguuucugcuaugcagcuauggacacuagcaauucucauuuaccuuaauucaaucaaggacugagaauacugaaguaugaaauuaacucugucugcuuccaguucauacuucuucccuguaccucuuuucuuaaauuuuuuuuaaaauuuuauuucaacagcauuuggaguauaagugguuuuuuuuuacguggaugaauuauauaguggugaauucugagauuuuagugcauccaucacucaaguaguguacauuguaucuaauauguaguuuuuuuuaaucccuagcuccucuuccauccucuccuuucugagucucuaaaguccaucauaucagucuguaugccuuuguguacucauagcuuagcucccacuuauaagugagagcauaugguuuuugguuuucucuguagcucuuuagaaucccaaacuguagccuaagggaaagguuuccaaggugcucuccuuauugcacuccaaaguaugauuuuuaucucccuaacucuaugaaucuagcaaacacuuugcuuaacuuuucagcaucucaagugccuuuucugaauuugacagauacacgucagaaaugugcucccaaaugccuagcuuaucucucuuuauuaacuucuccaaaucuuugccaauagcuauaugucuuaacugccuuguuugcucuuuagagcuuuguaacacaugcauuuuuauaguuuauucugcuuuucaaguuuuuuucauugaaauaauucuuguaaugaccaauagucuaguaugcugcuguaagacuucuauagcuguuaacuccuuucauauuucaauuucuuuaugugcuguuuuuugcaagaauuccuaggcuccauuuucuaauucauacguuggcaaaugaugaaugugauaugacaaugaugaccucuguuccagccauauacuuuuuuaaagaaaauuuuauuggaacacagucaugcucucuuguuuacauauuaucuaugacuucuuuuguauuacaguggcaaaguugaguaauuguggaagagaccauauggccuacaaaggcuaaaauauuuacuaucuuguucauuaagaaaaaauuugcugacucuuauugagauuuauuuuuccuuuauucaacuuucugaaguuugucaauugauuuaaaaauuuuaaugacuuuuccuuucuaaauuauauauuuuuauaucuaacauuauugugccauuucuauauuuuugcuauauuuuuugccuuaaccaaacaauguguuuuaauugagucagugaauaaagaacucacugaaaguagaaguggaaaccuaagcuauaagcuacuauauuauauaagcuucucaaccuauaauuguuuuuccauuagauauagaacaauggaagugacaacaagauugacauggaaugaugaaaaucaucugcgcaagcugcuuggaaauguuucuuugagucuucucuauaagucuaguguucauggagguagcauugaagauaugguugaaagaugcagccgucagggauguacuauaacaauggcuuacauugauuacaauaugauuguagccuuuaugcuuggaaauuauauuaauuuacaugaaaguucuacagagccaaaugauucccuaugguuuucacuucaaaagaaaaaugacaccacugaaauagaaacuuuacucuuaaauacagcaccaaaaauuauugaugagcaacuggugugucguuuaucgaaaacggauauuuucauuauaugucgagauaauaaaauuuaucuagauaaaaugauaacaagaaacuugaaacuaagguuuuauggccaccgucaguauuuggaaugugaaguuuuucgaguugaagguuuguaaaauuagauaauccuacaucucacauuaugauucuaauccuuguguucgguagguaauaauugaucuacaagagcaaggaaagugaaaggaacaguuagauucaugccauacucuuugauaaauucugaaaugaaacguggggaacauaaggauuaugagguuuuuauccagaacguauaggcugcuuugagcaaagcaaguugagaaauauaugugcagagauagagaugacaaaggagauggggauguggagagagagagaucuuaucaucagagcugcucuguuuugacauaugacccaaagaucagacccuuauaugacccuuagaacuucuagguguaauuaugugagagcuuccagagcaaguuaaugugcagagaggauaauuuuuccuccucuuccucucauguugccaacucugacuccuaacugagcagcucagcccuggguuaugcaagaaaacuccaugucuuauuucaaaaguagacuuggccacauuuaaccaaacaaguuuuaaaaauguauuaugcuauguuuauuuccuauaggaauuaaggauaaccuagacgacauaaagaggauaauuaaagccagagaagaagcucuaggugacuugagauguucuuuaugguauucuuuauuggcuguucugaugcuguauuuaaccacuauauuuuaacaggcacagaaauaggcuucuagcagacaucagagacuauaggcccuaugcagacuugguuucagaaauucguauucuuuugguggguccaguugggucuggaaaguccaguuuuuucaauucagucaagucuauuuuucauggccaugugacuggccaagccguaguggggucugauaucaccagcauaaccgagcggggcaauccuaauauacaauuaaaugcuaaaucaaauggaaaauaggaguaaaauuuugaucagaaccaccuccauugugcuauauuauacagagaagcuuucaaauuuuauggauggaagaagcaguuauauaaagaauacuuuuuaguauuuguauaaaaaacaacaaaaaauuaaaaacccuaugaaaaucuuauuacaauaagucauagacuguucucucccuucugguuugagugauacuacacccuugccagcaccacagauggaaaaauuguaauuaaagugucucugagaaauccuuuucuuugcaaucuucccaaaucguccauauuuuuuuguguauguugaauguauaucugaccaucaaauaaaauacuuucagaauuguucuagaaaauauauaggauauauucuguuaaagauggaaaaaauggaaaaucucugccauuuauguugugugacacuauggggcuagauggggcagaaggagcaggacugugcauggaugacauuccccacaucuuaaaagguuguaugccagacagauaucagguaagauuucuucaauauccaaaacauuucaaaucauuuucuucaguauuuuucauugaauuuuuaaccacauaaggcaauuucaacucccauaaugugguuucaacaucaaucaacacuauucuacuuugaaugaauaagaauucauaugaaaaaguagagugacuauuguucuuuucuguaacauugagaaauaaagccaaaaggcaggauucuacucauuugcauucuaguaaaagaucaaggagauaguguguuuuuaucacucuuuacaauaauguaaacuaaugauagucacuuaaucccuugcacuuuuuggguuacauagacaaaauauuggaacaaguaacuauuuuguguugaaaugucauuuuauacuguaaaugcuuagauuucaccacuaaauaccuagauucaaaauuuggcuuugcuacuaacagauguuuacccguaaguugcacacuucucucucucggucuuuuuuuuuuuuuuuuuuaaauuguauuuaacaaacguuaaugguguuuauuucuggauacuaggauuugaaauuagcuuuucaaaaauauuauuuaaacuuuccugcaauacuuacaauggauaauuaucauuuuuaccaaagcaauaaaguguuuuuuuuccuauaagagagauauaauggcauuaugcucacaguggaaaggaaguaaagaggaggugcuacuguuuggggaaagaguagcugaggagaaagagggagaucaguaguuacaguauuagaagcauuaauugugucuuuaaggguuaaacagaggcucucugauuucugaauguuaccuuauguuuuuauaacaguuuaauucccguaaaccaauuacaccugagcauucuacuuuuaucaccucuccaucucugaaggacaggauucacuguguggcuuaugucuuagacaucaacucuauugacaaucucuacucuaaaauguuggcaaaagugaagcaaguucacaaagaaguauuaaacugugguauagcauauguggccuugcuuacuaaaguggaugauugcagugagguucuucaagacaacuuuuuaaacaugaguagaucuaugacuucucaaagccgggucaugaauguccauaaaaugcuaggcauuccuauuuccaauauuuugaugguuggaaauuaugcuucagauuuggaacuggaccccaugaaggauauucucauccucucugcacugaggcagaugcugcgggcugcagaugauuuuuuagaagauuugccucuugaggaaacuggugcaauugagagagcguuacagcccugcauuugagauaaguugccuugauucugacauuuggcccagccuguacuggugugccgcaaugagagucaaucucuauugacagccugcuucagauuuugcuuuuguucguuuugccuucuguccuuggaacagucauaucucaaguucaaaggccaaaaccugagaagcggugggcuaagauagguccuacugcaaaccaccccuccauauuuccguaccauuuacaauucaguuucugugacaucuuuuuaaaccacuggaggaaaaaugagauauucucuaauuuauucuucuauaacacucuauauagagcuaugugaguacuaaucacauugaauaauaguuauaaaauuauuguauagacaucugcuucuuaaacagauugugaguucuuugagaaacagcguggauuuuacuuaucuguguauucacagagcuuagcacagugccugguaaugagcaagcauacuugccauuacuuuuccuucccacucucuccaacaucacauucacuuuaaauuuuucuguauauagaaaggaaaacuagccugggcaacaugaugaaaccccaucuccacugcaaaaaaaaaaaaaaaaaauaagaaagaacaaaacaaaccccacaaaaauuagcuggguaugauggcacgugccuguagucccaguuacucaggaugauugauugagccuuggagguggaggcuacagugagcugagauugugccacuguacucuagccagggagaaagagugagauccuggcucaaaaaaaccaaauaaaacaaaacaaacaaacgaaaaacagaaaggaagacugaaagagaaugaaaagcuggggagaggaaauaaaaauaaagaaggaagaguguuucauuuauaucugaaugaaaauaugaaugacucuaaguaauugaauuaauuaaaaugagccaacuuuuuuuuaacaauuuacauuuuauuucuaugggaaaaaauaaauauuccucuucuaacaaacccaugcuugauuuucauuaauugaauuccaaaucauccuagccauguguccuuccauuuagguuacuggggcaaaucaguaagaaaguucuuauauuuaugcuccaaauaauucugaaguccucuuacuagcugugaaagcuaguacuauuaagaaagaaaacaaaauucccaaaagauagcuuucacuuuuuuuuuuccuuaaagacuuccuaauucucuucuccaaauucuuagucuucuucaaaauaauaugcuuugguucaauaguuauccacauucugacagucuaauuuaguuuuaaucagaauuauacucaucuuuuggguagucauagauauuaagaaagcaagaguuucuuauguccaguuauggaauauuuccuaaagcaaggcugcaggugaaguugugcucaagugaauguucaggagacacaauucaguggaagaaauuaagucuuuaaaaaagaccuaggaauaggagaaccauggaaauugaggagguaggccuacaaguagauauugggaacaaaauuagagaggcaaccagaaaaaguuauuuuaggcucaccagaguuguucuuauugcacaguaacacaccaauauaccaaaacagcagguauugcaguagagaaagaguuuaauaauugaauggcagaaaaaugaggaagguugaggaaaccucaaaucuaccucccugcugagucuaaguuuaggauuuuuaagagaaaggcagguaaggugcugaaggucuggagcugcugauuuguugggguauagggaaugaaaugaaacauacagagaugaaaacuggaaguuuuuuuuuguuuguuuuguuuuuuuuuuguuguuguuuuuuuuuuuuuuuguuuuuuugcugagucaauuccuuggagggggucuucagacugacuggugucagcagacccaugggauuccaagaucuggaaaacuuuuuagauagaaacuugauguuucuuaacguuacauauauuaucuuauagaaauaacuaagggaaguuagugccuugugaccacaucuaugugacuuuuaggcaguaagaaacuauaaggaaaggagcuaacagucaugcuguaaguagcuacagggaauuggcuuaaagggcaaguugguuaguacuuagcuguguuuuuauucaaagucuacauuuuauguagugguuaauguuugcuguucauuaggaugguuucacaguuaccauacaaauguagaagcaacagguccaaaaaguagggcaugauuuucuccauguaauccagggagaaaacaagccaugaccauuguugguugggagacugaaggugauugaagguucaccaucauccucaccaacuuuugggccauaauucacccaacccuuugguggagccugaaaaaaaucugggcagaauguaggacuucuuuauuuuguuuaaagggguaacacagagugcccuuaugaaggaguuggagauccugcaaggaagagaaggagugaaggagagaucaagagagagaaacaaugaggaacauuucauuugacccaacauccuuuaggagcauaaauguugacacuaaguuaucccuuuugugcuaaaauggacaguauuggcaaaaugauaccacaacuucuuauucucuggcucuauauugcuuuggaaacacuuaaacaucaaauggaguuaaauacauauuugaaauuuagguuaggaaauauuggugaggaggccucaaaaagggggaaacaucuuuugucugggaggauauuuuccauuuuguggauuucccugaucuuuuucuaccacccugagggguggugggaauuaucauuuugcuacauuuuagaggucauccaggauuuuugaaacuuuacauucuuuacgguuaagcaagauguacagcucagucaaagacacuaaauucuucuuagaaaaauagugcuaaggaguauagcagaugaccuauauguguguuggcugggagaauaucaucuuaaagugagagugauguuguggagacaguugaaaugucaaugcuagagccucuguggugugaaugggcacguuagguuguugcauuagaaagugacuguuucugacagaaauuuguagcuuugugcaaacucacccaccaucuaccucaauaaaauauagagaaaagaaaaauagagcaguuugaguucuaugagguaugcaggcccagagagacauaaguauguuccuuuagucuugcuuccugugugccacacugccccuccacaaccauagcugggggcaauuguuuaaagucauuuuguucccgacuagcugccuugcacauuaucuucauuuuccuggaauuugauacagagagcaauuuauagccaauugauagcuuaugcuguuucaauguaaauucgugguaaauaacuuaggaacugccucuucuuuuucuuugaaaaccuacuuauaacuguugcuaauaagaauguguauuguucaggacaacuugucuccauacaguuggguuguaacccucaugcuuggcccaaauaaacucucuacuuauaucaguuuuuccuacacuucuuccuuuuaggucaacaauaccaagagggguuacugugcuggguaauguguaaacuugugucuuguuuagaaagauaaauuuaaagacuaucacauugcuuuuucauaaaacaagacaggucuacaauuaauuuauuuugacgcaaauugauaggggggccaaguaagccccauaugcuuaaugaucagcugaugaauaaucaucuccuagcaacauaacucaaucuaaugcuaagguacccacaagauggcaaggcugaucaaagucgucauggaauccugcaaccaaaagccaugggaauuuggaagcccucaaaucccauuccuaaucugaugagucuauggaccaauuuguggaggacaguagauuaaauagaucugauuuuugccaucaauguaaggaggauaaaaacuugcauaccaauuguacacccuugcaaaaucuuucucugauguuggagaaaaugggccagugagaucauggauauagaaguacagucaauguucagcuguacccucccacaaucccacuuccuuccucaacacaauucaaacaaauagacucagacuguuucaggcuccaggacaggaagugcaguguaggcaaaauugcaaaaauugagggcacagggguggagguggggggguugaauaacaagcugugcuaaauaauuacguguaaauauauuuuuucauuuuuaaaaauugauuucuuuugcacauuccaugacaauauaugucacauuuuuaaaauaaaugcaaagaagcauacauccaa

SEQ ID NO: 573 - RNA, 2805 nt, Homo Sapiens
ucuuugaagcuucaaggcugcugaauaauuuccuucucccauuuugugccugccuagcuauccagacagagcagcuacccucagcucuagcugauacuacagacaguacaacagaucaagaaguauggcagugacaacucguuugacaugguugcacgaaaagauccugcaaaaucauuuuggagggaagcggcuuagccuucucuauaaggguaguguccauggauuccguaauggaguuuugcuugacagauguuguaaucaagggccuacucuaacagugauuuauagugaagaucauauuauuggagcauaugcagaagagaguuaccaggaaggaaaguaugcuuccaucauccuuuuugcacuucaagauacuaaaauuucagaauggaaacuaggacuauguacaccagaaacacuguuuuguugugauguuacaaaauauaacuccccaacuaauuuccagauagauggaagaaauagaaaagugauuauggacuuaaagacaauggaaaaucuuggacuugcucaaaauuguacuaucucuauucaggauuaugaaguuuuucgaugcgaagauucacuggaugaaagaaagauaaaaggggucauugagcucaggaagagcuuacugucugccuugagaacuuaugaaccauauggaucccugguucaacaaauacgaauucugcugcuggguccaauuggagcugggaaguccagcuuuuucaacucagugaggucuguuuuccaagggcauguaacgcaucaggcuuuggugggcacuaauacaacugggauaucugagaagguaagcacauuugaggccaccuagccuuugcuucucuguucaaaucaauuauauuucaaaagccuuuugcagaucaacuuuauuacauauagacuucaucucaauuuauaauaaaaaaugaaucuuuaaaauugcuuuucuccccucuacaguauaggacauacucuauuagagacgggaaagauggcaaauaccugccguuuauucugugugacucacuggggcugagugagaaagaaggcggccugugcagggaugacauauucuauaucuugaacgguaacauucgugauagauaccaguuuaaucccauggaaucaaucaaauuaaaucaucaugacuacauugauuccccaucgcugaaggacagaauucauuguguggcauuuguauuugaugccagcucuauucaauacuucuccucucagaugauaguaaagaucaaaagaauucgaagggaguugguaaacgcuggugugguacauguggcuuugcucacucauguggauagcauggauuugauuacaaaaggugaccuuauagaaauagagagaugugagccugugagguccaagguaaugaaugaugcccuucguaaacacauuuucugggguauguuacuacaaucacauacuaguguguauaaaaauaaaaacaagcagcuacuggguuuaagaagaauuacaaaauuacuuaaauagggcccguuucccaagauuuaaaaauuaaauacaguuguuccuugguauuugcaggggauuaguuccaggacuuugcauuguuaccaaaaucuguggaugcuuaauggcauaguauuuguauuugcauauaaccuaugcacauccuuugguauacuuuaaauaauaucuagauuacuuauaauaccuaacccaaauuaaaugcuuuguaaauaguuguucuacucuauuuuucauuauuaaugacaagaaaauaaccuguacauguucaguacagaugaaauauuuuuucaaaauuuauuuuuuugagaugaaguuucuguugcccaggcuggagugcaguggcaugauuucggcucacugcaaccuccgccuccuggguucaagugauucuccugccucugucucucagcagcugggauuacaggcacaugccaccaugccuggcuaaucuuuucuguauuuuuguagagauuagguuucaccauguuggccaggcuggucucaaacuccugaccucaggugaucugcucaucucggucccccaaaguucugggauuaaggcaugagucccuauacccagccauuuuuuuucaauuuuuuuugagccuuaguugaacucacagaugcagaacccauggauacagaaggcuaacugucuaucuuuacacugacauacaucuugauauugcuuucauaauuuauacuaacauaaaauaauauuuuucacuguuuugcaaugucuuuuuaauuucuguauugcagcuagaggaaguccaaagaaaacuuggauuugcucuuucugacaucucggugguuagcaauuauuccucugagugggagcuggacccuguaaaggauguucuaauucuuucugcucugagacgaaugcuaugggcugcagaugacuucuuagaggauuugccuuuugagcaaauagguagaugguuuggugguguggaagcuuggaagcggucagggaaucuaagggaggaaauuaucaacugugcacaaggaaaaaaauagauaugugaaagguucacguaaauuuccucacaucacagaagauuaaaauucagaaaggagaaaacacagaccaaagagaaguaucuaagaccaaagggauguguuuuauuaaugucuaggaugaagaaaugcauagaacauuguaguacuuguaaauaacuagaaauaacaugauuuagucauaauugugaaaaauaauaauaauuuuucuuggauuuauguucuguaucugugaaaaaauaaauuucuuauaaaacucgggucuaa

SEQ ID NO: 574 - RNA, 1362 nt, Homo Sapiens
auggacggguugaacuuugagaugguggcuggguugagccugcggacccagggaggauacgcccuccucucaccccagggauacaacacuacacuaaccuuuuuuggcuauaacuugugucauguaaacggcaaaaugcuggugaauacugugcuaccuggaauggagauuugcaaggugcuaauggggaaauuaaaauuacagccugaggugggcagaccgugcggcuggagcaagguugaaacuguugaggagcccauggagguagaagaagcagcaaaagaagacaaagaagaaucugaugaugaagcugcaguagaggaagaaaaagaagaaaagaaaucaaagacuaaaaaagaaagugaugaccccauggcuuauauucacuuuaccacugaaggggaaguuaccuucaaaucaauuuuauuuguacccacaucugauccacguggucuauuugaugaauauggaucuaaaaagagugauuacauuaagcuguaugugcucuguguauucaucacagaugaauuccaugauaugaugccuaaguaccuuaauuuugucaagggugugguggacucagaugaucuccccuugaauguuucccuugagacucuucagcaacauaaacugcuuaaggugauuaggaagaagcuuguuuguaaaacucuggacaagaucaagaagauugcuggugagaaauacaaugauaauuuuuggaaagaauuugguaccaacaucaagcuuggugugauugaagaccacuccaaucaaacaugucuugcuaaacuucuuauguuccagucuucucaucauccaacugacauuacuacacuagaccaguauguggaaagaaugaagggaaaacaagacaaaaucuacuucauggcuggguccagcagaaaagaggcugaaucuccuccaucuguugaacgacuucugaaaaagggcugugaaguuauuuaccucacagaaccuguggaugaacacugcauucaggccuuucccaaauuugaugggaagagguuccagaauguugucaaggaaggaaugaaguuugauaaaagugagaaaacuaaggagagucaugaagcaguugagaaagaauuugagccucugcucaauuggaugaaagauaaagcccuuaaggacaaaauugagaaggcuguggugucucagcaccugacagaaucucugugugcuuugguggccagccaguacggacggucuggcaacacggagagaaucaugaaagcacaagcauaccaaacgagcaaggacagcucugcaaauuacuaugcaagucagaagaaaacauuugaaauuaaucccagacacccacugaucagagacaugcuuuga

SEQ ID NO: 575 - RNA, 68 nt, Homo Sapiens
cuucaauuuuauuuuaaaacggugagauuuuguuuugucugagaaaaucucgcuguuuuagacugagg

SEQ ID NO: 576 - RNA, 420 nt, Homo Sapiens
guuuuagggagggagagcggccuggguccuggguguugugugcggagcuguggcgucgcgugugaggcgcgugcagggugagugugaguggacgcgugagugugugagugugcgcgcuuggagcguguuaggcgagugcgugcgcccaccccugcgccccuccucccgcuuacacuuugaucuuauuugaucggaucgugaccccagccccgccgggccgacccgaaaugaaaagcucuccuccugcgaagcccccucggggcgcugugcagcgaggccccuuaggcggcggccacgcugugguccccgaggucccggagcuggcccugcggggcccggcgcucagaagugaugaauugaucagauagacgaggccgggcuuguccccggccacugauuaucgaggcgauucugaucugg

SEQ ID NO: 577 - RNA, 9308 nt, Homo Sapiens
uucuuucucucgguucacacgccacgugugcaacaucggagaugcucauaaaauaaccccuggcccgaaagggcaguagaaaacggaaauuuguuggcuggcuuggaggaugcuuccacuguguucuucacacgagccccgggccugccuguugggccgguugcgcaccccgggcgcgcgcucucccgcgcccacgccgcgcgcaccagcggcggcggcugccauggcgacccgcaggugagcugcagaggcgcgcguggucccugccccacccgcgcggagccagagaggaggcgguugucaaggcgacguggguaggaggagaggacagagggaggaggaaggaugggcgguguuggcguagccgcagggaggugacugaagcgagccuggccucuugcauccuccgccuguguaccucccuccccuuuuuuuccgccuucugccagcagaagcagcagccgcagcaccugagccgcuacugccgcucacucaggacaacgcuauggcugagccugggcacagccaccaucucuccgccagagucaggggaagaacugagaggcgcauaccccggcuguggcggcugcugcucugggcugggaccgccuuccaggugacccagggaacgggaccggagcuucaugccugcaaagaguuucccacguuccucugcuccauaaggacacuacuuaaacauaacaacaaagagagucacacacaaaaaugauuucuagggacuagaccauggcuggguggaagggaaugauccaaaucauuguaguucuuguacucgguucauaaucaucagcucccugcccggggucccagggcccauuucugagaggaugagcaucaguagccauggugcugggaagugggugggaagcuguuaauguuugaucacugcuaaugcacauuucgcccacuguucucuccccugcagucugaguaccacuaugaguacacggcgugugacagcacggguuccagguggagggucgccgugccgcauaccccgggccugugcaccagccugccugaccccaucaagggcaccgagugcuccuucuccugcaacgccggggaguuucuggauaugaaggaccagucauguaagccaugcgcugagggccgcuacucccucggcacaggcauucgguuugaugagugggaugagcugccccauggcuuugccagccucucagccaacauggagcuggaugacagugcugcugaguccaccgggaacuguacuucguccaaguggguuccccggggcgacuacaucgccuccaacacggacgaaugcacagccacacugauguacgccgucaaccugaagcaaucuggcaccguuaacuucgaauacuacuauccagacuccagcaucaucuuugaguuuuucguucagaaugaccagugccagcccaaugcagaugacuccagguggaugaagaccacagagaaaggaugggaauuccacaguguggagcuaaaucgaggcaauaauguccucuauuggagaaccacagccuucucaguauggaccaaaguacccaagccugugcuggugagaaacauugccauaacagggguggccuacacuucagaaugcuuccccugcaaaccuggcacguaugcagacaagcagggcuccucuuucugcaaacuuugcccagccaacucuuauucaaauaaaggagaaacuucuugccaccagugugacccugacaaauacucagagaaaggaucuucuuccuguaacgugcgcccagcuugcacagacaaagauuauuucuacacacacacggccugcgaugccaacggagaguuggggcaucauccccuucuccagcagccaagagagaauggcugugucuugucaguugcaccuuagacucaguucuguggugucugguauucuguaugaccuugugaacauuuauuuucauuuucuuggucucagccaacucacuaauaaaaggcagacaauuaauccugcugcucuucucccuccuguucauaacaugugacugaauguggcugucuuuccucccuucugccccauucucuucccucccugggcucacgccaaggccuucugggucaguaccgugcuugcugccugaaagcccgggugucugccuuggccugaccacugccggggccuuuagaugcugggucagaccaaagccuguguucccgccuugcagcacagccaaggcccagcucagaggaggagcacugaagcgugugcuuucaggagugcgcaugaacaugcauuccccagcuguuccuugcagacuucugcuuugugccucauucccgcacugguucugcucagucuggugauugaguuugucuucugaacaguauuuuaaaaucaagggacacaccucgagcuggcuccuaugauuacauuucugaccuuggcugugccucaguuguuucucagggaccaggauggcccauccauuggggucagugaaugugcugcuccaagagcuggcccgagacaguuugccagcuccuaggacucuccucucccugagacucacaggaggcaggugagguucaagccuggggcucuggcugucgcagcccuccgcagggaagagggccgagcugagcaggggaaggaggagcccagggcuccccaucaguuaaggcagucugugucccuccuuaaggacuuguuucuuaucuugaaaaauauggacagaggccuuauucauccuucuuuucauauguaugguaucugcacagaucauguucaucaaccccucaguucaaccuauaagggcacguuuuugucugugacucgaucugagggccacaugggaagaauggagcugcccaccuucaccccugacucagccggggucuccugcgggucaucuccacuucuguacccaaugcaggggccauguuucauucaucucugagacaccagauugaacacaaccaugacucaggcacugggcuaggugcuugggauacauccgugagccacacaaaguuccccaccccagaggagcucuuaccuggcccagaaucuggaucucugcccccagccccuauccucaagguagagucccaaagauguccuaaaucucacacaggcugaguugugcuuaauccauuucugcagacacaacucauguacaaaugggccaagccgaaaaucuguagcgaggaccuugagggggcagugaagcugccugccucuggugugaagacccacugcccacccugcaacccaggcuucuucaaaaccaacaacagcaccugccagcccugcccauaugguuccuacuccaauggcucagacuguacccgcugcccugcagggacugaaccugcugugggauuugaauacaaaugguggaacacgcugcccacaaacauggaaacgaccguucucagugggaucaacuucgaguacaagggcaugacaggcugggagguggcuggugaucacauuuacacagcugcuggagccucagacaaugacuucaugauucucacucugguugugccaggauuuagaccuccgcagucggugauggcagacacagagaauaaagagguggccagaaucacauuugucuuugagacccucuguucugugaacugugagcucuacuucauggugguacguuuuccuuucuuugcccgcuagagggccuccaggggaggguuagccccaucugccccauugguguguccacgugacugacacccccccuuguagugauuccacagaggaaaggcccagacugaccagcagggacuucacaguuuaacaagggucucaccaaccgugauggcaccugggauggcagccacaugggcacccacuuccccucuggccaucgcacccgcuucacuugucuguccuggguucagggugugaauucuaggaccaacacuccuguggagacguggaaagguuccaaaggcaaacaguccuauaccuacaucauugaggagaacacuaccacgagcuucaccugggccuuccagaggaccacuuuucaugaggcaagcaggaaguacaccaaugacguugccaagaucuacuccaucaaugucaccaauguuaugaaugguguggccuccuacugccgucccugugcccuagaagccucugaugugggcuccuccugcaccucuuguccugcugguuacuauauugaccgagauucaggaaccugccacuccugccccacuaacacaauucugaaagcccaccagccuuaugguguccaggccugugugcccugugguccagggaccaagaacaacaagauccacucucugugcuacaacgauugcaccuucucacgcaacacuccgaccaggacuuucaacuacaacuucuccgcuuuggcaaacacugucacucuugcuggagggccaagcuucacuuccaaagggcugaaauacuuccaucacuuuacccucagucucuguggaaaccaggguaggaaaaugucugugugcaccgacaaugucacugaccuccggauuccugagggugagucaggguucuccaaaucuaucacagccuacgucugccaggcagucaucauccccccagaggugacaggcuacaaggccgggguuuccucacagccugucagccuugcugaucgacuuauuggggugacaacagauaugacucuggauggaaucaccuccccagcugaacuuuuccaccuggaguccuugggaauaccggacgugaucuucuuuuauagguccaaugaugugacccaguccugcaguucugggagaucaaccaccauccgcgucaggugcaguccacagaaaacugucccuggaaguuugcugcugccaggaacgugcucggaugggaccugugauggcugcaacuuccacuuccugugggagagcgcggcugcuugcccgcucugcucaguggcugacuaccaugcuaucgucagcagcuguguggcugggauccagaagacuacuuacguguggcgagaacccaagcuaugcucugguggcauuucucugccugagcagagagucaccaucugcaaaaccauagauuucuggcugaaagugggcaucucugcaggcaccuguacugccauccugcucaccgucuugaccugcuacuuuuggaaaaagaaucaaaaacuagaguacaaguacuccaagcuggugaugaaugcuacucucaaggacugugaccugccagcagcugacagcugcgccaucauggaaggcgaggauguagaggacgaccucaucuuuaccagcaagaagucacucuuugggaagaucaaaucauuuaccuccaaggugucuggguccaguccuuugggagcugaaucauaguucagucucagcuguuccccacugagcaauucugagcugggagggcuggcuuuguguggguggcagccagcuccugucaccaucucucuuucagaggacuccugauggauuugacucagugccgcugaagacauccucaggaggccuagacauggaccugugagaggcacugccugccucaccugccuccucaccuugcauagcaccuuugcaagccugcggcgauuugggugccagcauccugcaacacccacugcuggaaaucucuucauuguggccuuaucagauguuugaauuucagaucuuuuuuuauagaguacccaaacccuccuuucugcuugccucaaaccugccaaauauacccacacuuuguuuguaaauuaugcccuugcuuguaucuuguuucccaaaauggcccauccgccagagccauagcuucgucugcucauaauucuuauagcuuuggaaugaaaauauuucuaucuucuuaaguauagaaacuauuuccucuguccucuaacuuaagggcagaaacagcugggaguuuuccucgcaugcccucagcucaugaucucuucaggagagaggcugggugaggagggugucgggguucccugguggauaaucuucauagcagccuggauccauuuccccuggauaaccagcucaaagggagugaaaaugguagucugagggcaaggggagcaaggccuggguaagaaaagccuugaaaagcauaaaaagaggccgggcgcgguggcucacgccuguaaucccagcacuuugggaggccgaggcgggcagaucaugaggucgggagauugagaccauccuggcuaacacggugaaaccccgucucuacuaaaaauacaaaaaauuagccgggcgugguggcgggugccuguagucccagcuacucgggaggcugaggcgggagaauagcgugaaccuggaaggcggagcuugcagugagccgagaucgcgccacugcacuccauccagccugggugacagagugagacucugccucaaaaaaaaaaaaaaaaaaaaagaaaagcacaaagagaggcaacaaggaauguuuuuguuuuugagacaggcucucacucugucaccuaggcuggagugcaguggcauaaucacuguucagugcagccucaagcucuugggcucaagcuauccucccaucucaaccucucaaguagcuaggacuacaagugugcaccaccaggcucacuaauuuuuauauuuuuuguagacacaggguuucaccauguugcccaggcuggucuccaacuccugggcucaagugaucuguccgccucagccucccaaacugcugggauuacaggcauaagccacugcacucagccuuuuauuuguuuuuuaaaccacguagcucauugccuucucuuaaguaaaugauagauauucucacugaagccaaaggaauaaguucaucaagaaaaugcccaaagcccugguggauacauccucccuaucuuuuuuuuaaaccuuccacuaucacucuaugacacugaaaagaaccagguaagccccaaacccagauguuccagccuuauccucuguuggguuuacccacagacauagcaaacccugucagugaggaaaauuccccauccuugagugcccccguccuagaaguuugggccauauuauggaacaggggucucuuauuugaaaagagcacaaggaggccaagauuuuaauggggcacuuuaggggauacagcccacaauggcaugggccugagguggccgugaugucugcuucuaagcuuaacgcaucugcucaggcacagaauaaacgucuaggcuggccaaaaaaggaacugaaucccaggcccauacgccagcaccagaaucaaaccagucuucaaggaaggaaggcuaggagaguuuaacaagauuuucacugggcccagcaugguggcucacaccuguaaucccaaggcagaaugguggcuugagcucaggaguucaagaccagccugggcaacacagugagacccugucucuaaaaaauuuaaaaauaaacaagguguucaccaagcugggauacuucucacuauuaagccccuaucuuucucuuuuuuucauucucaauugcuuugugugauaaaaaacuaaagagacuucugguccaauuucuggcaacaucccuucugaaaggugaguagagugggugucuucuaugcccauuuuccccaauuuuacacaaacuauuaucaaugaacuuuuaaguaccuagaauggguaaaaccagagcaagacuuuaaauuaccuucuucuuucuucuacuggcaguucugccuccaucacuaucaggcuagggugaccuucccuuggucaagccccaauugcccaugauuugugccugugcccuuucuccagugaccauuuggugaccagaugguagauauagaaaggggauggcauuugcaagugacuagucugccacaaaaugcucaucugauuagccacugcugcccuggcaauggcuuuguaagagucaaugagaacuagagccaggcuguggucccuggccaucaacaguguuggugacggcagggagucccuuugguuuaauaaauccaguuuuucuuuggguauccaaauucuccccuccuuuuguaggagucaggcucucagaaccuguguccauguuggaacuucccccaguguggaugcagauacgcagcuccugagcuccagccuaaagucuucuguagccucagcaauacuugggcaccugcugucucacugaauagcuuucuuuugugacaaaggccacagacagcccuuagacuauuccggaaacaguaggaaaaauuacauaugucuuugacuucuuuauucugacuccacugauuuuagccauaauacuuuaaggagcuacuuuuuacuaccccuuaccgugcugacuucugcaggucugcccugugaccugucaggaacuccugaguuacgcuacuggggucaccuguugcuccccuagcaaguuaggcaugucauauauuuuuaacagcuuuauugagauauaauucacauauuacacaauucaccuuuaaaacauacgauucaaugguuuucagcaaacucacagaguuguccgcccacuugagagcaaacacauguucaauuuucuuuuccuuuuuuuuuuugagacagagucagcuuuguugcccaggcuggagugcagugccaugaucuuggcucacugcagccuccccauccuggguucaagugauccuucugcuucagccuccccaguagcugggauuacaagcaugcgccaccacgccuagcuaauuuuuguguuuuuaguagagaugggguuucaccauguuggccaggcuggucucaaacuccuggacucaagugauccacccaccucggccucccaaagugcugggauuacagguguaagccaccgugccuggccuacauguucaauuuucuaugaacaaaggcuuuaguccuugacccagggcuaaaguggucuguccaagcuguuguugguagagggaguaugauaaaauguuuaaaucucauuugguuaccuugaguccuggaacaugcaguaacugucaugcuauagacaucaucuguauuuggcugggaauacaaaugaagauugugguguauucaagcaguaggguuuuugcuuuuguuuuuguuuuagugccaacaaaacuuuuuuuugucugacuacauuaaagauaagacugacuauauuuauacaacagaaacuuuguaauagauuuuuucagcuuugugaaaucgaauuuuuuuucaucagggcugguuggauuuccuuuuuacccuguaauccaagcguuaauaguuuguuagaagauggguuauugcaugucacuuuuuuuuuuuguaaaauaaaaacauaccuuacaa

SEQ ID NO: 578 - RNA, 4216 nt, Homo Sapiens
uauaugugaagugggcgguuguaaaguuagcuuucucuucauuuagcugucacuggacagaaaaauaugagcugugggcagaugccccuggaugagagccaguagccagucucuggccucucugugcccuccccuaggagcccccgaccccgccauggguccccuccuggccucugccagccucucccacucuugcuucauugaccucuggcucaccuuuauuuuuucuccugucucuucccacuucugguuucuuuguuuggguuuaucacagauccuuuccucuucccuccuuucauauuucuaagcccucucaagagagaagaaucauauuuuuccucaaccaucgcucuaucucuggcacccagcacauugccaggcugaguuggcacucaaaaauguuuguagaacaaacuacucucucuauacaucuuucugacuugguggggaagaagguccaaaacuuugcugaugacuccuuggaugaagaaacuucucauacaguggugugagcccuggagucagaaugguuggcuugagccccaauuucauuacugccuggccaggugaaggagauucuguucaucaguggcagccagggaugucucuccuuccuacccugacucuccucuuucugcuggguccccucccggauacagggcucacaccuguggaccucagagccagcgucaagaccaagaggaaagaaaucaccaaaagccagacccuuguauagagggaaggggaaggaagggagggaagacagacuccucuggggauacaugcgacugucuuggcugggaaaucugaucuggugggggacucacccccuccucucgaaucagcucagcccugaugugucuuugugggcuuggguuucucugugccugaaagaugaggcgugggguggggguggccgggcugcugguugaggcugaauucuucugagcaaugugguuguguuuacugggagggugggagggccagaccuuuuuccugccuuccaggcuucggagauaaggcagaaagugaggaugaaggauagaauggguaauacucugaaaccacaagaaagaguucuggcuuuugucucugccccacagcucagacauuuccuggggcaucuggaaggaagcugacccacucccaccacccuggggucccagcccauggggagcacagaaccucagugggcaccccuuucuuccauucuaccuccuuuccauugucaguuuagccacaaaauuauuuuagcuuuuuuacugccagucccacccucaguuuucccugccacaugagcccagcccuagagcugagcuuuucucccugccucccagcacagccaaagccacagagacccuaggcaggugacagagcccagccuggcaugcaucggccuugagggcucugcugcaggaccaccuuccccuuccuugcuggccucucaggggucguggccagccugcauccuggacacagaccagccccaaagcaaccagugccaagcccuggggauagacagucaccugguauaaaaaacaccaccaccuuuauuagaaugcugggcagccuuuuuuuucucucucucuccuuuuuuuuuuuuuuaaacaaaaaaaacacaaaagugucuguacaaaaauggggaucaggaucucagucuguagaaaucuguuuuauucuuaccaacauccaauaucauuuccauggcauagcucugggcuggucccguggaagagauuccaaauauguggugauuucugguggaauuucugcccccuuggaggggaagaugacugcauggcaugcugggagugcaggcacauggcaggagugaggguggcuggagcugaggagccagugugccucagucuaugcugaccuuggccuuuacacccuccuuagugucagacaccagugcgcccccugcugguggggaggggaagcagggcugacuccaccccaucaugggagacucccuuuugguuuccaucucaucaugaagagcuucaguccacgcggcguucuccucccauuuuccuggguucccugaacgaugagccaaguaagcugucuuagcuggagagaugacaauggacuuggacaaagucuggaggaagcagggcagugucucccugccuccagcccagaguucaggugaggggacucaguuugugguaggaagaguccuggcugcuucgaagccccuucuccuaggcagccccaccuuguucuaagagaaaagacccuguaacguguucccugcugggggcugacagugccagcugcucucgcagccuccagaaccaucuggggcuuggaggcagaggugggcugggagcgacugggaauggaaaaagaggugggcagcucauucugcagguccaugcaaccgaucacgugguccaguucagaaggccggguggcuccuugggcuuuacccugagcgagacgaggcuuggagacuuauagucaccaucugaggaaggcucaaagcuguggccccccaggguggggggaaagccauggauggaguagaugccagggugagccgcagaaggggcuggcacccccaugaagccagccacacucccaugggggugggaauauggagacaugcauggggaggggaugcccucuggagacacaaggcaggggccuccagggcucccagauccuggacuggcccacagggaguucugcagcugaaaagagagggaaagaaggcccaugagccuguagccucaggagcugacuucccuacccaggggcuuucucuuuguccuuggggccccagaaacuuuccaggaaaccuccacuuggcucagaucuacccccucucacccccaacacuggcaguggcaucucaggaggccccugccacuguucucaaaacgaaauuuucuucugugauuccuuuguguuccgcaugcgucauucaugagacaggcaagagccccgguuugcagagaaagaagugaagugguguacccacugucauacagaacgcugacgcucuccagguuucuucaggccagaccucauauucuuuuuggugacccugccagguccugguucagguagggcuggggucuuaccugaggguggcugucaguacggggcagcacagagaugucauaggcagccgugaagggguuccgccccuccuggaucuucccauaacgcucgcgcuuccgccacuuggcucugcgguucuggaaccagaccugggggcagguuguggggguuugagggggugauagggcagcccugaggaaaggagccugcuagggagagcugaugguuguguccucuugugggauggggagcaggcuccaggauggaggaucucaacuguuaauccacacuguucuccaggccagggaagccugggaggaagccugggagaggcccaagcccacaguggguaauuggccccaugggccuccagcugucacuccccagguugaaucacugugguccuccagccuggcugugucuaguaaggguguugugggggcaucugugggccucaggggcccuagguacuuccuggguauacuguguacauguguuggguuucuagucucccugccucaucuccuuuuccaggcuacccaccucauagcauccgaggaaucuuagacauuucuguucaggucaugguccuguuuaaacccucagugacucccuggagaccuugguccagagcauagcuucuuaacaaggccccugccucucugcacagccucauauccugccaggcaaacacauuuauucuucugguugccucccaagcucccgcccagcucuucugaaacacugcuaucuugcuccuuccaucuuuugcuuagguuuucucuuccugggcuacucauccccucaacacauacauccacacugggcauccuccacaggacuuccaaaauacccuggaccucucuuuguacucaccccauuccauuaccaugaucuguuuuggaaucuguuucucccauuuauuugugagcccuuggcagauagggguggcacaucuguguguugugcacaucuguguacauaucugugaugaauucguuguuugguauaugugcugugacuguuacauuuaacuguauugguauauauguuuuguauuucuaucauuuaaucaacauuuaugugucagccucuaagcuaaauuuaacaaugucaaaauaaaaccaaccaaacaaaacaa

SEQ ID NO: 579 - RNA, 3781 nt, Homo Sapiens
agcauuugucacucaaccucugaauguuagugacacuauugggacgaaaaaggacugugcuggcccaaauggcaggcaucucauauguggcaucuuucuuucuccuucugacuaagcucagcauuggccagagagaaguaacaguucagaaaggaccacuguuuagagcugaagguuacccagucagcauuggcugcaauguaacuggccaccagggaccuucugagcagcauuuccaguggucuguuuaccugccgacaaacccgacccaggaaguccagaucauuagcaccaaggaugcugccuucucuuacgcaguauauacgcagcgggugcgaagcggagacgucuacguggagaggguccagggcaacucagucuuguugcacaucucaaaacuccagaugaaggaugcuggcgaguaugagugucacacaccaaacacugaugagaaauacuauggaaguuacagugcaaagacuaaucuaauuguuauuccagauacccucucugccaccaugaguucucagacucucgguaaggaggaaggugagccauuagcccucaccugugaggcauccaaagccacagcccaacauacucaccucucugucaccugguaccuaacacaggauggaggaggaagccaagccacugagauuauuucucucuccaaagauuuuauauuggucccugggcccuuguauacagagcgguuugcagccagugacguacagcucaacaaacugggacccacuacauucaggcuguccauagagaggcuccaguccucagaucagggucagcuguucugugaggcaacggaauggauucaggauccagaugaaacuuggauguucaucaccaaaaagcagaccgaucaaaccacucugaggauccagccagcagugaaagauuuucaagucaacauuacagcugacagcuuguuugcugaagggaaacccuuagaacugguuugccugguuguaagcaguggccgugacccacagcuucaaggcauuugguucuucaaugggacugaaauugcucacauugaugcugguggaguccugggccugaagaaugacuacaaagagagagcaagucaaggagagcuccagguuucaaaguuaggccccaaggcuuucucucucaagaucuucucucugggcccagaggaugaaggcgccuacagaugugugguagcagaggucaugaaaacacgcacagguuccuggcaggugcuucagagaaagcagucaccagacagccacgugcaccugaggaagccagcagcaagaaguguggucaugucuaccaagaacaagcagcaaguugugugggaaggagagacacucgccuuucucuguaaggcugguggagcugaaaguccccugucugugagcugguggcacaucccacgggaccagacacagcccgaguuuguggcuggcauggggcaggauggcauugugcagcugggugccuccuaugggguacccaguuaccauggcaacacaaggcuggagaaaauggacugggccaccuuccagcuggagaucaccuucacugccaucacagacaguggcacauaugagugcagaguaucugagaagucucggaaccaggccagagaucugagcuggacucagaagauuucaguuacuguaaagucucuggagucaaguuuacaaguuagucugaugagccgucagccgcaagugauguuaaccaacaccuuugaccuguccugugucgugagggccgguuacucugaccucaaggugccacucacugugacguggcaguuccagccagcuagcucucacaucuuccaccagcuuauucgaaucacccacaauggcacuauugaaugggggaauuuccuaucccgguuccaaaagaagacgaaagugucgcagucuuuauuucguucacaacuccuaguccaugaugccacugaggaagagacaggaguguaucagugugaaguagaaguuuaugacagaaauucccuauacaacaaccgccccccgagggcuucugccaucucucacccacugaggauagccgucacuuuaccagagagcaagcuaaaagugaauucaaggagucaaguccaagagcucuccaucaacuccaacacugauauagaauguagcaucuugucccgguccaauggaaaccuucaguuagccauuauuugguauuuuucuccuguuuccacuaaugccucuuggcuaaagauccuggagauggaccaaaccaauguuauaaaaacuggggaugaguuucacaccccacagagaaaacaaaaauuucauacugagaagguuucccaagacuuauuucagcugcacauucugaauguggaagacagcgaucggggcaaauaucacugugcuguggaggaauggcuccugucuacaaauggcacuuggcacaagcuuggagaaaagaagucaggacuaacagaauugaaacucaagcccacaggaaguaagguacgugucuccaaaguguacuggaccgaaaaugugacugagcacagagaaguggccauccgcugcagccuggagaguguaggcagcucagccacucuguacucugugaugugguacuggaacagagaaaacucuggaaguaaauugcuggugcacuugcaacaugauggcuugcuggaguauggggaagaggggcucaggaggcaccugcacuguuaccguucauccucuacagacuuuguccugaagcuucaucagguggagauggaggaugcaggaauguacugguguaggguggcagaguggcagcuccauggacacccaagcaaguggauuaaucaagcauccgaugagucacagcggauggugcucacggugcugccuucagaucuuuugcccaugugguugcagucaauccaauuuaauucagaucagcaaaaguuacugagcacaugugcuaggcacuguaggggauauagaaacaaauggcacuaucagacauacucaaguaacuauagugaacaaaggagacgaguaaaagggaauuaaagaggccuaaacaaagggcugagugagaacgggauggaagagaagaacugugccugcagcaagagcccacgcuuccuuccaggaucugcuccucggccccuuuacucuauuuccuguucaucugucccuucguccugcuccuccuucugcucaucucccuccucugcuuauacuggaaggccaggaaguugucaacacugcguuccaacacacggaaagaaaaagcucucuggguggacuugaaagaggcuggaggugugaccacaaauaggagggaagacgaggaggaagaugaaggcaacugaaucccaagaggcaccugcagccaggaaggaaagcuuguuuuacagcuuccugccuugcugccuguuucuucccaagccccguguggaauguggugaccuagucaccuggaaccagcuccugacagaccccggcaacuucuagaugaacccaagugaacuuuccucauuaccauccugaagucacuaccccagggggagcuauagcuucaugaccguaacaugugaccugugugcuggcaggacgacucacugcggcugcgccacugggaccccuccccuacaugcaccaaugcacucucuccccucuccaucaccccauaaaacccuccugucacuuuccuucagagacaccgcuuuggagaguauucccagcgcucuccuugcuugugacaaguaaaaaaaaaaaaaaacuccuuuucauca

SEQ ID NO: 580 - RNA, 311 nt, Homo Sapiens
ugaugaagugccagauaggaugggaauggaagauaucguggaagccaacuaugaguuugcaagcuuugccuucuugaggauggaggaucgcuguagaggaggaaacaaagcuggagggucacauaccagcucuucaauccuuggccuagaauucacaccugcuauucccacucccaggccauuggccagaagaacuagucacagagccaugccuguauuuaagcaacagcgaaauguuaagcauguggggagcaguauaugccuccgccacccuggcugagagugugugucaauaaaccuucuuggauaaa

SEQ ID NO: 581 - RNA, 3316 nt, Homo Sapiens
gacggggauccggaaggcguugucggugacaucacggagagggcgauuucuauguagaugaggcagcgcaggggcugcugcuuugccacgaaagaguucccgugccgugggagcaagucugggaccgcuggucggaccggagagucgcagcuguguguuagggcuaggauggcuccgggaugcgcgugacgcaagugaccuugcguguaaaggcauggcaguaucugccaccacuuguuuugguccaagggcagaaaucaguauccuggaaaccaaucaguacuugcgcucugaacuggaaaagugcaaacagaacuuccaagaccucacagagaaauuccugacauccaaagcuacugccuacucccugaccaaucaccugcagaaauauagauacaugaucccuuaauucaggcucaggcugaagaacugacccacuuacgacagaagacacaggaagggagaggugucugcuaccuuuuuacccagcaugugaagaacacagucaagucuuuugagggccuucucaggaacacugacauugccuacuaccagagacagagauucugugagcaaaugguacaaggaagccagcugacagagauccuugucagaaaacuugccacagaaucuugcucucuuacccaagcuggagugcagugacacggucuuggcugacugcaaucugugccuccugggcucaagcaaucuucccaccucagccucccaaguagcugggacuacaggugugugccaccacaccuggcuaauguuuguauuuuuuguagagauaggguuucuccauguuguccaggcuugucuugaacuacugagcugaaguaauccaccugcuuuggacucccaaagugcugggauuacagauaugagccacugugccuggccugagaguucuuaguuucaaucaguaagagaagagacgggguuucaccacauuggccaggccgaucucaaacuccugaccucaugugacccacauuggccuggcaaagugcugggauuacaagcaugagccaccacacuggccuagcuucuuuaauacaagaaucacccccaauucucaccaacaaacugagaagaaaaaaaaaagaauuacccccaagaacaucugaggaagcacaacagggacagacuugaagguaccugggcaguccucugguuuuggaguagagaaaaucacaacgguaagaaaaaugaagacaggcaaaagccacuggcuccuaggcacacucuacucccggucaaaaguggauuguauauguccucuuugaugugauggucccuuugguuuuggugccucuuccaugagcuucagaucagaacuagcuaugugguuccaggcugccuugguuucaucccuugucuugccuacuucaccuggcucaggagggacaucaaggaggaagaaauggauaaaguccuggagggacuucaaacaguauuugacccauuccagccgccaugacucccaccagcuucgcagcagcaaugccuuccucuuugaugcacaggaagaccccucugcucuggauauagccaaagaugagauccagagacagcgguagcaccugaaggaaacccuuuucaucaacaacugccugugagaaaagcuggaaugucaucucagcagcuuugaugaagaaaauggugggagaggcccaagucagugcuucuggcaauauguauuuuucuaaagcaugcaccucuaaacucuacaggcacaucauagauuccaucguccagcuguauaaugaaaacagaguucucagagaacaccggagacucccccgacuugccuguaucaaguuucuagagguaagcggugaaaauccacaauaugaagucacucucagacgggucccuucucuugucacacuccacuguagaaacaaaagaggacggggaagccagagcugcucaaaaccuuauaacccacaauugucauaguuauucucaacuuacacagggcugcuuucuagacgcacccccuccaggcccccagacugccaggcuccaggaauaaguagcucugagaaauauaguuuuucgguggaagccacacuccacuauugcaaauuggagaagagaaggacaaacuuaaaaggugaaaagauuuaagagaacaacauggugaaaccccaucucuacuaaaaauacaaaaauuagcuaggcguggugacaugcaccuguagucccagcuacucaggaggcugaggcaggagaaucauuucaaccugggaggcggagguugcagugacccaagauugcuccacugcacucuagccugggugacagagcaagacucccucucaagaaaaaaagaagaaagaaagaaagaagaaagaaaacaauuguuuuaguugaauacauuuugucaagauuaaaucaacuuuccccuaggguacugauagaauaagcaaucauaauuuagauucuaacuuacuggucuuugagaaauugugaaaacaaaaaaggugccauaagccaaaaaaggagcaaaaguccuaauuguaacaacugauguuggaacuaugaaaagcucuucucuacuuuuaacaaagcuuagucacaaacaguuccccaguugacgagaacaacuaaaacaacagaacaauugaaaguccaaauuugaaagcuccaucuccgagaagcaaauuuuacagccacuccagauuuguauuccaaauggauaguuugauuauaaaaaucacaucccuucagccugcaaagcugaagaggaggaaauacaggauguauuggucuugcuguucagggugguagaggaggaagaaaaucccagucgucuuugaaauucacagagaauaugaaaagcagguuguccuguacaguaucugcaaucaguuacgauacagaaauaacuuaaacaugucaagaaagaugaaugcagauacuaugaggaagugcuaaaguacagccaagaucaucucaugcuguacccuuaccaucuaucggauauuauggugaagggcuugagcauaacaccauuuucauauuauacugggauuauggagaauauuaugaacagugagaaaaguuaugauucauugcccaauuuuacugcugcugacugucuaaggcuucucggcauaggaagaaaccaguauauugaucuuaugaaucaguguagaucaucaaaaaaauucuucagaaggaaaacagcccaugaucuucuaccaauaaagccaguggaaauugccauagaggcguaguggguggugcaggcuggauauaucacauaagaugacaucaagauacgcacuuugccugagaaaugugc

SEQ ID NO: 582 - RNA, 2099 nt, Homo Sapiens
aaacuaaaucaaacuugaguaugaaacuucuuuuuuuuuaagugccuaaguccugaaugacaacaaaagacugaagaacugacaacgauuagaggacacuaaggagacuuaacaacuaaaugcaaaaugggacccugaaucugauccuggaacacaaaaacuaaauuaguagaaaagugguaaaauagguggucgcgcgcccgaccgccgcagucccagucgagccgcgacccuuccggcugcccccaccccaccucgccgccaugugccuccgccgcccagcgcuguucccgggcguggcgcugcuucucgccgcggcccgccucgcggcugccuccgacgugcuaggacucagggacgacaacuuggagagucgcaucuccgacacgggcucugcgggccucaugcucgucgaguucuucgcccccugguguggacacugcaagagacuugcuccugaguaugaagcugcagcuaccagauuaaaaggaauagucccauuagcaaaggcugauugcacugccaacacuaacaccuguaauaaauauggagucaguggauauccaacccugaauauguuuagagauggugaagaagcaggugcuuaugauggaccuaggacugcugauggaauugucagccaccugaagaagcaggcaggcccagcuucagugccucucaggacugaggaagaauuuaagaaauucauuagugauaaagaugccucuauaguagguuuuuucgaugauucauucagugaagcucacuccgaguuccuaaaagcagccagcaacuugagggauaacuaccgauuugcacauacgaauguugagucucuggugaacgaguaugaugauaacggagaugguaucaucuuauuucguccuucacaucucacuaacaaguuggaggacaagacuguggcauauacagugcaaaaaaugaccaguggcaaaauuaaaaaguuuauccaggaaaacauuuuugguaucugcccucacaugacagaagacaauaaagauuugauacagggcaaggacuuacuuauugcuuacuaugauguggacuaugaaaagaaugcuaaagguuccaacuacuggagaaacaggguaaugaugguggcaaagaaauuccuggaugcugggcacaaacucaacuuugcuguagcuagccgcaaaaccuuuagccaugaacuuucugauuuuggcuuggagagcacugcuggagagauuccuguuguugcuaucagaacugcuaaaggagagaaguuugucaugcaggaggauuucucgcgugaugggaaugcucuggagagguuccugcaggauuacuuugauggcaaucugaagagauaccugaagucugaaccuaucccagagagcaaugaugggccugugaagguagugguagcagagaauuuugaugaaauagugaauaaugaaaauaaagaugugcugauugaauuuuaugccccuugguguggucacuguaagaaccuggagcccaaguauaaagaacuuggcgagaagcucagcaaagaccugaauaucgucauagccaagauggaugccacagccaaugaugugccuucuccauaugaagucagaguuuuccuaccauauacuucucuccagccaacaagaagcuaaauccaaagaaauaugaagguggccaugaauuaagugauuuuauuagcuaucuacaacgagaagcuacaaaccccccuguaauucaagaagaaaaacccaagaagaagaaggcacaggaggaucucuaaagcaguaggcaaacaccacuuuguaaaaggacucuuccaccagagaugggaaaaccacuggggaggacuaggacccauaugggaauuauuacgucucagggccgagaggacagaauggauauaaucugaauccuguuaaauuuucucuaagccauuucuuagcugcacuguuauggaaauaccaggaccaguuuauguuugugguuuugggaaaaauuauuuguguugggggaaauguugugggagucggguugaguuggggguauuuucuaauuuuuuugugcauuuggaacagugacaauaaauaagaccccuuuaaacu

SEQ ID NO: 583 - RNA, 590 nt, Homo Sapiens
cacacggaugcggaaaccgagacgggcuggauggaaaacucuuuccagacagacuccggggcccucaacuggucuccgaccuuccccugcaaccugcgacaccugccauuuucccaucuuaggcuccagaagcagaaucaagugggaugucuuggaagaaaaacaaacaaaaggcccacuagguggagugaaauggaucaggagcaauuauguucaauuucaccuuuaaguuuucucaaaaggaggagcauuaagaaucagccaccuuaguacauacuuaaagaauuauccucagacuuuccaguuuuaaucuucuagauuuacugaaaccugauccuguccccgcugaugaaacaucagaggaaugggauccuguaggugaagaucaucagcuuauaaaauccuguugccaucaauggggguagcaggaaaaugaugaagauugguuaaggggccaguggacucagcauugaaaugaaucauggacuugaagccaaaagacucaguuugugucccagcucucucaagcaaagcccccaagucccaguuuccucaucuauaaaaaauaauaaaaauacuuaauggacaaa

SEQ ID NO: 584 - RNA, 536 nt, Homo Sapiens
cccaaagugucaaaguugguaaauggcagagcuggaauucaaagagucugauuccaaagucuauauaguccggcgugaucauuaaaggaauuccuuguguucaaagagcagugcuugaaaaccaagcucauuugugccugcagaaaugccagccucugggguagaagaaaugucauacuuugaucaucuuccacacugcucugggcauacuccgucacaaacuacguugugugaaucugaggacugcuuuagaaaugaguucccaaauugcucaagaaauaguucaggcuguaauucugaaaagccuucugcucacucagguccagugaucaccucugaggagugagauuagagcagcgaagagacuuucaauucuuacuuuauacacuucuguauuguuugaaccugaaggacuugaaagagaaccaaaaggagggguagcauucccagcagcuagcacuuucauccaaugccagggcuuucauuggccaaauuauuuucaaagauacugccugaccgaagcacuucugcaauaa

SEQ ID NO: 585 - RNA, 1338 nt, Homo Sapiens
aauaucuugcauguuacagauuucacugcucccaccagcuuggagacaacaugugguucuugacaacucugcuccuuuggguuccaguugaugggcaaguggacaccacaaaggcagugaucacuuugcagccuccaugggucagcguguuccaagaggaaaccguaaccuugcacugugaggugcuccaucugccugggagcagcuccacacagugguuucucaauggcacagccacucagaccucgacccccagcuacagaaucaccucugccagugucaaugacaguggugaauacaggugccagagaggucucucagggcgaagugaccccauacagcuggaaauccacagaggcuggccacuacugcaggucuccagcagagucuucacggaaggagaaccucuggccuugaggugucaugcguggaaggauaagcugguguacaaugugcuuuacuaucgaaauggcaaagccuuuaaguuuuuccacuggaauucuaaccucaccauucugaaaaccaacauaagucacaauggcaccuaccauugcucaggcaagggaaagcaucacuacacaucagcaggaauaucacaauacacugugaaagagcuauuuccagcuccagugcugaaugcaucugugacauccccacuccuggggggaaucuggucacccugagcugugaaacaaaguugcucuugcagaggccugguuugcagcuuuacuucuccuucuacaugggcagcaagacccugcgaggcaggaacacauccucugaauacuaaauacuaacugcuagaagagaagacucuggguuauacuggugcgaggcugccacagaggauggaaauguccuuaagcgcagcccugaguuggagcuucaagugcuuggccuccaguuaccaacuccugucugguuucauguccuuuucuaucuggcagugggaauaauguuuuuagugaacacuguucucugggugacaauacguaaagaacugaaaagaaagaaaaaguggaauuuagaaaucucuuuggauucuggucaugagaagaagguaauuuccagccuucaagaagacagacauuuagaagaagagcugaaaugucaggaacaaaaagaagaacagcugcaggaaggggugcaccggaaggagccccagggggccacguagcagcggcucaguggguggccaucgaucuggaccguccccuguccacuugcuccccgugagcacugcguacaaacauccaaaaguucaacaacaccagucuaaccagaacugugugucucaugguauauaacucuuaaagcaaauaaaugaacugacuucaa

SEQ ID NO: 586 - RNA, 2998 nt, Homo Sapiens
ggagccaccagcagaaccucuucaauaucuugcauguuacagauuucacugcucccaccagcuuggagacaacaugugguucuugacaacucugcuccuuuggguuccaguugaugggcaagugggugagugaucucuaacucagcuucuccuucuaugccacuuuccuacuuccaaaggauggguccuauuaaccugcagaagagcauauagggaaagcagagaaagaagaaagauuuauaaauuauguaaaaucucccauauucagagcaugauuuucauaaaaacuaugauuuguaagcuuucuuucuaaaguuuucugaaugagcucuuuccucugagcgaaaugccugaauguauauauaacagcaggaaagggccagaauugcacaaacacuaaaguagucugcugacacugaaguagucugcuggguuucccaacauccccuaaaccaguccccuuuacaagaaagcagaguggguuuuuucuccucagaaagagccaggcaaauacugaaggcuucaaagagaggaguuugaaccuccguuuccaauguacaagcugcugaagcccugcaauguacucucagagacaguauagcucagaggauaaggaaaacagcuccgcuuggcuugcccaagucuaaaacccugcuucauugcucccaacagaaaaaccuacaucaguaauuuaauccucaggagccccagauucccaacacccagaugaggauuuaauaacaaugaacagaggucucugcagcaggaggacacucuuaaaggcuggcuuuuguagguuuccacuugccuauuuuucaaauaaaucuaaauauguauuuuucccuugugcuauccacaaaagccucaccaguugcucagagcccucacaccacaaaggcagugaucacuuugcagccuccaugggucagcguguuccaagaggaaaccguaaccuugcacugugaggugcuccaucugccugggagcagcucuacacagugguuucucaauggcacagccacucagaccucgacccccagcuacagaaucaccucugccagugucaaugacaguggugaauacaggugccagagaggucucucagggcgaagugaccccauacagcuggaaauccacagaggcuggcuacuacugcaggucuccagcagagucuucacggaaggagaaccucuggccuugaggugucaugcguggaaggauaagcugguguacaaugugcuuuacuaucgaaauggcaaagccuuuaaguuuuuccacuggaauucuaaccucaccauucugaaaaccaacauaagucacaauggcaccuaccauugcucaggcaugggaaagcaucgcuacacaucagcaggaauaucugucacugugaaagagcuauuuccagcuccagugcugaaugcaucugugacauccccacuccuggaggggaaucuggucacccugagcugugaaacaaaguugcucuugcagaggccugguuugcagcuuuacuucuccuucuacaugggcagcaagacccugcgaggcaggaacacauccucugaauaccaaauacuaacugcuagaagagaagacucuggguuauacuggugcgaggcugccacagaggauggaaauguccuuaagcgcagcccugaguuggagcuucaagugcuugacagaagaagggacucccuuaucucccaugggacugaggccuccaguuaccaacuccugucugguuucauguccuuuucuaucuggcagugggaauaauguuuuuagugaacacuguucucugggugacaauacguaaagaacugaaaagaaagaaaaagugggauuuagaaaucucuuuggauucuggucaugagaagaagguaauuuccagccuucaagaagacagacauuuagaagaagagcugaaaugucaggaacaaaaagaagaacagcugcaggaaggggugcaccggaaggagccccagggggccacguagcagcggcucaguggguggccaucgaucuggaccguccccugcccacuugcuccccgugagcacugcguacaaacauccaaaaguucaacaacaccagaacugugugucucaugguauguaacucuuaaagcaaauaaaugaacugacuucaacugggauacauuuggaaauguggucaucaaagaugacuugaaaugaggccuacucuaaagaauucuugaaaaacuuacaagucaagccuagccugauaauccuauuacauaguuugaaaaauaguauuuuauuucucagaacaagguaaaaaggugagugggugcauauguacagaagauuaagacagagaaacagacagaaagagacacacacacagccaggaguggguagauuucagggagacaagagggaauaguauagacaauaaggaaggaaauaguacuuacaaaugacuccuaagggacugugagacugagagggcucacgccucuguguucaggauacuuaguucauggcuuuucucuuugacuuuacuaaaagagaaugucuccauacgcguucuaggcauacaaggggguaacucaugaugagaaauggauguguuauucuugcccucucuuuugaggcucucucauaaccccucuauuucuagagacaacaaaaaugcugccaguccuaggccccugcccuguaggaaggcagaauguaacuguucuguuuguuuaacgauuaaguccaaaucuccaagugcggcacugcaaagagacgcuucaaguggggagaagcggcgauaccauagaguccagaucuugccuccagagauuugcuuuaccuuccugauuuucugguuacuaauuagcuucaggauacgcugcucucauacuugggcuguaguuuggagacaaaauauuuuccugccacuguguaacauagcugagguaaaaacugaacuauguaaaugacucuacuaaaaguuuagggaaaaaaaacaggaggaguaugacaca

SEQ ID NO: 587 - RNA, 2909 nt, Homo Sapiens
guggcaaaaccuguuuugaagaugagguuaccucccuuccacaccucccuccuuggaggcaagagcuacaacagcugagacagaaaagagguaaggaaguguugggggcugggacaaccagcuccccaacaacuccuagguguuuaaagaaggaggcaggaagacuugugaagaugggaacuauacaagaggcaggaaaaaagacagauguuggguggagcaacugcuacagagguaaauaugauuaacuuuacauuccaucuuucgucugcucccaaacuuaacagcagguaaucugcuucuagcaaguggugaagguaagagaagcaucuguauaggaggcaagagaucugaguccuuuugaaggccuauccucugcucuguaucucaauuacuguucuucauuucaauuauucuuaccuacuauucaguucccuugaucuuuucuucuugggggcugucuuagggucagggagauugcagaagcaccagaacuaggagcagcccugagacauggggaguuggagcugaaggaggaauggcaggaugaagaauucccuaggcauaggugauaaaaucaugguggggagagagaaccuauauauugaguccuggcuugaugccuuugguguauaugucugccgccuuuuaaucucuuccccucuagauugcuuccugaggaggcuggcacuucugaagauccugaagacccuaaaggagauucacaggcagcugcagguacccccagcacuuuagcccuguguggccagcgccccaugcgcaagcgucuuucugccccagaguugcggcugagucugacuaaggggccuggaaaugauggagcuucacccacccagucugcaccuuccucuccugauggcaguucugaccuggagauagacgaauuggagacaccuucagacucggagcagcuggacaguggacaugaauuugaaugggaagaugaacuaccccgggcagagggucugggcaccagugagacagcugaaaggcugggccgagguuguaugugggaugugacuggagaagauggacaucacuggaggguguuccgaaugggaccacgggagcagcgcguagacaugacugucauugagcccuauaagaaaguccugucucauggagguuaccacggugauggccucaaugcugucauccuuuuugcuuccuguuaucuacccagaagcagcauccccaacuacaccuaugucauggaacacuuguuuagguauauggugggaacucuggagcugcuaguagcugaaaauuaccugcuuguucauuugaguggaggcacaagcagggcccaaguuccaccucuaagcuggauacgucaguguuaccguacccuggaucggcgaguuuuauaaguaaucuuggucauggagcgauguagaagcaugcaaaaggaacuuacgcgaggguagagcacaagauggaaauggagcagaaaaagaccagguggucgggcgcgguggcucacgucuguaaucccagcacuuuggaaggccgagaaaaaaaaaaaaaaaaaaaaaucuugagaguuuuuuuaaaaaugaggaucauggagggcuaaauaagauggguggagcugagauuacagcugacggaauggggauuagacccaaguaccagauaaaucuagaaacuagagaagugaaugaaggaaguuacaguacagaaaacaguuccacgugaucuucacacauaaagguggaagaagaaauaggaugaucucauguuguuuuucaggcuacggaaaaaccugcgagcccuggugguuguccaugcuacaugguaugugaaagcauuucuggcacugcuucggcccuucaucaguuccaaauucacacgaaaaauccguuuucuggacagccugggggagcuggcccaacucauaucccuggaucaaguccacaucccugaagcugucagacagcuggaccgggaucuccauggcucaggagggacauagcacaggacuggauaaaaggccuuagaaccaguuagugaucugccuacaccugaaucccugaaacaucugaacuguuuuguaaaucaucuuauccccaaccucaguaccaccggaucuucacuucucagugggauuuuguccuuugcaugacccuacuuucagcagggcuuugaggcugggaaacugaucugcugggugacuuucauuccaguugcugggacggaaggcugaauguagggucauuuuguaugggauaugcagagcucuggguuuuuuuguuuuuuguuuuuugagacggagucucgcucugucgccaggcuggagugcaguggugcgaucucggcucacugcaaccuccgccucccgguucaagccauucuucugccucagccucagcgaguagcugagacuaccggcgcacgccaccacgcccagcuaauuguuuuguauuuuuaguagagacgggguuucaccauguuggccaggauggucucgaucucuugaccucgugaucugcccgccucggccucccaaagugccgagauuacaggugugagccaccgcgcucggccagagcucuggguuuuaauccuacuuuagcuguagaaccuugggcaaauaacuucaucuuuuuggguccuaauuuuccuccugucuaacuggagggacugugauccuuccaccuuggauggaagaggcuuaccugacagccagccugccugcugggagccaggagagucagcucauuaaaucuugaagaaccgcuguaugcccuuuuuccuucuaagucaugucugcugccugugagccugggaaggagugcuuucaaaaccuguauuuuugcccucuuuaguaaauuuagaacuguagaggcuaauaaacugcgaugagacauuuaagcucugcuccaaag

SEQ ID NO: 588 - RNA, 700 nt, Homo Sapiens
gcccauuccaguuggagaacguagugagucuuucaguggagccagggucugguuugucgugaggagcuccgcgauguccucucaacagagcgccguuuccgccaaaggcuuuuccaaggggucgucccagggccccgcuccgugucccgccccggcgcccaccccggcgcccgccuccuccuccuccugcugcggcuccggcaggggcugcugcggcgacucaggcugcugcggcuccagcuccaccaguugcugcugcuucccaaggagacgccgccgacagcggaguagugguugcugcugcugcgggggcggcagccagaggucccagcgcuccaacaaccggagcucaggaugcugcuccggcugcugagaggcccgcaacccccagcgcugcgcuagagaaacccgcccagcccagagcgggcccgccccgcugcggcucccacgcggggcugggccucggaguuugccccguaaagcgaauugcacuuugauguucagaaacccacuuuguucucagccacgcaaaacucccugaccccgaugugauuuuucuccccggggauucgagagccaugcgugggacacuggacccuacugucuacacgggcuugcacacagcaggugcucagcaaaugucuauugauuugauugucuuuugaagaugucauaauaaagcuucuaccuccugagaaca

SEQ ID NO: 589 - RNA, 3071 nt, Homo Sapiens
agcagcgcaguauggcgggcggggcccgggaggugcucacacugcaguugggacauuuugccgguuucgugggcgcgcacugguggaaccagcaggaugcugcgcugggccgagcgaccgauuccaaggagcccccgggagagcugugccccgacguccuguaucguacgggccggacgcugcacggccaggagaccuacacgccgcgacucauccucauggaucugaaggguaguuugagcucccuaaaagaggaagguggacucuacagggacaaacaguuggaugcugcaauagcauggcaggggaagcucaccacacacaaagaggaacucuaucccaagaacccuuaucuccaagacuuucugagugcagaggugagggccucuguccugaacuuuuuaacccggugccacaaccugagggucuccauaggggcagggagugcugaguagugauggugucuggagggucaaauccauucccaauggcaaagguuccucaccacuccccaccgcuacaacuccaaaaccacuuaucccuacagaggccagcaucagggucuggucagacuuccucagaguccaucuccauccccggagcaucuguaugauucagaaguacaaccacgauggggaagcaggucggcuggaggcuuuuggccaaggggaaaguguccuaaaggaacccaaguaccaggaagagcuggaggacaggcugcauuucuacguggaggaaugugacuacuugcagguaguggcguggcaaugugcacuccaggguggaagcucuucucauccugcuaacuaucuuucgucacucacccccgcccagggcuuccagauccugugugaccugcacgauggcuucucugggguaggcgcgaaggcggcagagcugcuacaagaugaauauucagggcggggaauaauaacuuggggccugcuaccuggucccuaccaucguggggugaguggaacuuggaggaguaaacauucgaaucccauugggagaguggcuuaaugcaaacugguuuuuuucuuuacgaggaggcccagagaaacaucuaucgucuauuaaacacagcuuuuggucucgugcaccugacugcucacagcucucgucugccccuuguccuugggugggagccugggccugcgaccugagccaccugucaacuucccuuaccugcauuaugauguaagucucggugcucuuguucugacugcggcaggcuacagggccuccucaugcucccagucagucgcugucuguacuggcucuguuccugaggcccgagcuugaacucagcugugauguggccucucagaucacacuguccuaugcuuguccagccuggggucaaacauaccccugauucauccccugggucucucugguguuaacauucugccuccacacauucuuuuccagggccauucugcccuuccacugcagugccauccuggcuacagcccuggacacagucacuguuccuuaucgccuguguuccucuccaguuuccaugguucaucuggcugacaugcugagcuucugugggaaaaaguggugacagcaggagcaaucaucccuuuccccuuggcuccaggccagucccuuccugauucccugaugcaguuuggaggagccaccccauggaccccacugucugcauguggggagccuucuggaacacguugcuuugcccagucaguggugcugaggguauagacagagcaugccacacaagccagcucaccccagggacaccuccacccucugcccuucaugcauguaccacuggggaagaaaucuuggcucaguauuuacaacagcagcagccuggagucaugaguucuucccaucugcugcugacucccugcaggguggcuccuccuuacccccaccucuucucaagcugcaguccaccggguaugguucuggaugguucccccaagggagcagcaguggagagcaucccaguguuuggggcacuguguuccucuucgucccugcaccagacccuggaagccuuggccagagaccucaccaaacucgacuugcggcgcugggccagcuucauggaugcuggaguggagcacgaugacguagcagagcugcugcaggagcuacaaagccuggcccagugcuaccaggguggugacagccucguggacuaaaguucccagugugggagaaaggagcuaguuugcaauaaaaacagcuggaugcaggagcccagugucuucaugcagaggagcucaaugucgcgggacuagcuacaccaacauaugcacuuuuuacauuuagaaacacugugauuagaccacagaacaauaaauaugugccaucagaccaaaaaaaaguagagaaaggagcugaacuccacucucgaugcuauuuacagaggacaucuguaaagucuucauaaaagaccuugaaugaugccuaggauggcagagccccuggguccuacuccauccuccagccuuuguccuuguccuggccuccugcucuccagaucuguaaacugggcucaaggacuguacaagcagaguacaacuacccccuccccggugccagggcgccuguuggguuugguccuguguagaugauucccagagucucauucauccagcuccucuucagacagaagguccccauggucagacagcuggucugcauugcugguacugguugcaucauccucauccucagagcuggcuucacaggcaguguggaagagcugcaugaguucucgaaaacggugggaaaccuaagaaaggaggagggcuguauucacuggucuuuuuuuuuuguuuuugagacggagucucucucuguugcugagacuggagugcaguggcacugugucagcuuacugcaaccuccgucuccuggguucaagcaauucuccugccucagcuacuuugggagaggcugaggcaggacaaucacuugaaccugggagguggagguuguagugagcugagauugugccacugcacuccagccuaggcgacaagugaaacugcgucuaaaauacauaaauaaauaaaaauuuaaaaauc

SEQ ID NO: 590 - RNA, 5530 nt, Homo Sapiens
cccgccuccccgccgcucccgcagucaggcuggggcucgaaguggggacccucgccccguccucggcuguccaguccuccuccucgcagaccccggcgguuccuaccccaggccgcaggggagacggggccccaaggcaggcuucauauccugaacgcugggaucccccaggacauucccuggcccccaggccccaggucccaggccccagggcugagcugugggcaggccccaccuggccucugcaaugucaccgccucuguguccccuccuucuccuggcugugggccugcggcuggcuggaacucucaaccccagugaucccaauaccugcagcuucugggaaagcuucacuaccaccaccaaggagucccacucccgccccuucagccugcuccccucagagcccugcgagcggcccugggagggcccccauacuugcccccagcccacaaacucagaggaaacuccuggcuucuagggauucauucugcauggucugugucgggguuguauaccggaccguguaccgucagguggugaagacggaccaccgccagcgccugcagugcugccauggcuucuaugagagcaggggguucugugucccgcucugugcccaggaguguguccauggccguuguguggcacccaaucagugccaaugugugccaggcuggcggggcgacgacuguuccagugagugugccccaggaaugugggggccacagugugacaagcccugcagcugcggcaacaacagcucgugugaucccaagagugggguauguucuugcccuucuggucugcagcccccgaacugccuucagcccuguaccccuggcuacuauggcccugccugccaguuccgcugccagugccauggggcacccugcgauccccagacuggagccugcuucugccccgcagagagaacugggcccagcugugacguguccuguucccagggcacuucuggcuucuucugccccagcacccauucuugccaaaauggaggugucuuccaaaccccacagggcuccugcagcugccccccuggcuggaugggcaccaucugcucccugcccugcccagagggcuuucacggacccaacugcucccaggaaugucgcugccacaacggcggccucugugaccgauucacugggcagugccgcugcgcuccggguuacacuggggaucggugaguggcguggggcgggcgggagacgggagggaggagguggggcgccgccaggcucacucagcuaggugcccaggugccgggaggagugcccggugggccgcuuugggcaggacugugcugagacgugcgacugcgccccggacgcccguugcuucccggccaacggcgcaugucugugcgaacacggcuucacuggggaccgcugcacggaucgccucugccccgacggcuucuacggucucagcugccaggcccccugcaccugcgaccgggagcacagccucagcugccacccgaugaacggggagugcuccugccugccgggcugggcgggccuccacugcaacgagagcugcccgcaggacacgcaugggccagggugccaggagcacugucucugccugcacgguggcgucugccaggcuaccagcggccucugucagugcgcgccggguuacacgggcccucacugugcuagucuuuguccuccugacaccuacggugucaacuguucugcacgcugcucaugugaaaaugccaucgccugcucacccaucgacggcgagugcgucugcaaggaagguuggcagcgugguaacugcucugugcccugcccacccggaaccuggggcuucaguugcaaugccagcugccagugugcccaugaggcagucugcagcccccaaacuggagccuguaccugcaccccuggguggcauggggcccacugccagcugcccuguccguggcgucccccagcugacuggccuaccugcuccccacuccuucuccaagaaggggcaguuuggagaagguugugccagucgcugugacugugaccacucugauggcugugacccuguucauggacgcugucagugccaggcuggcuggaugggugcccgcugccaccuguccugcccugagggcuuauggggagucaacuguagcaacaccugcaccugcaagaaugggggcaccugucucccugagaauggcaacugcgugugugcacccggauuccggggccccuccugccagagaugugaggcucccuacugccccuuccaccugccaccagcagggggcaguguagugucagcugccagagcaccccuccccccgcgcccgccgcccaccucucccaccuuacccccggucucuuccucugacccgucuucagacuaguuacugcagugggaaggugggagggagacggugggguaagggcugauugaccugucagccuggccgcuauggcaaacgcugugugcccugcaagugcgcuaaccacuccuucugccaccccucgaacgggaccugcuacugccuggcuggcuggacaggccccgacugcucccagccaugcccuccaggacacuggggagaaaacugugcccagaccugccaaugucaccauggugggaccugccauccccaggaugggagcuguaucugcccccuaggcuggacuggacaccacugcuuagaaggcugcccucuggggacauuuggugcuaacugcucccagccaugccagugugguccuggagaaaagugccacccagagacuggggccuguguaugucccccagggcacaguggugcaccuugcaggauuggaauccaggagcccuuuacugugaugccgaccacuccaguagcguauaacucgcugggugcagugauuggcauugcagugcuggggucccuugugguagcccugguggcacuguucauuggcuaucggcacuggcaaaaaggcaaggagcaccaccaccuggcuguggcuuacagcagcgggcgccuggacggcuccgaguaugucaugccagaugucccuccgagcuacagucacuacuacuccaaccccagcuaccacacccugucgcagugcuccccaaaccccccacccccuaacaagguuccaggcccgcucuuugccagccugcagaacccugagcggccagguggggcccaagggcaugauaaccacaccacccugccugcugacuggaagcaccgccgggagcccccuccagggccucuggacagggcgggaggccagggucucuggcgcggguggaugugugcagcccagaugccgcgucugagugugugugucuggagacgggggcucugggccccauuucuagaggaagugugagccgggggaggggacagagggcugauuaccaguugccuccuccuccucagggagcagccgccuggaccgaagcuacagcuauagcuacagcaauggcccaggcccauucuacaauaaagggcucaucucugaagaggagcucggggccaguguggcuucccugagcagugagaacccauaugccaccauccgggaccugcccagcuugccagggggcccccgggagagcagcuacauggagaugaaaggcccucccucaggaucuccccccaggcagccuccucaguucugggacagccagaggcggcggcaaccccagccacagagagacaguggcaccuacgagcagcccagcccccugauccaugaccgagacucugugggcucccagcccccucugccuccgggccuaccccccggccacuaugacucacccaagaacagccacaucccuggacauuaugacuugccuccaguacggcaucccccaucaccuccacuucgacgccaggaccguugaggagccaggaugguauggcagaggccagcacaccuggcuguugcugcucaaggcuggggacagagccuaguguaccccugccaggagcagggaguggaccggcaggcugugaacaugaacaacgcuuaacagagcaagugaugggagccuuguuccuggguucuaccaugggagacgcugaucagcaggaugccuggcucccuuucccaacccacugcucccaaggccuccagggcccuguguacauaaacugguggguuggaaguugcuggguaacucugauuucagacaugcgugugggguaccuuuucugugcaugcucagccugggcucugugcguguguguguuucugugauuuuagaaggguaccaggcacagguucuguccuagggcacuuaccauuuaguagggagauggaaccaacccaauuaacucuagcaauagccuccuaacuggccuccuccauugauucagugaaccuuccaaugcauggcucauaauuucaaaauacaggcugguuaguuacucccuaccugaaagccuucauaggugccucuuugcucuucugccaguaucaaaacuuuugaaggccuuaaaggcccugcuuugccuggcccaucugucucuccagccucaccuugaacuguguuccugucacugcacgccagucacaccggccucuagguccuccuguaggccacucuucuuucuggcacagggaccugcacaccuggagugcccuuccucccccacucgccuguucaccccugcuuuuccuuuacaccuccuccucagggaagugcccacccuccguacaucuuucacagcccugauugcagcuguguucacucaccagguaccugcagaaggccuacagggugccaggcacuucuuuaauguguucuuucuuuaugugauuauuugauuaaucucugccucccccacuagacuguaagcucccugaaggcaagaauccugugcuuaugcucaauauuagcucucccuuggcacagaguaggcacucaacaaaugcuccccaaaaggcugaguggcugacugaauuaaguaccagugacaugcaguaacugcuaagauagaugagccaucuguaugcucugacaguuacagacugaauaaguuggagacuucccuaaaggguggcauuuccccaggguaacaacgcagagcucaggugugggaaggugccaggggcaggggugcagaggggcugaggcugaggggggugcagaggcuggagaaaggauaacaggagagaguauacaggcaugccuugauuuauugcacuucacagguagcagaauuuuuaaagaaauugaagguuuugggacauauaugugacagcaauagguuaagaaaagcaaagcagagaaauugaagauuugugucaacacugcuuuaagcaaaucuguuggcaccauuuuuccaauagcaugugcccauuuugggucucuacauugcauuuugguaauugcuugcaauauuucaagcauuuucauuguuauuauauguguuauagugaucugugaucagugaucuuugauauauuauuguaauuguuucggggcgccaugaaccgcacccauauaacacgguaaacuuaaucagcaaacguug

SEQ ID NO: 591 - RNA, 2374 nt, Homo Sapiens
caagggagagaaguguguucacuuccuuuugcuaagcccuuccuuuccagagagugucuuggggggcaucugacugcuuccccccacccucugccaggcauugcuggagaauguuaagacggcgauggagaugccaucaaccccacccugcagagcaucaccagcccccaguagaaauaugaauagaaaucacccugugggcaauggucccauuuuaaaauaugcugucccauuguccccuagagccuacuuuaacuugucagaccauguauuccacuucauaugcaagaggcaugcacugagcccauagguggcuaggcaaacacccaauagcucccugaaauggcuucauuaugcagccucgacagccaccccaacccucccacucucacacugaaacacccagaccuagagauagcuagacacacccagacacccgccaagccccucacauacagauaugugcacaaugauacacagcaaacguacacagaguucaguacacacaaagagcucacgcccacgugcacacaccccucaguugggacagaguugaccaccaccaccuuucucccaaacacauggcuuuugaacugccuuuccuuggauccaguucaaggggauggaggagcagugagagucagccgcccuuccacuccaauuucccagcaccucccuuaucucugccucacaagucacccagccccccucucuuccuuccuugugcuugaagaaucucuccuugcuggaaagcccccuguuuucucaaucucccuuuccacuucgguaaaaucucuacuugcuggaaagcccccuguuuucucaaucucccuuuccacuucgguaaaaugcccacuuucugguccccaccuuuuuccugaguguagucccaaccagccaaauccaaccucaaaacaggaagacccaaggccagugacccccauaggccugaggcuugugcaggcagugggcgugggguaaggcuuccugaugcccccugucccugcccagaaccugauggcccucauuaguccuuggcucuuaucuuggaagcacaggcgcugacagccgucccagcccuucugucugcgggccugaaccaaacggugccauggggaacugucugcacaggggcuuccccaggacuguuccugcuccggcucuucaggcucccugcuuuguccuuuuccacuguccgcacugcaucugacuccugcagagaccuuguucucccacccgaccuuccucucuguccuccccucccaccugccccucaauucccaggagacucuuccgguguaacucugauggccuccucuggguauguccuccaggcggagcucucccccucaacugagaacucaagucagcuggacuucgaagauguauggaauucuuccuauggugugaaugauuccuucccagauggagacuauggugccaaccuggaagcagcugcccccugccacuccuguaaccugcuggaugacucugcacugcccuucuucauccucaccaguguccuggguauccuagcuagcagcacuguccucuucaugcuuuucagaccucucuuccgcuggcagcucugcccuggcuggccuguccuggcacagcuggcugugggcagugcccucuucagcauuguggugcccgucuuggccccagggcuagguagcacucgcagcucugcccuguguagccugggcuacugugucugguauggcucagccuuugcccaggcuuugcugcuagggugccaugccucccugggccacagacugggugcaggccaggucccaggccucacccuggggcucacugugggaauuuggggaguggcugcccuacugacacugccugucacccuggccaguggugcuucugguggacucugcacccugauauacagcacggagcugaaggcuuugcaggccacacacacuguagccugucuugccaucuuugucuuguugccauuggguuuguuuggagccaaggggcugaagaaggcauuggguauggggccaggccccuggaugaauauccugugggccugguuuauuuucugguggccucauggggugguucuaggacuggauuuccuggugagguccaagcuguugcuguugucaacaugucuggcccagcaggcucuggaccugcugcugaaccuggcagaagcccuggcaauuuugcacuguguggcuacgccccugcuccucgcccuauucugccaccaggccacccgcacccucuugcccucucugccccucccugaaggauggucuucucaucuggacacccuuggaagcaaauccuaguucucuucccaccugucaaccugaauuaaagucuacacugccuuugugaa

SEQ ID NO: 592 - RNA, 1424 nt, Homo Sapiens
ggccggaggcggcgagcugagcggcucugacaggacgggucgcagggggucgccuggccggagcugggcuccgagaaucccgggugccagcaccagagcagcggcucuccgcacuaacucuccucuccuggucagcuguaaccccugccgcagagcccggcaacuuucagcugucgcccgcggagccccgagggccacucgccucaccugugcgugcagcgccucgcgcgcccuguccggcugcggagaugagcgagcuuaauaccaaaacauccccagcaaccaaccaggcagcuggccaagaggaaaaaggaaaagcuggcaaugucaagaaggcggaggaggaggaggagauugacauugaucugacagcaccagaaacagagaaggcugcccuugcuauucagggcaaguuccggcgauuucagaaaaggaaaaaggaucccagcuccugaauggccaggcuugcccuucaccuucaccuucaugcuggucccuucucuccccuucuccacacccauguaucuuuaucccuugucccucuagccuuuccuugaggcaaguucaaccuuuauauacucuuguaucuggcccccucaagccaucacagaaguagaggcacaagagagguggagaagaugaagacuucaaucagcagucacuagucuaaggguggaacaauuucuucuugguauaagguucuuugaucaguagcuaugccugcccuguagggcuaaacaagaggcuucgaggcugagagaucuccccaaagaacaaugugggaaggaggggaaggcuuucagaguagggugccugagggugggacauaugcacuguucugcuaguuacggcauucacacuuuagguaacauuuuuuuuccccuucagauccuucugcaccaacuccaacuuccccucccaggaucuaagccacaguggggacuggagccucguuuucccccuaggcagaccuaaaucaagcagcuuaccacaauagugcaugcugaguagauuaguuccaaggaagggagacuggaaugcuggugucaaggaaaagccucccucaucaucuagucuaagaccauaacgggcagaagcauaagagguuccagggccauaggagaaugagaaguagggcacauauagggaggaaagaaaagugaagaagggggaaaucucugaauuuuuuuacugcugggaaaaguguacuacaugaaggaugcuuggggcuuugcuaaccugcucaccgcuaacccuccaagucuaaccauccccagaggccacacaaaccaagugacuccuguaguucccauuugccccacuauggagucagggcaaaaguggaauagccacuccaugugauuuuagcauguuuaaucauuuuaacaauaaaccaccccacaaauggggucauuuaaccucua

SEQ ID NO: 593 - RNA, 1204 nt, Homo Sapiens
gguuuaaaaugacagucucaaguucauuuagaaagagaaggcuaauucaaagaaacagcaaggcaagcuuccuuucucuguaggaaucauuauuaucccccuuugucauggcccaccggggagcccauuuugccuuuagaucccgcuggcagaagaccgacgaugaacucuguagacauagcaugucuuuuauccuucacaaagccauucgcaaugacuucuuucagagcuaucucuaccugcuggaaaaaauuccccuggaucugauacauaucugucauuuugggauuucuuuucauuggauuccugguuaauuacgucaucuuucaucgugcaucuucucuugauuguaacccucauugggcuggaauauagcuucaagaaacuucugaagaaugaaucuauaggagugaaauuguacgcuuuaacaagccaagucaucaauggugagaugcaguucuaugccagagcuaaacuuuucuaccaagaaguaccagccacagaagaggguaugaugggaaauuucauugaacuguccagcccagacauccaggccucucagaaauuucuuaggaaauuuguugggggcaugacaauagaagcuacuucacaggauaauguggagaucuaaugagauaauacaugucaggggccugggagagcuggaacagacugcgccuuggacugcggcuccgggauaggaagggucagcaaacacgucuuauugccuguuuucaacaguguggagcugguggauaugauggaauccuuucuccuugaagcccagaacuaccugcaggucaaaggugacaaaguagaaagcuaccacugcuacagccugcaggaauucacaccccccuucaggagauaugaugucaucuggauucagugggucucugggcaccugacugauaaggaccuucuugcauuucuuucccggugccgagauggccugaaagaaaauggcaucaucauauugaaggacaauguggcccgggagggcuguauccuugaucucucugacagcagugugacucgggacauggacauccuccggagccuaauaaggaagagugggcugguggugcugggccaggagaagcaggauggcuucccagagcagugcauccccguguggauguucgcacugcacagcgacagacacuccugaaaaagcagugggaaugaacgacuggacugggca

SEQ ID NO: 594 - RNA, 658 nt, Homo Sapiens
cuuagaucuuaagccacugcugaucuucuuagaaccacacaccgcaggugcuucccuguggaaacugcaaauguuuacucugucuuccaccuuugaaugacuuagaacauguuguggcuaagguucauucguuaucaacauucagaaacugccauuuccuuuucuaccugcaaagccuaauaauaacuuuuuaaacuauugcuuccuuugcauauucaccauacauccugcuuucagauguggaaucuaaaaccuugcugagaaacugccuccaauguugcucccuuaacuuucacuguggaaaacucugaaggaaguuggccgcaccauuuaauggaagcaugaggaacuagucucuuuccuuuagauauguaugaaaauggcuccacugugacucagcagauggcuccacugugacucagcagaucuccaggauuuuccuguguaguuucuguuuuggcuuucaucuggugggaacugacugcuacaggaccgaggcuuuuaaaucaaacccaaauaacaaaauguauuuagagcugaaaaagguggugccaucaggcugggguggggaugaggaagugauucauuaccccaguuggaauguaaauucaaugaguuuaauuacuaguggugucaaaaaaggauuuucacugauagc

SEQ ID NO: 595 - RNA, 2038 nt, Homo Sapiens
aacugcccgcagugcccaugguggcucggaugggaggaaccaccgcggagccggggacagggggagcagggcagugcucugcugggugaggggcacccagcuccagaggcuaggugggcgucgcugguggguggacuccugggcgcugcgcggagccgcgccggcuggguuagcgcgggcggggcgcuuagucccacccccagaggaggcggaagaggagcccgagccuggccgcgggcugggccccgccgcagcuccagcuggccggcuugguccugcggucccuucucugggaggcccgaccccggccgcgcccagcccccaccaugccacccgcggggcuccgccgggccgcgccgcucaccgcaaucgcucuguuggugcugggggcuccccuggguaaggggauggggagagaugcggcaggagugggaugggggcggaggaaggggagggaccgauccgaggggcuugggcucggggcuucuccgagacccuccggcugccacgggagccuuggguguugcuggguccucaagaagcgggaagagggagcuccaggaugcugggccaugggaggcugaucccggggugcagggucagcuucaggcagaggccucgggggcucuggggcugagacccucaggguggagacaaggggcaacccucaguguucgggagccgucaggcuggggaccgccgggggaguggggccgagcgcggcuggggaugaacuggccugguggccacugggcacccccaaucccugcccgcagugcuggccggcgaggacugccugugguaccuggaccggaauggcuccuggcauccgggguuuaacugcgaguucuucaccuucugcugcgggaccugcuaccaucgguacugcugcagggaccugaccuugcuuaucaccgagaggcagcagaagcacugccuggccuucagccccaagaccauagcaggcaucgccucagcugugauccucuuuguugcugugguugccaccaccaucugcugcuuccucuguuccuguugcuaccuguaccgccggcgccagcagcuccagagcccauuugaaggccaggagauuccaaugacaggcaucccagugcagccaguauacccauacccccaggaccccaaagcuggcccugcacccccacagccuggcuucauauacccaccuagugguccugcuccccaauauccacucuacccagcugggcccccagucuacaacccugcagcuccuccucccuauaugccaccacagcccucuuacccgggagccugaggaaccagccaugucucugcugccccuucagugaugccaaccuugggagaugcccucauccuguaccugcaucugguccuggggguggcaggaguccuccagccaccaggccccagaccaagccaagcccugggcccuacuggggacagagccccagggaaguggaacaggagcugaacuagaacuaugagggguuggggggagggcuuggaauuaugggcuauuuuuacugggggcaagggagggagaugacagccugggucacagugccuguuuucaaauagucccucugcucccaagaucccagccaggaaggcuggggcccuacuguuuguccccucugggcugggguggggggagggaggagguuccgucagcagcuggcaguagcccuccucucuggcugccccacuggccacaucucuggccugcuagauuaaagcuguaaagacauaacucauaucagucgcaucauuggacccauccacaccuuccaggaacaccgccuucagcugggcccagacuguugcccacuccauauuccaaaaguaggggagggccagcaccagcaucggagcacagcaccauccucacccccauccacaagcagaccaaggcggacuguuccuggcuuccuaaaggcuuccuaaagacaaugaggugaauuuugccacagcucugaagagaugcucguuugcacuacagauauucccugcuagggaucaacagcucuacaacagc

SEQ ID NO: 596 - RNA, 125 nt, Homo Sapiens
gcagacucacuaugcaccugacuguacuuccaggcaggugcuuuuucugucugccagagaaacauuccagggugcuguggcugccucaccuauccagggcgaugcagcucccuggggacacaggu

SEQ ID NO: 597 - RNA, 4250 nt, Homo Sapiens
agcuugucucaaacuccacauacagaaagccaccgaccuuauuccgguauccuacacccauuccccacucucauuacacucccaccccuggcccucagcgucggagucaagagcaacagggacacuuccguucuccuuguaggacuggugaaaccguaaugaagaacaccccuaaacucccauaaucggugcggauuccuauggggaaggccuauauuguugacaucuuccaggccuugguucuggaccuugagaaagaggcuguggaacuagagauagcgaugcuuuuuaggguaaauguauguagguauugggggaaggggagggaucaaucgaaaaauggaagugguuuaaaguucauauuucacuuuuugcuaucucuauagcguacaacuugugaguuacuuacaggcuguaaaagcuucucaagucuaaaaauaucugaaaacuaaacuugaauuaacucuuaauacaaacaguacuuugaaaaugcagcauuuaaccuuguuuuaaaauuuuuuucucaaagcauuuuuuuccagccacucacauuuuaaaagguuguauuacuuuuaguuagaacugaaagggcucaacuagcauuugcugugaccaguaugcggagucuguguuggcuuuccagaauugacuuuuuggguuguauuggcaaaucacaguccuaaaugaugaauguugaaugaugcacuauguuuuuguuuaaaugagauuuccugaaaauaguuaauuucagaauuaagggaaauugaugucgcuaucaugaggcaucauaaaaauauguauuuuacaaggugaaggcauuucaaguagauauaguucuugaugaagcaggaagaacauggaucugggauuuggaagaccuggcuucuagcugcuacuaaccaacucugugacucugggaaagggggacucaguucuuacuucuguaacaugaggacacuggacuauuugaauucagaacuuagaaaauuggaagggaccuuaaagcccucuaagaaagaguucgggaauguucuccauugcugucaguuuuccuccaaaaauaaccuggcuuggaaguuauugguccagugggaauuugauuccccauagaaacuggagaaaagguaaugcaaguagagaggaacagcuguauuucugcuugaguaauaaacccacuaacagauucugguacgaauuguggagacauaaagagaaugaguguauguacucuaaguguaccaguuucuucacucucuccuggcagaagaugcaacacuuuuagugauucugggauucugggauguguuccuauuaauucuaauacagaugaagaagaugugguagaggaaaagaugguagcagaaggagugaauaaagaggcaaaacagccugcuaaaaagaaaagaaagaaggguuugcgaauuaaggggaaaaggcgucgaaaaaaauugauucuugccaaaaaguuuaguaaggauuugggaucugggaggccuguugcagaugccccugcuuuguuagcuuccaaugacccugagcaggaugaagaaagucuuuuugagagcaauauagaaaaacagaucuaucuaccuaguacuagagccaagaccuccauuguguggcacuucuuucauguugacccccaguacaccuggcgggccauuuguaaccucugugagaaaagcgucagcagggguaaaccagguagccaucuugguacaucuacucuucaacgacaucugcaagcaaggcauucaccucauuggaccagggccaacaaguuuggaguugcuaguggagaggaggacuuuaccuuggaugugucuuuaucucccucuucuggaagcaauggaagcuuugaauauauuccuacugauccauuagaugauaauagaaugggcaagaagcaugauaaaucagcaucugaugcccuaagggcagaaagagggagauuucucaucaaaaguaacauugucaagcaugcuuuaauuccuggaacuagagccaagacaucugccguuuggaauuuuuuuuacacugauccucagcacaucucaagagcuguguguaauauauguaaaagaagugugagccgggguaggccagggucccacuuagggacuucaacacuucaacgacaccugcaagccacacauccuauccauugggcuguugccaacaaagacaguggugcuguugcaaauggauuagaugaagcugagacugagagaagugaucucuugagugauaccuugcauggagaaaagucuacaggcagccaagauuuaacagcugaggaccuuagugacucugauucagaugaaccuauguuagagguugaaaacagaucugaaaguccuauucccguugcagagcaaggcacucugaugcgugcgcaggagagagaaacaacauguuguggaaauccagucucaagucacauaagucaggcaauuauccaaaugauuguggaggauaugcauccuuacaacuauuucucaaccccagccuuucagagguucaugcagauuguggccccugauuauagguugccaucagagacuuacuuuuucacuaaggcuguaccucaguuauaugauugugucagagaaaaaauuuucuuaacuuuagagaauguucaaagccaaaagauacaccugacuguugacauauggacccaugacccauccacugacuauuuuauugugacuguacacuggguuucuuuggaaacugcgucuuuucucaauaauggcaggauccccgauuuuagaaagugggcagugcuuuguguuacagguuuggcuaaagacuguuugauaaccaauauuuuacaagaauuaaaugaccagauuggucuguggcuuucuccaaauuuccuuaucccuagcuucauuguuucugacaauuccucuaaugugguacaugcaaucaaagauggugguuuuacccaugugccaugcuuccugcauuguuuaaauauggucauucaggacuuuuucugcgagcacaaaagcauugagaauauguuaguggcugccaggaaaacuugucaucauuuuagucauucggucaaggcccgucagauacugcaagaguuccaaaaugaucaccaacuuccauggaagaauuugaagcaggacgaaacuggccauuggauuucuacuuuuuauauguuaaaauggcucuuggagcauugcuacucaguucaccauagucuugguagagccaguggaguugugcucaccucccuucaguggacucuaaugacuuauguuugugauauucuuaagccauuugaggaggcuacccagaaagugagcgugaagaccgcaggauugaaucaggugcuaccccuaauccaucaucuacuccuuucccugcagaaacucagagaagauuuucaagucagagguauuacucaggcccucaaucugguggauaguuuaucucugaaacuugaaacagauacccuacuaagugccaugcuuaaauccaagcccuguaucuuggcuacuuuguuagauccuugcuuuaaaaacaguuuggaagacuuuuuuccucaaggugcugauuuagaaacuuauaagcaguuccuugcagaagaggucuguaauuauauggaaucuucaccagagaucugccaaauuccaacuucagaagcuucuugucccucaguuacagugggagcugauucauuuaccucaucucuaaaagaaggcaccuccaguucagguucuguugauagcucagcuguagacaauguugcccuuggaagcaaaagcuucauguucccuucugcuguagcaguuguggaugaguacuucaaagagaaguauucagaguucucaggaggugaugacccuuuaauuuacuggcagaggaagauaagcauauggccggcuuugacccagguugccauccaguaucuaaguugccccauguguaguuggcaaucugaauguaucuuuacuaaaaauagccacuuucauccaaaacagaucaugagccuggacuuugacaauauagaacaacugauguuucugaaaaugaacuugaaaaauguuaacuacgauuauucuacguugguucugagcugggauccugagcagaaugaaguuguucaaagcagugaaaaagaaauacugccuuaauuucuuuuucuccauuuaaaaugggcaacuuuuugcuguguuacuguaucuuaauagcuguaguuguuaaauauaaucauuaucuuuauaaacaca

SEQ ID NO: 598 - RNA, 2441 nt, Homo Sapiens
ugaaauucagggacucuuugguggagcaauuaccagucaacuucaggguauuaugauaaacucugaucuggggaggaaccaggacuacauagaucaaggcaguuuucuucuuugagaaacuaucccagauaucaucauagagucuucugcucuuccucaacuaccaaaggcugucauuuccuugaagacauggaucccauaacauuuauucuagugcuuuaugacaaguuggaauucaaugacuauuuauuaaauugaguucuuucagcagaaaaacaucagcgaagcagcaggccaugcaccccccaaaaacuccaucuggggcucuucauagaaaaaggaaaauggcagccuggcccuucuccaggcuguggaaagucucugauccaauucucuuccaaaugaccuugaucgcugcucuguugccugcuguucuuggcaauugugguccuccacccacuuuaucauuugcugccccgauggauauuacguugacugagacacgcuucaaaacuggaacuacucugaaauacaccugccucccuggcuacgucagaucccauucaacucagacgcuuaccuguaauucugauggcgaauggguguauaacaccuucuguaucuuagauacaggguuucaccauauuggcuagacuggucucaaacuccugaccucaagugaucugccugccucggcuucccaaagugcugauauuacagacaaacgaugcagacacccaggagaguuacguaaugggcaaguagagauuaagacagauuuaucuuuuggaucacaaauagaauucagcuguucagaaggauuuuucuuaauuggcucaaccacuagucguugugaaguccaagauagaggaguuggcuggagucauccucucccacaaugugaaauugucaaguguaagccuccuccagacaucaggaauggaaggcacagcggugaagaaaauuucuacgcauacggcuuuucugucaccuacagcugugacccccgcuucucacucuugggccaugccuccauuucuugcacuguggagaaugaaacaauagguguuuggagaccaagcccuccuaccugugaaaaaaucaccugucgcaagccagauguuucacauggggaaauggucucuggauuuggacccaucuauaauuacaaagacacuauuguguuuaagugccaaaaagguuuuguucucagaggcagcaguguaauucauugugaugcugauagcaaauggaauccuucuccuccugcuugugagcccaauaguuguauuaauuuaccagacauuccacaugcuuccugggaaacauauccuaggccgacaaaagaggauguguauguuguugggacuguguuaagguaccgcugucauccuggcuacaaacccacuacagaugagccuacgacugugauuugucagaaaaauuugagauggaccccauaccaaggaugugaggcguuauguugcccugaaccaaagcuaaauaauggugaaaucacucaacacaggaaaagucguccugccaaucacuguguuuauuucuauggagaugagauuucauuuucaugucaugagaccaguagguuuucagcuauaugccaaggagauggcacguggaguccccgaacaccaucauguggagacauuugcaauuuuccuccuaaaauugcccaugggcauuauaaacaaucuaguucauacagcuuuuucaaagaagagauuauauaugaaugugauaaaggcuacauucuggucggacaggcgaaacucuccugcaguuauucacacuggucagcuccagccccucaauguaaagcucugugucggaaaccagaauuagugaauggaagguugucuguggauaaggaucaguauguugagccugaaaaugucaccauccaaugugauucuggcuauggugugguugguccccaaaguaucacuugcucugggaacagaaccugguacccagaggugcccaagugugagugggagacccccgaaggcugugaacaagugcucacaggcaaaagacucaugcagugucucccaaacccagaggaugugaaaauggcccuggagguauauaagcugucucuggaaauugaacaacuggaacuacagagagacagcgcaagacaauccacuuuggauaaagaacuauaauuuuucucaaaagaaggaggaaaaggugucuugcuggcuugccucuugcaauucaauacagaucaguuuagcaaaucuacugucaauuuggcagugauauucaucauaauaaauaucuagaaaugauaauuugcuaaaguuuagugcuuugagauugugaaauuauuaaucauccucuguguggcucauguuuuugcuuuucaacacacaaagcacaaauuuuuuuucgauuaaaaauguauguauaaaaaacua

SEQ ID NO: 599 - RNA, 13302 nt, Homo Sapiens
uuuugucccggaaccccgcagcccuccccacacucugggcgcggagcacaaugauuggucacuccuauuuucgcugagcuuuuccucuuauuucaguuuucuucgagaucaaaucugguuuguagaugugcuuggggagaaugggggccucuucuccaagaagcccggagccugucgggccgccggcgcccggucuccccuucugcugcggaggaucccugcuggcgguuguggugcugcuugcgcugccgguggccuggggucaaugcaaugccccagaauggcuuccauuugccaggccuaccaaccuaacugaugaauuugaguuucccauugggacauaucugaacuaugaaugccgcccugguuauuccggaagaccguuuucuaucaucugccuaaaaaacucagucuggacuggugcuaaggacaggugcagacguaaaucaugucguaauccuccagauccugugaauggcauggugcaugugaucaaaggcauccaguucggaucccaaauuaaauauucuuguacuaaagggugaguuggcaucucuugaaccaacaucucuugguucaagaguucuaacacagccuuacuaccuucuagucacaugucagaaaggacaacuaaacuauuaccaucugcucuuuaacggcuucaacacagauguuuagcuccugacugaaaugagcaaagguaugacaagaucgggggaaaaucaucuguauccuugcuggaaaccaaggcagagcauauaugaaaaguguggcauucauugggugggaaggaagaaaaugggggaagaguauagucaaagcacacaaacagccuuaacgcagaggggacauugcuggaagaaagggaaggccauugaguaacugugugagagaaaucuuaacggucauagcacaaguaguuugcuagggcugcuguaacagaguacuccaaaacggguggcuuaacacaaaugaaguuuuuaaaauucuguuccggaggcugaaagugcaaaaucaagguguuggcagagccaugcuccccucuaaaaccuguaaggauggauccuucuuugcuucuuccagcuucuggagccccaggccuuccuuggcguguggcagcagaacucccguuucugucucuguccucacauggccgucuucccucugggucuguguccucacaugcuguuuuccugucuguguauggcugugucgaaagugcucucuuuuaauaaggacaccaaucauaauggauuagcgcccacacuaacgaccucaucuuaacuggauugccucuccaaagaccauauuuccaaauaagaucacauuaauaagcacauaccgacucauugguuccucgucugccacaugcaucaucucaggugauacugucauuugggauaaugaaacaccuauuugugacagaauuccuugugggcuaccccccaccaucaccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggccccgccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucaccugggcaggaaguguucuacagcugugagcccggcuacgaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuacugugucuuggcuggaauggaaagccuuuggaauagcaguguuccagugugugaacaaaucuuuuguccaaguccuccaguuauuccuaaugggagacacacaggaaaaccucuggaagucuuucccuuugggaaaacaguaaauuacacaugcgacccccacccagacagagggacgagcuucgaccucauuggagagagcaccauccgcugcacaagugacccucaagggaaugggguuuggagcagcccugccccucgcuguggaauucuggggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggugaguuggcagcaacaucucuugguuuaagaguuccagcacagcgauaguacuuucuagccacaucucagcaaggaaacuaggcuauugccaccugcucuuaagaggcuugaacacagguguuaacuccugauugaaaugaacaaagauaggagaagauuagggggaaaaucuguauccuugcuggaaaccagggcagugcacauauaaagaguaugcuguucacuggaugggaaggaaaaaaacuuagaaguguaguagucaaagcacacaaacaacccuaacccagaguagacauugcuggaagaaagggaagaccauguagcagcugugugagagaaugaaucuuaaugauaacagcaugaucccuugcuagggcugccaucaaaaaguacaggccuuccucguuuuauuguacuucgcagauguuaugcuuuuuacaaauugaacgcuugugggaacgcuguguaagcauguucgucggcaucauuuauccaacagcguguguugacuucgugucucuguguagcauuuugauuauucucacaguaucccagauguuuucauuauuaucaugucugugauagugaucugucaucagugaucuuugauguuacuauugucauuguuuggggucccuacgaacugcacccauauaagacagaaaacuuaaucaauaaaugugcgugcuuugacugcgcaccgacucauuggucacucaucugcugaauguauccucucgggcaaugcugcccauuggagcacgaagccgccaauuugucaacgaauuccuugugggcuaccccccaccaucgccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggcccggccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucacccgggcaggaaguguucuacagcugugagcccggcuacgaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuacugugucuuggcuggaauggaaagccuuuggaauagcaguguuccagugugugaacaaaucuuuuguccaaguccuccaguuauuccuaaugggagacacacaggaaaaccucuggaagucuuucccuuugggaaaacaguaaauuacacaugcgacccccacccagacagagggacgagcuucgaccucauuggagagagcaccauccgcugcacaagugacccucaagggaaugggguuuggagcagcccugccccucgcuguggaauucugggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggugaguuggcagcaacaucucuugguuuaagaguuccagcacagcgauaguacuuucuagccacaucucagcaaggaaacuaggcuauugccaccugcucuuaagaggcuugaacacagguguuaacuccugauugaaaugaacaaagauaggagaagauuagggggaaaaucuguauccuugcuggaaaccagggcagugcacauauaaagaguaugcuguucacuggaugggaaagaaaaaaaauuagaaguguaguagucaaagcacacaaacaacccuaacccagaguagacauugcuggaagaaagggaagaccauguagcagcugugugagagaaugaaucuuaaugauaacagcaugaucccuugcuagggcugccaucaaaaaguacaggccuuccucguuuuauuguacuucgcagauguuaugcuuuuuacaaauugaacgcuugugggaacgcuguguaagcauguucgucggcaucauuuauccaacagcguguguugacuucgugucucuguguagcauuuugauuauucucacaguaucccagauguuuucauuauuaucaugucugugauagugaucugucaucagugaucuuugauguuacuauugucauuguuuggggucccuacgaacugcacccauauaagacagaaaacuuaaucaauaaaugugcgugcuuugacugcgcaccgacucauuggucacucaucugcugaauguauccucucgggcaaugcugcccauuggagcacgaagccgccaauuugucaacgaucaugccaucuucccugugaguuguuuggaagaugagcuuucuacauuuuggggagcaaagacgaaugagcaauugcaagcuaacaaggaauauaaaauguguauaauccuggguuuagugauggugugaggaaaucagcaauuucaaacccaguuggugggaggauaagugggaacaaacuuuguagaaggccaauaaacuggcugggcacugcccuacgguagaguaggacacaguauucaguucuuccaagaucagacgagauugggcgcauuuagggugguaugguuguagaucaguauccaguucuuuuuauuauuucugaaucuguaaguaucauguuuauuauauguaauauuguauauuuguacuuugucuuuguuaguucuuccagagcuuuuguucuuauuauuuaauaaagauguuauacuggaauuccuugugggcuaccccccaccaucgccaauggagauuucauuagcaccaacagagagaauuuucacuauggaucaguggugaccuaccgcugcaauccuggaagcggagggagaaagguguuugagcuugugggugagcccuccauauacugcaccagcaaugacgaucaagugggcaucuggagcggcccggccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccggagcuaccaagcugcuccaggguaugucagccaccuccagauguccugcaugcugagcguacccaaagggacaaggacaacuuuucacccgggcaggaaguguucuacagcugugagcccggcuaugaccucagaggggcugcgucuaugcgcugcacaccccagggagacuggagcccugcagcccccacaugugaagugaaauccugugaugacuucaugggccaacuucuuaauggccgugugcuauuuccaguaaaucuccagcuuggagcaaaaguggauuuuguuugugaugaaggauuucaauuaaaaggcagcucugcuaguuauugugucuuggcuggaauggaaagccuuuggaauagcaguguuccagugugugaacaaaucuuuuguccaaguccuccaguuauuccuaaugggagacacacaggaaaaccucuggaagucuuucccuuuggaaaagcaguaaauuacacaugcgacccccacccagacagagggacgagcuucgaccucauuggagagagcaccauccgcugcacaagugacccucaagggaaugggguuuggagcagcccugccccucgcuguggaauucugggucacugucaagccccagaucauuuucuguuugccaaguugaaaacccaaaccaaugcaucugacuuucccauugggacaucuuuaaaguacgaaugccguccugaguacuacgggaggccauucucuaucacaugucuagauaaccuggucuggucaagucccaaagaugucuguaaacguaaaucauguaaaacuccuccagauccagugaauggcauggugcaugugaucacagacauccagguuggauccagaaucaacuauucuuguacuacagggugaguuggcagcaacaucucuugguuuaagaguuccagcacagcgauaguacuuucuagccacaucucagcaaggaaacuaggcuauugccaccugcucuuaagaggcuugaacacagguguuaacuccugauugaaaugaacaaagauaggagaagauuagggggaaaaucuguauccuugcuggaaaccagggcagugcacauauaaagaguaugcuguucacuggaugggaaagaaaaaaacuuagaaguguaguagucaaagcacacaaacaacccuaacccagaguagacauugcuggaagaaagggaagaccauguagcagcugugugagagaaugaaucuuaaugauaacagcaugaucccuugcuagggcugccaucaaaaaguacaggccuuccucguuuuauuguacuucgcagauguuaugcuuuuuacaaauugaacgcuugugggaacgcuguguaagcauguucgucggcaucauuuauccaacagcguguguugacuucgugucucuguguagcauuuugauuauucucacaguaucccagauguuuucauuauuaucaugucugugauagugaucugucaucagugaucuuugauguuacuauugucauuguuuggggucccuacgaacugcacccauauaagacagaaaacuuaaucaauaaaugugcgugcuuugacugcgcaccgacucauuggucacucaucugcugaauguauccucucaggcaauacugcccauuggagcacgaagccgccaauuugucaacgaauuccuugugggcuacccccaaccaucgccaauggagauuucauuagcaccaacagagagaauuuucacuauggaucaguggugaccuaccgcugcaaucuuggaagcagagggagaaagguguuugagcuugugggugagcccuccauauacugcaccagcaaugacgaucaagugggcaucuggagcggccccgccccucagugcauuauaccuaacaaaugcacgccuccaaauguggaaaauggaauauugguaucugacaacagaagcuuauuuuccuuaaaugaaguuguggaguuuaggugucagccuggcuuugucaugaaaggaccccgccgugugaagugccaggcccugaacaaaugggagccagaguuaccaagcugcuccagggugugucagccgccuccagaaauccugcauggugagcauaccccaagccaucaggacaacuuuucaccugggcaggaaguguucuacagcugugagccuggcuaugaccucagaggggcugcgucucugcacugcacaccccagggagacuggagcccugaagccccgagaugugcagugaaauccugugaugacuucuugggucaacucccucauggccgugugcuauuuccacuuaaucuccagcuuggggcaaagguguccuuugucugugaugaaggguuucgcuuaaagggcaguuccguuagucauugugucuugguuggaaugagaagccuuuggaauaacaguguuccugugugugaacauaucuuuuguccaaauccuccagcuauccuuaaugggagacacacaggaacucccucuggagauauucccuauggaaaagaaauaucuuacacaugugacccccacccagacagagggaugaccuucaaccucauuggggagagcaccauccgcugcacaagugacccucaugggaaugggguuuggagcagcccugccccucgcugugaacuuucuguucgugcuggucacuguaaaaccccagagcaguuuccauuugccaguccuacgaucccaauuaaugacuuugaguuuccagucgggacaucuuugaauuaugaaugccguccuggguauuuugggaaaauguucucuaucuccugccuagaaaacuuggucuggucaaguguugaagacaacuguagacgaaaaucauguggaccuccaccagaacccuucaauggaauggugcauauaaacacagauacacaguuuggaucaacaguuaauuauucuuguaaugaaggguuucgacucauugguuccccaucuacuacuugucucgucucaggcaauaaugucacaugggauaagaaggcaccuauuugugagaucauaucuugugagccaccuccaaccauauccaauggagacuucuacagcaacaauagaacaucuuuucacaauggaacggugguaacuuaccagugccacacuggaccagauggagaacagcuguuugagcuugugggagaacggucaauauauugcaccagcaaagaugaucaaguugguguuuggagcagcccucccccucgguguauuucuacuaauaaaugcacagcuccagaaguugaaaaugcaauuagaguaccaggaaacaggaguuucuuuacccucacugagaucaucagauuuagaugucagcccggguuugucaugguagggucccacacugugcagugccagaccaauggcagaugggggcccaagcugccacacugcuccagggugugucagccgccuccagaaauccugcauggugagcauacccuaagccaucaggacaacuuuucaccugggcaggaaguguucuacagcugugagcccagcuaugaccucagaggggcugcgucucugcacugcacgccccagggagacuggagcccugaagccccuagauguacagugaaauccugugaugacuuccugggccaacucccucauggccgugugcuacuuccacuuaaucuccagcuuggggcaaagguguccuuuguuugcgaugaaggguuccgauuaaaaggcaggucugcuagucauugugucuuggcuggaaugaaagcccuuuggaauagcaguguuccagugugugaacaaaucuuuuguccaaauccuccagcuauccuuaaugggagacacacaggaacucccuuuggagauauucccuauggaaaagaaauaucuuacgcaugcgacacccacccagacagagggaugaccuucaaccucauuggggagagcuccauccgcugcacaagugacccucaagggaaugggguuuggagcagcccugccccucgcugugaacuuucuguuccugcugccugcccacauccacccaagauccaaaacgggcauuacauuggaggacacguaucucuauaucuuccugggaugacaaucagcuacauuugugaccccggcuaccuguuagugggaaagggcuucauuuucuguacagaccagggaaucuggagccaauuggaucauuauugcaaagaaguaaauuguagcuucccacuguuuaugaauggaaucucgaaggaguuagaaaugaaaaaaguauaucacuauggagauuaugugacuuugaagugugaagauggguauacucuggaaggcagucccuggagccagugccaggcggaugacagaugggacccuccucuggccaaauguaccucucguacacaugaugcucucauaguuggcacuuuaucugguacgaucuucuuuauuuuacucaucauuuuccucucuuggauaauucuaaagcacagaaaaggcaauaaugcacaugaaaacccuaaagaaguggcuauccauuuacauucucaaggaggcagcagcguucauccccgaacucugcaaacaaaugaagaaaauagcagguaccugguccuuccuugacaaaguacuauacagcugaagaacaucucgaauacaauuuuggugggaaaggagccaauugauuucaacagaaucagaucugagcuucauaaagucuuugaagugacuucacagagacgcagacaugugcacuugaagaugcugccccuucccugguaccuagcaaagcuccugccucuuugugugcgucacugugaaacccccacccuucugccucgugcuaaacgcacacaguaucuagucaggggaaaagacugcauuuaggagauagaaaauaguuuggauuacuuaaaggaauaagguguugccuggaauuucugguuuguaagguggucacuguucuuuuuuaaaauauuuguaauauggaaugggcucaguaagaagagcuuggaaaaugcagaaaguuaugaaaaauaagucacuuauaauuaugcuaccuacugauaaccacuccuaauauuuugauucauuuucugccuaucuucuuucacauauguguuuuuuuacauacguacuuuucccccuuaguuuguuuccuuuuauuuuauagagcagaacccuagucuuuuaaacaguuuagagugaaauauaugcuauaucaguuuuuacuuucucuagggagaaaaauuaauuuacuagaaaggcaugaaaugaucaugggaagagugguuaagacuacugaagagaaauauuuggaaaauaagauuucgauaucuucuuuuuuuuugagauggagucuggcucugucucccaggcuggagugcaguggcguaaucucggcucacugcaagcuccgccucccggguugacaccauuuuccugccucagccuccugaguaguugggauuaccaguagaugggacuacaggcaccugccaacacgcccggcuaauuuuuuuguauuuuuaguagagacgggguuucaccauguuagccaggauggucuggaucuccugaccucgugauccaccugccucggccucccaaagugcugcgauuacaggcaugagccaccgcgccuggccgcuuucgauauuuucuaaacuuuaauucaaaagcacuuugugcuguguucuauauaaaaaacauaauaaaaauugaaaugaaagaauaauuguuauuauaaaaguacuagcuuacuuuuguauggauucagaauauacuaaauuaacuuuuuaaaacacaacuuuuaaaaaauguaucaaaauaauaaacguguucugauauuuuuaaaauaagugaccuuguguucuuuaaccaguccacaucuuuagagaacaaaaauguguuaugauauuaugggccaugcuaaugaccucuagaaaacaucagaauauuucuggauauuuaauaauagcuuuauauaugacuaaugcucauuucuauguaauucuguuuaauaguugcuuuaaaggugaauuuugccacauuuacuuugacagcaguauaaggagugagauagacaugaaccugaauuucaauuuaaaaucauggaagagagggaaaaaaaaccagcuuaagaaaaaucaacugauaaacugcaagaaaaaaaugcaacuuacaucacaaaagcuaauugcuuuauuauuuagagaguacuuaaaaauuaaagaccaaacuucucuccacccaacaaaaaugggcaaaggacauacagcuaggucaccaagaaagaagggcaaauagguggugaguauauguaaagauacuugauaggacuuuugcuuaguugaaucuuuagcaaaucucuuuuauuucuugggauuuugaagaaguaauuuuuaaaggaggacuagaaacuaagugauugggaauuggccuuuuuagaauuaaaauuucccauuacaagaaaaaaaaauccuguguucuuuuuuuuuuccagaauggaguaggucagugagcaaugugauuaauaaauauuucaaugucugugacuuuugauuuauuuuggagacagggucuugcucuguuacccaggcuggagugcaguggugcuaucuaggcuuacugcaaccucaccugucacuuuuuaauugcaagaaagcugaaagguuuuuuucuauuauaucaguuauaaugauaaauacuguauauacuaacuaugaguaaaauacuauauugccuaacuuguauuauuaagcaauucugcuaaccugugaccuuacauuuucaucugaaaagcaggggcuggacaccaauugcccuaugaagcuauugcuaguccuaacauucuuuguuuuguuugcuuuuuuggcacacuuaaguguguacuaugaaguuuaugaugcuuuaaugaaauuuucugucucuaccauuguaaugagaaaggaauaaaauacuuuauuuugcaaaucua

SEQ ID NO: 600 - RNA, 3542 nt, Homo Sapiens
gcaggaagacggcgcugcccggaggagcggggcgggcgggcgcgcgggggagcgggcggcgggcgggagccaggcccgggcgggggcgggggcggcggggccagaagaggcggcgggccgcgcuccggccggucugcggcguuggccuuggcggcggcgguggagaagaugcugcagucccuggccggcagcucgugcgugcgccugguggagcggcaccgcucggccuggugcuucggcuuccuggugcugggcuacuugcucuaccuggucuucggcgcaguggucuucuccucgguggagcugcccuaugaggaccugcugcgccaggagcugcgcaagcugaagcgacgcuucuuggaggagcacgagugccugucugagcagcagcuggagcaguuccugggccgggugcuggaggccagcaacuacggcgugucggugcucagcaacgccucgggcaacuggaacugggacuucaccuccgcgcucuucuucgccagcaccgugcucuccaccacaggagucaguagaaaauggggagccucugugggcuccugguccugcaccgugauaaauagccuguccugcaaccuggcuuaaaacagggaaagccggaguuaggcaacagagugccuagcuuucucagucauucaaacacaagcacggaagaagagauugcacugaccagaggaccgccagggugugaugcuccguagucgcagggaugaaggaaaaccaugggcggagcuugucauggacagcuccuagguggacauaaauggaaacucauugguucuggggcacggcgggaagagggagacggcccuggacggccgcaccaagaauuucacaacccaaacccgacuagaaagccuggggcucccaauauuacaagucuguucuugacaaggaaguugggaugacagaacuacuguaugaaaacucagaaaugcucagaagugcagaccuuugguucuguuuucuuccucaucagauaggaauuuuuuuuaacuacgcacagaaucacacuugcgaagucuucuuuuccuucuuguuacuuuauuuagaagcugugaacucaagaaguaggucccauguugaaucuacaugugcgcaggugauucuuuuagccaagucauuuccacacucaugcccaagucuggagauacacaggugcggguuucugacaacaucaagauaugaaaggacugagaagagcuaaaccccaguagagccaaguugggagguggugaaaaaaauccaggugaauggggcuaagaccccauacccaggaagcgagcuggcaucagaagcagaagacugaggucauuuuuauggaugggagaugugcugguggguuuuuagaagagcucaugucaguuggcauccauuucuucaguaaggugagaagguccugaggguuuuaucuccugauuugguuagaagauuguugaaucuggcugugagagccuuucaagugccuaaaggagagagcuugaacuucccugagaguacaccagcuccuucugccuugugagauuagagugagaagucuaugaggaagcagcccucaccagacacugaaucugcuggugccuugaucagagacuucccagccacuaaaacuggacagucuucauugaugaccuuacuauuuaccacagaaguucaucuauguggcuccaaacucuauuucaagaauaugaaaggcauguagguuaugccuacguucucggacccuugauagauguuuugcugacccaccuucugauaucuguagaguuacccuaggcuccaccuuccaccaaccaguucugugucaaagugcaaaaugaaaaucacagaaaaagucaaccugaccugaagcuuauucaucaccgugcaaugaguuucaccauacaguuauggccacaccgugcccuugucagauggagguaaggccuucugcaucaucuacuccgucauuggcauucccuucacccuccuguuccugacggcugugguccagcgcaucaccgugcacgucacccgcaggccgguccucuacuuccacauccgcuggggcuucuccaagcaggugguggccaucguccaugccgugcuccuuggguuugucacuguguccugcuucuucuucaucccggccgcugucuucucaguccuggaggaugacuggaacuuccuggaauccuuuuauuuuuguuuuauuucccugagcaccauuggccugggggauuaugugccuggggaaggcuacaaucaaaaauucagagagcucuauaagauugggaucacguguuaccugcuacuuggccuuauugccauguugguaguucuggaaaccuucugugaacuccaugagcugaaaaaauucagaaaaauguucuaugugaagaaggacaaggacgaggaucaggugcacaucauagagcaugaccaacuguccuucuccucgaucacagaccaggcagcuggcaugaaagaggaccagaagcaaaaugagccuuuuguggccacccagucaucugccugcguggauggcccugcaaaccauugagcguaggauuuguugcauuaugcuagagcaccagggucagggugcaaggaagaggcuuaaguauguucauuuuuaucagaaugcaaaagcgaaaauuaugucacuuuaagaaauagcuacuguuugcaaugucuuauuaaaaaacaacaaaaaaagacaaauggaacaaagaagcugugaccccagcaggaugucuaauaugugaggaaaugagauguccaccuaaaauucauaugugacaaaauuaucucgaccuuacauaggaggagaauacuugaagcaguaugcugcugugguuagaagcagauuuuauacuuuuaacuggaaacuuugggguuugcauuuagaucauuuagcugauggcuaaauagcaaaauuuauauuuagaagcaaaaaaaaaaagcauagagauguguuuuauaaauagguuuauguguacugguuugcauguacccacccaaaaugauuauuuuuguagaaucuaaguuaaacuuacuauuuauaaugcauagguaaccauuaacuauguacauauaaaguauaaauauguuuauauucuguacauaugguuuaggucaccagauccuaguguaguucugaaacuaagacuauagauauuuuguuucuuuugauuucucuuuauacuaaagaauccagaguugcuacaauaaaauaaggggaauaauaaacuugagagugaauaaccauaguauucugcugcaauaaauguuucuacccucuugcgauagaauggugucagaugucuaacauguuuauaaacauuuuuuugaauugaacagguuaugaaaaggauuuauuaaaagguuaagauacuuuguuuugaaaguacauugugauuugcagccaccuagcacuaaagcauagaacuuaaacacgaaucccuaaaugaacagauuauguuacauuaaucugagaauuuuaaauuuagaagcuaaaauaaauaaaaaucacagcugguugu

SEQ ID NO: 601 - RNA, 1342 nt, Homo Sapiens
caucugcaugugcccccuuaucuaauucuuugguuguuucucuguaauagcugguggauuaugggaaaggacaaugccaguuaccuacaggcauucauccuggugggcucuucugaucggccuggacuggagaaaauucucuuugcuguuaucuugaucuucugcauccugacccuggugggcaacacugccaucauccucuugcuggucauggaugucaggcuccacacacccauguacuucuuucuugggaaucugucuuucuuagaucucugcuuuacagcaagcauugccccucagcugcuguggaaccugggggguccagagaagaccaucaccuaccacggcuguguggcccaacucuacaucuacaugaugcugggcuccaccgagugcguccuccugguugucaugucccaugaccgcuauguggccgucugccggucccugcacuacauggcagucaugcgcccacaucucugccugcagcuggugacuguggccuggugcuguggcuuccuaaacuccuucaucauguguccucagacgaugcagcucucccgguguggacgucgcaggguggaccacuuccugugugagaugccugcucuuauugccaugucuugugaggaaaccaugcugguagaagcgauucaccuuugcccuggggguggcucuccuccuggugccgcucucccucauccucaucuccuauggcgugauugcagccgcggugcugaggaugaagucagcagcagggcgaaagaaagccuuccacaccugcucuucucaccucacaguggucucucucuucuacggaaccaucaucuacguguaccugaagccggccaacagcuacucccaagaucaggggaaguuccugacucucuucuacaccaucgucauucccagcaucaacccccucaucuacacuuugaggaacaaggaugugaaggggaccaugaagaaacuucuggggugggagaaaggggcuggggagccucaacgaggggaacacucuaguaauguagacaguuugcuggaguuacucucuuagaugugucuguggccauguggagaacuaauauucaaggaguagagugaacgcgggugggaaaaugcuuucgaguuugaccccguccucugcccucuggaugugaagugguuuccuucuguuugaaguugccugcuucaggauaucucugcuguaucuugcacuuuccuugucuuuuugauuuauccacaacugcuggggacuuacaaaacuaauucaaucacccaaaggcacugggcagucugcagauuaugucauggaugucaaauaaaaauugagacaacauga

SEQ ID NO: 602 - RNA, 6329 nt, Homo Sapiens
agggcugucacagagcuguggugggaauuucccaugagaccccgccccuggcugagucaccgcacuccuguguuugaccugaaguccucucgagcugcagaagccugaagaccaaggaguggaaaguucuccggcagcccugagaucucaagagugacauuugugagaccagcuaauuugauuaaaauucucuuggaaucagcuuugcuaguaucauaccugugccagauuucaucaugggaaacagcuguuacaacauaguagccacucuguugcugguccucaacuuugagaggacaagaucauugcaggauccuuguaguaacugcccagcugguacauucugugauaauaacaggaaucagauuugcagucccuguccuccaaauaguuucuccagcgcagguggacaaaggaccugugacauaugcaggcaguguaaagguguuuucaggaccaggaaggaguguuccuccaccagcaaugcagagugugacugcacuccaggguuucacugccugggggcaggaugcagcaugugugaacaggauuguaaacaaggucaagaacugacaaaaaaagguuguaaagacuguugcuuugggacauuuaacgaucagaaacguggcaucugucgacccuggacaaacaucagaguggcugacgaauggaaucaugauucacaagaaaaguauugacuauuuucucggacuuagcugaauucugucuuuggaaaguggcuuuuuuaaaaagcuguucuuuggauggaaagucugugcuugugaaugggacgaaggagagggacguggucuguggaccaucuccagccgaccucucuccgggagcauccucugugaccccgccugccccugcgagagagccaggacacucuccgcagaucaucuccuucuuucuugcgcugacgucgacugcguugcucuuccugcuguucuuccucacgcuccguuucucuguuguuaaacggggcagaaagaaacuccuguauauauucaaacaacguaagauuaacauaaucauauuacagcucuggcaaauggaagcaguggggauaccuucacaauccuggagucauaacacugcauuccaaggaaaccaucggaucucgaaucucaguaacccucaagacgaaaauaagugcugcugaauugaaacuagagcuaugauugggauauggcuaauauuuuaugguuuagugauucaugcuuaagauucaugcuuuuuuagcuaauguagaaaauaaagaaaauaguucuuacauuuaugagaccaguacaaacuacucaagaggaagauggcuguagcugccgauuuccagaagaagaagaaggaggaugugaacugugaaauggaagucaauagggcuguugggacuuucuugaaaagaagcaaggaaauaugagucauccgcuaucacagcuuucaaaagcaagaacaccauccuacauaauacccaggauucccccaacacacguucuuuucuaaaugccaaugaguuggccuuuaaaaaugcaccacuuuuuuuuuuuuuuugacagggucucacucugucacccaggcuggagugcaguggcaccaccauggcucucugcagccuugaccucugggagcucaagugauccuccugccucagucuccugaguagcuggaacuacaaggaagggccaccacaccugacuaacuuuuuuguuuuuuguuugguaaagauggcauuucaccauguuguacaggcuggucucaaacuccuagguucacuuuggccucccaaagugcugggauuacagacaugaacugccaggcccggccaaaauaaugcaccacuuuuaacagaacagacagaugaggacagagcuggugauaaaaaaaaaaaaaaaaaagcauuuucuagauaccacuuaacagguuugagcuaguuuuuuugaaauccaaagaaaauuauaguuuaaauucaauuacauaguccagugguccaacuauaauuauaaucaaaaucaaugcagguuuguuuuuuggugcuaauaugacauaugacaauaagccacgaggugcaguaaguacccgacuaaaguuuccguggguucugucauguaacacgacaugcuccaccgucaggggggaguaugagcagagugccugaguuuagggucaaggacaaaaaaccucaggccuggaggaaguuuuggaaagaguucaagugucuguauauccuauggucuucuccauccucacaccuucugccuuuguccugcucccuuuuaagccagguuacauucuaaaaauucuuaacuuuuaacauaauauuuuauaccaaagccaauaaaugaacugcauaugauagguaugaaguacagugagaaaauuaacaccugugagcucauuguccuaccacagcacuagagugggggccgccaaacucccauggccaaaccuggugcaccauuugccuuuguuugucuguugguuugcuugagacagucuugcucuguugcccaggcuggaauggaguggcuauucacaggcacaaucauagcacacuuuagccuuaaacuccugggcucaagugauccacccgccucagucucccaaguagcugggauuacaggugcaaaccuggcaugccugccauuguuuggcuuaugaucuaaggauagcuuuuuaaauuuuauucauuuuauuuuuuuuugagacagugucucacucugucucccaggcuggaguacagugguacaaucuuggaucaccgccucccaguuucaagugaucucccugccucagccuccuaaguagcugggacuacagguaugugccaccacgccuggcuaauuuuuauauuuuuaguagagacgggguuucaccauguuguccaggcuggucucaaacuccugaccucaggugaucugcccaccucugccucccaaagugcugggauuacaggcaugagccaccaugccuggccauuucuuacacuuuuguaugacaugccuauugcaagcuugcgugccucugucccauguuauuuuacucugggauuuagguggagggagcagcuucuauuuggaacauuggccaucgcauggcaaauggguaucugucacuucugcuccuauuuaguugguucuacuauaaccuuuagagcaaauccugcagccaagccaggcaucaauagggcagaaaaguauauucuguaaauaggggugaggagaagauauuucugaacaauagucuacugcaguaccaaauugcuuuucaaaguggcuguucuaauguacucccgucagucauauaagugucauguaaguaucccauugauccacauccuugcuacccucugguacuaucaggugcccuuaauuuugccaagccaguggguauagaaugagaucucacuguggucuuaguuugcauuugcuugguuacugaugagcaccuugucaaauauuuauauaccauuuguguuuauuuuuuuaaauaaaaugcuugcucaugcuuuuuugcccauuugcaaaaaaacuuggggccgggugcaguggcucaugccuguagucccagcucuuugggaggccaaggugggcagaucgcuugagcccaggaguucgagaccagccuuggcaacauggcgaaacccugucuuuacaaaaaauacaaaaauuagccgggugugguggugugcaccugaagucccagcuacucaguagguucgcuuugagccugggaggcagagguugcagugagcugggaccgcaucacuacacuucagccugggcaacagagaaaaaccuuuucucagaaacaaacaaacccaaaugugguuguuuguccugauuccuaaaaggucuuuauguauucuagauaauaaucuuuggucaguuauauguguuaaaaaauaucuucuuuguggccaggcacgguagcucacaccuguaaucccagcacuuugcggggcugagguggguggaucaucugaggucaagaguucaagaucagccuggccaacacagugaaaccccaucucuacuaaacauguacaaaacuuagcuggguaugguggcgggugccuguaaccccagcugcuccagaggcuguggcagaagaaucgcuugaacccaggaggcagagguugcagcgagccaagauugugccauugcacuccagacugggugacaagagugaaauucugccuaucuaucuaucuaucuaucuauaucuauauauauauauauauauauccuuuguaauuuauuuuucccuuuuuaaaauuuuuuauaaaauucuuuuuuauuuuuauuuuuagcagaggugagguuucugagguuucauuauguugcccaggcuggucuugaacuccugagcucaagugauccucccaccucagccuuccaaagugcuggaauugcagacaugagccaccgcgccccuccuguuuuucucuaauuaauggugucuuucuuugucuuucugguaauaagcaaaaaguucuucauuugauuugguuaaauuuauaacuguuuucucauaugguuaacauuuuuucuugccuggcuaaagaaauccuuuucugcccaauacuauaaagagguuugcccacauuuuauuccaaaaguuuuaaguuuugucuuucaucuugaagucuaauguaucaggaacuggcuuuugugccuguugggagguagugauccaauuccaugucuugcauguagguaaccacuggucccugcgccauguauucaauacgucgucuuucuccugcgggucugcaaucucaccuaccauccaucaaguuuccauagggccaugggucugcuucugggcucccuguucuguuccauugucaauuugucuauccugugccaguaucacacuguguuuauuacaauagcuuuguaacagcucucgauauccgguaggacaucucccuccaccuucuuuuucuacuucagaagugucuuagcuaggucaggcacgguggcucacgccuguaaucccagcacuuugggaggccgacgcggauggaucaccugaggucaggaguuuugagacagccuggccaacauggugaaaccccaucucuacuaaaaaauacaaaaauuagucaggcaugguggcaugugccuguaaucccagcuauuugggaggcugaggccggagaauugcuugaacccggggggcggagguugcagugagccgagaucguaccauugcacuccagccugggugacagagcgaaacucugucucaggaaaaaaaagaaaagagaugucuugguuauucuugguucuuuauuauucaauauaaauuuuagaagcugaauuugaaaagauuuggauuggaauuucauuaaaucuacaggucaauuuagggagaguugauaauuuuacagaauugagucaucugguguuccaauaagaauaagagaacaauuauuggcuguacaauucuugccaaauaguaggcaaagcaaagcuuaggaaguauacuggugccauuucaggaacaaagcuaggugcgaauauuuuugucuuucugaaucaugaugcuguaaguucuaaagugauuucuccucuuggcuuuggacacaugguguuuaauuaccuacugcugacuauccacaaacagaaagagacuggucaugccccacaggguugggguauccaagauaauggagcgaggcucucauguguccuagguuacacaccgaaaauccacaguuuauucugugaagaaaggaggcuauguuuaugauacagacugugauauuuuuaucauagccuauucugguaucaugugcaaaagcuauaaaugaaaaacacaggaacuuggcaugugagucauugcucccccuaaaugacaauuaauaaggaaggaacauugagacagaauaaaaugauccccuucuggguuuaauuuagaaaguuccauaauuagguuuaauagaaauaaauguaaauuucuaugauuaaaaauaaauuagcacauuuagggauacacaaauuauaaaucauuuucuaaaugcuaaaaacaagcucagguuuuuuucagaagaaaguuuuaauuuuuuuucuuuaguggaagauaucacucugacggaaaguuuugaugugaggggcggaugacuauaaagugggcaucuucccccacaggaagauguuuccaucugugggugagaggugcccaccgcagcuagggcagguuacaugugcccugugugugguaggacuuggagagugaucuuuaucaacguuuuuauuuaaaagacuaucuaauaaaacacaaaacuaugauguucacaggaaaaaaagaauaagaaaaaaaga

SEQ ID NO: 603 - RNA, 2209 nt, Homo Sapiens
ggacacgccuuagggaaaccgcuccugggcuugguagcugaacuuagacgucgagugcagcccgcccggugcgcgcggcgucuuacugccagaucucggaaaucagcugccaggguggggccgcguuuuggcgacggccacucggccaccccugccgcucccgccucucccaagagauuuuucuagcggguuaauuuccuguccggguaaacccuuuggugagucccucgccccucccuccccgccccuccccucuccaucccugcugucccggcuccccaguccguccgcgccgcgcuccaucgcccccgcacgcccgggcgcacgcccuccccgcccgggccgcccucuggcuccccgcgcccggcagccagugccucaccgcgccgucccgcgccagggcucgcuccgagagccgcuuccuucucgccgcggccggcgcgggccccccggccaugcgcccccgagccccagccugcgccgccgcggcgcucgggcucugcagccuucugcugcugcucgcgcccgggcacgcgugccccgcgggcugcgccugcaccgacccgcacaccguggacugccgcgaccgcgggcugcccagcgugccagacccuuucccccuggacgugcgcaagcugcugguggccggcaaccgcauccagcggauccccgaggacuucuucaucuucuacggcgaccuggucuaccuggacuucaggaacaacucgcugcgcucgcuggaggagggcacguucagcggcucggccaagcucguguuccucgaccucagcuacaacaacuugacccagcugggcgccggcgccuuccgcucggccgggaggcuggugaagcuuagccuggcuaacaacaaccuggugggcgugcacgaggacgccuucgagacccuggagucgcugcaggugcuggagcucaacgacaacaaccugcgcagccucagcguggccgcccuggccgcgcugcccgcgcugcgcucccugcgucuggacgggaaccccuggcugugcgacugugacuucgcccaccucuucuccuggauccaggagaacgcauccaaacugcccaaaggccuugaugaaauccagugcucccugcccauggagagcaggaggauaucccugcgugagcugucggaggccagcuucagcgaguguagguucagccugucacucacagaccucugcaucaucauuuucuccgguguggccguguccauugcggccaucaucuccagcuucuuccuggccacuguggugcagugccuccagaggugcgcacccaacaaagaugcggaggaugaagacgaggacaaggaugacugagccaccuccucccuccugccucuuacucuccagcaccgaaccagaagcucucuccaagacgagagggaaaugcugaaaauggaaaagcacuggccaccaucugugaacugaacagagccuguuccgugucuuggccccuggguacaccugcugggaccacugaucucagaguuuagaaucagcagagcacagaagcccaggaaggauggagggaauuauuccuggagcauaaccugccucucagaucgagguguguguugggggagaagaugaccgagucaggcuucauagcugaugacuaaaagccucccccaggaaaugugaagacuggcagcuuucaauggcaaagaugauuuuacgccauucuuuuucugaccuguacugggagaucaugaaacaucugccuuccucccaagaaacagcagcucaaacaguggagauucaaauucggaucauucaccacaagaacgagaacuuugauccuuauauaauaggccucagcaaccuugggauguuauacugggaacuaauaaacucgugugcaauagacucaauguuuauguucccccagauuuuauauguugaaaccuaauccccaaugugaugguauuuggagguggggcuuuugggaggugauuagguuuagaucauaucaugaggauggggcccaaaugaugggauuagugcccucaugaaagguggccccagagagcuccuucaccccuucaaugcuugaggaugcagcaagaaaucagcugcccaugaaccgagaagcaggcccucaccagaacccagccaugcuggcacccagaucucagacuuccagccuccagaacugggagaaauaaauaaaugucuguuguuuguaa

SEQ ID NO: 604 - RNA, 559 nt, Homo Sapiens
aggucauagaaguuuggcuucucucauugaccuggaaggaugccgucauccacucugaccugcaaaccuuuugaucucaaacagcgaucuuccaggcguggccccaaaucaacagcaucagcgucacccaggagcugccugaagcccucuugugggaagcaaguuugucugcuccuuucugugagacguucccagucacuggcucacccugggagagacaguacgcguguucuaagcuaccaacagacuuccucagaugcagugagucaguacaaacacacaggcaagguugaagaacucuauggccuucgucucucuuggcucagccaggcacaguuccucuuagcccaagacaaaacagccuaugcuguuaaaucagugguucuaccagcuuccaaucauaaaaccaaggggcaauaauacauaaaauuggaacuuauagauucuuucccaaaacccaaaggcccaguccagucacgagaagacaucaggcaaaccgaaauucagggaaguucuacaaaacacuaaccaguacucuucaaaguucucaaggucauga

SEQ ID NO: 605 - RNA, 8843 nt, Homo Sapiens
gggauccugaggagccagugggcugcaggcgcaggcgcaggcgaggggcuggguggcgguugagacagcggcgguacugggaggcguaggugagggucgcgaggcugcccgagcuucugagcgagcgcggugcuuuugggaacgcgggacgggcgaucugcggcgccaggagcugggccgaggcgcggcggcgcggcugccggcugcccugugaaugggaaguuacgcgaaguccacccagcguuucugaggcaaucugaaggcaaauccuguuuagacccaggcgaagguucccggugacccgggcucucaccagccaauugucccuugccguccuccugagggugccuggagcuuaagcacugugugcucuuggccuccacacuggggaugccgcugacucccacuguccagggcuuccaguggauucuccgaggcccugauguagaaacuuccccauugggugcaccaagagcagccucacauggugugggcugacaucaagagcugccagauccaacagguccugggggaguaggagccagugcaaggagagaaguccauugagaaaggcaaauggaugacaucagacccaggggcugagguccccaacugcagcuggguagcuucuggaguggacaaggagcaacagggaaguucguggccugguguucugggauccacugucucaucucauucuugugggcaccagaacguauccaaagacaagacucagugucucuggcaacagugagccagagauagaauguguuucagaggaggaggaagggguuguuguaccccauggaaacaguauauuguuuuacaguagcgugucuuucucuaauaacuacuuagcguguuccuguuaauggaaaauauuggugguguaaguuuccccacuguucucaucuucauguaaauuuguucauuuccuuccuuccuuccuuccuucccuacuucccuccaacucucuuucucucucuuuuuauucuuucccuccuucccacccgcccuccaucccucccuuccuuccuccuucccuccuucccucccuucuuuccuuucuuccuuucuucuuuucuucuucuuucucucucaugcucucucuuuuucuuuccuuuucauucucucuacuuuuuugaagagaucacacuguacugaaaccuacauuauuuuccaaaaucucuggaucugcuucugucuugcaggcagagagcucauccaguagcccuuagcucuucccagcccccuccuuugauuugugggugccacugcggcagcugcugagucucagugguuucuggucuucaccaaguucugcccacccagaugguuuuuaccuguccucaccagaaaccugcacugucuagauugcugaggcugcuucuccuuaaccgaucugcuaucuguauuccaggggcaccccaggguuagagguaaauggcacaggccuugaaaucuccaacugcucugacuccagguuggugcacuucaaugccaaguacuaaccacacaauuacaggaugccaccaaaaccuugauauggggcugcugcauccuaauuaaaaaaacaguuaauagacauuauuuuuuagaacaguucuagguuuacagaaaacuugaguggauaauacagagaguucuccuaggcuccccuguccuccagcacacaauuuucccuacuaguauguuguauuagugugguccauucauuacaauugaugaaccacuguugauacgucauuaucaacuaaaguccauaguuuacauuagaggucauucuuugaguuucacagauuauggguuuuggcaauuacauaauguccuaaauccccaauacagcaucaugcgaaagaguuucacugcugaaaauucccugugcuucaccauuucacgcguccuccucuccuccaccccugacaaccacucaccauuuuacuacuucuaucuuuuugacuuuccaagaauguccuagaguuggagugguacaguauguggguuuccagacuggcuucuuucuagcauuauguacuuuaaguuccuucaugucuuuucauggcuugauaacuuguuuuuuaaaaucagugaaucagauuuccuuguauggcuacaacaguuuguuuauucuuucgcuuggugaaagacaucuugggcacuuccaaguuuuggcgaugaugaauaaaauugcuguaaguacuucugugcaggauuuugagugaacuuaaguuuuccaaagugacuguacccuuuugauuuccacuagcgauggaaaguucugguugcuccucaucuuugacagcauuugguguguucaccuuuuugaauuuuagccauucuaaacagcuuaucugccccuacuguggaaugaugugacagacauagaauaacacuuacagugauucuaguucaaaaugaggcaacauggaagggauaaagaagucacugacccaaaauaguuuggaaauggagcugggcaaaauccagcagaaguuucuuaauuaggaucgacagccugggaccggcccgccguccugugggucuuugccucugggcugucugcugugcauuucuuggaaccauuauuauuuaucuuuuuuucucacacuuuuuuggguauggcuucuaucgcacuccaaauguuuuugagauucauccauguuguucugugugucaccaguuuguuccuuuagccauuccauggaaugaguguaucacaguuuauugauccauucuuguauugacagauacuugaauguuuccaguuuuuuguauuaugaauaaaacugcuaugaaccccuugaagauaaggauggucaaacaaaauaauauuauaucugcagaaagucagaucuugguaagauuuacuaguugggaauccaauguuaaugccaagaagcagcugccaguugggaucaaaugugagccuauggaucaaggaaugccuggacacaguagacaaaaguuguucaacuggacgccuuaggauacacgcuaccaaaaacaaaguagccaaaaaggaaccagaauaacagaauaucagagccagaggaacauuuggaggaagauggccaaucuuuccuaagcugcucaccuuacaagaaaacgaaucguacugcuaagaauucaaacuucagcagucauggggagccuuggaaggagcccgaaucacugauggaauuggacagugcauggagaugguucagcaggacaaggugcugaaaacucauccccgugugaccucaaguaagccauguaacucugugaaccugcaguuuuaucauuuuuaaaauaaagaaacaugacagauuuucauuaugacacagaaugucaggucucccagaugccagaaaauacauuuacuuaaagccguugauacgucuuaaagcgguuuccuuacagugucauuggaggacaguguggagugcagagagacaugcuuugaaaugggauugauccaguccuccuuccuucacuaccacaugaaugcugggcagcccagggucaacccaccgcacccucaacucagacgguuaccuggcacgcuggccacagucuaccucacucuuaucagagucugagcuacuggcagugcuuucagcucugaguucaggcaccucgaaccuuguuuuuguggugaaggauccuaaagugcuguggggagugaucacauuuuucacaacaucccuggcuccaccucuucugccacaaacgucagcauggugguaucagcuggcccuugguccagcgagaaggcagagacgaacauuuuagaaaucaacgagaaauugcgcccccagcuggcagagaacaaacagcaguucagaaaccucaaagagaaauguuuuguaacucaacuggccggcuuccuggccaaccgacagaagaaauacaaguaugaagaguguaaagaccucauaaaauuuaugcugaggaaugagcgacaguucaaggaggagaagcuugcagagcagcucaagcaagcugaggagcucaggcaauauaaaguccugguucacucucaggaacgagagcugacccaguuaagggagaaguuacgggaagggagagaugccucccgcucauugaaucagcaucuccaggcccuccucacuccggauaagccagacaagucccaggggcaggaccuccaagaacagcuggcugagggguguagacuggcacagcaacuuuuccagaagcucagcccagaaaaugacgaagaugaggaugaagauguucaaguugaggaggcugagaaaguacuggaaucaucugcccccagggaggugcagaaggcugaagaaagcaaagucccugaggacucacuggaggaaugugccaucacuuguucaaauagccacagcccuugugacuccaaccagccucacaagaacaucaacaucaccuuugaggaagacaaagucaacucaacucugguuguagacagagaauccucucaugaugaaugucaggaugcuguaaacauucucccagucccuggccccaccucuucugccacaaacgucagcauggugguaucagccggcccuuuguccagcgagaaggcagagaugaacauucuagaaaucaacgagaaauugcauccccagcuggcagagaagaaacagcaguucagaaaccucaaagagaaauguuuuguaacucaacuggccugcuuccuggccaaccagcagaacaaauacaaauaugaagagugcaaagaccucauaaaaucuaugcugaggaaugagcgacaguucaaggaggagaagcuugcagagcagcucaagcaagcugaggagcucaggcaauauaaaguccugguucacucucaggaacgagagcugacccaguuaagggagaaguuacgggaagggagagaugccucccgcucauugaaucagcaucuccaggcccuccucacuccggauaagccagacaagucccaggggcaggaccuccaagaacagcuggcugagggguguagacuggcacagcaacuuuuccagaagcucagcccagaaaaugacgaagaugaggaugaagauguucaaguugaggaggcugagaaaguacuggaaucaucugcccccagggaggugcagaaggcugaagaaagcaaagucccugaggacucacuggaggaaugugccaucacuuguucaaauagccacggcccuugugacuccaaccagccucacaagaacaucaacaucaccuuugaggaagacaaagucaacucagcucugguuguagacagagaauccucucaugaugaaugucaggaugcuguaaacauucucccagucccuggccccaccucuucugccacaaacgucagcauggugguaucagccggcccuuuguccagcgagaaggcagagaugaacauucuagaaaucaacgagaaauugcauccccagcuggcagagaagaaacagcaguucagaaaccucaaagagaaauguuuuguaacucaacuggccugcuuccuggccaaccagcagaacaaauacaaauaaaaugaagagugcaaagaccucauaaaaucuaugcugaggaaugagcgacaguucaaggaggagaagcuugcagagcagcucaagcaagcugaggagcucaggcaauauaaaguccugguucacucucaggaacgagagcugacccaguuaagggagaaguuacgggaagggagagaugccuccugcucauugaaucagcaucuccaggcccuccucacuccggaugagccagacaagucccaggggcaggaccuccaagaacagcuggcugagggguguagacuggcacagcaccuuguccaaaagcucagcccagaaaaugacaacgaugacgaugaagauguucaaguugagguggcugagaaagugcagaaaucgucugcccccagggagaugccgaaggcugaagaaaaggaagucccugaggacucacuggaggaaugugccaucacuuguucaaauagccauggcccuuaugacuccaaccagccacauaggaaaaccaaaaucacauuugaggaagacaaagucgacucaacucucauuggcucauccucucauguugaaugggaggaugcuguacacauuaucccagaaaaugaaagugaugaugaggaagaggaagaaaaagggccagugucucccaggaaucugcaggagucugaagaggaggaagucccccaggaguccugggaugaagguuauucgacucucucaauuccuccugaaauguuggccucguacaagucuuacagcggcacauuucacucauuagaggaacagcaagucugcauggcuguugacauaggcggauuggacagaggaauguuucugugugcaaggaagaacugcuuaauguaagaggccccaucugaauuuauuugcaggacaucggugggaucaagugaaaaaggaggaccaagaggcaacaggucccaggcucagcagggagcugcuggaugagaaagggccugaagucuugcaggacucacuggauagauguuauucaacuccuucagguuaucuugaacugacugacucaugccagcccuacagaagugccuuuuacauauuggagcaacagcguguuggcugggcucuugacauggaugaaauugaaaaguaccaagaaguggaagaagaccaagacccaucaugccccaggccaggcucagcagggagcugcuggaggcaguagagccugaagucuugcaggacucacuggauagauguuauucaacuccuuccaguugucuugaacagccugacuccugccugcccuauggaaguuccuuuuaugcauuggaggaaaaacauguuggcuuuucucuugacgugggagaaauugaaaagaaggggaaggggaagaaaagaaggggaagaagaucaacgaagaaaagaaggagaaggggaagaaaagaaggggaagaagaucaaaacccaccaugccccaggcucagcggcaugcugauggaaguggaagagccugaagucuugcaggacucacuggauagauguuauucgacuccgucaauguacuuugaacuaccugacucauuccagcacuacagaaguguguuuuacucauuugaggaacagcacaucagcuucgcccuugacguggacaauagguuucuuacuuugaugggaacaagucuccaccuggucuuccagaugggagucauauucccacaguaagcagcccuuacuaagccgagagaugucauuccugcaggcaggaccuauaggcacgugaagauuugaaugaaacuauaguuccauuuggaagcccagacauaggaugggucagugggcauggcucuauuccuauucucagaccaugccaguggcacccugugcucagucugaagacaauggacccaaguuaggugugacacguucacauaacugugcagcacaugccgggagugaucagucagacauuuuaauuugaaccacuuaucucuggguagcuacaaaguuccucagggauuucauuuugcagucaugucucugagcuucuauaccugcucaaggucagugucaucuuuguguuuagcucauccaaagguguuacccugguuucaaugaaccuaaccucauucuuuguaucuucaguguugaauuguuuuagcugauccaucuuuaacacaggagggauccuuggcugaggauuguauuucagaaccaccaacugcucuugacaauuguuaacccgcuaggcuccuuugguuagagaagccacaguccuucagccuccaauuggugucaguacuuaggaagaccacagcuagauggacaaacagcauugggaggccuuagcccugcuccucucgauuccauccuguagagaacaggagucaggagccgcuggcaggagacagcaugucacccaggacucugccggugcagaauaugaacaacgccauguucuugcagaaaacgcuuagccugaguuucauaggagguaauuaccagacaacugcagaauguagaacacugagcaggacaacugaccugucuccuucacauaguccauaucaccacaaaucacacaacaaaaaggagaagagauauuuuggguucaaaaaaaguaaaaagauaauauagcugcauuucuuuaguuauuuugaaccccaaauauuuccucaucuuuuuguuguugucauugaugguggugacauggacuuguuuauagaggacaggucagcucucuggcucaaugaucuacauucugaaguugucugaaaaugucuucaugauuaaauucagccuaaacguuuugccgggaacacugcagagacaaugcugugaguuuccaaccuuagcccaucugcgggcagagaaggucuaguuuguccaucagcauuaucaugauaucaggacugguuacuugguuaaggaggggucuaggagaucugucccuuuuagagacaccuuacuuauaaugaaguauuugggagggugguuuucaaaauuagaaauguccuguauuccaaugaucauccuguaaacauuuuaucauuuauuaaucaucccugccugugucuauuauuauauucauaucucuacgcuggaaacuuucugccucaauguuuacugugccuuuguuuuugcuaguguguguuguugaaaaaaaaaacauucucugccugaguuuuaauuuuuguccaaaguuauuuuaaucuauacaauuaaaagcuuuugccuaucacucuggacuguuggauuguuuuuuacauucaguguuauaaucuuuuguuaugcugauugguuuugguggguacugaugugaauuaauaaaaacauuuccauuuc

SEQ ID NO: 606 - RNA, 8966 nt, Homo Sapiens
ggauguugugaaccgggucgcggcggccgaggcucgggccuccaggaccacuggcugcccaugagagacgaaggauggcauccaagggggccggcgugucuuucucccgcaagagcuguaggcugaccucagaugcugagaaauccagggucacaggaacuccugaccucagggacccgcugcagcugggaggggagcuguccaggaggccggccugggaaugagcacaggccugcggcuggcagagagccgggucgagccagcccuggagaagcaggcccagcuggaggagcagcugcgggacaaggugcuccacgagaaggaccugucccagcagcagaugcaaagcgaccuggacaaggcugaccucagugccaggagggucccuggugggugcugcaugaggcaggcgucacugcagaagagugacagagcugggccuggcagugaagcgucuacagaagcagaaucuggagaaggaucaggucgacaaggaccucaccgagaagcuugaggcccuggaaucccugcggcuacaggagcaggcggcccuggagacagaggauggagaggggcuacagcggagccuaagggaccuggcacaggccguccugucugacgcugagagcggcagccugcguccaacagcguccgaccgcagccugcgggggcucucgggccagcggaccccgucuccaccgcggcgcuccucgccgggccgaggccguucgccccgcagaggccccuccccggccugcucagaagacuccacgcucgcuugcccugauucucuccgcccugcacuuuugccagcugaagguccagguaggaaggggcuugaguuuucugggcgcagccagaggcccagggggaggggcucgcgcccuccaggugggggugggggcgugucugggggaggagucugagcgcccuggggugcagccagagcccugagaaauagugucugagggugucaggacccccaaggagguggucgagggcucugcgcugaagccagcccagaagugggggugcuugggcagcugggggugggugcuugggcagccgguggagggaggaggcugcgacaguguuaggguccugguagagagggagacaggucccuggucauacagagccaggacccugggaaaaggucuagcaagggaaaucacagccuaggaugagagcuugggaacuaggggcagagccaggguagggaggagugugagaguggaaccaggaugcaagggggaggagccugggagcccugggggugggaucagaacccaggagacgagugugccugggaguuugucuggcaucccgggggcuuugauaggaguuguccgggaccccagggagaugaggguucagaggguggugagggcacauaggaggggaguggaagccuggcucucaggccuaggccccuauccugccccagggcagguccaggcccuggaccccgccuagcguaggcuaguguguaucccuggaaccagaagagaguaggugggcucuggaggccucaaaggacccccgcuagacucugugauccccacgccccagaacaugcgugggcgcuaugaggcaagccaggaccugcugggcacccugcggaagcagcuuagcgacagcgagagugagcggcgggcccuagaggaacaccugcguggcgccgucggucuugucccgcaggcacuggccaacauggcgaaaccccaucucuacuaaaaauuuaaaaaauugcccaggcacaguggcuaacgccuguaaucccagcacuuugggaggccgaggcgugcagaucacuugaggucaggaauuugagaccagccuggccaacauggugaaaccccacuucuaaauaaaaaugcaaaaauuagcugggcguggugauaggcgcuuguaaucccagcuacucgggaggcugaggcaggagaaucgcuugaacucuggagguggagauugcagcaagcuguguggagugcagugagauugugucacugcacuccagccuaggcaagagugagacuguguguagggagaagagcaaccugguccacagccugcagguggcccagcagcaggccgaggagcugccgcaggagcgggagaagcugcagguugcccaggaggagcugcagcgccagcgggaccggcuggaggaagagcaggaagaggcggugcagaauggcgcacggguucgccgggagcuugagcgcagccauagacaacuagagcagcuggaagggaagcgcucaguccuggccaaggagcugguggaggugagggaggcgcugagccgcgccacgcugcaacgggacaugcugcaggccgagaagaccgagguggccgaggcgcugaccaagggugaggcuggccgcauggagcucgagcucuccgugaccaagcugagggcagaggaggccucccugcaggacucccuguccaagcugagcgcccucaacgagagccuugcucaggacaaguuggaucugaacugccuugucacccagcuggaggaagaaaaggccaugcugcagggccggcagcggcaggcggagcaggaggccacaguggcgccggcagagcaggaguggcuggaggagcugugguuggagcaggagguggcacggcagggccuggagggcucccuaugaguggcggagcaggcccaggaggcgcuggagcaacagcuccccacacugcaccaugagcucaguuggcugcaggagcagcuagcacagguaggccaaacugugugugggguggucuggagagcauguggggcaggccaggcucgcagccuccugcauccaguccuggguuaagucacaggcacuggagccugcuucuggguuaaauccagucccacuucuccuagcuggggaccuuggacaagcugcccaaccucccauaccucaguugccccauuuauaacauggggcuagccgggugcaguggcucacgccuauaaucccagcaguuggggaagccgaggcggguggaucaccugagguccggagaucaagaccauccuggcuaacacggugaaacccuaucucuacaaaaaauuagcugggugugguggcacgcgccuguagucccagcuacucaggaggcugaggcaggagaaucgcuugccucugccuccgggguuuaagcuguucgccugccucagcgucccaaguagcagggacuacaggcgugcaccaccaugcccggcuaauuuuuguauuuuuaguagagacaggguuucaccacguuggccaggcuggucuugaacucuugaccucaagugauccaccugccaaagugcugggauuauaggcgugagccaccguguccggccgggcccugguuuuuguacacacgugcauugcagaucuagagaaggucaugacuugcccaaguacauauagcacaucagggcagacccugggcucgaacccaggccuucugccaggacuggguuaggcccagaguugggguacugcacgaugaacaagcugggggaugcugggagugcuacucagucucugggugggagccagcucuccuggcagcugagcaggcgggagcaggagcuggagcaggcccggugggaggcccagugacagguggagacgcuggggcaaguggcccgggagaaggaggcgcuagccaaggagcacgcuggccuggcugugcagcuggcggccugcggagcgugaaggcaggaccgugucagaggaggccacacaccugcaguaaggccuugggcucugcccaacccgcccugggcgguccuccuggggccacgccaugaacagccucacccaggcacgggcccccaggggcaguuacuaaggagucuggcuugccaacucguccuagcugugggcucaggcuuccccagggagugugggccuggccaggcagguagauuggcacuuggcccaugccuggccacucccugagauccacaguuuccuggggccagggaggcugagucccagggccucacgcacuguaugugcugcagcuuggagaaggaagcccuggagggcagccuguuugaggugcaauggcagcuggcccagcuugaggcccgccgggagcagcuggaagccgaggggcaggcccugcugcuggccaaggagacccugacugguacgaguggcuggggacuuggggggaacaccagguuccagcccagacugcaaccucccaaugucuguagucucacagaaguugggagcacuggaguaggagucuggcuggccuggguuccaguccugugccaccacuuagaucucaccuucccuugagcaagccccuuuccucucugggcugcagauuccucagcugaugauuggagguggcaaugcccaccuucuaagccuguugccaggaugacaugggaaaagcguguaaggccguggcacggugccuggcugagucaacaguaacugcuguucaucggucaucaggccuguuagucugaguucucugugguuuucagaugacucucuuggccccagaauccgagccccacuucccugcaccguuccccaucgaaucucugaacucagggcuucuuucugcucaucuaacauuaacuaagcaccuacuugggucauggaaauuaauuuuccuguccauguacaccugagccagacagaaccaggaagggaaaugcugguggguuuccaacccgggagaugguuuuuagaugauggcuauaccauuuccauucccuguagucguuuccauuaaugcugauaguuaaugcuugacagguauguucaugucagucauuaaaggagaugcuuuauguguagcugugcagcugugggaaguugcugcugaucuccucugauccuccauuucaucaucuguuaaacggggaugaggauaaacuacauaggcauguuaugaagacaaaaugagguuaugucuaaaauacuuagcugggugcuugacgcauaguaagugcugagucaguaauaggguuuuuguuuguuuguuuguuuuuguuuguuuguuuugagauggaguuucacucuuguugcccaggcuggagugcaauggcgcgauuuuggcucaccucaaccuccgccucccagguucaagcgauucuccugccucagccuuccaaguagcugggauuacaggcacgcgccaccaugccuggcuaauuuuguauuuuuaguagagacgggguuucaccauguuggucaagcuggucucgaacucucgaccucaggugaucugcccacuucggccucccaaagugcugggauuacaggcaugagccaccgcgcccagccuguuugauuuuuugagacagagucucacucuugucgcccagguuggagugcaguggugcgaucugagcucacugcaacuucugccucuuggguucaagcgauucuccugccucagccucccaaguagcuaggacuacauacguccgccaccaugcccagcuaauuguuguauuuuuaguagagacaggguuucaccguguuggccaggcuggucuugaacuccuuaccuaaggugauccaccugccccagcuucccaaagugcugggauuacaggagugagccauggcaccuggccuaggguuguuauauguuugacauccgucccauuugggaggccuucucaucagucauuuuaugccuuuaaugccauucuagguaggcaggaaaggggucagggccagugggcccauguagcagauagggaaacugaggcccagagaggacaagccacuucuucaagaggacccaaacuggaugccaggcaggcccucugccucugggauuuugcccauauggcucaacuggccuaagucugcuggcccaaggaaaaauuucaacccaacccugcccuuucccccauuccucucgugcaggggaguuggcgggccugcggcagcaaauaauagcuacgcaggagaaagccagucuagacaaggagcugauggcccagaagcuggugcaggcugagcgggaggcccaggccucucugcgggagcagugggcagcccaggaggaggacuuacagugacuccagcgugaaaagguucaggcagcuggggaggggugggcagaagucugagccaguguuucaucaucguucuugcucugccucggucuguacaucugugaaaugggacucccucucuguuguggaggcccuggggacagcugggaggacuggaggggugguggggagguugugguccuuauuagacauucagauacccaggucccaaaucugguccagcccugguaauccugaugcagaggguccacaaccacauuugggaaauguugaccuaaugcacagcaggaaagcacuuucauuugcuaagaaguuuccauaugaagggccacgcagaccugagcauguagaaaggcaaggggccagggaaguuacuagaacacugacucugggguuauauugccuggguuugaaucuaaucuuggucgcuuacuggugaugcuacccaaggugucugugccuucauuuccccaccuguagaaauagggauaggauaguggaagguauugaggaugagcugagaccaucugcauagagggcuuaacauagugacugguacuuagcaaaugcuccaugaguuaugauugcuggcacuggcaugcucuccagaguggcccucagaacaggggcccucagccaccaaauccuagacagggcuuccucugacagaggugcaggcuaugacuacauggcuccagggcaugccacucacccugcaguccccauggccuuggguggugguuaucacgcuucuccaucagggggcgguaaagcucuuuccgaaagugcugggauuccaggcaugagcuauggugaagcucuuaaagaagggguggcuuggccgggcgugcugacucaugccuguaaucccagcacuuugggaggcugaggugggcggaucacgaggucaggagaucgagaccauccuagcuaacacagugaaacccuaucucuccuaaaaucacaaaaaauuagcugggcaugguggcacgcgccuguagucccagauacuugggaggguaaggcagaagaaucgcuucaaccugggaggcagagguugcagugagccaaaaucacgccacugcacuccagccugggugacagagcgagacucugucuuccuggcccccuaggaggcagcauggcgggagcuggaggccgagcgggcccagcugcagagucagcugcagcgugagcaggaggagcugcuggcccggcggaaggcugagaaggaacagcugagugaggagauugcugcccugcagcaggagcaugacgagggccuccuccuggccgagagcgagaagcagcagguucgugagcccuggcguggccucugcugcucucugagcugcuccaguucuggggccgggcccugcucugccacuuggcagcuaggagcccuggggcaggccacugcccucuugggggccucaguuuccuuaccugcaggaggggaggauuagaaggggguucgugaggcuuugcugugcuccaugccuggcacacagugagcacuuacugagugacagugacagucgugacaccaggaaagcuguuccauauucucccaugccucgucccaccccacgcugggcauggauccucauggcugccuucugagcaguccccacgaugcccacaggcaucagcugacguguccccccaaauaacaaaucccuaacuuuccuauaauguaacggagacagggcagacugugcccaucuccucuccucaccagcuguguaccugggcgagucacuuuaccuccuugagccucaguuuccucaucuguaagauggguagaaagaaagacucugcagucagggugcuguggcggguuagugagcucuaugagugguauccacguccgggauucuugugacugccguugugcccuuuuccagggcugcaugucugcccuggguccaccugcaguggcacacucaggccucuaagcccccagugggcacauuuccuaggcagcaagaagccugagcaugcccccaggaccagcccaucccccaagcccuuuguccccugccucugcccaggccuugucucugaaggagucugagaagauggcgcugucagagaaguugauggguacacggcacagccuggccaccaucucccuggagauggagcggcagaaaccagaugcccagagccggcaggagcaggaccggguaggccugccgucguagggaggcuugcggagcaggagcgcccucucuccaccgagcuaucccgcgguuuccagcaucccaucuggcggacuccucuuccucucucuucuccuacucugggucuucuauccugguguuccuugaaugccuaucuuccuuuugugccucggaaccucucacgccugccacaaguuacucuuuuccuugguaguucugaacuuuaaauaagguaaugccuguaagaaugccauaaaugcucaauaauugucaucuguuauuauuuucaucaguaacaucaucugaaucaucaguauugucugcuuuuaacagcugcauuuuucauuguccaaauauagucacauacauuugaccauuuuauaauuauugaauaauaaauuuguucugcuauuuuacaaugaaaaauaaugcugcagagagcauuuuugcacauguaucguggcagauguaggccagaggcucuucuuuuauccauccuauggccaaccuaugaauguauacacguuuaaugagauuuugccagcaaucaaagccuucagggaaaaugucccuagcucuuuacuacaucagaucaaggacucuggauaauuggcauaacauccuggaauagcugaaacagagauauuauucucugcucuccucuguugucuuugucuuuucacgucuuaauaaaagugcuggugacaagaguguaa

SEQ ID NO: 607 - RNA, 6343 nt, Homo Sapiens
cuccccgaacugcggcggcggcgagcgccggccgcaucugagcagagcugcagcggcggccgcgggcaccagagugccgagcccaggacgcccccggcccaggcccuugggguuuggugccagcugcggggcgccugggcuuggggaagaaaccuuguguacgcacaccugcacacacacacagucuccggaggaucuccacagcgguggagaggaggaagggugaacgccgugguggagugguccauguggaccugcuccccuuugcugccaggagguuaauaccucugccaaccgaggccacccucccucggacccccauucggaggaagcagacccaaguucgaauucugacauugccacugagcagccguacaacuuuugaaggggcucuugagggcuccugcacccaccagaaugugcagagaagaggucccaggugggagccgagagggggcugagggcagauccccaagagagaaguaauuggugugagagaggaucucaauuucuucgugucuaaaauggggaaacugcagcgccacuuacccugccuagcggccgcguugccaaggugacccgggcgcgggaaggcggcuccggcucgcgcgggccgggccgggcggcggcggcggcaccaugagcggccggaagcgcagcuucaccuucggggccuacggcggguagggcguggcgcggcgcggggcggggcgcgugcgcgcgugugcgugugcacgcgugggggggagcccgugcggggugugcucgcguuugggcgggugggccugggcuaugacugcugugggggcugagcguuugaccucagugcgcgcauggcugucgugcuguggcgccuguguguguguguuucuguuucugugucuguguguguucccauugcguguccaugugcauguguggggaggugagugcaggguggacauugcuguguuugugucuaagcacaugauaguggcgcuuaugcaugugacuggggcugcggggcuacuccgccugugugugcgcgcgugugugugcaugcgugugugcgcaacugcucacauguauaggguggacaaguccuucacuucucgccggaguguguggaggagcgaugggcagaaccagcacuucccucaggcacuagaccugucacgagugaacuuaguucccuccuauacuccuucacucuacccuaagcuauuucaccucuuggaaccggcuucucaucuguauaauggagaugacauuuguaccucggagcucagcgcugcggggcccggacccgggcgcgcgcgggccaggagccggcugggccagcugaagugccgccccggcgggggccgggccgggccgcgcucaggauggcacagcugcggcccgcggugccacccggccguccgcggaggggcucgcugcccgcgggggccagcuggcagaacacagaucuauuugagaugauugagaagaugcagggaagcaggauggaugaacaacgcugcuccuucccgccgccccucaaaacagaggaggacuacauuccauacccgagcgugcacgaggugucuuggggcgagaaggacccuucccccucauccugcugccccaguuugggggcuacuggauugagggcaccaaccacgaaaucaccagcauccccgagacagagccacugcagucgcccacaaccaaggugaagcucgagugcaaccccacagcccgcaucuaccggaagcacuuucucggcaaggagcauuucaauuacuacucacuggacgcugcccucggccaccuugucuucucacucaaguacgaugucaucggggaccaagagcaccugcggcugcugcucaggaccaagugccggacauaccaugaugucauccccaucuccugccucaccgaguucccuaauguuguccagauggcaaaguuggugugugaagacgucaauguggaucgguucuauccugugcucuaccccaagguauggcuggaucugggcacagcucacugagggugggugaguaacuggaagacugagcauuuauuaagcaccuucugugugccagauacuuucccaagguucucucauuuaauccucacaauaacccugugaaguccacagcuucccggcucaucgucaccuuugacgagcaugucaucagcaauaacuucaaguuuggcgucauuuaucagaagcuugggcagaccuccgaggaagaacucuucagcaccaaugaggaaagucccgcuuucguggaguuccuugaauuucuuggccagaaggucaaacugcaggacuuuaagggguuccgaggaggccuggacgugacccacgggcagacggggaccgaaucuguguacugcaacuuccgcaacaaggagaucauguuucacguguccaccaagcugccauacacggaaggggacgcccagcaguugcagcggaagcggcacaucgggaacgacaucguggcuguggucuuccaggaugagaacacuccuuucgugcccgacaugaucgcguccaacuuccugcaugccuacgucguggugcaggcugagggcgggggcccugauggcccccucuacaaggucucugucacugcaagagaugaugugcccuucuuuggacccccccucccggaccccgcuguguucaggaaggugaggggcacccccccagucaugggcagagcaggacaaaugggugggggccuggggggugcauacacauucugccuuaugaggucccaaagucucauuguaugccagggcagcugggcuccccuaacugcaaccggggccuggcuuuuccauucaucuugaaaacaccuuuuuuuuuuuuuucacaaggucacaggauaaacuacacgauuguuuuacacuuuccauaguagacuggccucuccucauuucuguucucuuucugacaguuccagucucuuucuuucuucuaaaauguuuggggaggggcacacuucaagccugggcuucagcucuguacguagcguguucugcuacccuagacugaagcaguagguugagaccccaacccagacccuaacaucuguggaguuugcucucccgaaggcgugggcagccaugaagggcacuggggccccuugaagguaccuggggagcugagcccagggagauacccuuuugggagugaagagggugaccccaggccccagcagagcaugguucaggagcugcagccucugccucguugggguuccgacccuuguuuaugugucaucucaacuucccuuccuuaucuccuccacacugggaguuuccaggggccugaguuccaggaauuuuugcugacaaagcugaucaaugcugaauaugccugcuacaaggcagagaaguuugccaaacuggaggagcggacgcgggccgcccuccuggagacgcucuaugaggaacuacacauccacagccaguccaugaugggcuugggcggcgacgaggacaagauggagaauggcagugggggcggcggcuucuuugagucuuucaagcgggucauccggagccgcagccaguccauggaugccauggggcugagcaacaagaagcccaacaccguguccaccagccacagcgggagcuucgcgcccaacaaccccgaccuggccaaggcggcuggaauaucauugcuuauuccugggaaaagugcgaguagauucggacgccggggcagugccauaggcauaggaaccguggaagagguugucguccgcggggccgccggcucuggaggcugccugcacgcgcuguucucugcucgcucucaggacggaggccauauuggggacguugccccucugcccccgggacaggccccagggcgugcgggauggaguggcggcagcuccgauggcacucagcaccugcuuuggggccugguaccugugccagagccagugccccucaccaggggcuucuggcccugccuuggccccugggacccuggcccagucccugccaggauccgguacccaaaggcccuacacccagccgcacgucccccaauaucgccggucugcauggagcgccaucccucuccucugcccugacuccuccuccccgccacgaagugaccugggguccuaccccuuccugccuccagagaagcugggggcgggcuucuggggccuggggcaucccagcacagugugugggaagcugggggagucuuccagcugcugggccagaaccucccccagccaauuuggagguuccggggaggggcccuagcuggcacggggugggacuuggguugcuacacugcccucugaccacugcccuuaggcugcagaucccacagagcccuggggggcggggagcgguagccauucugaggacucggccuccucccacccuagcccccucaggaugcuguccuaauccugggccaguauugacgugcaguccugccgugugagcucgggagagccccuugcccuccuggggacuguuucccuuucguaaacugggaggcugucucugggaauggauaucuucucucguucuuucuugcucaucaacucugcuucagggccuggggcagcaggauccccagaggggauguggggggggcacuggggcucccagguaagguggcacugaguuggggccucuccccacagucacugauugucccugggaagagccccacgaggaagaagucgggcccguucggcucccgccgcagcagcgccauuggcaucgagaacauacaggaggugcaggagaagagggagagcccuccggcuggucagaagaccccagacagcgggcacgucucacaggagcccaagucggagaacucauccacucagagcuccccagagaugcccacgaccaagaacagagcggagaccgcagcgcagagagcagaggcgcucaaggacuucucccgcuccucguccagugccagcagcuucgccagcgugguggaggagacggaggguguggacggagaggacacaggccuggagagcgugucauccucaggaacaccccacaagcgggacuccuucaucuauagcacguggcuggaggacagugucagcaccacuagugggggcagcuccccagugagguggcucccuccugccccccuccccaggccccucucgaucaccccacccagacgccggcaaguugggggacccugcgugucccgagaucaagauccagcuggaagcaucugagcagcacaugccccagcugggcuguuagccgggccacccccucugaaggugaaacugagcagaugaggccacagaagcacaaggggaaggugccgugucaagcccaggcagacgagaccucugcccugaagaccaacaccagcccgugggcugcccccugccuccccacccuccccauggcccacccaucugggcugucucugcagggcagagccguccagaccugggaucagggaagcugcuggcaucguccccacccccagccugggggucugggcuggggcagggauugcucaguggaagcaggacugggggucuggcuugcccccucccugggccuccaucaccccugagcaucccucuggacucagagggaacaaggugggagagagaguuugagacagcuccguguggagagcuuagccccuggaggcagcacaaggaggaugugauaugugggggagugagcacuggguugggagccggguccugguuuccaauuuggguucugcugugugacucugggcaagucacucucccucucugggcaugucugcuacaaauggacaagauuauuucagaggucacugaagacugugauuacaugcaccugccuuagaagguaggauuuucuucccagggaccuccuaucacccuacccugcuucuugaggucccuggagccccaggugggcugaggggcagggagccggcugugcccaguaugccuccuggacccuccaguucugccacaggucugccgaugcccuguccacugccuacacaugacagacaaguaacccccucaugggggauggggaccuaccuggcuccucagccagcacccagcuuaaccccugccaucccaugcugggcccuccaggccaagagucucagcuggccgagaguccaggccuugccucccccgaccgccauggagggggcagcccggcacagcugcugggagcccuugugugucuggucacacuuuuuaggcgucacgccaaaggccagccuccuggccccaauacccauuuuggaagccccuguggccguguggaugucgguaacaguuguauaaaauaaauucuauuuaucgcuauuguacccaga

SEQ ID NO: 608 - RNA, 3978 nt, Homo Sapiens
gccggagugggccgucagcacuuaaagggcccgcggcucgggcguaggaggcggugccucugcagcaagcguggggcgcgggaacccgagcagguucgggagacggaaugaagggccgggugggcucgcgaggggccggggaguccgcggggagcgagggaguuuccgaggggcgggucguguuccuggcagcgucccuccagggcaggcccgcccccuuugucccaguuccccgcugcccgggcuggggcggccgggguucauucauugccggccugaggacuccuagcucggccccgcuccgcgcuacagcccaaagcccagccugagacccagccgcccucguaugcccacggccuagcuccccuucccuccaacagacagacugggaaaaccgagugggcgacggcugagcaaggucacuccgcugucgggggcgcagccggccucagaccagcuuucgugcuucccagggccucucugcgaccacuuucgggguccgcgccaggcgcggggcgggggcgggggcggcuucggcgcggcgggcagaguccagcgggcagcggugggggaagggcgagccgccuggggagagggccgggcugcgagccuggcgauccagauuccagcccgcugucgccagcugugggaccgaagggcaacuguuucaccucucuggcccuaguaucuguaucuguaaagugccagugauaacaccugucucaccgagaugcugggggaauucaggaaaaucaugcaaaagugccugguacggagccuggcacgcagagggcucuuggucaaguggguuggagcugcgugagcccagaaggggauagaggcagcguggaggaaggcggcagcgggcccggucgcugggaaugaaaggccucagugucuggggcuuccuccccguacuacccgcagaguuuguucaggguggaggugcgcaccuggccaaguccacgucuacacggcccacccagaguagccuaaguugggcgggauuccuaacucugagccaggagugaccgggcuggcccuggcaugggcagaggcugagcggggguugggguggggcccccuccaggaccaaccacggugugguugccccugagcuggccucagccugccuggcaaaggaccucacccuugaggccaugugaucuauuuccugcuuccucccagcugacccuugagggaaagggggugggggccgccuagagcaggagguauuagucacugcgcccaggagccaguuuacaccuagcgaaggcggaggcauuggacaagccugggucugagcagacagaaccccuuccugcgacccuggagucccaaucgugcugccauuuuccuucugcccaggacucuccaguccucagucaccuuggacaaagaaguguggauccucagauuccaucuuuuccaacuccaagccgccuccuuccaaagcgagcuuagggggcaggauuccagugggaaggaagcucugagcaggcagccucagccaccucugagacucuguauccugggccaggugccauggcagagaaggugcugguaacagguggggcuggcuacauuggcagccacacggugcuggagcugcuggaggcuggcuacuugccuguggucaucgauaacuuccauaaugccuuccguggugagcggggcaguggggcuggggcuacuugaggggauggcagaagcaaaacccuggguuccaccuccaccaccgggcggggaaugugugucuggcuagucccugggaacacagcaccccaugucgugaugauguggccuacauguacccuaccaggagggggcucccugccugagagccugcggcggguccaggagcugacaggccgcucuguggaguuugaggagauggacauuuuggaccagggagcccuacagcgucucuucaaaaaggugggugcaggcugggcacgguggcucacgccuguaauuccagcacuuuggaaggccgaggugaggagaucacuugagcccagguguucaagaccagccugcucaacacagugaaaccccaucucuacagaaaaauacaaaaauuagcugggcaugguagcccauaccuguggucccagcuacucgggaggcuggcaugggaggauggcuugagccugggagguggagguugcggugagcugagauggcaccacuguacuccagccuggacaacagagcgagacugucaaaaaaaaaaaaaaaggugagugcaggcaggcaggcugagggcauugccaaggacuaaaaccaguagagcaaccucuggccaugucaccccugcaguacagcuuuauggcggucauccacuuugcggggcucaaggccgugggcgagucggugcagaagccucuggauuauuacagaguuaaccugaccgggaccauccagcuucuggagaucaugaaggcccacggggugaagaaccugguguucagcagcucagccacuguguacgggaacccccaguaccugccccuugaugaggcccaccccacgggugguuguaccaacccuuacggcaaguccaaguucuucaucgaggaaaugauccgggaccugugccaggcagacaagacuuggaacgcagugcugcugcgcuauuucaaccccacaggugcccaugccucuggcugcauuggugaggauccccagggcauacccaacaaccucaugccuuaugucucccagguggcgaucgggcgacgggaggcccugaaugucuuuggcaaugacuaugacacagaggauggcacagguguccgggauuacauccaugucguggaucuggccaagggccacauugcagccuuaaggaagcugaaagaacaguguggcugccggguaggaagagaagggagaagugagggaggggagggaccagauccaggcagagcggcccagaggcguggucaguccagcccgcuccauaaacccuguucuccgugggccagaucuacaaccugggcacgggcacaggcuauucagugcugcagaugguccaggcuauggagaaggccucugggaagaagguaggcccccccgccccacccaccucacccaccucaccccacccagcucucagcaacagagcagcuuuggcccuucccacucaccucucuggaggguaccuggcacugcccagucuccucagccugccuagcacccggugccugcgggccagccgcugcucugcacuucugcuucuuaaagaccuggccagcagcugggccagggccggcucagcuaagcuccaacuaccuccugucuugcagaucccguacaaggugguggcacggcgggaaggugauguggcagccuguuacgccaaccccagccuggcccaagaggagcugggguggacagcagccuuagggcuggacaggaugugugagugcuggccugaccccugcaguuaggggccagggaggggcuaaaucagaucugggcaugcccacccagggcgggcuguggggugggggaggcucugcauuccaccgugggcccugagcacacaccucgccguguugcaggugaggaucucuggcgcuggcagaagcagaauccuucaggcuuuggcacgcaagccugaggacccuccccuaccaaggaccaggaaaagcagcagcugccugcucuccagccucuggcaggaacucagggcccuggagcugcuggggccaagccaaggccuccccuaccucaaaccccagcugggcccgcuuagcccaccaggcaugaggccaagggcuccacugaccaggaggccgaggucucuaacucuuaucuuccacaggguccaagaguucaucaggacccccaagagugagugagggggcaaggcucuggcacaaaaccuccuccucccaggcacucauuuauauugcucugaaagagcuuuccaaaguauuuaaaaauaaaaacaaguuuucuuacacuggg

SEQ ID NO: 609 - RNA, 865 nt, Homo Sapiens
aaaagccagccuucagccggagaaccguuuacucgcugcugugcccaucuaucagcaggcuccgggcugaagauugcuucucuucucuccuccaaggucuagugacggagcccgcgcgcggcgccaccaugcggcagaaggcgguaucgcuuuucuugugcuaccugcugcucuucacuugcagugggguggaggcaggugagaaugcggguaaggaugcagguaagaaaaagugcucggagagcucggacagcggcuccggguucuggaaggcccugaccuucauggccgucggaggaggacucgcagucgccgggcugcccgcgcugggcuucaccggcgccggcaucgcggccaacucgguggcugccucgcugaugagcuggucugcgauccugaaugggggcggcgugcccgccggggggcuaguggccacgcugcagagccucggggcugguggcagcagcgucgucauagguaauauuggugcccugaugggcuacgccacccacaaguaucucgauagugaggaggaugaggaguagccagcagcucccagaaccucuucuuccuucuuggccuaacucuuccaguuaggaucuagaacuuugccuuuuuuuuuuuuuuuuuuuuuuugagauggguucucacuauauuguccaggcuagagugcaguggcuauucacagaugcgaacauaguacacugcagccuccaacuccuagccucaagugauccuccugucucaaccucccaaguaggauuacaagcaugcgccgacgaugcccagaauccagaacuuugucuaucacucuccccaacaaccuagaugugaaaacagaauaaacuucacccagaaaacacuu

SEQ ID NO: 610 - RNA, 279 nt, Homo Sapiens
caguggugcagucucagcucacuacagucuccaccaaccagguucaagugauucuccugucagccucccaaguaguugggaucauagaccaaaaucuucgaaugcauuggaaauacgaaaguagagugucucuugcccuccuggaguuugugaucuaguugcuagugaugaaggcaaaguggauauucagagaacagagucagaacuucaucugggaucagagcuucuuguguucacuauugcugggcccaauugcaaaugagacuaguaugauguccc

SEQ ID NO: 611 - RNA, 1486 nt, Homo Sapiens
guggacaccacgugauccuggggaggcuuuugccucuuccgagggcucuggcuccagggccucccuguuccaggggcuaggugugccuuccucaaugcugcuuuuggcuaugagggugacgggcccagggcuucagggccccagaucgcaccuugccaucugggguguccguccuuugucccccacagcaggcuguguuugcccauuuucuccucugccauggguggagauggaucugaaguuggguguugaagccucugaccaaggcuguaucuuguuuugaggcccugcccgguuuccagggaccacaucuggggccaagaggaagaaccgaacugggacuaggcccgucuucgugucuccucccucccucgccuuccuccuuccuagcuccucuccuccagggccagacugagcccagguugauuucaggcggacaccaauagacuccacagcagcuccaggagcccagacaccggcggccagaagcaaggcuaggagcugcugcagccaugucggcccucagccuccucauucugggccugcucacggcagugccaccugccagcugucagcaaggccuggggaaccuucagcccuggaugcagggccuuaucgcgguggccguguuccugguccucguugcaaucgccuuugcagucaaccacuucuggugccaggaggagccggacagagagaggcuuuggacucaggauaaaucuuuugcaaauauuuggccccccacuauggaguggggagaaagugagagaccccauggguggggccaguagccgcggcugacaugcccuguugcacacagcucugggaagggcaguugcuagccuucgggcuugugagaaccaggacccagaauagggucugcuuggacgaggggggccccacugaggagccccacugaugaaucccauccccagggagccugcacacaugauccugaccgucggaaacaaggcagauggaguccuggugggaacagauggaagguacucuucgauggcggccaguuucagguccagugagcaugagaaugccuaugagaaugugcccgaggaggaaggcaagguccgcagcaccccgauguaaccuucucuguggcuccaaccccaagacucccaggcacaugggauggauguccagugcuaccacccaagcccccuccuucuuuguguggaaucugcaauagugggcugacucccuccagccccaugccggcccuacccgcccuugaaguauagccagccaagguuggagcucagaccgugucuagguuggggcucggcuguggcccuggggucuccugcucagcucagaagagccuucuggagaggacagucagcugagcaccucccauccugcucacacguccuuccccauaacuauggaaauggcccuaauuucugugaaauaaagacuuuuuguauuucuggggcugaggcucagcaacagccccucaggcuuccaguga

SEQ ID NO: 612 - RNA, 120 nt, Homo Sapiens
agcuguucugaggguagugaguuaucucaauugacuguucaccaugaguuacaguugaacuccuuguucuacucuuucuccucacccuucucacuacugacugcacuugacuagucuuuu

SEQ ID NO: 613 - RNA, 6145 nt, Homo Sapiens
guccuuucaauuucgguucucacagacucuuacuuggaugucuguaaauccggcuggacuuucagcuucuaagaacaguccguuucucgaggauccaggcgcaggaggacagagcaaugggugagagaacucuucacgcugcagugcccacaccagguuauccagaaucugaauccaucaugauggcccccauuugucuaguggaaaaccaggaagagcagcugacagugaauucaaaggcauuagagauucuugacaagauuucucagcccgugguggugguggccauuguagggcuauaccgcacaggaaaauccuaucucaugaaucgucuugcaggaaagcgcaauggcuucccucugggcuccacggugcagucugaaacuaagggcaucuggauguggugugugccccaccucucuaagccaaaccacacccugguccuucuggacaccgagggccugggcgauguagaaaagaguaacccuaagaaugacucguggaucuuugcccuggcugugcuucuaagcagcagcuuugucuauaacagcgugagcaccaucaaccaccaggcccuggagcagcugcacuaugugacugagcuagcagagcuaaucagggcaaaauccugccccagaccugaugaagcugaggacuccagcgaguuugcgaguuucuuuccagacuuuauuuggacuguucgggauuuuacccuggagcuaaaguuagauggaaaccccaucacagaagaugaguaccuggagaaugccuugaagcugauuccaggcaagaaucccaaaauucaaaauucaaacaugccuagagaguguaucaggcauuucuuccgaaaacggaagugcuuugucuuugaccggccuacaaaugacaagcaauauuuaaaucauauggacgaagugccagaagaaaaucuggaaaggcauuuccuuaugcaaucagacaacuucuguucuuauaucuucacccaugcaaagaccaagacccugagagagggaaucauugucacuggaaagcggcuggggacucugguggugacuuauguagaugccaucaacaguggagcaguaccuugucuggagaaugcagugacagcacuggcccagcuugagaacccagcggcugugcagagggcagccgaccacuauagccagcagauggcccagcaacugaggcuccccacagacacgcuccaggagcugcuggacgugcaugcagccugugagagggaagccauugcagucuucauggagcacuccuucaaggaugaaaaccaugaauuccagaagaagcuuguggacaccauagagaaaaagaagggagacuuugugcugcagaaugaagaggcaucugccaaauauugccaggcugagcuuaagcggcuuucagagcaccugacagaaagcauuuugagaggaauuuucucuguuccuggaggacacaaucucuacuuagaagaaaagaaacagguugagugggacuauaagcuagugcccagaaaaggaguuaaggcaaacgagguccuccagaacuuccugcagucacaggugguuguagaggaauccauccugcagucagacaaagcccucacugcuggagagaaggccauagcagcggagcgggccaugaaggaagcagcugagaaggaacaggagcugcuaagagaaaaacagaaggagcagcagcaaaugauggaggcucaagagagaagcuuccaggaauacauggcccaaauggagaagaaguuggaggaggaaagggaaaaccuucucagagagcaugaaaggcugcuaaaacacaagcugaagguacaagaagaaaugcuuaaggaagaauuucaaaagaaaucugagcaguuaaauaaagagauuaaucaacugaaagaaaaaauugaaagcacuaaaaaugaacaguuaaggcucuuaaagauccuugacauggcuagcaacauaaugauugucacucuaccuggggcuuccaagcuacuuggaguagggacaaaauaucuuggcucacguauuuaagagccugaauauuccagguaagaaaauauaaaaugagguuuauuuuauuuuaauaacauaacacuguugcucauuuuguaaguauauguguuauagcaguuucauucaagaaaaguuuaaaauuaaaaagugauuaucaaagaauaucagggccugacauccacaaaaaacaaacuuaauuuugauugaacuaauaauuuauaaacaugggaaacaagucagaaguagugacauuauuccuagaaaagauuuaaggaaagcaaaaagacaacugguaagauuaagaagccauuaaccauuugcaauuuauauuauagucacagaaauaauuucaguuaugacuagcucuugccgauuaaugagaagagagcagcuccacaauuuuuaauuuuuuuaacuuuuauuuuagauucagggguauaugugcagguuuguuacauagguaaacugcaugucauggggguuuggugugcagauaauuuuaucacacaauuauuaaucauaauacccaauagguuuuuuucugaucuucucccuccucccaaccuacacccucaaguagaccccagugucucuuguucuccucugaguauccauguguucucuuuguuuggcccccauuuauaagugagaacaugugguauuuggguuucuguuccuguguuaguuugcuuaugauaauggcuuccagcuccauccauauugcuacagaggacaugaucuuguuguuuuuuauggcugcauaguauuccaugguguuuguauauaccacauuuucauuauccagccuauuauuaaugcacauuuagguugauuccuuaucuuugcuauugugaacagugcugcaauggacauacacgugcaugugccuuuaugguacaaugauuuauauuuccuugggauaugcauuccuuugggaauaaugggauugcugaguugaaugguaauucugaguucuuugaggaaucaccaaccugcuuuccacaguggcuaaacuaauuuacacucccaccaacaguguauguguuccauuuucuccacaaccuugccagcaucuguuauuuauugacuuucuaguaacagccauucugacuggugugagaugguaugcauuucuguagugauuagugaugaugagugauuuuuauaugcuuuuuaaaugcauauaugucuucuuuugaaauguguucauguucuuugcccacuuucuuuuuaaugggguugcuuguuuuucgcuuguaaauuuuuugaagcuucuuauagauucuggauauuagaucuuuguuggaugcauaguuggcaaauauuuucuaccauucuguagguugucuguuacuuuguuaauuguuucauuuuguuuuguuuuuguuuuuugaaacagggucucacuuugacacccaggcuggagugcaguagcacaaacaugggucauuguagccucaaccucccaggcucaagcaguccuuucaccucaaccccccacauagcugggacuacaggugcuuacacccaagaccaguuaauuuuuuguauuuguuuguagagauguguuuuuccauguugcccaagcuggucuugaacuacugagcucaagcaaucugccugcuucagccucccaaaguacugggauuuaggcaugagccaccacaucuggccaauaguuucuuuugaugugcagaagcucuuuaauuuaauuagaucuccuuugucaguuuuuguuuuugcugcaauugcuuauguuaucuucaucaugaaauuuuagccaagucuuauguccagaaugguauuucuuagguuauuuuucagaguuuuuauaguuuaauguuuuauauuuaagucuuuaauccuucuuaaguugauuuuuguaugcagaguaagcugggggcccaguuucaaucuucugcauauggcuagccaguaaucccagcaccauuuauuaaauggggacuucuuuccccauugcuuguuuuugucagcuuuguccaagaucagaugauuguagguguacagcauuauuucuggacucucuguuauguuccauuuaucugugugucuguuuuucuacuaauaccaugcuguuuugguuacuguagcucuguaguaugguuugagguuugguaacuugaugccuccccuuuuguucuuuauguuuaggauugccuuggcuaggcucuuuuuugguuccauaugaauuuuaaaguaguuucuaauucugugaagaaugucauugguaguuugauagggauagcauugaacuauuugcucaacucaacauuuuaggaauuuauuucugcugucuagugcucaaaacuugcagcuagaauugagggaagagagagaccuucuuauauuguuuuauauuguuugauacucaguaccuguuuuaagaaaaaacaacaaggaaguaaaaccaaagacaggcagcccagcgccaggcccaaaaccaggccugggccugccuggccuaaacccaguaguuaaaaaucaacucauugccuguaaucccagcacuuugggaggccgagacggguggaucacgaggucaggagaucgagaccauccuggcuaacacggugaaaccccgucucuacuaaaaauacaaaaauuagccgggcaugguggcacgcgccuguagucccagcuacacgggaggcugaggcaggagaauggcgugaacccaggaggcggagcuugcagugagucgagaucgcgccacugcacuccagccugggcgacagagcgaaacuccgucucaaaaaaaaaaaaaaaaaaucaacucauaacuuagaaaccgauguuauucauagauuccagacauuguauagaagaacauuuggaaacucacugccuuguucuguuucucucugaccaccagugcaugcagccccugucauguaccgccuguuugcucaaaucaaucaugacccuuucaugugaaaucuuuaguguugugagcccuuaaaagggacagaaauugugcauucaaggagcuuggauuuuaaggcagcagcuugcugaugccaccagcugaaaaaagcccuuccuucuccaacucggugucugagaaguuuugucugcagcucauccugcuacagaaugaacuccuuguaauucuacaagauaugccaugggccuuuucacaggggacacaggcuucuuaaaacaacccggcuuccucacccuauguccuuuauuuacaaagcugugcuccuauucaugagcauggaauguuuuuccauuuguuugugacaucucuuauuucuuucagggguaucuuguaauucucauuauauauaucuuuugcuuccuugguuagcuguauuuuuagguauuuuagucuucuuguggcaauugugaaugggauugcauuccugauuuggcucuuggcuuaauguuauuaacgccacauuuuuuaaauagacaaaaauaugagauuaaaaauguugaauuuuacuaacaauaaaaguuguucaaaggaaaacuauaagguucuuguuucaacucugucauaggaagaacaggacagugagcuggcacagaguuagggaaacugacugugucucauauuggcuagugagagugaucuguuggaauuguauaucaaaauuuuaauguacauacauuuugucuagcaauucuacuauuggguauuuauauaguacauauaaauauaaauguauauguuuaguaaauauauacuuauaguuaguaaauauauuuuauaucuauuuaguaaauauacuaaaugucaggccucugagcccaagcuaagccaucauauccccugugaccugcauguacauacguccagauggccugaagcaagugaagaaucacaaaagaagugaaaauggccuguuccugccuuaacugaugacauuaccuugugaaauuccuucuccuggcucauccuggcucaaaagcucccccacuaagcaacuugugacacccaccucugcccgccagagaacaacccccuuugacuguaauuuuccuuuaccaacccaaauccuguaaaauggucccaacccuaucucccuucacugacugucuuuucggacucagccagccugcacccaggugauuaaaaagcuuuauugcucaca

SEQ ID NO: 614 - RNA, 7598 nt, Homo Sapiens
ccaggcuuuaucuuguugaguaguugugaagaguaaaccuucacaugaagcauagggccgucuccguggggccgaugcgacggcaggcgaaggcgauggagcucuggcucgagggcuuggccggacgacggugacacuggucgcccgccugcuggaacugcagugaccgagguccuggcaagggggcuaggggguggggcugcagccgggacggggccuucggcagggccugcgggggcgggacggagcggacccgagugauacccgggagacuagcuuggccacaggagacaacguugagguacagacagguggcagagaaacaaacaucgguauugcuuaaaccacuugcuauuuccaguuccggcuguauguaccaaaacuuaaucuuauauaguaccccaaagaggugcuaugaaaauuaauugugauagugugauugaagugauuggcacauaguauuuaacaaaauauuuaaugaaguguaaucacuguucuugcuguuuuaauucucacaauacucuguaugaaguggguguucaauaaguauuugaugaaucuuuaaaaauuugcuaggucuaccauaaccaaauaccgcagauugagugguucaaacgccagagauugauauucucacaagucuggaggcuguagaaaucuaacaucaaggugccaacaggaacaggauuauucaagaucagguuguagccauuuucaacaaggaucacugaucaaaauuuucuuuuuacaaagagauuuacaaguuaaacaugaagggaaaauacuggaaucauuuggauucugacaggauaaagaauacaauauuucacauuuacuuguaauggaaccuuuguaagauucaucacuugucauucacccaguugggaacauggauguugguuuuucucguacuacuguucagacacugucaagaagccacugcaaaaacaucaaacaaaaaauuucucaaugggaaggaagggcuaaugguauaucuaauccagaaaagugguguccaaaggacuuuggagugagauauaacugucaccaagagauccgucuuaagaaaaauccuauagcugagagaaagagcaaaaacuuggauguaaccagccgugaaaaugugggucuagauauaaaugaaaauaccaaaagccaugaucaaagugagaaugaaaauaagaaacaugaauaugacgauacacacuucuuuaaaaaugaaucagaauccaacuggguauguucucgggucaaagaaauugaaagcuguaaagaagaugucuuagauccagagacuucauuaccuccaggaaacuucuauaccucacaaauacuguggaagaaaauagaagcacuucccccagauaaacucuuaaauuuggcuuuagaacauugugacucuucagaaaaagaacugaacuucagaguucuggauaguucauacggaauaaccaagagcuuagaaaauauuuacucugaaccugaggggcaagaauguggaccuuccauaaauccuuugccaaaaccucguaggacauucagauauuuauccgaaucugguguuacgccguauaaagaaagaaacugugacaaaaaauacugugaaaauaacucuugugcacaaucuucuuuggccucuucucaggaaccugaaccaaagaaauaugguggaaaaaucagaggaagaucuaaaaggaaauccuuugaauuugaggauauucagcacuuucgaaaucggaacucacagacgauucgugaagaacuuggaagaaauucugggucagcacuuuauuacacacagucugaggacaauaucuaugaagauaucauauaucccaccaaagaaaauccauaugaagauauuccagugcagccuuuaccuauguggagauccccuucagcauggaagcuaccacccgcuaaaagugcuuuuaaagcacccaagcucccuccaaaaccucaguuccuucaccggaagacuauggaaguaaagaacucacaggcuuauuugcggucaaagcuuacaaaagauacaacuuugccggucacuuuaacggaauggaagcuuuuccgagcuggugaaguugcaaacacgaaaaggaaaaaucuuccaaggcuuguauugaaaauagaugacauauuugaaucuaaaagagggaagaagaagguaaaguuacauucuuacacuggaaaggaauuaccuccgacaaaaggugaaaccagugggaacgaaagugaugccgaguaucugccaaagaaucgccauaaacgcuuagcacaacugcaaccgucuuccaagaggaauccucacuaccagaccuuggagcgggaucuuauugaauuacaggagcagcagcuguuugaacuuuuugugguggugucucuacagaagaaaccaucaggaauaagcuauauuccccaggucauacaacaauucccuggcaaggaugaucauggcuauaagcaguccaaagacauggaagagagacuuaaaguuauuccaaaauuuuguuuuccugauucaaaggacuggaugccaaccucagaacucaagagugaaacauucuccuuugucuugacuggugaagauggaagccggugguuugguuacuguaagaagcucuugccaguaggcaaaggaaagcgacucccugagguauacugcaugguuagucgccuaggcugcuucaaucuuuuuucaaaguaugaugcuuauuuaacuuuuauugauugcagaagcuuaucugucuuaaauuuuauuuggguuauuuuaaaguuuguacaccagguuuggcaguuccuguaauggcauucuuuuauauuuuuuaacuuaguccauaauaaaauaacacuuugcguauauagauucuggaugaaguagagaagagaagagaaaugucuccagcccuuguuuacccauucaugcgaagugucauggaagcuccuuucccagcuccuggacgcaccaucacaguuaagaguuaccucccuggggcuggagaugagcugauucaacuucuugcauuucaguccauugaacucugccgaccacuagauucccgauuggaacauguugauuuuaaaugucucuuuaagugccugagugugugucaucucauccgggucugugccucucuccuuuuggagcguaggguaaucuuuguugccaacagccuaagcacccugucaaaauguggccaugcugugguagcuacacuguauccguucaccuggcagcauaccuauaucccaguccugccagcaucuaugauugacaucgugugcucaccuacaccauuccuuauuggaauccugucuugcuccuuaccacagcuccaggaccuacccauugaagaggugcugauaguugaucucugugcagacaaguucuuacaggaguuuauagcugccuaucccaaaggaggaaggaggaaacauaaaugucucauucucaaaagagguaaaaccacccuucaacuccaggugggucgacacauaagccucuaauuuaauuacauuuuaaaagcauuuauuaagcacugauuauuucuuuuuuuuuuuuuuuuugagauggagucucgcucugucgcccaggcuggagugcaguggcgcaaucucggcucacugcaagcuccgccgccuccuggguucacgccauucuccugccucagccucccgaguagcugggacuacagguaucugaugaggaugaaauucuaccaccaaaacuucaagcugcccugaugcagauuuuggaagaacgaaaugaaaucuugacucaggagcagaauuuuucacaagaaauguagaagaugagauaacagggcuggaaaacuaagaugugacacucaacucucugguguccgaagcauuugucagguuuuuuguggaguugguaggacauuauucuuugaacaugacugucacugagcguggggagcguguuuuccaaagggaaccauuccguaagucccacaccucccgaaguguacgccacuuccuggaucucuucauggaaacucagauguuugcaggauucauccaggaccgagagcuucggaaaaguggaguuaaagguuuguuugagauccgggccauccaguauuuggaaacaauuccugagucggagcccagugggaugaauagaauuuugcggagucuugguuaguugcuguguuuuccuguuagauaaauguggcugaagaccaggcgcgguggcucaugccuguaauuccagcacuuugcgaggucaaguaaggagguuugcuugaggccaggaguuugagaccagcgugggcaacauagugagaccccaucccuacacaaaauuuuaaaauuagcugggcaugguugggcaugguggcuuaugccuguaaucccagcacuuugggaggcugaggcagguugaucaccugagguuaggaguucgagacuagcuagccuguccaacauggugaaaccccaucucugcuaaaaauacaaaaauuagccugguuuaguggcaggcaccuguaaucccagcuacuugggaggcugaggcagaagaauugcuugaacccaggauauggagguuacggugagcagagaucacaccauugcacuccagccugggcaacaagagcaaaauucugucucaaaaaaaaaaaaaaaauuagcuaggcaugcuggcacauuccuguaguucuagcuacgcaggaggcugagaggcccgagggggaucgcuggagcccgggaguuugaggccucaguaagaugaucuugccacagaugacagagugagauucuugucucuaaaaaaauaaauaaauaaaaaugaagcaaaaugaaauuucugcaaaagaaaugaaaucucugauugucuccauccugaauauacaacagaaagugccaaagaaaauauuuuucuaagggucaggaucccaugaaguauucuacaaaauucuugaaauuuuaaaagguuaaagagcgagucaggcuguuagaggaggauucuccuguugcugcuguaguaaucacuggagaauuguugggaauggucuggcaccaugccaucuuuacucugucuccauuuuuuuuuuauagcagccuuuucuaugugauucuugggcucauucucuguuuugugcuuugucugugaaaguaguuguguuucacaaggaaaagccuuguuguuguuacauuuaaaaaauagcucaaagaugagaauaaugagagaaaugcugaguuuaagguaguagagagacaugauggaaauggagaacacuagccuuauacacauaauucucaucacugaacuaucauggccccuuuaaacccaugggcuguuugaccugggcuaaggaauagacucaucacauaucuccauuguuuugccuuauauuauaucuaggggaaucucacuuaggaggaagcccuacuuguaauauuauaagguacuguuauuaaguaccuuauaaaauuagacaucuugcaacuccuccuccaaauuauguggcauuugaguaguuugcuugugccucacaugucaacauuaaacuuuguggaggcuggaugcaguggcucacaccuguaaucuccaccacuuugggaggcuaaggcaggaguuugagggugggaguuugagacuagccugggcaacauagcaagaucccaucucuacaaaaacauuuuaaaaauaaguaaauaaauuuaaacuuugugaaauuauagcuaauaugaaaauguccuuucaagggcaugggagccaccuuuauuuuuuaguguccaccaugugccaugcacugugguauauguaugcauaucaucucaaccaauccuuaaaucaaccuuaugagauagauauuugcaucuccauuuuacuaauaaacugaggcugggugcuauggcucacgucuguaaucccagcacuaugggaguccaaggcgaguggaucauuugaggucaggaguucgagaccagccuggcaacauggugaaacucugucucuacuaaaaauacacacaaaaaauuagcugggugugguggcaggugccuguaauccuggcugcucgggaggcugagccaugagaaucgcuugagcccaggaggcagagguugcagugagccgagaucgcgccacugcauuccagccagggugacagagcgagacuccaucucaaaaaaaagaaaaaaggaaaagaaaaaagaaaaaaacaaauucaaagaaguuaaauacguugcccaaaguuguacaacacagaacugaagccaagacuuuuauggacacagaaaaaguugguuaguccuacagauggaaauuucaucucaguaggauuauauagcuauuucuuuuauuaauaaaaauuuucuauuaaguguaccagagccacuuuucagcucugaggauaaggaacuuuauaggugccuagaugagacucuuuuuauuccccuagaaauguugaaauuuuugcucuaauuaaauuagacucaaaauaugaacauuccuugaacauauaccacuuagucauccagaccuuuaauaucuaaaguaguaguaguagugauuggaaagagaaaguuuucagugauggugcaguguuuuuuuuguguguguauguguguguguguguguuuuguuucgguuuuuuuuuuuuuuuuuugagauggaguuucgcucuuuuugcccaggcuggagugcaauggugugaucucggcucacugcaaccuccgccucccggcuucaagcaauucuccugccucagccuccugaguagcuggaauuauaggcacccgccaccacaccuggcuaauuuuguacuuuuaguggagacggggguuucaccauguuggccaggcuggucucgaacuccugaccucaggugauccacccaccuuggccucccaaagugcugggauuacaggcaugagucacugcacccggccuguguguguguguguguguguguguguguguuuucaaacucaugggcaaauucaaguucagauggugcacuuuucauugauuaauguuauagcaaaugucaguuuguuuucuucaguuucugcugaugguuuuaacuggcacagaaaguauuuauucaaccuuacaaaacuguguaaguuguauugugauacaguuuauugacuuguacaguauugucauuacaacccauucagguaugcaugaaucugaagcagaacaccauuuaagacuggugcuguauaauauaauuccuacagauguggguccagggaauagaacugagccugucuuuuuuuuaauguuaagcagguuacccccaguggggcuucuacuagacaucucuccauuuggucucuucuuacacuccaacccagcaggaacaguuaauaauuggauguuuauaaaauggggguaaaaggguuuacugugauggauccuggcuaucccucuaggaggagaccuuugcuucagcaauggugucuucauccucgcagccugaagcugcuucauuuccuuaggucuguuguguuuucuguaaaguguuaggaauucuggauauuuuuguaaaagaaucaagauuuguauaaaauguuguuuacagaucuuuuaaugaauaaauacauaaaccccccacaga

SEQ ID NO: 615 - RNA, 3056 nt, Homo Sapiens
acacuauuuaaggccaauacacgggagcugguugugagucaccaaggaaggcagcggcagcuccacucagccaguacccagauacgcugggaaccuuccccagccauggcuucccuggggcagauccucuucuggagcugguaaucuguggcguaacaagaccuccaggugauucucuguauuagcagccgcucugugcucccugauuccuccagaaaagcacaaggauuuaauccagauagauauaaauuucaccugggaucauuuaucauuccacauucuucuuuaagaaaugugcuaaagagccacagaugggucuugaugaaaacaaaggaaaagccaugaaguuucuacagcugcaauuguguccggaauuuauuccuucugguggguucauggucuugcugacuucaagaaugaagccgcugaccucgcggcuacacugaggaacaagcuuauguggaacauaauuagcaucaucauuauucuggcuggagcaauugcacucaucauuggcuuugguauuucagaagucucugucuggcuuucagcaaugaaggguuugguuguagaaguuccaaggcuucccuuagcauugaucuuugcuuccugaacugcagggagacacuccaucacagucacuacugucgccucagcugggaacauuggggaggauggaauccugagcugcacuuuugaaccugacaucaaacuuucugauaucgugauacaauggcugaaggaagguguuuuaggcuugguccaugaguucaaagaaggcaaagaugagcugucggagcaggaugaaauguucagaggccggacagcaguguuugcugaucaagugauaguuggcaaugccucuuugcggcugaaaaacgugcaacucacagaugcuggcaccuacaaauguuauaucaucacuucuaaaggcaaggggaaugcuaaccuugaguauaaaacuggagccuucagcaugccggaagugaauguggacuauaaugccagcucagagaccuugcggugugaggcuccccgaugguucccccagcccacaguggucugggcaucccaaguugaccagggagccaacuucucggaagucuccaauaccagcuuugagcugaacucugagaaugugaccaugaagguugugucugugcucuacaauguuacgaucaacaacacauacuccuguaugauugaaaaugacauugccaaagcaacaggggauaucaaagugacagaaucggagaucaaaaggcggagucaccuacagcugcuaaacucaaaggcuucucugugugucucuucuuucuuugccaucagcugggcacuucugccucucagcccuuaccugaugcuaaaauaaugugccucggccacaaaaaagcaugcaaagucauuguuacaacagggaucuacagaacuauuucaccaccagauaugaccuaguuuuauauuucugggaggaaaugaauucauaucuagaagucuggagugagcaaacaagagcaagaaacaaaaagaagccaaaagcagaaggcuccaauaugaacaagauaaaucuaucuucaaagacauauuagaaguugggaaaauaauucaugugaacuagacaaguguguuaagagugauaaguaaaaugcacguggagacaagugcauccccagaucucagggaccucccccugccugucaccuggggagugagaggacaggauagugcauguucuuugucucugaauuuuuaguuauaugugcuguaauguugcucugaggaagccccuggaaagucuaucccaacauauccacaucuuauauuccacaaauuaagcuguaguauguacccuaagacgcugcuaauugacugccacuucgcaacucaggggcggcugcauuuuaguaaugggucaaaugauucacuuuuuaugaugcuuccaaaggugccuuggcuucucuucccaacugacaaaugccaaaguugagaaaaaugaucauaauuuuagcauaaacagagcagucggcgacaccgauuuuauaaauaaacugagcaccuucuuuuuaaacaaacaaaugcggguuuauuucucagaugauguucauccgugaaugguccagggaaggaccuuucaccuugucuauauggcauuaugucaucacaagcucugaggcuucuccuuuccauccugcguggacagcuaagaccucaguuuucaauagcaucuagagcagugggacucagcuggggugauuucgccccccaucuccgggggaaugucugaagacaauuuugguuaccucaaugagggaguggaggaggauacagugcuacuaccaacuaguggauagaggccagggaugcugcucaaccuccuaccauguacaggacgucuccccauuacaacuacccaauccgaagugucaacugugucagggcuaagaaacccugguuuugaguagaaaagggccuggaaagaggggagccaacaaaucugucugcuuccucacauuagucauuggcaaauaagcauucugucucuuuggcugcugccucagcacagagagccagaacucuaucgggcaccaggauaacaucucucagugaacagaguugacaaggccuaugggaaaugccugaugggauuaucuucagcuuguugagcuucuaaguuucuuucccuucauucuacccugcaagccaaguucuguaagagaaaugccugaguucuagcucagguuuucuuacucugaauuuagaucuccagacccugccuggccacaauucaaauuaaggcaacaaacauauaccuuccaugaagcacacacagacuuuugaaagcaaggacaaugacugcuugaauugaggccuugaggaaugaagcuuugaaggaaaagaauacuuuguuuccagcccccuucccacacucuucauguguuaaccacugccuuccuggaccuuggagccacggugacuguauuacauguuguuauagaaaacugauuuuagaguucugaucguucaagagaaugauuaaauauacauuuccuacacca

SEQ ID NO: 616 - RNA, 3540 nt, Homo Sapiens
gcgggguuggagggacucagcuacgcgccuggggaggccgcgggcccucgcagacuaccgaacuuccauucugccgccggguuuucacaccugccggccccgaggaaacaaugacguugggauuuuggggggccgccccuugacucgggcgaaugggacacgaacggcgaccccuugcucucuuccauccgccugccgccguugcugcccaccgacuccuacagcucauuucucgcuccugcaggcuccaggaaugcaaauaauuucucacuggguuuuggcgggggcgcggagcugcggcgaagcgcgcgcccgacagcuuucgccgcagcuggguccccgggcgcuggcggcugcggcccccagauacgggcggaggcugcaauaugcacaugcggccacaguguggugccaggggcccgccgugggacacgcucggagcgcgacgccccaucccaucauuuacggaucaaaccaaauaaucuagaaucaaguugcugugugugucauacuccuccuguuuuuuuucccuaaacuuuuaguagagucauuuacauaguucaguuuuuaccucagcuguuacacaguggcaggaaaauauuuugucuccaaacuacagcccaaguaugagagcagcguauccugaagcuaauuaguaaccagaaaaucaggaagguaaagcaaaucucuggaggcaagaucuggacucuaugguaucgccgcuucuccccacuugaagcgucucuuugcagugccgcacuuggagauuuggacuuaaucguuaaacaaaaagaacaguuacauucugccuuccuacagggcaggggccuaggacuggcagcauuuuuguugucucuagaaauagagggguuaugagagagccucaaaagagagggcaagaauaacacauccauuucucaucaugaguuacccccuuguaugccuagaacgcguauggagacauucucuuuuaguaaagucaaagagaaaagccaugaacuaaguauccugaacacagaggcgugagcccucucagucucacagucccuuaggagucauuuaucucagaaguugguugaaacaaaaacaguucauacagcaugguaggcagaauucuaaaaugaucccaaugacucacucccuugcauaauccccuugaguguggguggaaccuaugacuugcuucuagccaacagaauaugacaagggugaugaaaugucacucuugggauugcuacauuauguaagacucuaucuuagcagucuggauggaaagucuccuccugaacuugaagagguaagcugccacgccaggagagggccuacaagagugccacaaggcaagggccucuaggagcugagaguggccccccacugaugggcagcaagaaagcaggaaccucaguccuacaaccacaaagaacugaauucugccagugaccuugugagccuggaagagcugcaaacagaaacacagcaaagucaacacccuaacugcagccuuggaagacucucagcagagcacucagcuaagcugugaugggaguccugacccauggaaacuggaagaucuuaaauguauguuguugcuaaauuuguuacacagcaauagaaaacaaauacacuccaacucuugacaaauuuguuaauaggaccacgcauccugagacaaacacacagaagggcaaacauccagauauaaacauccuacuacauugauaugaauacucacauauguaagaucaaugauaucacuagcaaaacaagcuccaagucaauggguuuuuccuuucgacaaacaccucuacacauaaccaaaaaugcuucaacuacuuuucuuuucuccagaggcaguugguuuggcuaaguaaaaaugggguucuuaggagacuaaggcggaaaagagacaauagugccuuuuuccccuccagaacuuaucuaagaauggaaggcagguguuucuaugcuauacauagcaugaauuuuacagucauggauacugauauaaugcuuccaaauagaauuaauucucuucccucccuuauucccacccacagccagcagaugcugaaagacugcacuguccaaacacugccaucuuugcuuuauauauccaaaagagugggaaaugcugucacaucuccaucagaaacugucaaacacuaguaaugguagaaaauaucugaaugacacaauuaauaggcuugauuuuguggaugcucuacuuuagaaagaaaauucauaugcuuuucaaacacacaugcaauauuagaaaaauuaagugugaacuaggccacaaagcaauuuucaacaaauacuaaugaacugauaccauguuuaacacaaauucuaaccaaagugcuauaacauuagaaaucaauaacaaaaaacuacccuccaaaaaacaucuaaguaauucaugaauaaaauaauguauaacagaaauuuaugaguuuuaaacuuaaaugguaaugguaguauuauauaucaaaacucacgagaugcagcuuuuagcagacauuacuaauuuccuacucaacaaucauuccccuaccuucaugacuuuggugucagccauaugauuagggcucggguccaccaaccagcugcauuuucuuggucuuagcauauacugauuaaauugaaaugacuaagagucagugagcugcaauugaauuccccauggcugacuguggcaaaacauuuuaaaauagggcauagacagcaccaaccaaaaauguugguguauuguacuguaguaaaauuaacaagucuuguucauugaaaacaaacaaaacuuuaauauuauagugaaaagaaaagccacagagugggagaagauauuuaagacacuugaaaaaggacuuauauccagaauauauaaauaacuccuauaagucaguaagaaaaagacagacaauagaaaaauuaucaaaaagagcuuacaaaaaaggauacccaaauagguaauaaacgugaaaaauggucaauaucauagucauuagggaaaugcuuaauuugcauuuguauauccaaaagagugggaaauuguaacauaccuccaucagauacugucgaacauuaguaaugguagaaaauauuugaaacauguaaacaaaaauauccacagcauuacuauuuguaaguggucaaaaccagaagcaacccgagccccucagcagaaugggaaaauaugaaauauacaguaauaagaacaaaugaacuucaauuuacaacauguauacuguucacaaucauaauguugagaaaaauaaaccagacacaaaagaguacauccugucccauaccguagcccuuuauaugaaguucaaaaauaggcaaaaaaccuauggugcuggaagucagugucagggguggacuagaaaugggcaagaaggaguuucugaggugcuggaaaugucuaaaauagaucuggaugcuguuuacuuugaaaaaauuuacuguggcguacauuuauggcuuguuguacauaaguuauauuucaaugaaaauucacauuaaaauguaauguaaaaaaga

SEQ ID NO: 617 - RNA, 2427 nt, Homo Sapiens
gaaggaaagcgcaugcgcgucgggcacagcgcgugcagccucgugcagcucuucuggucuccggcgcccgccccucagacguaauguugaauuaaagaaaauacuuuaucagaagaagauggccacugcccaguugcagaggacucccauguguucuacuuucccuugaauuuuagagugcacugguauuucccaauaagauaucaacugaacaccagucuuugguguuagugaagaggcuucuagcaguuucaguauccuguaucacguauuugaggggaauauucccagaaugcgcuuauggaacaagauaucuagaugaucuuugugucaaaauacugagagaagauaaaaauugcccaggaucuacacaguuagugaaauggaugcuaggauguuaugaugcuuuacagaaaaaauauguaagucuugcaaucucuuuauccuuuuuuuucuacaguuuaugaucuacaaauauaacuggaguuaugauguaguaaaacauucauuugaacuaacuugaguguaggucagucugaauuacugaaaagccuaaacauuugaauauuuuaaagacuaaucaucaacucauuuaaagauaauggaauuaacacuaaacaaauuuuuccaagcuaguuuuuuuaacacuuauuuguauuaauaacacguguuaacuuacaaaaaaguuaaugaauuaaagagucuuuucaaauaguuuauucauuaguuucacaugccuucuacaagcuuguuuauacuaauaauuuaauaaauuauuucuaaggaugguuguucuagcuguauacacaaacccagaagauccucagcugcgauauuuucuauuuaagacaauuucagaauguuaccaauucaaauucaaauacaccaauaauggaccacucauggacuucauaaguaaaaaccaaagcaacgaaucuagcauguugucuacugacaccaagaaagcaagcauucuccucauucgcaagauuuauauccuaaugcaaaaucuggggccuuuaccuaaugauguuuguuugaccaugaaacuuuuuuacuaugaugaaguuacuuuuuugcaguuacacccccagauuaccagccucccgguuuuaaggauggugauugugaaggaguuauauuugaaggggaaccuauguauuuaaaugugggagaagucucaacaccuuuucacaucuucaaaguaaaagugaccacugagagagaacgaauggaaaauauugacucaacuauacuaucaccaaaacaaauaaaaacaccauuucaaaaaauccugagggacaaagauguagaagaugaacaggagcauuauacaagugaugauuuggacauugaaacuaaaauggaagaacaggaaaaaaacccugcaucuucugaacuugaagaaccaaguuuaguuugugaggaagaugaaauuaugaggucuaaagaaaguccagaucuuucuauuucucauucucagguugagcaguuagucaauaaaacaucugaacuugauaugucugaaagcaaaacaagaaguggaaaagucuuucagaauaaaauggcaaauggaaaucaaccaguaaaaucuuccaaagaaaaucggaagagaagucaacaugaaucugggagaauacagcccuacugaagauuauacauuuugcaaguacauacuuucagcagccauuggaagauguuaauaauaaauuuuacucuacuuuuaagaaacccagauauaguuaugcuagguccuccaucacuuugauucuucuagucaagagucagugccaaaaaggagaaaguuuagugaaccaaaggaacauauauaaaaauuauuuuuguucugcaggcuugcagaguucuucucaccauuuaaacugaaggacccuauauuauauuucccuaacucugaagauguauauguaguuuaaagcaguuuguacacuaaaacuaaguuuuuggcugacugucauauugugguccuuaaucuugagauaaauccaauagaacuuuugaauaaaagcaaaaguacaaaugucauaauugauucgguaauaaguaaaauuucaaaauugauuuuguucauuaccuacuuaauauuuccuuuaaauauauacuaacuguuaaggcccucuaaugccauuuuucuaaacaguaauguuuacuuugguauuaaaauuugguauggauucacuuuuuacuuauguuaaaauuauaccauuuaacuggcucuuuugucauugugcuguuauuaaaacaauguucuucaauauuuugacauaauguauuaacauuuuaauauauaauguacaauuuaagaauuggugcuuuaccuuuacuaugcuuuuuuuuacaggacaaaaagacugauuuuuaaaguauggcauuuuuugcagcauaaauaaaauauuguucaguacguag

SEQ ID NO: 618 - RNA, 535 nt, Homo Sapiens
aagaugaagccugaacugauuauaaaaccuuccuuggcucagugcccuucaccacugcuggcuuuuugcuguagcuccacauuccugugcauugagggguuaacauuaggcugggaagaugacaaaacuugaagagcaucuggagggaauugucaauaucuuccaccaauacucaguucggaaggggcauuuugacacccucucuaagggugagcugaagcagcugcuuacaaaggagcuugcaaacaccaucaagaggccuaagaaagggucuuaauaucaaagauaaagcugucauugaugaaauauuccaaggccuggaugcuaaucaagaugaacaggucgacuuucaagaauucauaucccugguagccauugcgcugaaggcugcccauuaccacacccacaaagaguagguagcucucugaaggcuuuuuacccagcaauguccucaaugagggucuuuucuuucccucaccaaaacccagccuugcccguggggaguaagaguuaauaaacacacucacgaaaaguu

SEQ ID NO: 619 - RNA, 1006 nt, Homo Sapiens
gagaaaccagagacuguagcaacucuggcagggagaagcugucucugauggccugaagcugugggcagcuggccaagccuaaccgcuauaaaaaggagcugccucucagcccugcaugucucuugucagcugucuuucagaagaccugguaagugggacugucuggguuggccccgcacuuugggcuucucuuggggagggucagggaaguggagcagccuuccugagagaggagagagaaagcucagggaggucuggagcaaagauacuccuggagguggggagugaggcagggauaaggaaggagaguauccuccagcaccuuccaguggguaagggcacauugucuccuaggcuggacuuuucuugagcagaggguggggugguaaggaaagucuacgggccccgugugugugcacaugucucugugugaauggacccuuccccuucccacacguguaucccuaucaucccacccuucccaccagagccauagccaucugcugguuugguuauuuggagagugcaggccaggacaaggccaucgcuuggggcaugaauccucugcguacugcccuggccagaugcaaauucccugccaugggauuccccagaagguucuguuuuucagguggggcaaguccgugggcaucauguugaccgagcuggagaaagccuugaacucuaucaucgacgucuaccacaaguacucccugauaaaggggaauuuccaugccgucuacagggaugaccugaagaaauugcuagagaccgaguguccucaguauaucaggaaaaagggugcagacgucugguucaaagaguuggauaucaacacugauggugcaguuaacuuccaggaguuccucauucuggugauaaagaugggcguggcagcccacaaaaaaagccaugaagaaagccacaaagaguagcugaguuacugggcccagaggcugggccccuggacauguaccugcagaauaauaaagucaucaauaccuca

SEQ ID NO: 620 - RNA, 10261 nt, Homo Sapiens
uaugucuucuaaagauaaugucgauuguguauggcugaugggauucuaggaccaagcaagagguuuuuuuuuuucccccacauacuuaacguuucuauauuucuauuugaauucgacuggacaguuccauuugaauuauuucucucucucucucucucugacacauuuuaucuugccagguucuaaaccuuuaggaaaaauggagcaauuuccaaaggaaaccguuguggagagcagugggccaaagguuuuggaaacagcagaagagauccaggagaggcgucaggaaguguugacucgguaucaaaguuucaaggagcgggucgcugagaggggucagaagcuugaggauuccuaucacuuacaaguuuucaagcgagaugcagaugaucuggggaaguggaucauggagaaagucaauaucuuaaccgauaagagcuaugaagacccaacuaauauacaggggaaauaucagaagcaucaaucccuugaagcagaggugcaaacaaaaucaagacucaugucugaacuggaaaaaacaagggaagaacgauuuaccaugggucauucugcccacgaagaaacgaaggcccauauagaggagcuacgccaccugugggaccugcuguuagagcugacccuggagaagggugaccaguugcugcgggcccugaaguuccagcaguauguacaggagugugcugacaucuuagaguggauuggagacaaggaggcuauagcgacaucaguggagcuaggugaagacugggagcgcaccgaaguucugcauaagaaauuugaagacuuccaaguggagcugguagcuaaagaagggagaguuguugaagugaaccaauaugccaaugagugugccgaggaaaaccauccugaccuacccuuaauucagucuaagcaaaaugaggugaaugcugccugggagcgccuucgugguuuggcucuccagagacagaaagcucuguccaaugcugcaaacuuacaacgauucaaaagggaugugacugaagccauccaguggaucaaggagaaggaaccuguacucaccucugaggacuauggcaaagaccuuguugccucugaaggacuguuucacagucacaagggacuugagagaaaucuugcugucaugagugacaaggugaaggaguuaugugcuaaagcagagaagcugacacuuucccauccuucagaugcaccucagauccaggagaugaaagaagaucuggucuccagcugggagcauauucgugcccuggccaccagcagauaugaaaaacugcaggcuacuuauugguaccaucgauuuucaucugacuuugaugaacucucaggcuggaugaacgagaagacugcugcgaucaaugcugaugagcugccaacagauguggcugguggagaaguucugcuggacaggcaucagcagcauaagcaugagauugacucuuacgaugaccgauuucaaucugcugaugagacuggucaagaccucgugaaugccaaucaugaagccucugaugaaguucgggaaaagauggaaauacuugacaacaacuggacugcccugcuggaacugugggacgagcgucaucgucaguaugagcagugcuuggacuuucaucucuucuacagagacagugagcaaguggacaguuggaugaguagacaagaggccuuccuggaaaacgaggaucugggaaacucacugggcagugcagaagcccuucuucagaagcaugaagacuuugaggaagccuuuacugcccaggaagagaagaucauaacuguagacaagacugcaaccaaauugauuggugaugaccauuaugauucagagaacaucaaggcuauccgugacgggcuguuagcccggcgggaugcccuacgugaaaaggcugccacuagacguagauugcugaaggagucauugcuucugcaaaaacuguaugaggacucagaugaccuaaagaacuggaucaacaagaagaaaaaguuggcagaugaugaagauuacaaggacauacagaacuugaagagcaggguucaaaagcagcaagucuuugaaaaggaguuggcaguuaauaagacccagcuggaaaacauacagaaaacuggccaagagaugauugaggguggucacuaugccucugacaaugugaccacucgucugagugaaguugccagccucugggaggaguugcuggaggcuacaaaacagaaagggacccaguugcaugaggccaaccagcagcugcaauuugaaaauaaugcagaagauuugcagcgcuggcuggaggauguugaguggcaagucaccucugaggauuaugggaaaggccuggccgagguacagaaucgacucaggaaacacggccuccuggagucggcuguggcugcucgucaggaucagguggauauccuuacagaccuggcugcauauuuugaagaaauaggccauccugauucuaaggauauaagggcaaggcaagaguccuugguaugccgauuugaagcucugaaagagccacuggccacccgaaagaagaagcucuuagaccuucuccaucugcagcugauuuguagagacacagaggaugaggaggccuggauccaagagacugaacccucagcuacuuccaccuaccuuggaaaggaccugauugcuuccaaaaagcuucugaauaggcauagagucauccuggagaacauugccagccaugaaccacgcauucaagagauaacagaaaggggaaacaaaaugguagaggaaggacacuuugcugcagaagauguggccucuagggucaagaguuugaaccagaauauggagucucuccgugcucgagcugcuaggcgacaaaaugaucuugaagccaauguccaguuccagcaguaccuggcugaccugcaugaagcagaaacauggaucagagagaaggaaccuauuguagauaauacuaacuauggugcugaugaagaagcagcuggggcucuucuaaagaagcaugaggccuuucuauuagaucucaauucauuuggagacaguaugaaagcucugcggaaucaggcaaacgccugccagcaacaacaggcugcaccaguggagggaguugcuggagaacaaagggucauggcuuuauaugacuuccaggcccgcagcccccgagaagucaccaugaagaaaggugaugucuuaacgcugcucaguuccaucaauaaggacugguggaagguggaagcugcugaucaucagggcauugucccagcugucuaugucagaagacuggcccacgaugaguucccgaugcucccacagcggcgacgagaagagccaggaaacaucacccagcgccaggagcagauugagaaccaauaccgcucccucuuggaucgggcagaagaacgcagacgucgucuauugcaacguuauaaugaauuuuuauuggccuaugaggcaggagacaugcuggaauggauucaagagaaaaaggcagaaaacacuggaguggaacuagaugauguuugggagcugcagaaaaaguuugaugaguuccaaaaggauuugaauaccaaugagccucggcuaagggauaucaacaagguagcugaugaucuacuauuugaaggacuucuaacaccagaaggagcucaaauccggcaggaauugaauucccgcugggguucuuugcagaggcuugcagaugaacagcggcagcugcugggcagugcccaugcuguugaaguguuucacagagaagcagaugacacgaaggagcagauugagaagaaaugccaggcccucagugcugcagacccuggcucagaucuguucaguguucaggcucuucagcgacggcaugagggcuuugaaagggaccucguaccccugggagauaaggugaccauacugggggagacagcagagcggcucagugagucccauccagaugccacugaggaccugcagagacagaaaauggagcugaaugaggccugggaagaccugcaggggcguacaaaggaucguaaggagagccuaaaugaggcccagaaauucuaccuguuccucagcaaggccagggaucugcagaacuggaucaguagcauugguggcaugguaucaucacaggagcuggccgaagacuuaacuggcauagagaucuugcuggagagacaucaggagcaccgugcugacauggaggcagaggcucccaccuuccaggccuuagaggacuucagugcagaacuuaucgacagugggcaccaugcuagcccugaaauugaaaaaaagcuucaagcugucaagcuagagagagaugauuuggagaaggcuugggaaaaacgcaagaagauccuagaccagugccuggaguugcagauguuccaggggaacugugaucaaguugagagcuggaugguggcacgugagaauucccugaggucagaugacaaaaguuccuuagacagucuggaggcuuugaugaagaaacgggacgauuuggacaaagcaaucacugcccaggaagggaagaucacugaccuagaacauuuugcugagagccucauugcugaugaacacuaugccaaagaagagauugcuacgcggcuccaacguguacuagacagguggaaggcucucaaagcacaacugauugaugagcggacaaagcuuggagacuaugccaaccuaaaacaauucuaccgagaccuugaggagcuggaagaauggaucagugagaugcugcccacagccugugaugaauccuacaaagacgccacuaacauucagaggaaauaccugaaacaccagaccuuugcacaugaagucgauggccgaucugagcaggugcauggcgucaucaaccuggggaacucccugauugaguguagcgcuugugauggcaaugaagaggccaugaaggagcaacuggaacagcugaaggaacauugggaucaucugcuugagagaacaaaugacaaagggaagaagcucaaugaggccagucgucaacagagguucaacacaagcauccgggacuuugaguucuggcucucagaggcagagacauugcuggccaugaaagaucaggccagggacuuggcuucagcaggaaaccuacucaagaagcaucagcuauuggagagagagauguuggcucgagagguaaguaguguuggcaucccucuccucugggcagaauagaaauauuucuggcucuucucccucccauguuaggagaccauuugaaaacauagccuugcaaaauuguucuuaguguucucaaccagcagucauuuuaauuagguaaaauuaacgggcugugaagacauuaaaacugucacugauaaucaauuaucccuaaacuauagacuuuaagauuccagaaaguggaccugggaaacuaucuuuuuuaucuuuuacugaugcauacauauaagccaauugucuuuaagcuauauauuugaucugguauuugaaagaaaguggaaguuuacuuuauagaauuacaaacaaaagaugcacucaaggaccugaauacauuggcugaagauuugcucuccagcgggacuuucaacguugaucagauugugaagaaaaaagauaaugucaacaagcguuuccugaauguccaagaauuggcagcugcacaccacgaaaaauugaaagaggccuaugccuuguuccaguucuuccaggaucuagaugaugaggaauccuggauagaggagaaguugauacgagugagcucccaggacuaugggagagaucuucaggggguucagaacuugcugaagaagcacaaacgccuagagggggagcugguggcccaugagccugccauccagaaugugcuggauauggcagagaagcugaaagacaaggcugcuguggggcaagaggagauccaguugcggcuggcucaguuuguugaacacugggagaagcucaaagaguuggccaaggcccgaggacuuaaguuggaagaaucccuagaauacuugcaauucaugcagaaugcugaggaagaggaagcuuggaucaaugaaaagaaugcuuuggcuguccgaggagauuguggagauacauuagcugcuacucagagcuugcuaaugaagcaugaagcuuuggaaaaugacuuugcuguccaugagacccgaguacaaaaugugugugcacaaggagaagacauccuaaauaagguguugcaggaggaaagucagaacaaagagauuucuuccaagauagaggcucugaaugaaaagaccccuucucuggcuaaggcaauagcugcuuggaaguugcaauuggaagacgauuaugccuuucaggaauucaacuggaaggcugaugugguagaggcuuggauagcugauaaggaaacaagccuaaagaccaauggcaauggugcagaccuuggugacuuccucacucuucuggcaaaacaggacacucuggaugccagucugcagaguuuccagcaagagagacuucccgagaucacugaccugaaggacaaacugauuucugcucaacacaaccagucuaaagccauugaagagcguuaugccgcucugcugaagcgcugggaacaguugcuggaagccucggcaguccacagacagaaauugcuggagaaacagcugccucuacagaagguuuaaaaaaauuaugaggcaugaucaguucucuguuaccuguauauuagccaugaaauucggaaacagauauuggaaacucaguuuggauaauacaaaaaccuuuuauugcauugaaagauguugggaagacauucuuacugagcaaaaaguagauugaaaagaagcuuuaaaaauuuuuuuuagauugauugauuaguugcauaacuaacuugagauggaagccaggcaaacaguggaagagguggauggaacaagaggaugaucauauaauugaaaacuaccuuugcuacuuuuggaauuuuaaaacugaaauaauuuuagaaauaauucgaccucccucauuuguaaaugaugaaagacuuaaacaauuucacacaaugagaaaaugccagaaccagggcucguaccgcuaacucacauguucaaccaucaaaguacacagucccuauugguuuuaguucugcccuuuuagauugguggcccugcagauauuuaaagacaggcauuauuuuuauccucaaucuucucuucugcugagaggcuuuaucaggaaagaugguagugucuuuuuuuucucucugcaggcugaggaccuguucguggaauuugcacauaaggcuucagcuuugaacaacuggugugaaaagauggaagaaaacuugucagagccugugcacugugucucccugaaugaaauucggcagcugcagaaagaccaugaggacuucuuggccucccuggcuagggcucaagcagacuuuaaauguuugcuggagcuagaccagcagauuaaggccuuaggugugccuuccagcccuuauaccugguuaacaguggaggugcuggaaaggaccuggaagcaccuaucugacaucauugaggaacgggagcaggagcugcaaaaggaagaggcaagacaggucaagaacuuugagaugugucaggaguuugaacagaaugccaguaccuuccuucaauggauccuggaaaccaggugugcuaugcuacaucccaaaccaugaccccugugucccuuuucucucaugugauuccuguuccggaccuccauguccagggcuuacuuucuggauggaucauugcucaaagaaacaggaacucuggaaucucagcuggaagcaaauaaaagaaaacagaaggagauccaggcgaugaagcgucaacuaaccaagauuguggaccugggggacaacuuggaagacgcucugauccuugauaucaaauacagcaccauuggauuggcucagcagugggaccagcucuaccagcuuggguugcggaugcaacacaaccuggagcaacagauccaggccaaguauugagggcguguggccagagcagggagggaugcaggugguguuagguguuaggaccuuaacuaagggcgagaguuuggugcaccagauaaaagaguugcuucagagaaccaauauucugggucuuuacugccccacggaaugacuauuucucuuuauacugaaauccaucaugaaauaaaagacagugcucuccauccaccugagccuacucaucacccacuuggacaacaacugacuuuuauacccaauuucucagaguucuuucaccaucuuaugugaucucuuaggaaaccauucccuuucauagaauuuuaucuaaaauguaaugucuagauuaaaagaaacauuuaaaguguggccaaauagagcagaagggcagaaacucauuuucuagauaaauucacuauaucaaagcagcucuaggucucaauagcauuuuggcaacauuuuuaucuagauuaggagauugucuucaaccauaugaaaauguaaaaucuacucuuggcucauggacuguacaaaagcagguggcagccuagauuuggcccauggacuauaguuugccaacucuugaacuagaugacucaaauagcaaauuguccauuaaaauuccucucucuuccauguggcuuguguucugcuaaccuguguuucauauacagggaaaauucauguuuuuuuuuuuucuuucagggacaucaaaggugugagugaagagacucuaaaggaauuuagcacaaucuauaaacacuuugaugagaauuugacagggcgccugacucacaaagaguuccgguccugccugagaggacucaauuacuacuugcccaugguggaggaggaugaacaugagcccaaguuugagaaguuccuggaugcuguggauccagggaggaagggcuaugucucacuggaggacuauacugcuuuccugauugacaaggagucagaaaacaucaaguccagugaugaaauagagaaugccuuccaagcccuggcagagggcaagucauauauuaccaaagaagacaugaagcagguccgauucugguugcuuccccuacuacacugucauccuaauuugaauucuggucaucucaggcccggaaacuguacacauuaaaggugcaauucuuuaucaaucauaccucgacaaagcuguuacaaaaagaaaaugauguggucuuccagacacuaucuggagccacccacccacacgcuaacuuauuggagucuuuagggauccacuugguaaucaaacagcacagugaauagaggaacucuuuggcauaagaggaucauagguucaagucccagcucuaccacuuucuggcaguguaaccacuggcccuuaccccagagcaagugucauucugugccacacauaugcagcaauauauggacccacggggucgaagccaucucucuggcuaugacuacguuggcuucaccaauuccuacuuuggcaacuaauaagcagcuccucguggaucguagaaaaucuuagugucgugggaaauuuacuggggggcaaagaguacaggcaaauguggaagauaaagauggccucgugugugugugugugugugugugugugugugugugcuuguguuugugugcauauuacauuuauuguaggaucuuaaaaaaucucaagggugggagauagaaagguuaauagaguuggaggaguggaagcuauuuuguaugcaacuagucacugcugaggggugucaaaguuucuauuuuuauuuguucuguuuugcacgucuuuaucauuuugcuuuauuccgauuauagaauaaaguaauucuuuuuaaaaauauuuuuuggggcaaaguuaaguaaaauguugagcuucuauauuucugggaacuguacucauauaagagugggcagcuaauuuuacuguaaagaagggccaugguauaguagauaaauaaaauccaaggcaauuuucaaacaauuuuuuuaaacuuuggaauguguuuaaauuuaaauuugaaaauaaagauauuugauuuucuggggaacaugaauauuuuaguuuguacaaugaaacaacacacagaucagcauaacaccuguuuucuucuuguuuuuuuuccauacuucaaaauuauuguagauguuauuacucucagaaagacaaaauuccagcauagcagggcuuucucuuguccuccaagcucccguauuuucucuuaaguuuuaauguaauaaaaauaauacuucaauauccuguuaaa

SEQ ID NO: 621 - RNA, 996 nt, Homo Sapiens
augugcuggacuaugcccucuccauuuacagguagcucuacuagaaauauggagagcggaaaccaaucaacagugacugaauuuaucuucacuggauucccucagcuucaggaugguagucuccuguacuucuuuccuuuacuuuucaucuauacuuuuauuaucauugauaacuuauuaaucuucucugcuguaaggcuggacacccaucuccacaaccccauguauaauuuuaucaguauauuuuccuuucuggagaucugguacaccacagccaccauucccaagaugcucuccaaccucaucagugaaaagaaggccaucucaaugacuggcugcaucuugcagauguauuucuuccacucacuugaaaacucagaggggaucuugcugaccaccauggccauugacagauacguugccaucugcaacccucuucgcuaucaaaugaucaugaccccccggcucugugcucaacucucugcagguuccugccucuucgguuuccuuauccugcuucccgagauugugaugauuuccacacugccuuucugugggcccaaccaaauccaucagaucuucugugacuuggucccugugcuaagccuggccuguacagacacguccaugauucugauugaggaugugauucaugcugugaccaucaucauuaccuuccuaaucauugcccuguccuauguaagaauugucacugugauauugaggauucccucuucugaagggaggcaaaaggcuuuuucuaccugugcaggccaccucauggucuucccgauauucuuuggcaguguaucacucauguacuugcguuucagcgacacuuauccaccaguuuuggacacagccauugcacugauguuuacuguacuugcuccauucuucaaucccaucauuuauagccugagaaacaaggacaugaacaaugcgauuaaaaaacuguucugucuucaaaaaguguugaacaagccuggagguuaa

SEQ ID NO: 622 - RNA, 1050 nt, Homo Sapiens
uccuuguugacuccauuuguugcuuucagacacugauauagcagaaugaagagaaagaacuucacagaagugucagaauucauuuucuugggauuuucuagcuuuggaaagcaucagauaacccucuuugugguuuuccuaacugucuacauuuuaacucugguugcuaacaucaucauugugacuaucaucugcauugaccaucaucuccacacucccauguauuucuuccuaagcaugcuggcuaguucagagacgguguacacacuggucauugugccacgaaugcuuuugagccucauuuuucauaaccaaccuaucuccuuggcaggcugugcuacacaaauguucuuuuuuguuaucuuggccacuaauaauugcuuccugcuuacugcaaugggguaugaccgcuauguggccaucugcagaccccugagauacacugucaucaugagcaagggacuaugugcccagcugguguguggguccuuuggcauuggucugacuauggcaguucuccaugugacagccauguucaauuugccguucuguggcacagugguagaccacuucuuuugugacauuuacccagucaugaaacuuucuugcauugauaccacuaucaaugagauaauaaauuaugguguaaguucauuugugauuuuugugcccauaggccugauauuuaucuccuauguccuugucaucucuuccauccuucaaauugccucagcugagggccggaagaagaccuuugccaccugugucucccaccucacugugguuauuguccacuguggcugugccuccauugccuaccucaagccgaagucagaaaguucaauagaaaaagaccuuguucucucagugacguacaccaucaucacucccuugcugaacccuguuguuuacagucugagaaacaaggagguaaaggaugcccuaugcagaguugugggcagaaauauuucuuaauggauuggauuauuucauuaagagaccauuagcccaguguagugugucuacucacaaacaugccacaauacacaa

SEQ ID NO: 623 - RNA, 1483 nt, Homo Sapiens
aggagcguuuuuggagaaagcugcacucuguugagcuccagggcgcaguggagggagggagugaaggagcucucuguacccaaggaaagugcagcugagacucagacaagauuacaaugaaccaacucagcuuccugcuguuucucauagcgaccaccagaggauggaguacagaugaggcuaauacuuacuucaaggaauggaccuguucuucgucuccaucucugcccagaagcugcaaggaaaucaaagacgaauguccuagugcauuugugucucugguuccuagggccuuucuugucauggggcugaaaugaacccucagcucucagacagggaggcucugggcugguucucucuacagauggccuguauuuucuccgcacugagaaugguguuaucuaccagaccuucugugacaugaccucuggggguggcggcuggacccugguggccagcgugcacgagaaugacaugcgugggaagugcacggugggcgaucgcugguccagucagcagggcagcaaagcagucuacccagagggggacggcaacugggccaacuacaacaccuuuggaucugcagaggcggccacgagcgaugacuacaagacacuuugaaucacaacuuccuccuaacaaggcuguuagggcccuggguguggugggaucaucggcugggaguggggugucugaguaugguuggccaucugcucaucuggaguccagagcucucacaguccagcugaaguugcauguguggaccuucugccuccugggaccuccuggcccagucaggcucagugucuguugcuuuccagaacccuggcuacuacgacauccaggccaaggaccugggcaucuggcacgugcccaauaagucccccaugcagcacuggagaaacagcucccugcugagguaccgcacggacacuggcuuccuccagacacugggacauaaucuguuuggcaucuaccagaaauauccagugaaauauggagaaggaaaguguuggacugacaacggcccggugaucccuguggucuaugauuuuggcgacgcccagaaaacagcaucuuauuacucacccuauggccagcgggaauucacugcgggauuuguucaguucaggguauuuaauaacgagagagcagccaacgccuugugugcuggaaugagggucaccggauguaacacugagcaccacugcauugguggaggaggauacuuuccagaggccaguccccagcaguguggagauuuuucugguuuugauuggaguggauauggaacucauguugguuacagcagcagccgugagauaacugaggcagcugugcuucuauucuaucguugagaguuuugugggagggaacccagaccucuccucccaaccaugagaucccaaggauggagaacaacuuacccaguagcuagaauguuaauggcagaagagaaaacaauaaaucauauugacucaag

SEQ ID NO: 624 - RNA, 9370 nt, Homo Sapiens
aggaaaagccccagaaaaagcggagggagugagagccagaggcugcugcugccguuugcaagaacugcaggggaggaggacgcugccacccacagccucuagagcucauugcagcugggacagcccggagugugguuagcagcucggcaagcgcugcccagguccuggggugguggcagccagcgggagcaggaaaggaagcauguucccaggcugcccacgccucuggguccugguggucuugggcaccagcuggguaggcugggggagccaagggacagaagcggcacagcuaaggcaguucuacguggcugcucagggcaucaguuggagcuaccgaccugagcccacaaacucaaguuugaaucuuucuguaacuuccuuuaagaaaauugucuacagagaguaugaaccauauuuuaagaaagaaaaaccacaaucuaccauuucaggacuucuugggccuacuuuauaugcugaagucggagacaucauaaaaguucacuuuaaaaauaaggcagauaagcccuugagcauccauccucaaggaauuagguacaguaaauuaucagaaggugcuucuuaccuugaccacacauucccugcggagaagauggacgacgcuguggcuccaggccgagaauacaccuaugaauggaguaucagugaggacaguggacccacccaugaugacccuccaugccucacacacaucuauuacucccaugaaaaucugaucgaggauuucaacucggggcugauugggccccugcuuaucuguaaaaaagggacccuaacugagggugggacacagaagacguuugacaagcaaaucgugcuacuauuugcuguguuugaugaaagcaagagcuggagccagucaucaucccuaauguacacagucaauggauaugugaaugggacaaugccagauauaacaguuugugcccaugaccacaucagcuggcaucugcugggaaugagcucggggccagaauuauucuccauucauuucaacggccagguccuggagcagaaccaucauaaggucucagccaucacccuugucagugcuacauccacuaccgcaaauaugacugugggcccagagggaaaguggaucauaucuucucucaccccaaaacauuugcaagcugggaugcaggcuuacauugacauuaaaaacugcccaaagaaaaccaggaaucuuaagaaaauaacucgugagcagaggcggcacaugaagaggugggaauacuucauugcugcagaggaagucauuugggacuaugcaccuguaauaccagcgaauauggacaaaaaauacaggucucagcauuuggauaauuucucaaaccaaauuggaaaacauuauaagaaaguuauguacacacaguacgaagaugaguccuucaccaaacauacagugaaucccaauaugaaagaagaugggauuuuggguccuauuaucagagcccaggucagagacacacucaaaaucguguucaaaaauauggccagccgccccuauagcauuuacccucauggagugaccuucucgccuuaugaagaugaagucaacucuucuuucaccucaggcaggaacaacaccaugaucagagcaguucaaccaggggaaaccuauacuuauaaguggaacaucuuagaguuugaugaacccacagaaaaugaugcccagugcuuaacaagaccauacuacagugacguggacaucaugagagacaucgccucugggcuaauaggacuacuucuaaucuguaagagcagaucccuggacaggcaaggaauacagagggcagcagacaucgaacagcaggcuguguuugcuguguuugaugagaacaaaagcugguaccuugaggacaacaucaacaaguuuugugaaaauccugaugaggugaaacgugaugaccccaaguuuuaugaaucaaacaucaugagcaauuuuacacuuucagcuaucaauggcuaugugccugagagcauaacuacucuuggauucugcuuugaugacacuguccaguggcacuucuguaguguggggacccagaaugaaauuuugaccauccacuucacugggcacucauucaucuauggaaagaggcaugaggacaccuugacccucuuccccaugcguggagaaucugugacggucacaauggauaauguuggaacuuggauguuaacuuccaugaauucuaguccaagaagcaaaaagcugaggcugaaauucagggauguuaaauguaucccagaugaugaugaagacucauaugagauuuuugaaccuccagaaucuacagucauggcuacacggaaaaugcaugaucguuuagaaccugaagaugaagagagugaugcugacuaugauuaccagaacagacuggcugcagcauuaggaaucaggucauuccgaaacucaucauugaaucaggaagaagaagaguucaaucuuacugcccuagcucuggagaauggcacugaauucguuucuucaaacacagauauaauuguugguucaaauuauucuuccccaaguaauauuaguaaguucacugucaauaaccuugcagaaccucagaaagccccuucucaccaacaagccaccacagcugguuccccacugagacaccucauuggcaagaacucaguucucaauucuuccacagcagagcauuccagcccauauucugaagacccuauagaggauccucuacagccagaugucacagggauacgucuacuuucacuuggugcuggagaauucaaaagucaagaacaugcuaagcauaagggacccaagguagaaagagaucaagcagcaaagcacagguucuccuggaugaaauuacuagcacauaaaguugggagacaccuaagccaagacacugguucuccuuccggaaugaggcccugggaggaccuuccuagccaagacacugguucuccuuccagaaugaggcccuggaaggacccuccuagugaucuguuacucuuaaaacaaaguaacucaucuaagauuuugguugggagauggcauuuggcuucugagaaagguagcuaugaaauaauccaagauacugaugaagacacagcuguuaacaauuggcugaucagcccccagaaugccucacgugcuuggggagaaagcaccccucuugccaacaagccuggaaagcagaguggccacccaaaguuuccuagaguuagacauaaaucucuacaaguaagacaggauggaggaaagaguagacugaagaaaagccaguuucucauuaagacacgaaaaaagaaaaaagagaagcacacacaccaugcuccuuuaucuccgaggaccuuucacccucuaagaagugaagccuacaacacauuuucagaaagaagacuuaagcauucguuggugcuucauaaauccaaugaaacaucucuucccacagaccucaaucagacauugcccucuauggauuuuggcuggauagccucacuuccugaccauaaucagaauuccucaaaugacacuggucaggcaagcuguccuccaggucuuuaucagacagugcccccagaggaacacuaucaaacauuccccauucaagacccugaucaaaugcacucuacuucagaccccagucacagauccucuucuccagagcucagugaaaugcuugaguaugaccgaagucacaaguccuuccccacagauauaagucaaauguccccuuccucagaacaugaagucuggcagacagucaucucuccagaccucagccaggugacccucucuccagaacucagccagacaaaccucucuccagaccucagccacacgacucucucuccagaacucauucagagaaaccuuuccccagcccucggucagaugcccauuucuccagaccucagccauacaacccuuucuccagaccucagccauacaacccuuucuuuagaccucagccagacaaaccucucuccagaacucagucagacaaaccuuucuccagcccucggucagaugccccuuucuccagaccucagccauacaacccuuucucuagacuucagccagacaaaccucucuccagaacucagccauaugacucucucuccagaacucagucagacaaaccuuuccccagcccucggucagaugcccauuucuccagaccucagccauacaacccuuucucuagacuucagccagacaaaccucucuccagaacucagucaaacaaaccuuuccccagcccucggucagaugccccuuucuccagaccccagccauacaacccuuucucuagaccucagccagacaaaccucucuccagaacucagucagacaaaccuuuccccagaccucagugagaugccccucuuugcagaucucagucaaauuccccuuaccccagaccucgaccagaugacacuuucuccagaccuuggugagacagaucuuuccccaaacuuuggucagaugucccuuuccccagaccucagccaggugacucucucuccagacaucagugacaccacccuucucccggaucucagccagauaucaccuccuccagaccuugaucagauauucuacccuucugaaucuagucagucauugcuucuucaagaauuuaaugagucuuuuccuuauccagaccuuggucagaugccaucuccuucaucuccuacucucaaugauacuuuucuaucaaaggaauuuaauccacugguuauagugggccucaguaaagaugguacagauuacauugagaucauuccaaaggaagagguccagagcagugaagaugacuaugcugaaauugauuaugugcccuaugaugaccccuacaaaacugauguuaggacaaacaucaacuccuccagagauccugacaacauugcagcaugguaccuccgcagcaacaauggaaacagaagaaauuauuacauugcugcugaagaaauauccugggauuauucagaauuuguacaaagggaaacagauauugaagacucugaugauauuccagaagauaccacauauaagaaaguaguuuuucgaaaguaccucgacagcacuuuuaccaaacgugauccucgaggggaguaugaagagcaucucggaauucuugguccuauuaucagagcugaaguggaugauguuauccaaguucguuuuaaaaauuuagcauccagaccguauucucuacaugcccauggacuuuccuaugaaaaaucaucagagggaaagacuuaugaagaugacucuccugaaugguuuaaggaagauaaugcuguucagccaaauagcaguuauaccuacguauggcaugccacugagcgaucagggccagaaaguccuggcucugccugucgggcuugggccuacuacucagcugugaacccagaaaaagauauucacucaggcuugauagguccccuccuaaucugccaaaaaggaauacuacauaaggacagcaacaugccuauggacaugagagaauuugucuuacuauuuaugaccuuugaugaaaagaagagcugguacuaugaaaagaagucccgaaguucuuggagacucacauccucagaaaugaaaaaaucccaugaguuucacgccauuaaugggaugaucuacagcuugccuggccugaaaauguaugagcaagagugggugagguuacaccugcugaacauaggcggcucccaagacauucacgugguucacuuucacggccagaccuugcuggaaaauggcaauaaacagcaccaguuaggggucuggccccuucugccugguucauuuaaaacucuugaaaugaaggcaucaaaaccuggcugguggcuccuaaacacagagguuggagaaaaccagagagcagggaugcaaacgccauuucuuaucauggacagagacuguaggaugccaaugggacuaagcacugguaucauaucugauucacagaucaaggcuucagaguuucuggguuacugggagcccagauuagcaagauuaaacaaugguggaucuuauaaugcuuggaguguagaaaaacuugcagcagaauuugccucuaaaccuuggauccagguggacaugcaaaaggaagucauaaucacagggauccagacccaaggugccaaacacuaccugaaguccugcuauaccacagaguucuauguagcuuacaguuccaaccagaucaacuggcagaucuucaaagggaacagcacaaggaaugugauguauuuuaauggcaauucagaugccucuacaauaaaagagaaucaguuugacccaccuauuguggcuagauauauuaggaucucuccaacucgagccuauaacagaccuacccuucgauuggaacugcaagguugugagguaaauggauguuccacaccccuggguauggaaaauggaaagauagaaaacaagcaaaucacagcuucuucguuuaagaaaucuugguggggagauuacugggaacccuuccgugcccgucugaaugcccagggacgugugaaugccuggcaagccaaguaagggauaagauagaacaaaauccuuuugagcucugugcuuuuuugcauaacuuggucuaaaaaaaaagcaaagguuuuaacaucuuccuuaucuauguguuuuugucauuuucauaggcaaacaacaauaagcaguggcuagaaauugaucuacucaagaucaagaagauaacggcaauuauaacacagggcugcaagucucuguccucugaaauguauguaaagagcuauaccauccacuacagugagcagggaguggaauggaaaccauacaggcugaaauccuccaugguggacaagauuuuugaaggaaauacuaauaccaaaggacaugugaagaacuuuuucaaccccccaaucauuuccagguuuauccgugucauuccuaaaacauggaaucaaaguauugcacuucgccuggaacucuuuggcugugauauuuacuagaauugaacauucaaaaaccccuggaagagacucuuuaagaccucaaaccauuuagaaugggcaauguauuuuacgcuguguuaaauguuaacaguuuuccacuauuucucuuucuuuucuauuagugaauaaaauuuuauacaagaagcuuuuauaauguaacuccuugcuaccaguaaguaagauaauggcuauuacuucugcauuaauuugaauacagguaggaaaauaucaagaaccaacaagaaaagggcuuaucuuucuuaaugauugaaaaugcuaugaaguaauauuuauguaguuaaaaugcuucauuauaacucuuuuaaauccuuuacacacuaguaaaacagauauuacuuuaaauaauaauugauagaccuggauaacuuucacaaacacaugauuuuuuaaugguuuuucuugagugaagagaaaaacaauauuaucaaaugaaauaaguacuuaaaauauccugucuuucccauauaacaaugauuuuucugacuuuccaugaguaaaaaaacagccaagcaucuuuccaguagccccauugaaauugugaauccguccuggucucccuaaggacugcacacauugauauucaagguugguggucauuagauauggaacagaacugaaauaaccaugguagaacugaauguguaauguuggcuuuauucuagcugguacuacauggcacacaguuucaaaacauaauuucaccuacuggaaagcucagaccuguaaaacagagcaugggaacugcuggucuaaaugcaguuguuccugcucaaagagaccucuggccaaacuggcaagcaguuaaaguuuucuuucagggccuuccucucuauggccucaacuuccuccucucucuucuuccagcaacuuccccuuucaucauuccuuucccuggggacuuggcauucagugauccuguagauauugcacaacuggggaaccuuuagacauccuuaaaaucacaugagauagacagucauuuggggugucugaaauaaaccaccccaaaacuuaguguuaaaagagcaaccaaaaaaaauuuaugugagauuauggauuuguuacuuagcuugauuuaaucauccuguaacguguacauauaucaaaauguuauguauaccauaaauauauaaaauuuuaucaacgaaauucauaacaaucucucagaccacagagaaaucaaauuagaacugaggacuaagaaacucacucgaaaccacacaacuacauggaaacugaacaaccugcuccugaaugacuacuggguaaauaaugaaauuaaggcagaaauaaauaaguuccuuaaaaccaaugagaacaaagagacaacauaccagaaucucuaggagacagggcuuugcuuuugcugcauucuauucguugugaacacaaauuacaggccagucucgauucaguguagaagggaacugcauaaggaccacauaccaggaggcauaauucacugggagcaucuuuagaaacuaccagaguuaccuguugcccauaccagugggguaagcccuaugaauguauaugagaguuucaaacauccacaaaacauuggcuuucuaauauucguauucccacuauuccuuucuuuucaugauucaugucauugucccaucaacauuucuaagauuuccauuccguuaagagcaaaagagaauguuggaaggugggggaaaacauuucuuuguuuucuacagggccagcuucuuggaugugugugaucuguucaguugcaaagggucacaugcucagaaggaccgcaugcuaaauuuaaugcuuugcaguuacccucuugaaauccuuuauuuuuuaagaaggaauucgacauuuccauuuuucaaugagccccacaaauuacgcagcuaguccugggcuucucuacucugaaauugggcaggaucucucuugaucuagaauuuacuaaggcauaauaggggcaagaaaaucuuaugaaauaaugggggguagggaagagaugggaauggagcaugagauccagcuucguuauucucuacuugagaaaaauaaggccccaaagauuaaacaacuugcccaaggauauugcuuguuagugucagaacugaaaccagaaaccaaaugaucauaucccuagacuuuuagucugcuuucucuuccauaaaaugaaacuuauaauguuucuaauccauugcucagacagguagacaugaauauuaauugauaaugacuauuaauugaucuggaaaauacuuguuuggggaucaauaauauguuugggcuauuaucuaaugcuguguagaaauauuaaaaccccuguuauuuugaaauaaaaaagauacccacuuuu

SEQ ID NO: 625 - RNA, 3490 nt, Homo Sapiens
ggaggcagugagacuguaagcagucuggguugggcagaaggcagaaaaccagcagagucacagaggagaugggccaacugccaaauagccaucuuguaccagagauuccagagaguggucuuuggaauuucccaacuccuuugcuucagugcccugaucucugaacuaacaaaccagaaagaaguggcagcauggacuuaucauuacagcacaaaagcauacucauggaauauuucccguaaauacugccagaaucgcuacacagacuuaguggccauccagaauaaaaaugaaauugauuaccucaauaagguccuacccuacuacagcuccuacuacuggauugggauccgaaagaacaauaagacauggacaugggugggaaccaaaaaggcucucaccaacgaggcugagaacugggcugauaaugaaccuaacaacaaaaggaacaacgaggacugcguggagauauacaucaagaguccgucagccccuggcaaguggaaugaugagcacugcuugaagaaaaagcacgcauuguguuacacagccuccugccaggacauguccugcagcaaacaaggagagugccucgagaccaucgggaacuacaccugcuccuguuacccuggauucuaugggccagaaugugaauacgugagagaguguggagaacuugagcucccucaacacgugcucaugaacugcagccacccucugggaaacuucucuuuuaacucgcagugcagcuuccacugcacugacggguaccaaguaaaugggcccagcaagcuggaaugcuuggcuucuggaaucuggacaaauaagccuccacaguguuuagcugcccagugcccaccccugaagauuccugaacgaggaaacaugaccugccuucauucugcaaaagcauuccagcaucagucuagcugcagcuucaguugugaagagggauuugcauuaguuggaccggaaguggugcaaugcacagccucggggguauggacagccccagccccaguguguaaagcugugcagugucagcaccuggaagcccccagugaaggaaccauggacuguguucauccgcucacugcuuuugccuauggcuccagcuguaaauuugagugccagcccggcuacagagugaggggcuuggacaugcuccgcugcauugacucuggacacuggucugcacccuugccaaccugugaggcuauuucgugugagccgcuggagaguccuguccacggaagcauggauugcucuccauccuugagagcguuucaguaugacaccaacuguagcuuccgcugugcugaagguuucaugcugagaggagccgauauaguucggugugauaacuugggacaguggacagcaccagccccagucugucaagcuuugcagugccaggaucucccaguuccaaaugaggcccgggugaacugcucccaccccuucggugccuuuagguaccagucagucugcagcuucaccugcaaugaaggcuugcuccuggugggagcaagugugcuacagugcuuggcuacuggaaacuggaauucuguuccuccagaaugccaagguaagaccauucccugcacaccuuugcuaagcccucagaauggaacaaugaccuguguucaaccucuuggaaguuccaguuauaaauccacaugucaauucaucugugacgagggauauucuuugucuggaccagaaagauuggauuguacucgaucgggacgcuggacagacuccccaccaaugugugaagccaucaagugcccagaacucuuugccccagagcagggcagccuggauuguucugacacucguggagaauucaauguuggcuccaccugccauuucucuugugacaacggcuuuaagcuggaggggcccaauaauguggaaugcacaacuucuggaagauggucagcuacuccaccaaccugcaaaggcauagcaucacuuccuacuccaggggugcaauguccagcccucaccacuccugggcagggaaccauguacuguaggcaucauccgggaaccuuugguuuuaauaccacuuguuacuuuggcugcaacgcuggauucacacucauaggagacagcacucucagcugcagaccuucaggacaauggacagcaguaacuccagcaugcagagcugugaaaugcucagaacuacauguuaauaagccaauagcgaugaacugcuccaaccucuggggaaacuucaguuauggaucaaucugcucuuuccauugucuagagggccaguuacuuaauggcucugcacaaacagcaugccaagagaauggccacuggucaacuaccgugccaaccugccaagcaggaccauugacuauccaggaagcccugacuuacuuugguggagcgguggcuucuacgauaggucugauaaugggugggacgcuccuggcuuugcuaagaaagcguuucagacaaaaagccuccugaaaaucagucuacugguuuuccccaguaauuucuauccuuaaugacccucucuuucaucuuguuuuuuuuuuuuaaucauucauucuugucuucuugcugauuuuagaugaugggaaaugccccuugaauccucacagccaccuaggaacauauggaguuuuuacaaacgcugcauuugacccgaguccuuaaggaaaugauaauuauuuaaauuucuuuggucucauuuccagagaccuguccuuuuccuggucuccucauucagccuccauaugauccuguugugaacaucaaguuuccugcuacacuggacuuaacuauaaugcauuugcugcagguuuccauaaacacccaugaaucaaagacauggaauuaccuuagauuagcucuggaccagccuguuggacccgcucuggaccaacccuguuuccugaguuugggauugugguacaaucucaaauucucaaccuaccaccccuuccugucccaccucuucucuuccuguaacacaagccacagaagccaggagcaaauguuucugcaguagucucugugcuuugacucaccuguuacuugaaauaccagugaaccaaagagacuggagcaucugacucacaagaagaccagacuguggagaaauaaaaauaccucuuuauuuuuugauugaaggaagguuuucuccacuuuguuggaaagcagguggcaucucuaauuggaagaaauuccuguagcaucuucuggagucuccagugguugcuguugaugaggccucuuggaccucugcucugaggcuuccagagaguccucuggauggcaccagaggcugcagaaggccaagaaucaagcuagaaggccacaugucaccguggaccuuccugccaccagucacugucccucaaaugacccaaagaccaauauucaaaugcguaauuaaaagaauuuuccccaaaugccguguuccucuauuuuaugguuuguucaguaaggucuguauacauca

SEQ ID NO: 626 - RNA, 5002 nt, Homo Sapiens
agagcgcgaacccaaacacagaucgccgcugggguccaagcgcccuucaacuccgcccgcuagugcccaagauuaccgggaaggaauucaacgaaucaguggugaggugccgccgccaugccuacuacgggcggaaauuugagagaaagcuucgcaccgguaggaaaacugaggagcaaccgagcacgauuggaaagguugacgauagugguuaaguggcucggccuugcccucaguuaaaauggcaauuuuaguugcuucacugauacggaaucggcgaggcgccaaggaggcuuccugcguggggccgcagagcgagucgggaaacgauuuuaaacugaagaggcggcggagggccgaauucccuuuucucaacggcuugauuucagagcugggcuggucucugacaggcucagcuggagagggacggguugggacgcacuguccuuuugcccuucccccuccgcgagcagaagcugacuccgcaggagcgagggucgcagagcugggugagcggaaaugucccucccagagugaagucgcagggcccgccccgcgucugagggagcggaggucuuccugggugcguuugugucucuugugaacccacuuguggagcgagagggaauuugggagggccagggguuagucuggccucugucuuagcugucauuuuggcgguuuuuuuuuuuuuucuucaggggauuucagucuccacauaguuuuggagccggacuuuugaagaaugauucgugaauccggaaugggugacagcgucaucacggcauuuuauugguaaagaugcuuuguauuggucccggaccugcuuuaacuuuguauuugcccuguuguguggucauuaucuuacaauacuugcguguugagguguguuuaaacacuacgugcuuaacacuggcuaaguauuggcauuggggcgguuggauuuagguauugguggcaauguagaaaagugaucaagucagagccccuucacggacuaaucacaagagaaacaacaaagcuuuacuugugugcugugaaccacaacugcaaguggaauugucaagagaacuagcccugccaagcucaggaaaacuucugaggagauggcacauggaaaauggauaagauuuacugagacaaacgggaguagagaaguguuuuuaauuggcgauaaggugaauaaaaaggcagggagaacaguagagugaucaucugucuagaguagggggugcauguuuggguauagggcugucauuuaaccucuuaaagaauugucuacuggaacuuucuucacucccauccccccaccccccaauguuguauacaaaaccuuagaggaaguguaugcagaauguuggauuuuggaaaggcuaaugucgauggaucuuggggaagaacugaaguaguagaaaaugaaccuggauaggaucagauaauaagaucaaauacaguagugccuugaaagccagacaggaauucugauuugacuucauauagaugugugggaacuguuaugggaucucaagcaagguaaugauaaaaguggugacaaugaaagacugaugauggauuagggaaaggggcuaagauugggaacaagauaaguagcuauaauugagaaugaaagugaagcccacaucuaagaggacaaguguauaucuuuuuaagaaauaugucagaggccaggugugguggcuuaugccuguaauccagcacuuugggaggccaaggcaggcggaucaccugaggucaggaguucaagaccagccuggccaacauggagaaaccccaucucuaccaaaaaauacaaaaauuagccaggcguguuggugcauaccuguagucccagcuacuggggaggcugaggcaggagaaucacuugaaccugggagguggagguugcagugagccaagauugcaccacugcacuccagccugggagacagagugagacucugucuucaaaaaagaaauaugugagaauuugaugauaaaguuaacaaaguuaacuuuuuagauguaaaggugauguugaaggaagaguaaaagaugaugaaaguuuuuuuaguggggaaagaaaaugaaaaggaagaauggaauuauuacugagcaaaacagaguacaguaguuggcaaagaaagauugaauaagaugugaagcgaugauuaguuuugaacuuaaugaguuugacggagguuggaaaugcaggacuggguugcagcuguaauggucugaagacagagauuuaggagucauauagaaugauuauuuuccuauguagaaugaaugauuuucagaaucuggggccaccuacuauuggaacaugaggaaaaaaaaagaaucaguaaauaaauuggaacuauaaaaaguaaggaggagaaaagccccuaaaaaauggaaugucagaggaaacaaggucccagaaaguuuagaggaguaaggaugaacaaacuugaugaacaaaguauuuggccaugguuuuggcaaaaacaaugaucuucgaaaguacaguuucuuuguagugauagauggaagaaagagauugcugaagauuucuaguaaaauauuuauuaguaacuggaggcaauagguguagacgacguuuccaggagauuggucucagaaggaaugagacgaauuggauuuaaacacaaauuuuuaauguuagaaauacuagaauaugcuuggcagugaaagaaaaggauccuguauaggagugauuaaagaugauagagaugugaaguacagccugguugugguggugcacgcuuguaguccuagcuacucgagaggcugaggugggaggaucgccugagcccagcagguggaggcugcagugauaucaggccacugcacuccagccuggacaacagagugagacccugucucaaaaaaaaaaaaaaaaaaaaacagaccauggauucuuacagugcaccagagucaacuccuagugcauccucaagaccugaagauuacuuuauaggugccacuccucugcagaaacgauuagaaucggucaggaagcagaguucauuuauccugacuccaccucgaaggaaaauuccccaguguucgcaguugcagguaugcuuuuuggaagauguugacccucaaaagguugcauuccuucugcauaaacaguggacuuuauauaguuuaacucccuuauauaaauucuccuauaguaaucucaaagaguauucuagacuucucaaugcuuuuauuguugcugaaaagcaaaaaggacuugcuguggaagugggagaagacuucaacaucaaagugauuuuuucuacucuccuaggaaugaaaggaacacaaagggacccggaagcauuucuuguccagggucucauuuugucacccaggcuggaguacaguggcacgaucuugguugacugcaaccucugucuccugggcucaagugauccuuccaccuuagccuuccaaguagcugggacugcaggugcaugccaccacacucggauugugucaaaaucucaauugccaucugagaauagagaagguaaagugcuguggacuggcugguucugcuguguauuuggagacagucuucuggagacuguuucagaagauuucaccugucugcccuuauuccuugcaaauggagcagagucuaacacagcaauaauuggaacuugguuucagaaaaccuuugacuguuauuucaguccuuuagcaaucaaugcauuuaaucuuuccuggauggcugccauguggacugcaugcaaaauggaccauuauguggcuacuacugaauuucuuuggucuguacccuguagcccucaaagucuggacauuucuuucgcaauacauccagaggaugcaaaagcucuaugggacaguguccacaaaacaccuggggagguuacccaggaagaaguugaccuauucauggauugccuuuauucacauuuccauagacauuucaaaauucauuuaucagccacaagauuaguucguguuucaacaucuguagcuucagcacauacugauggaaaaauaaagauucugugucauaaauaccuuauuggaguguuagcauauuugacagaacuggcaauuuuucaaauugagugaagccuuauguggacuauaaguuauagauuauauacucuuauugauaacuugccuaauugcuaugcugaaagagacugcaggagaaauaggcaucuaucucugcaucuguuuuccccaccaugccuuuggaguugccaagauggaagccaagaaggaucuagaagaacaaagaauaugguaguagaugagccacagccaggugcccauguacuaaucaugauaaccugacaugccauucucaaaaugcugaguuguuaauuucuugucaucuuuaaauauauauauauaggcugggcuugguggcucacaccuguaauuccagcacuuugggaggcugagguggguggaucauuugaggccaggaauucaagaccagccuggccaacauggugaaaccccuucucuacugaaaauacaauaauuagcugggcgugguggcacaugccuaugaucccagcuacuggggaggcugaggcaggagaaucguuuuaacccagaagacaggcugcagugagccaagacugcaccacugcacuccagccugggcaacaaagugagacucugccucaaaaaauaaaaaagaaauaaaauaaauaaauacagcguuuauuauguuuaaacucuuaggauucaaaugagauguaucuaauggauauuucugauuugggucuuuaaaaccuuuaaucucuuuuaagcauuuuagacuugcauucagaaagaauucugucuucuaaagacauuuuccuagcauuucacugcggagaacuggcaaucaaaauccccucaaaagggaacuaaagauuaauauacacauuuuuuuagucauuaauaugcuucuguuuuaaauacaguucaacuccuguugcaauguugaauuaaauguuuauuuuaaaaugaa

SEQ ID NO: 627 - RNA, 60 nt, Homo Sapiens
agccugugaugcuuuaagaguaguggacagaagggauuucugaaauucuauucugaggcu

SEQ ID NO: 628 - RNA, 5269 nt, Homo Sapiens
gaccaauugucauacgacuugcagugagcgucaggagcacguccaggaacuccucagcagcgccuccuucagcuccacagccagacgcccucagacagcaaagccuacccccgcgccgcgcccugcccgccgcugcgaugcucgcccgcgcccugcugcugugcgcgguccuggcgcucagccauacagcaaauccuugcuguucccacccaugucaaaaccgagguguauguaugagugugggauuugaccaguauaagugcgauuguacccggacaggauucuauggagaaaacugcucaacaccggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauccagaucacauuugauugacaguccaccaacuuacaaugcugacuauggcuacaaaagcugggaagccuucucuaaccucuccuauuauacuagagcccuuccuccugugccugaugauugcccgacucccuugggugucaaagguaaaaagcagcuuccugauucaaaugagauuguggaaaaauugcuucuaagaagaaaguucaucccugauccccagggcucaaacaugauguuugcauucuuugcccagcacuucacgcaucaguuuuucaagacagaucauaagcgagggccagcuuucaccaacgggcugggccaugggguggacuuaaaucauauuuacggugaaacucuggcuagacagcguaaacugcgccuuuucaaggauggaaaaaugaaauaucagauaauugauggagagauguauccucccacagucaaagauacucaggcagagaugaucuacccuccucaagucccugagcaucuacgguuugcuguggggcaggaggucuuuggucuggugccuggucugaugauguaugccacaaucuggcugcgggaacacaacagaguaugcgaugugcuuaaacaggagcauccugaauggggugaugagcaguuguuccagacaagcaggcuaauacugauagguaaacaagaaaaugauuuauauaaaacccucuuccccagggaaaauuagugugcuaucuuuguuauguuuugaguaaaugacaagaugugguaaaugaaaacucacacauucuauauacauuaaauauguaagcaugacugauaaaauagcuaucuuuugauacugacaaggaagaaaacagaaaugaaggaauagcaaauuuuaaaaauugcauuccaguugcuugaaagcuugugaucagaugcaauaaauguuuuuauuauuuauuuugugcaaauaggagagacuauuaagauugugauugaagauuaugugcaacacuugaguggcuaucacuucaaacugaaauuugacccagaacuacuuuucaacaaacaauuccaguaccaaaaucguauugcugcugaauuuaacacccucuaucacuggcauccccuucugccugacaccuuucaaauucaugaccagaaauacaacuaucaacaguuuaucuacaacaacucuauauugcuggaacauggaauuacccaguuuguugaaucauucaccaggcaaauugcuggcaggaaagacuagucaguaacuuuagaauuucugccacggaaauuauuuuucuuaaacuuacuaaaagaguaguuaguuauauugcuaguaaaauuauuuuauugauauaagaagccuaacuuuguuugaaaagucuaaacuuuuagucuagucuacaguugucagacaaauagcaaauuguaccccuaccuuaaaaauauuuucaaaaaguaucuauaaucuuauaggaauaaauauuuuaggcuugaauacuaguguuauuuuugaaauguaaaaaggcaaauuaguucuaggcuggugucccauugaauuuuaagcagagcuccuguugaaauguagguaagcaucuuuccagcaaauaaaaauugucuccgcugggaguuucaguuuuaccugauuuguaccuaaggcaagcugaauacaaacaguaaauaugccuaaaauucuuguuuuacaacuaauuuuacuuuccacagguugcuggugguaggaauguuccacccgcaguacagaaaguaucacaggcuuccauugaccagagcaggcagaugaaauaccagucuuuuaaugaguaccgcaaacgcuuuaugcugaagcccuaugaaucauuugaagaacuuacaggagaaaaggaaaugucugcagaguuggaagcacucuauggugacaucgaugcuguggagcuguauccugcccuucugguagaaaagccucggccagaugccaucuuuggugaaaccaugguagaaguuggagcaccauucuccuugaaaggacuuauggguaauguuauauguucuccugccuacuggaagccaagcacuuuugguggagaaguggguuuucaaaucaucaacacugccucaauucagucucucaucugcaauaacgugaagggcugucccuuuacuucauucaguguuccagauccagagcucauuaaaacagucaccaucaaugcaaguucuucccgcuccggacuagaugauaucaaucccacaguacuacuaaaagaacguucgacugaacuguagaagucuaaugaucauauuuauuuauuuauaugaaccaugucuauuaauuuaauuauuuaauaauauuuauauuaaacuccuuauguuacuuaacaucuucuguaacagaagucaguacuccuguugcggagaaaggagucauacuugugaagacuuuuaugucacuacucuaaagauuuugcuguugcuguuaaguuuggaaaacaguuuuuauucuguuuuauaaaccagagagaaaugaguuuugacgucuuuuuacuugaauuucaacuuauauuauaagaacgaaaguaaagauguuugaauacuuaaacacugucacaagauggcaaaaugcugaaaguuuuuacacugucgauguuuccaaugcaucuuccaugaugcauuagaaguaacuaauguuugaaauuuuaaaguacuuuugguuauuuuucugucaucaaacaaaaacagguaucagugcauuauuaaaugaauauuuaaauuagacauuaccaguaauuucaugucuacuuuuuaaaaucagcaaugaaacaauaauuugaaauuucuaaauucauaggguagaaucaccuguaaaagcuuguuugauuucuuaaaguuauuaaacuuguacauauaccaaaaagaagcugucuuggauuuaaaucuguaaaaucaguagaaauuuuacuacaauugcuuguuaaaauauuuuauaagugauguuccuuuuucaccaagaguauaaaccuuuuuagugugacuguuaaaacuuccuuuuaaaucaaaaugccaaauuuauuaaggugguggagccacugcaguguuaucuuaaaauaagaauauuuuguugagauauuccagaauuuguuuauauggcugguaacauguaaaaucuauaucagcaaaagggucuaccuuuaaaauaagcaauaacaaagaagaaaaccaaauuauuguucaaauuuagguuuaaacuuuugaagcaaacuuuuuuuuauccuugugcacugcaggccugguacucagauuuugcuaugagguuaaugaaguaccaagcugugcuugaauaaugauauguuuucucagauuuucuguuguacaguuuaauuuagcaguccauaucacauugcaaaaguagcaaugaccucauaaaauaccucuucaaaaugcuuaaauucauuucacacauuaauuuuaucucagucuugaagccaauucaguaggugcauuggaaucaagccuggcuaccugcaugcuguuccuuuucuuuucuucuuuuagccauuuugcuaagagacacagucuucucaucacuucguuucuccuauuuuguuuuacuaguuuuaagaucagaguucacuuucuuuggacucugccuauauuuucuuaccugaacuuuugcaaguuuucagguaaaccucagcucaggacugcuauuuagcuccucuuaagaagauuaaaagagaaaaaaaaaggcccuuuuaaaaauaguauacacuuauuuuaagugaaaagcagagaauuuuauuuauagcuaauuuuagcuaucuguaaccaagauggaugcaaagaggcuagugccucagagagaacuguacgggguuugugacuggaaaaaguuacguucccauucuaauuaaugcccuuucuuauuuaaaaacaaaaccaaaugauaucuaaguaguucucagcaauaauaauaaugacgauaauacuucuuuuccacaucucauugucacugacauuuaaugguacuguauauuacuuaauuuauugaagauuauuauuuaugucuuauuaggacacuaugguuauaaacuguguuuaagccuacaaucauugauuuuuuuuuguuaugucacaaucaguauaucuucuuugggguuaccucucugaauauuauguaaacaauccaaagaaaugauuguauuaagauuugugaauaaauuuuuagaaaucugauuggcauauugagauauuuaagguugaauguuuguccuuaggauaggccuaugugcuagcccacaaagaauauugucucauuagccugaaugugccauaagacugaccuuuuaaaauguuuugagggaucuguggaugcuucguuaauuuguucagccacaauuuauugagaaaauauucugugucaagcacuguggguuuuaauauuuuuaaaucaaacgcugauuacagauaauaguauuuauauaaauaauugaaaaaaauuuucuuuugggaagagggagaaaaugaaauaaauaucauuaaagauaacucaggagaaucuucuuuacaauuuuacguuuagaauguuuaagguuaagaaagaaauagucaauaugcuuguauaaaacacuguucacuguuuuuuuuaaaaaaaaaacuugauuuguuauuaacauugaucugcugacaaaaccugggaauuuggguuguguaugcgaauguuucagugccucagacaaauguguauuuaacuuauguaaaagauaagucuggaaauaaaugucuguuuauuuuuguacuauuuaaaaauugacagaucuuuucugaagauaaacuuugauuguuucuaua

SEQ ID NO: 629 - RNA, 1873 nt, Homo Sapiens
ggguccggguuccagguggagagagagcuguuguacuggguggugucgcguaucgccguaccucgugugagaugaauggugucucagaaccauagcccacaccuguguugauuagaauugagaguuuacauccuggucuccgggauucuucuuaguaacuccucuguccacacuccagguccacuucagcaccaaaaugcauauacacugucaucuucgugcucuaucucggaccacagagacugagcgccugcuagucuaacauaguuucagaaaaaacccugcuuucagaggaacuucaaauuauauuugucugugugugauccaagagccaaagacagauuaaaugauuccaguggacauacugcucugauuaugagcuacauccaaccccuggcagcaugcaucauugccuuggaaaauaugucacagcaauuauauccuuauuccucuugagcuucuuccuccgugagaaaauccaaaaugcugaauauaaacuucuguugaaggaaaaggaggacauagcuuggaaauagcugucaaacaaaucaacucugaaagcaagaaccaucugugaaccuucaaggagaugcagagagacucccaucuucuccagcaggcuagcuaccaaucccuggcuggagccuguccccaggaaaagagacugcugaccguggggauugccucaaugcagcauccucgugggagcuaccucuuggacaaccugcaguccauguuccaagcuuccucauaacgugagcuggaguauaucguggugcugguccaccugucagguccugacccugaauggcuuggccaaacagcugccacuauuucaggucucuucacaccacagauuagggccgggaagcugcuggugaucaaucauagcuccccucucccaggagaucugagugacguuaaucacucaucacucugugaagcccucuauuccagacagaaaguagaucaugcccuccucaugaacuuugcuagcaaccucucugauuacuuucuuuuguuggaagaucauauucauugcacccccaaauucgcugcugccaucucuucggccuuaucagccuggaaagaacuaccuugggugauccuggaguucucccaccugagcaucucugggaaaguuuucugcaccagugacuucucccgccugaacacuuuuuuccuccucuuccauaaggacacuccuacucacuugcuucucucugaauuucgucuucucuuggcccagaauauuccuauucauuucagucccucugucuuccaccacacaggcaauuauucuguguuugaugacaugugcuuuucuguggagaaggacagggucuuuggugaaccagacaacccuguugcaacuguccuuacugacaugguaucaauguuggcugugauucuacaauacacuuauacacugaacaaggagggcuacucuaccuuaaauccuuuaaaaggaaacuacuugacagugauucuggacaggccacaaaaaaacacccagauagcagucgggagguaccgacugcagcaggggcaaguggaaccgggcuaugacccccaggaggaucccaaaagcugugcucgcuaugcccugcuagggccacuggugggaggaaauuuggaccagguaguauuuucugaagaagagucuguggaacaguugaauuguauccggcugcugguguuggcaucucaagagucuugacuccugaucaagcagaucaaagucuggacugagccugaggaagaggagagauagagggcacaauggggauucuggaagaauugggucugagaauggaaucuacaugguugggaagaaauaaacucaggcaccgaucaaaagcuacucauuuua

SEQ ID NO: 630 - RNA, 390 nt, Homo Sapiens
gccccuucugaccaggguuauguuuacuuccucacagccacuuuuacuucuagaguuguagccccaagaaggaugucaaauaagggaacgaaacacccuccagagagauaccuccaaagcucaccuauagaggucaaccucugccaguccuuugggaugaggucaugaaugccuuucugcaguggaaagcuuugccuucugcaguucgugagucaguugugacauggacagcauauaguccuucaaccucagccugcucacuggugggauauggaccuauucgagucugcugccucagauauaugggcuaucauuauccuaagugccugcacaccuacccaccccugaccugccugcccugcucaggauuaacucagucuggaaagcuuc

SEQ ID NO: 631 - RNA, 85 nt, Homo Sapiens
ucaggcaaagggauauuuacagauacuuuuuaaaauuuguuugaguugaggcagauuaaauaucuguauucuccuuugccugcag

SEQ ID NO: 632 - RNA, 135 nt, Homo Sapiens
cugcauucuuaaacccucuugguagcuucguucuaagugcuuccaagauaugagugaaugcuauagaaauugcaggggaguccaaagggcugcgcuucucccguggcucagucuuauuucauaccugcgacaucu

SEQ ID NO: 633 - RNA, 2474 nt, Homo Sapiens
agcuuucuuuccuuccuuucuguuagcuaaaaguuacuacauuuuucuugggcucugaagucugccuggauugugguauuuaaugugaggcagcugcagacugugccccaaagcaaaugaggcuagaggaauuccccuuucugaaggcaucccaccugagugucacaaagaugugcagcugaaaacaagccugacuucuguauauaaaggaaucugggcaggcagacccucggcucuugggagaggaggcggagagucugcagccggcaggaacuccugguagcauuauguggcugcugcggugcguuuugcuguguguuucauuaucucuugcugugaguggccagcauaagccugaggcaccagauuauuccagugugcuccacugugggccguggagcuuccaguuugcuguaaaccucaaccaggaggcaacgucuccuccuguacuaauagcuugggacaaccaagggcugcugcacgagcugcagaaugacuccgacuguggcaccuggauaagaaaagguccaggcagcuccgugguguuggaggcaaccuauagcagcugcuaugucacugagugggacucccacuacaucaugccaguuggaguugaaggagcaggcgcggcugaacacaaggugguuacagagaggaagcugcucaaguguccuauggaucuucuagcccgagaugcuccagauacugacuggugugacuccaucccagcacgggacagacugccaugugcaccuucacccaucucucgaggagacugugaagggcuaggcuguuguuauagcucugaagaggugaauuccugcuacuauggaaacacugugaccuugcauuguacccgagagggccauuucucuauugcugugucucggaacgugaccucgccaccacugcucuuggauucugugcgcuuggcccuuaggaaugacagugcguguaacccugugauggcaacacaagcuuuuguucuguuccaguuuccauuuacuuccuguggcaccacaagacagaucacuggagaccgagcaguauaugaaaaugaacugguggcaacuagggaugugaaaaaugggagccguggcucugucacucgugacagcaucuucaggcuccaugucagcugcagcuacucaguaaguagcaacucucucccaaucaauguccagguuuucacucucccaccacccuuuccugagacccagccuggaccccucacucuggaacuucagauugccaaagauaaaaacuauggcucuuacuacgguguuggugacuacccaguggugaaguugcuucgggaucccauuuacguggaggucuccauccuucacagaacagaccccuaccuggggcugcuccuacaacaguguugggcaacacccagcacugacccccugagucagccacaguggcccauccugguaaagggcugccccuacauuggagacaacuaucagacccagcugaucccuguccagaaagccuuggaucuuccauuucccucucaccaccagcgcuucagcaucuucaccuucagcuuugugaacccuacaguggagaaacaggcccucaggggaccggugcaucugcacugcagcgugucagucugccagccugcugagacaccauccuguguggugaccuguccugaucucagucgaagaagaaauuuugacaacaguucucagaacacuacugcuaguguuucuagcaaaggccccaugauucuacuccaagccacuaaggacccuccagaaaagcuccguguuccuguagacucgaaaguucuguggguggcaggccuuucugggaccuuaauccuuggagccuuguuaguauccuacuuggcugucaagaaacagaagaguugcccagaccaaaugugucaauaaaaccagaguguauucccagccugugcugagcuucucauuugaaagggaaauauuuaucuuggcuucuuggaagucuaaccugagaaccuaaggaagcuggcaggugacuggaaacagcaucuugacuuuacccuccauguauugaaacauuuuauuggauccuuauuuuggacaaaguucccuuuuauauuaggaaaugaagucaguacucugguccaacaaccaacaacauggaacuuguuuacauggucugguaacaagaauaaugguaggaaaccagaaguugaagcugauguuauagcagccguuuggaaagaagccuauucuaacaaugucacguucccugccacucccaucuucacucagaauauucagaucagaagagccagauacagacacagagauguaaucucugugaacucaacuuucucaccucugaaauagaaaacuaucaauuguuucuagcugucuggcucuaaauuuuugguucuuagaaccuucuuaauccccuucaguuuuuuuccacgggucuugauuugcagcuguccuuuggaaacucuacuc

SEQ ID NO: 634 - RNA, 3198 nt, Homo Sapiens
cuaacucauagcccuguauuuugcuaaguuuuuccucuacucuugaguccuccuuuaaucuauagaguguuauucuacacuggaccucucucuuauuuuuuggagucuagcaucuugcaucuuccuggagccccaacuaaacucauaacuucuaagcuucuaagaaauauaugacgagcuccaugagggccaaggcucuccauucuuguucaccacugcacacucaggagcucauggcaugcuggcugugcuaguucuagucagggauaaaguaggauaagugaagguauuuaauuauuguuuucuuuuccagauccucaacagaauaauugcugacaaacucucuugcccagaaaaugucuacuggaauuauggaguacaaaaaaacuacaaaagcaaugaaaaaaagaaggauguuuuauuuacauccuauuucaaaaccauugcuuucuugcuauuguaugucucugcaggcccaauaucgcgcaucuucauaagaaguuuagaauuguuccuuauguuuccuucuaacaaacacugguauauucacaugaaaguguauauuuuauucacuuccaaaacaguuagcucauaauucagaacauugagguuugcaaaaugacugaaggaaacuuuaccuaaacaauaguugccaguucugcugagaauuaucacgggcccacaacggcuguguguuuuuccauacagauauucuaauuuuuuuauuaugcagcuaauuuuuuuuuagacucgcgaauaaaauagcaagucagucugugcauaagcauauguuuaaaucuaccaggagaaaugucuggaaucuuuuugguuauuaaaauuaaaauucaggauaaugaaaggcauaugcaacuuauuauauucuuuauauaacuuauuucaucuaauccuccaaauagcuauauaacauauuuauccccaccuuacauagauguuaaccaaagucuguaagguucguucauuuguccacaguuacccagaaaauuguuuguggagcucaguacaaggcugacugccagacuccaaagucuauguuccuucuacuaccauacauugccuuuguuuuucuuuuauaaaaguugaaaaaauaucauucugcuuuuccuacuuuuccgaaaacuauuuaugaugauaaauccaguuuuuuguguuaaguuucaagaaguuggugaaauggagacagccaauccaacccaggagacaguguuugaaaacagggcuucagcuacuugcaugauguggauuggggaaauggucuguccuccuagccaugggaugucccugcuguguucaggaaucuuuccaucucuuggauuuuaaaggaaaguauccuuucugucaguaaaguuuuccuucguuaauuuuuccuucccuauaaagauagggccuuuauagagguaaucgccuuaaaaugaggcuauuagaguggccuuaauccaacaucacuagaguucuuagaagaaggggacauuuggacacagagacauggggagaacgccauaugaagacgaaggcagagauucaucuacaaaccaaggaacuacaaagacugccagcagcccccagaagccaggcggcagacauggaacagauucucccucacagcugucaggaggagccaacccugccuccagaauugugaagcacuaaguuucuguuguuuaggccuuccagucucugcuacuuuauugcaacaacucuagcaaauuaaugcacaaauggcagaaugguauuuuucaacuuuuaugagaaaaguaaaggcaguuauaguagaagagagcaucaugagucgacugugcucagauagggcuauuugcuuuuccccaacuaugcuccauacuuuuuucuuuucauauguuuuuuuugagucggggucuugcucugcugcccagguuggagugcagugucaugaucauagcucacuguaaccucgaccuucugagcuugagugauccuccugucucagccucccaaguagcugagacugcaggugcaugccaacacagcuggcuauuuauuuguuuuuauuuuauuguagagacagggucucauuguguugcccaggcuggccucaaacuucuggccuuaagucauccuccugucuuggccucccaaagugcugggacuaugggugugaacccaucgcacccagacauuuuguacuucuuuaauuuggagugucuuuccuuuccaugcaugccuauagaauuuaugauuaucauuuagcccaaagaagacuuucgcauaaauucugccguaacccuuguuggaauaaauguauuccucuaagcucccucuagcucuauuuguaucuuuauuauaaauauuaauauaucuuuccuugcauugcuguuacauguaugcacaucuuaucuucuggcaauaaauaagccucgucccuugggggaagggcuaaccuuuccuccuucugguauugcucaggaugcugaccacagcacccugcacagagaagagguuuaauauuuauuuuauuacuuaaauugcauaagagggaucuaccuacuugugaaaaagguugcugugaccuguguuccuucuucugugacaagaaacuaaaauguacauauauucucuucuugauguucuuucgaguuuuaucuccuuccuagaucugguucaccagauuuccuccccuccuuuuuuuucaucaauacaaaacuucaagucgcagucuugccaauaauucuucuuugacuaauuuaugaguuaaauaaagaaaaaauuccucacacacauaucauguccaaggucagcucaacauugcuuuauuccacaccucucaauggguguaugaugcgggcccacuuuaacacuguaucagugguugauuccuacgugcagaucuuucugcucuuuuugccugaauuaucuucaauguucuuugugcaaaaaucacagccaguauagucuauuuccaaaagagcuguaaagaggcauuucagaaacuucccuaaacaauauuucuuuaaaaugcaccaagcuggauaaagccgcuuugugaccugcauaaaaacuccaacggauaaauguguauuaccuucccaaagaacuacuucuccaaaguuauuccagcucuuuccaguugaaaugucaaacuugacauaaaaaugagauguucuugcaucaauuaauaaacaaauaaaucuguguuucccauug

SEQ ID NO: 635 - RNA, 7078 nt, Homo Sapiens
auaagaaaaaaaauauuuuaaaaggguaaccguuaaacagcuaggaccugcaacuucagugcuucugggauaacuggaacaucagaaggacagauuuuauuacagcauaaucacaccucauuucuuucaucagcaguugucaccagacgcuguuacuuccuaaaauggcggacaaucuucccacagaguuugaugugguuauaauagggacagguuugcccgaauccauccuugcagcugcauguucaagaaguggucagaggguucugcauauugauucaagaagcuacuauggaggaaacugggcuaguuucagcuuuucaggauugcuauccugguugaaggaguaucagcaaaacaaugacauuggggaagaaaguacuguuguauggcaggaccugauccaugaaacagaagaagccaucacucuucgcaagaaggaugaaacuauucaacacacagaagcuuuuugcuacgccagucaggauauggaggacaacguugaagagauuggugcucugcagaaaaauccuucuuugggggugucuaauaccuucacugaaguucuggauucugcauuaccugaagaaagccaguuaucguauuuuaauagcgacgaaaugccugcaaaacacacucagaaaagugauacagagauuucacuagaaguaacugauguagaggaaucaguggagaaggaaaaguauuguggagauaaaacuuguaugcacacaguuucagauaaagauggagauaaagaugaaagcaaaucuacaguagaagauaaggccgaugaaccaauuagaaauaggauuacuuacucucaaauaguuaaagaaggcaggagguuuaauauugauuuggugucaaaacugcuguauucucaaggauugcuaauugaucuuuuaaucaaaucagauguuagucguuauguagaauuuaaaaaugucacuaggauucuugcauuucgggaaggaaagguagaacaaguuccuuguuccagagcagaugucuuuaauagcaaggaacucaccaugguugaaaagaggaugcuaaugaaauuucucacauuuuguuuagaguaugaacaacauccugaugaauaccaagcuuucaggcaguguucauuuucagaauacuuaaaaacuaaaaaacuaacucccaaccuucaacauuuuguacugcacucaauugcaaugacaucagaaucaucuugcacuacaauagauggucuuaacgcaacuaaaaacuuccuucagugucucggacgguuuggcaacacccccuuuuuauuucccuuguauggccaaggagaaauuccccaggguuucuguaggaugugugcaguuuuugguggaaucuauugucuucgucauaaaguacaaugcuuuguagucgacaaagaaucuggacgauguaaagcaauuauagaucacuuuggucaaagaauaaaugcuaaauauuuuauuguggaagacaguuaccuuucugaggaaacaugcucaaaugugcaguauaagcagaucucuagggcaguacucauuacagaucagucuauacuaaagacagauuuagaucagcagacuuccauucugauaguuccuccagcagagccaggagcuugugcuguacgggucacagaauuauguucuucaaccaugacaugcaugaaggacaccuaucugguacauuugacauguucaucuucuaaaacagcaagagaagacuuagaaucaguggugaagaaauuauucacuccguauacugaaacagaaauaaacgaggaagaacuuacaaagccaagacucuugugggcucuuuauuuuaauaugagagauuccucgggaaucagcagaagcucguauaauggcuugccuuccaauguuuaugucugcucugggccugacuguggccugggaaaugagcaugcugucaagcaagcugaaacacuuuuccaggagaucuuuccaacugaagaauucugcccuccaccuccaaauccagaagacauuaucuuugauggugaugauaagcagccagaggcuccuggaaccaauaauguaguaauggccaaacuagaauccucugaggaaagcaaaaaccuagaaagcccagagaagcaccuucaaaauuagaaaagagcaaucucgaaaugcuguuuuggaccuccuucauggcaucagaauuuucucauuuaaaggacaguuucccauaugaguaauuagaagugguuauauaugaugaaugcuaugcagauguugucuuuaacucucagacauucagcauugaauaucuuuguuaaccuaucaaugagugauuuauugauuauugaacauuuuguuuagaaugggcuauaugacccagaaucuuaaaacagaguuagcuuuauuuuaguauuggguauauauguaaggguuccauauuagcaacucagcuuaaagguaauguauuugcuaaugaucuucagauuuuaucuuugucuacagaacaauuaguaauacccaaguaauauuuuaauuacuuuugcagcuguuacaguugcugcggccuguucgaauagugaaacauacacaaaugguaaauuauguggaucuuuugcauauaauauaaauguauagacauggugguaggaauagcaacuaauacaaaugccaauaugauaauaaaauacauuugucuauaaucguuuaaagauuagcuuugcaugauccuuuaugcacugugaaggucugaaguuuauaauacucacuugacccuuguaacugaugaggcaaugaugccaccacaguauucuaauuuacaaaaagaauuggaguucaauuagugguuguaaagcucauuuuggggagguugauugcaaaggaaauuugaaagauaagauuuauucuuauuuaauacuucagaaaauuucugcagagcccugcccuggcacuuaaaauagcuuccaauaaguaacuuagaccaaaaggaaaaaugaagugccccaggagaagauacuucagaagggcuguucugaaauuccuaaggaggaauucuuaggaauuccuaaggagaaacagagugaggccuuuuuaaccugagauuacagauacuuauaaaacccucuauaaauagauuacccaagguuuuucagugagaaugaaacauaccaccuuguuggcucuaccacuuuaauuaauaucacuauaacauaacugauaggaaugaaucaaaggaggauuuaccaugcccuuucgguugugucccacuuaacaaauugugaaguaacaauuuucuguaaucucucuugccucuuagcuguuauccagaguauagaaacuuuuuuucucccagagccacccaacgucauaaaacugguaguacucuaauggugaaaaccuguggagcugucagaagacaugaacuugcuuuuccucuaguccaguuuccauucuucagucagaguaugaugaucccugugacaguuuuugcucugaaauaguauuuaucauguguuugguaccuaguauuaugcuuucucaugacaguuucucaacaauccugugaggcaaauucgcauguacccucuguauuaguguguucucaugcuguugauaaagacacaccugagaugguaauuuguaaagaaaaagguuuaauggacucacaguuccauguggcuggggaggccucacaaucaugguggaaggugaaaggcacgucuuacauggcgguggacaagagagaaugagaacuaagugaaaagggaaacccuuuuaaaaccaucagauaucgugagacuuauuuacuaccaugagaacaguaugggggaaacaacuccaugauucaguuaucucccaccagguuccucccacaacacgugggaauuauaggagcuacaauucaagaugagauuugagugggaacacagccaaaccauaucaccuucaaagaagaaauaagagaauuauuaguaauuugcucagaaucugguauguggaagagccaacauggggacccagccuuuugugauucuaaaaccuuugaucuuucuacuaacauucacuguuagagaguguaggcgcugcaggagaaagagaaagugcccacgaaaauuagucuagcauugccggggguaaaaagcacacacugguccugcagcuuauugaaucagagaaaugugaagauaagaugaacuaaacaaacauauuuuagagcauggaucucgaagcagaauuuggcuaaauuuuaacaaaauguucuucaguaacacaucucaugaucugaagauuguguuacaaaaaauauuaucaggccaaaauuuguucggaauacacuaauuuuugcuccucuauaugugaggaaaaugagacuagacagauuuaaguaauugacaacuuacuuaaaguagcaaagucauggauuguauugacuuuuaaaaauauaguaaaagucauauuuaaacuuuauccuaaaguuuaaaucuaacagaacaacugaaauacuugaaauagaccuauaaaauaguaauuaaaaugagaaauacauaagaugauaaauaaaaugaaggugaagguauuccagaucuaccgaaaagauuuucaguaucacagauuauucauaagaaauugagaaaaggaacaaucagaaguugcaaaagaugguauagccgaauauaauggaaauaggaaaaauuagucgaaaauaaagguugauuuagaaaugaagaaaaugaauauauuucuuaauacaaaauaagugggaaaugagaaguuauaccaauaaaaagcauuuaaaaauuuaggggauauuguaacccaguauaauuuucugacagguuggacuuugacccuaauggacuuacuggugaacuuuuucaaauguuuaaauaaugucuauccauguaucaugaaggacaguaugcuucaaauugucuuuugaggcagacauguucucaguacuaaaagacauuuuuagaaggauuuuauucucaacagaugcaaaaugcaaaauaaaauauuggcaaacaauacagcaacaaauaauuuacuaucacucaggauuauaaggcugguguuaagcagaacagccauuaaaucagcaucaaaagaacaaauaguaaaauccaaaguauuaauuacagauaacuuuucaaaaauucaucauucacccuugauuuaauuauuucucuggcaaugauuuaauagacuucucggagucuguuaaguacuuaaaccaagaacuaccauuauuccuacugggaaaacauaaacauuucucaaguggaaaguaaacaguguuggcacuauuuuuauauaugguuaaagagaccugucauugcaauaaaagccagcauucacaaaaugaggaagauaaggaaaguagcauaaauauuuucuauuaacauggcuuuacaacugcuaaaacuuauaguauaaaaauguacuaacaaagacuaauucaagaaguugcaggauacacaauuuuuaaaaaucucauuucuacaucuuagcagugacaaacugcaauuuaaaaaguguguuugguuauuaauauauaugagacuuuuaaagaaaguuauauaacuacauagagauaaauuaagaaagaugccuaaauagaagcaaguuuaaagagcuauauuuuuaaacaugaacaaacucccaugggagccaugccaguguaguggaaaaguaguacauggggagauggggaguuuuuuugaaaaccagaauuacaguucucauuucacuacuuaccaguuguauacucuugggaaagucacuccuaguaucuauuucaccaucuacagaagagaaauacuucacagaauuauuguggggauuaaguuagauaauguguuuuaaaauauaaagcuacauccaaagaaaugccaauaugugacauuaguaugaaauuuacuacaguuccauuuaacauuccaacugguugcuguguggaauauggcauaauuguaauaaauuauuuaggaaagcaagcaaagauguaaguuuuuuuaauuuagggggaaaaaaugggagccuugcucuccaaauccuuaaaacaugcuauuaagcaaccuuucugaauauucuguggugccaaguagaaaguuuaacugaaauuaauaagccaauggaaagaaagaaauauuaauaacugcugguggaaagacuagcuagaugucaguguggaaagauuagauccacuuuacaugugauauuccaaaugaauuaaaauguuaaguauaaaaagaaaaauacuacaagucucacaccaauagugguauaaaggaacuucauggcaauuggcaagguagaucaacuaagagaaaaaguuuuaaauguguaguaaauaggaaaaagacaaaacaagauggaauuuaaaagaagcuauuugcauuacacauggaugcacucaguuuuuguaaaacuauaugcauauccauaaggguuuguacucuuaggcaaauuuauaaagcgaucguguauaaaugauauaaaaaaucaauuugaaugguauucaaauuuccuaauauuaaaaaugcaacuuugacuuaguucaugcuauuguauuagcaaaacuguuuuaauugcauguguccuuauagcagcagcauuguguauuaguagccuuuuaagagaacuguguagaagacuauaaaaagggcuuuauaacugaucuuuugacauacucacuuugaguggcauaugcccaggaaaauauuuaaaagaaagaaaagcuauuuguacaaaguuuucuagcaguuccacucagauaacuuuaagggggaaaaaagcccaacgauuggaaaugguuaaguaaauuuugguguauugcuagugcuaucacagaauguuauauagccauucaauaauauugauauaugucaaauuguaugcaaaaaagugagauucaaaaauguuaauaagaacauaaauuguguuuacugauacaugugaaaauuuaggucuacauugaaaagaaucagaagauaacauguaauucaguuuaacauuagggguucuuuauuuuucuucuguuaaauauugauguaugcaauaaaaaauaaaagauuaauugguaaagugguuuacug

SEQ ID NO: 636 - RNA, 1192 nt, Homo Sapiens
ggaggaaugaguuagguucccgguugcgggacaguuuuuuuuucuuuuuuaaaacagacacagcuacugagugcaaugccgccuccacagaaaaucccaagcgucagacccuucaagcagaggaaaagcuuggcaaucagacaagaggaaguugcuggaauccgggcaaaguuccccaacaaaaucccggugguaguggagcgcuaccccagggagacguuccugcccccgcuggacaaaaccaaguuccuggucccgcaggagcugaccaugacccaguuccucagcaucauccggagccgcaugguccugagagccacggaagccuuuuacuugcuggugaacaacaagagccuggucagcaugagcgcaaccauggcagagaucuacagagacuacaaggaugaggauggcuucguguacaugaccuacgccucccaggagacauuuggcugccuggagucagcagcccccagggaugggagcagccuugaggacagacccugcaauccucucuagcccaugucgggaaggaugugugcucugacagacgugucagaugcuggcagaagggauugguuuucuccuguguauacaguggaggagucugagaagcagggaugccuggggugaucagcuccaaccaguggcagcagagugguggcucuuccuaguuuaguuuuugugcuccguguucuuguguccuucuaagaaaaaugugggcugcucuugaaaguuauauaauuaucauuuuuuuuuuuuugaaacagggucuugcucuauugccuaggcuggagcacaguggcaugaucuuggcucacugcaaccuccgccuccuggguucaagugauucuucugccuccaccccccgaguggcugguauuacaagcacaugccaccacaccaggcuaauuuuuguauuuuuaguagagacgggguuucaccauguuggccaggcuggucucgaacuccugaccucaggugauccacccaccucggccucccaaagugcugggauuacaggcgugagccacugcauccagccauauaaccguauucuaaauaagaaaugguuggcuugugugaugguuuuguguaaugagcuagagauaauauuuuaagugucuucugugguauaugugggagggccauuaaggaguggguuucacucccugcaugugggcaggugucc

SEQ ID NO: 637 - RNA, 4281 nt, Homo Sapiens
gauuguaaguuuccugaggccucccuagaagcugagcagaugccagcaccacgcuuucuguacagccuaaggaacuaugagccaaugaaaccucuuuucuucauaaauuacccagucucagauauggaguuaccaguaaggagcuccaccgugacucuccucccugcuccguugccccgacgaggaagugugaaaacguuucuggcuccauccaagaguuacuucccugaagaagagagggcuuuguugaagucuucccaugcuuucugcacagggcucuggccuuggagaagggauuuccaguuaccgcagugucacuuggcccugggucuccucccgggagagagaaguguacggcucccaagguuccuggcaguuuugaaagagcucucagccacagccagcuuuacuuuggcaagugaggccauccccuuucuuuccuccuuuccuuucccauggaaccuacuccuuccaucugucuuucaagcucugccucagaaauggcaauucaaggcugauuuucuccuugaaugcacucucucugugaaagaggcuuuucaccaagaauguggugcugguguuucucuugccaaugggcuaaacaaaggccuccgcaccggguaacauuugggcaggccucuucacacaugccuguccuucuccgucgcacuuggcuaaagccaacaaccuaugugugaaaaguauaaagagauggaaaaauucccaugaaaaauccuuccgcaaagcaauugcgagacaacuauggcgucaucugauaacaugauuucuauuuugcaucuguuccauuguuggagggcacucauaguugcaagccuugcauguacauauguaaaaauuauaagugaaugcaucugcucagguuauuagccacugauugugaaauaaucugaaguuugagagucucaguuaauaaccuauaggugcugagagcauucaaagacccaauagcauaaguauuaaucaccucuuuucuccagaguagcaaauaagaaaccaggaagagcucaguuucacuuccaacuuguucuuuaagggccucagaguugauaguuguccucaucugggcucccuaaugccacgacaaaucaacuagaaaagaaauaugccccaaaucagcacccaaacacgcuggugccagccuguguccauguuccugcaacagcugcugcccacgggguaggacugagccaggucuaagauuagcagugucccagcuccucagguuccugcacauugacucacaacggaaucaaaacucgggagcucaacucucugguuucuucugcuuucucuucugcaauuuucuuucuuuuuuuuuuuuuuaacuuuauuuuacuggcaaccaugaaagagauauuuacagcaagacucagagcaaggucagagaccccuaaacaggugguuuucccuuaacuuaucaggcuggagcagaguuuaaaccaaacuagaggaaucccucuagcucugggcacaauguaaucucuacauccuggccuucaucgcauuggcuggaagcugguuggcuucauccaagggccuacuucgaggggauucaugccucugcaaguuugagcaucccucacuccuggcgcuggcggugccacucagccacggacuggagcauccacuuggucuggagcuuguacaaauaguagccauaaaccacgacuuuggugaggucugaagacuccagaggcuucagcucgagcauggccuugcucaccagcucaauguaagggauuccucccucgccaaccuccagagaguuaaagacaucucuaccacccgguggagaagaaagcugaccacuggugugcuuccagaaugcgagaagcucuugaagcccaacauucccuuucagugauauuacugacauuuucccaaagcuguguucuucagagcugcacauggcauuguuaacaacuauuucuuaaaaacauuucuuuuagagacgggauuuugccauguuggcagguuggucucaaacuuuugggcucaagagauccacccuccucagcuucccaaagugcugggauuaacaggccugagcacugcgcaacaacuauugaaacccuucuuuuuuuaagcugauaauuuuauaucuauguaagaucuucuguuuccugaacuucgugugaacaggucaggcgccuguuggaccccuggagccugguuaaugggaacgaccacagugggcaucaaauggguaacuucaguacgccagcacgguugagaacuauuguucaacgcgaacuucacauaugaagccccucucaugugucaggcacggcgucagaugcuggacggcaagaagguggccuucugcaaauggggaugaguccucaccaggugugggaucugccagcaccucgaucuugggcuucccagccucaguacuguaagaaguaagugucuguuguuuaagccaccccauguaauauaauuuuguuauagcagccuacauugauuaagacagaugcuaagaauaugaaggugaagaaaugucccaguacuucaugggaacacaucccaguggcuuacagaaucaaagaugaaagagagagggauacacgugguugcuggcucuucccugcugcucagaugccuggaucacuugacugccuucucuaucaaagguugauguuugcuuucgcuuuguuagaaacacgaaugauuggcuggaugcaguggcuaaugccuguaaucccagcacuuugggcaguugaggcggguggaucacuugaggucaggaguucgagaccagcguggccaacauggugaaaccccaucucuacuaaaaauacaaaaauuagccaggugugguggugugcaccuguaaccccagcuacugaggaggcugaguuaggagaauugcuugagcccgggaggcagugguuguggugagccgagaucaagccacugcacuccagccugggugacagagcgagacugcaucucaaaacaaaacaaaacaaaacaaccaagaaacacaaaugaucagggcuucaauucugcaaugcaacaaucacuaaccauuuguagagaauccuaauggcuuuuacauuuucagugccacuguucucuugcaaauaauaugauauaaccaaucaauauuuggaaggaacucugagauugcuuuaaaauuauugcauguuaauaauuaugaacauuuggguaaugcuuuuugacuuuacaaaaugucuuuauauauaagcacugguucuccaccaggggcaacucccucccccaggggacauuuggcaauguugggagacauuuuugguugucccagcuggggagaguguuacuggcaucuaguggguagaggccagggaggcugcuaaacauccgacaaugcacaggacagccucugacaacaaacuauuaucccgucuaaaugucgauaauguugagguugagaaacucccauacgcaagaucucucggaaauguuugcaauuuuuacaguuauugcauguguuagauauuuucacaauucuuuuacaaaucaggaucccgagggucaaagaugaugaguuacaguuucgcucuuucacccaggcuggagugcaguggcacgaucuuggcucacuucaaccucugccuuccaguuucaagugauucuacugccucagccucccaaguagcugggauuacaggcacccaccacuaugcucggcuaauuuuuuuguauuuucaauagugacagaguuucaccauauuggccaggcuggugucgaacuccugaccucaugaucugcccaccucugccucccaaagugcugggauuacaggcgugagccaucgcgcccagcccauaaguuuuagugccuuuuuuucauagaugcugaaacugaaaaagggugugguuaaauaauuugcccaagccagucucuggcaaagaugggauucauauccagcuacugaugaccaaacauggugagcagguauccuaugucccgaggaagcccauuccaccugagcacuggauggaagggauaucgcaaucacccccaugcaugauggacaggucuaggagcauuggacacucaauggaaacucaugccccugucagaaauuggcaacugccacuuccacggcacuugcaaacuuugcacacgguccagauguggccuggcuuguugcugucaugguagcaauaguaauuacuuaggggauuucugcagaucuugcucauauugugcauaauaggguauaaaauauggaaaauuugccucuaaaauaaaguguugcuggcaaa

SEQ ID NO: 638 - RNA, 2446 nt, Homo Sapiens
aaaauaugaacagauacagcuucaugcuuucaggaaaccaccuucucuuccaucuucuccuuuggccugcucagacagccagacuucuuaaacauauuuuuccuacaggcucaugcaaauuaagggauguggcugagcaucuccuucagugcccucaaacaggucaugaauguugcaaagcccagaaucgugcuaaccugguagaaggcugguuuagccagaacacacagagaggaccuucucaugaugguguggcugaauuccacaugucacuaacaguaucuugcccugacccgacuccaaguacugauccccaaggaaggcauaauagagagcccaucuuggggagggaugaugacuucaugugcaaacaagucaaauucaggauguguguugugggcagagauggcaaugcccagucaucuguuagguauacagguccgcuguacaggagaaaaaucagaacagaauuucuauuuguaguguuucuuuuagagacuagggaauugaaaccacaggugaauaagaauguacaaggaaccaggccuucuugaagaaauagcugaaccagauuggugucaggagcuguacaaggggauccaagaaugucuugucauacaagccggacagcuauuaaagacaacugaggucauggcaaaagggcccaggcuucuacuggccaacaaugagacaauuugagcaucccaaagaauaaugacuuuaguggacugaaacacaucaacauguauacauccaugaauucauaauacucaaaacgguaaaaccaaacucauuuguuaccuuuggaggagucugucaccucugauuauucugaaaacugguaaauagaaggggaaaauucaagcauuuauucugcuuuucuuguauaaacuguaccucacaguuacggaagagcugauaagggaaaugucuucuuuauugaaaaauucagcugauacauuuggaaggaaugagagaauuacaguaccaccauuaggugacaaugagggucugguuuuuuauuuuucuuuugcugagugcugggaacauagugauaacaaaaaaagccauaguguucuggcccuucuggaguuuugauucuagcacauuaaccaaauaaucccagagcaaaaauaaaaugucaacuaugguaaguguagagaagggaaaauacacagaacuuuuaacagcuuagauccgaggaagcugaccagccugcaaaaagggacagcuucccuagggaagugacuuugcagcugugaugauggaugacuaagaguuaaccaaggaaugggaggagggaggaggagacagagaaggcuuuccaagcagaagccagagcaugugcaaagauccuguggcaagaaggagccuggugcaggggaggaacgaagagacaugcaagcuggcuggagugcagagagggagacaggcaggcaggcaggugguuggauggggaggcaaggaucagauccugagucccuuggagaagcaggaaggcaucaugaugacuaaugucagaggcaggggaggacagguagggauagacagggaagcagugcugggaagaugcuaaaaugcugcaguuugugcuuggaaagaucauggccugguucuuccauugucaugauggguuguucucuuucuuauuguuuuucuaauuugucuugacuaauggagaagaucaggagcucaaaaauagagguuguuuacagcacucaguuuggcugcuauagguuaaugggcuuagacucuuuaaggggauuaggcuuuugcucagagaccaguggaguauucuagccaggcugucuugugaaggugguauguuaagaacuagguuugucugauuucucaaauuaaaaugugguacaucaaauuaaauuugaauuucagauaaauaacaacuaauuucagaugugucagauaaagaauggauauggcucuaguacaauaugggauaaugaauauuuucagauaaauagaugcccuguauucuguguagcaagcauaacuagagaaucaauguuagugcucaaacuaagaagacuuuugagaaauuaucagagguaaauacaaauauacauuuccauccauccauccauccauccauccauccauccauccauccauccauccaucccuguugagcuccaacuaugugucaggcacuucugggggguugaggguauugugaucaguaagacaaacucucugccuuuauaguguuuacauucuaggagaaaaauauucaucuuagagagauuauaaaaaacaaaucuuccgaaauaguaucuguuacguccaaaauagaggaauguauaaauaaauguuaauaugauggacuaacacgcagccauuacaaaaauccuguuuugaaggcuauuaaaugucauggugaauugauuccaauauaaaaccaaaugaaauaaaagcaguucacaaaacc

SEQ ID NO: 639 - RNA, 6345 nt, Homo Sapiens
ccggccucccgggacccggcaccucuagccagggacgcgcgcucggucccccgccgugcgcccccggucccgcgcccaggcucccgccccuggccuccuuaccagccacuugucgcccagcugcgaacuggagcgggaggcggcggccggagggcccaggacagccccgggagggcggcgaggcggagcaggagcgccccggcuccggccacauucucagagucaggaaaaggggcgagaggccacaugucucccucucgcccaacugaaaacgaaacggcgcuccagcagauuggguggaaagagcugggucucuuuucucuguuuuucacgcuagaaagggcuuguaaacauuguuccuuuuaaaaugaccuaccccaggcauuuguuugggcacacuucuguccuggggucaucguuccuagguggcuucggaccugggacuuuuccuguaucugcacauugucguuuuauacacaauugccaaggugggacugcuuucaacuuuacugugcuugaagcugcaaagcggauccuguuacagugcaaagaagaaauggcaaacggauaacagcuacugugccuagaagaugguucugcccugauguuuccuggaauaaugcugaggacugccuuucggguagccgcccuauucaguucacuucaucucggaaauaccugaccccugccuuggauccagcggcccuccugagagcugaggaaggaggaaauccuaugugucugcucccggagcugccacaacccaucuucccacaacucggaacuuggaaaaaggaacccaggacacgacuuugcuuuucuuuuggaccuaguuggugauuauacucugucucccauggagaccacgucuugcauccuuccuucuauaugggauuuaggauagaaauuaaaaagaaaacauauuauuuugagucuugauuuggagaaagguaguauucaggaggaaguaggcuaugauacacauagaaaauuugaggacaguguuacuuaacaaggacauuucugucucugcagaagucacagcuuggaggaaaccaguuugcacuauuugaugaggaauuuggccaccaaaccacugauacuuucccaaagguuuggcagaaauuguuuuuugaguggcucaccagaguacccagaagaaucaguauggaauuagaggacaguggccuacccuaaauaaagacaugagugauguauaaagucuagugucaauuuauucagaaaauaucaaaauuauucugggagcuaugggucaaaguugauaggcacaaacaaacaaaaacgaaagguauuuuaaauucacagcuuggauaaguaaaagggagauguugucauuucucuucuucaauccaacuuuagauuuucaagccggaaaaaggguaauuagaaguuagaaauuguuauugccagaaaauagcucuaaacccugaaaaaaaaaaaaaaaaaaaaaaaaacugacccuccucuuggggagugauaaaccucaauuacuguugauaguaaaacugauaucaacucuucgaaaccagugaaaggugaauggaaaccuuacccuagguuaagguuuaaaaaauguucauaauauauauuugaaaguuccauuauuuaaaauauucauuagacaugcuuuguaauguuaaguuacuucaaaaaaucuuacacaagggaagggaaguauguauuauuccuucauuuaagagaaagauaaugugugaauauuaguuaauauuuaucguacauuuacuaccugugucgaagcguaguguuacacacuuaauuucaauuauuuaauuugauucuaacaaugaauccccugagauggauaauauccucuucauuuuacagaugagacaauugagacuuaaagguuaaacaaaugauuuccuaagcucauucagcuaauaaacgguaggggacugcuugacaccaguccaguugacccucaaauccaugauuucugccaccauauucacagaaacaagacaagagcugaaaauauagccugacucuugaaacagucaaagaauuguguauguuuaugaaaguucugauuaauaagauauucugaggacaaaagacaaggcauggguagaggggcaauguguagauuagaauguaucacaaugcccacuaaauaguaaaaccauagaaaaugaaauuuaauccuuacuguguagaauauuuagaguagauuguuuuuuccucggugucaauuacuauuacaacuaucaaagaaugaaauuaaacaagaaacgguuccuuugguuuuuuuuuuuaaaggugggaguuauaaaaacaguauuugccaucugguuuuaguuauggcuguggaaauucuauggguacaauuuguugucauuguuguuaccacuaccaauacagagaugcuaauuguaacaucaguuucuaaaucagauagugaauaauuacauuuucaauguuuucuuaacauagauacaaguuaacaggauaugcuucuggccuguuucuggauucuaaggguagaaccagcauaaaacuagucaguccaaguauuucuaaagauccacagacacaguucuccuggauuugggaagccuagagauauuagcacaauaauuaaggcccaagugaguauaaaauuuuaucugaaauugaagagauauugauuagauaauccacagagacuacuuuuuagugauuaucuuccaccaggguaaaagcaacagcagccugaaaaugcaaaagaccauacauuuuaaugguaaguccuccccaggaaggauuaauaaaucucaggaggaagauuuauuaucuguaaauccaggaggaagaaaucaagaugaaaacuaucauauuuauaaauuugauuguugcaauuuuauaguuugacauagugcaauugcuuuagauuugaaggggaacuuacuuuagaguaagucacucaaucucuuuuuuggaaaggcaaaugccacaccugauccucaucacucccuucuccuuuguccauagccuggcuuuauucugccauuaacacacacacacacacacacacacacacacacacaaauugggaagaggauuucucauuuuacagaaaguaugcugggcuacacaggauauucuaucagguuucuuccagcuauaaaauucugagacuaaauaucaaauuaaagaaaguacuaauugucagcgaugggggauguacugcuauuugcuucuagugguacucacugcucauuuccuauauucacugguauaaaaaaauuucaaacacccucaaaaaagccuauacuggugguaccaggaaaacgcugaaaaucauuacuuucugugugguguccagcucuuuugguuacaucaucacuucgaccauucacuuuuaaagaaaaacuuuuguggaacaaaaauauaaagauuuauuuuuuuucuugguggcuuagcacaguggccuaauguggcugaccaugugcaccuguugugugagucacuuagacgugcuuuguuucuuggucacaguugaucccucaacucaagcaucucacccucaaaauguuuguuugggacccaagaggcaaaccuugagauggguuauuucuuucaccuuggauuggcucaucugcugggaguggagccaagcugacauuuccuuuccuuuuugucugccuaucacuacguagaggcagcacauaagagagggaaagccaugcgcguggaguccagcacaucacccagaaggcagauguucuaucuccauuuuacucauuaaaacaaacaaaaccacaccuggauugccugguacuuaaauaaaaugcacuaugaugauugaagaaaaauaucuuauauuuaaggaauaguuuuaauagcuuacaucuguauuucuauuagcuuccguuucuauuuuuaauauuuguauaauauuaaaaguaauuuuaaaaaugaacuaaucuuuuuacaucucuuaugagaauuuaauggagauaugauguuugaagaucaaagauacgugguauuugaaaucagaaaauguguuugcuuuucuacacagauuacaaauaucaugcauuauuucacaaacucuucucaaaguguugauuuuaaaauuaguaaaaggaggguauauucauaucacauccuggcauuuuuauaggcaagauugagcagcuauaaccucuaaagugcuuugaucccuauaagccucaagaagagaauggugcaauuugaauuaauaacuacccauuauagagcauuuguaucacaguauuuuccaaauacuaucuuauuuaacccuacagcaauccuaugauauggggauuauguacacauuacagaugagaacuugaggcucggagaaaguaaauaacuuacacaagaucacaaagcaagugacugccagagccaggaucagaacccagucaggcuucauuaggagcucugcugaacucugucuagagaauucucaccaccugcugcaaaggcuaaaagaaagggucauauuccacauguagauuuugagaaauauuuguuauuuuucuuaugauaaagguuaugcauacacacucacacacacacacacacacacacaacuagaaauuacagaaaagaaaaaagauuagccagaaugucaccaccuaaagacagauaauauuuugguguuuucaaauauucuuuuaucuauacuuuuuugaauuauuuuauuuuaaaaauaacuuuuacugguugccugauuaugaaguaauaaauauucaccauaaauauuuugaaaaauauaaaacugucuauaaaagaaauuugaaaugauugcuaaucucaaaauauagauaccugucaguacuuuggcauuuuauccuccuuguggcugaggucacauaucuugagacugaagcacaaaauuucuauaccauacaguuuauaguuuaggccacaacaucauuuuuaaaauuguuucuuugguuuuuacuugauuugcugauguuuuauuuuuuagaaaauugcagaugugauuuuuaggcagcugauuggaauguucugguugcucugaauaggacuagcuacuuuguuuuuuacugaaggacaaauauuauuccuacacacauaaaaaaccucaaagaaugaguaaugauacuguuuaaaucugcccuuauaacuccaaagaaugacuucaaauuuucuuucuuccaaagcaacuuuuaaaagccuuuccacugcacagugaaagaaaaccacaaacuccuuguuuaauaagugggaucacgugcuuuuaacacgaggaaaaggucaaucugaagcaacugauauggaacugccagaguaggaguugaaaaucuuccuaaacugcuggaggauacaccucugauagcuugagacaaauauccucuugaucauuguuucaccauauuugucuuugcucauggagaaccauuuugauccgugguuuagccucccaggugauugaacaauaccggugaucugaggcagacccucugugacggauaacagaaaagaaaauugaggaucagaaaauacgcacaauuugcaaaaaccaugggaaagaauauugauugaacaucuacucaagaacugcaaaacagagauuaccugaccuaaaggaguccauucucaauuuucugugcaaauuggggaaggcuguugauaaucgguggaugcuauagugcccauggaaagacucuagucugaagauaccagucucucccucccaagaucaccuccccugaccaaccuucugcacuccugacagauacaagggagcaagcaaguugcacccaaccuaauaguaaauugcagggacauuuccauucuaaggaaggaauuuuuguguguguugcaacucagcuucugcucuggcauuuugcugugcauuuauauugccaaucauguuggagaguccauguggugauuucugaaaacgagaugugagaaagaagaggauaauuuaagucuagaccuacagauugugcugauaaagugaugaagaacuacaaucuucuuagucauuucauuguauaagugcaauaaaggauuuugugucuuuccuggcaaacaacuugugaccacagugauggcuccagcagaauggaaaagacccuuuaccucacaucucagaaguaaagaugcugauuauuugacaucgccauuggaaucucaaaacaguguaaagcauuugcuaaaaagagucacuuucugagaaaugacucagaauucgacuuacguacuagcagaacuuauugcccauaaaaggaaaggccacacuuuuugugaaaacuuaauaaucccuaggauguaaaauuauacugaguuaaauccuagucccauuuuuaguacaag

SEQ ID NO: 640 - RNA, 677 nt, Homo Sapiens
ucuuuuccagaggcuagauauauaggagguuguggcugcuccagcagcuuggauucagagugagaaggcauaaaggagaauccccagcugacuugugcagugguuaauugaaauuauucaggcaagagaugauggugucuuggaccaggggaugaggaaggcuacaaaaugugucuaccuguauucugugaggagaacguguucccugguuuuagauacugugaagauggaucaggagagaguuuaucuagacuguuggggaaagguguugcgauuccuucagcuacacaggauugaaaggagacauuucugaaggggaaaaaggaaaugaaagaaaagauguuucagauugaggauaugcuguguggugaacuuguucuucacucuguaggguucacaaaugacucuucacugcccucuuggaugaaauaaacugguucccauagaaauggaccgucucugauuucacagucuagagcacacaaauaacucaacuuucuggaagcaagggugauggcucgugagagcucaaggacaaggaggagucuguagaagcacaccuggacucggggaaaucauugaccucucauccugaauuaaguagcgcuugaaaagacucucuuugaaucagaaaaauaaugcgagcuccuaucaaacuaccuuacacagccaacuga

SEQ ID NO: 641 - RNA, 61 nt, Homo Sapiens
gaguguuacagcucuuuuagaauuugucuagccggcuuuccaguuuugccggaaagccccc

SEQ ID NO: 642 - RNA, 293 nt, Homo Sapiens
gaaaaauaauaguacuauugaugagacagaguaccauccauucuuacauugcagucacauuggaucuacacugaauuaacaagcugcagccccagccaccgcuagagcggugagggcacaccggaucccagaucugcaggcggcugagcagguggagcccagcgaagagauguuccugcugcaggcaauuaugcaaaaugacaagugauugcuuuccuuuucaaagacaaccccuuuggaaaaagcuuuuuccucgaggacccuagggaaaugggggguuggugggaacuuca

SEQ ID NO: 643 - RNA, 462 nt, Homo Sapiens
uaguguuuaugcaaaaauaauuuagaaaaccauaaaaaucccugaagaaagucugagaaagaggugcaaggagagagggagaauuuccagcuucaucaaaacugugugcagauggagccucugcaggccacagcucuuuccucagcagacaucauccugccuguuacagaggaagugggcacugccgggcagagccccagcucuucugcaccacguucaagaaggcaggcaccacacaggcaaccucacgccuccuucggaagcagauggaguuuuuuuuuuuuuuuugcacaagguuacucuaaccuguuugucuucuugggguaacuuguucauucauauaugaauugucacccauucuaucaaacaaauaaaaucaccaugacaauugcuauuuuuaggcacauuuuaaagcuauaaaugagaucauguuaguuaauaaaaauuaucuccucaguuaaa

SEQ ID NO: 644 - RNA, 116 nt, Homo Sapiens
auccaaggccacaugaacacaaaugcgcagucuccucugcgaucgguagcuaaggauguuaggccaugauuggacuaggaugggagaugaacugagaacucuggauucuguagguu

SEQ ID NO: 645 - RNA, 116 nt, Homo Sapiens
auccaaggccacaugaacacaaaugcgcagucuccucugcgaucgguagcuaaggauguuaggccaugauuggacuaggaugggagaugaacugagaacuauggauucuguagguu

SEQ ID NO: 646 - RNA, 4442 nt, Homo Sapiens
gcgggaucuggccgcccucagggcuccggcgccaaguucagagccacgcgcagugcucuuggccgggaggaggcugugcugcaccagcaccucuugcuccacaucuccagagagcccagggugacuuucaggcugcaguuguuuuccucccucccacugucucucccgggguuuauccuguguugcuguuauucucagcccgggcuugcgcugggcaguaggaugaugcuauuguuggaaccugggaaggucggaaggaauagcugaggaaggcacagcuccacugugcccacagcggucuggacagaggaggaucugcaggugcaaagggcgcaggcagguucccggaggaaagcaggagccacgucuucggucuggcccuuguucuguugggguucuggaggacgugcugugcccuggccuuacugaccuuacuccaugcagugcugaugcaugcgacagcggugacccuccagggucccagucuaaccccaucucacuuggcuuuccugcacugcagagguugggaagcuaaauccauguuucccagacucuuuugcagccagggugcaggccuuugacacagauccucacaagcagccagauacaucacccagccccggaugugcagucgagucccaugagcugaagucuuuggcaugcaggugauaucugucacucacgguggcagggacaucuggacuugugggguggcugugguggacuuuguaggaguuuggucccuugugauuggugcugguaccagcaguuucuacuagacagugccagggcaugguuaggcuuuuuuuucuggcuacccugacccuuggagagcucccaagcuuggucucuggcucucacagggauuuaaugagcugcaugauagccuuuaauaaguuccuuucuguuuaaacuacccagguagaggcugcugucugcaggugggaagcccugauugcuggaaccuaagggaugugagaaaucacuguggagugucaagggcccuguggccgaguguguccagcccagugucauggggagcuuccauaucucauggcuccuugcugggccaagcccuccagaaccccaaacccccaaagacugaugaaugccagaguggccaccuugcuuaucuguggccccggcccuggugaucaccauggcagcugggaagggagccccguugagcccaucggcugaaaacagauggcgacuuagcgaaccugagcugggccggggcugcaagccagugcugcucgagaagacgaaccgccugggcccugaggcugcugugggcagggcgggccgggaugugggcagugcggagcuggcacuguugguagccccaggcaagccccgaccuggcaagccgcugcccccgaagacacguggagagcagaggcagagcgccuucacggagcugccgaggaugaaggaccggcagguggaugcucaggcccaggagagggagcacgaugaccccacaggccaaccuggugccccacagcugacccagaacauccccagaggcccagcuggcagcaaagucuucucuguguggcccagcggagcacgaagugagcaaagaagcgccuuuagcaaaccaaccaagcgaccagcagagaggccugagcuaaccucagucuucccugcaggggaaucugcagaugcccugggggagcugucuggacuccucaacacuacagaccucgcuuguuggggucgacuuucaacucccaagcuuuugguuggugauuuguggaacuugcaagcauugccacagaaugcuccacucuguagcacuuuucugggugccccuacacuguggcuggagcauacccaggcccaggugcccccacccucaucauccuccaccacuucgugggcccuccugccacccacccucaccucccugggcuuguccacccagaacuggugugcaaagugcaaccuguccuuucgccuaacguccgaccuggucuuucacaugcgaucccaccacaaaaaggagcaugcggggccugacccacauucucagaagcggagagaagaggcccuugccugcccugugugccaggagcacuuccgggagcgccaccaccucucccggcacaugacuucucacagcuagcaggugaccgcagaaugaccugcugggugcagcagccagccuuuggcagaggggggcucccugggccugcguugagggggcugucaugguccuuugcagagcugcugcuuuuggcauucauagauaaacagcucaggcauaauuugaaaaagccacaccugcaugauguguuuugaaggaaaugaaguccugaaauaaagugaugggcuuugcaaauccaggguagaggcccuaacaggcacagagagcaggggcaacuccuggcacacaucaugggcuuuggaggcacacaagccuggauucgaaucugggcucuuucacauacuagcugugacccuggacaaagagcuuuaaccugcugaguccccauuuucucaucugugaaauggagaugauaacacugugucuuagguuggcauucaggucacaugaaagguguguggaaaguggccagcauucugccugcagacccugagcacugagucaacaagguuugugaugaugucuguacuaguuagcuauuguuauuaacaagaucuccauggcagacaagcuaaagcaucugccuaagucgugagucuguggguuggcucagguuaagcugagcuuggcugggcuuggcagcaagucucagauuugaucaagucauauucguuuucuucuucggcuggugggcuacccagagcgagcacgcuucucucguggucaugccaagaacacaggagggugagucuaacaagcacaccucaagccucugcuugggucacauugccaauguccucucagcccauacaaguggcaggaccaggcccaauauuaaggaguggaaaaguguaggcugcccuuggugaagcugugacaagggagugaccauccauccccuccacaggagggugaggaauugggacagguaauuccagccaauaccugguccauaguucuucacauugugaguauaugaauacggggaaauagaacccccuccccaccaccuacacacaugcuguuuuaccuuccaagaauaggacaugugcaaaaacuaggcuuccagaucgugaggcuggggagcauucuagguaccauuuauuaucuacugcguuucggucaguagcuguuguagguacccgcaucagcccuuguuccuaaggauguguggagcccaggcuguacucuuugacauuccacaggucagucugcgugaaagcccuuuguggggaguuuccaagccagugucguuuuugcacugguuuccaccucacugucagauauuguucuuuugauaugcaguuuccagcccuccaaugaguccccagcacagaucucaggcuuguggcugggaauaagcccagcugagcagguggggaucucagccagccucccagacugcaccucuucuauugcucuccucuguccaccguuccaggcagcagcacucccaccuggcugcucugauguccucgcucccuccauuccugccucucaccaugcacgcauccauuguccacacacacacaaccagauaaucuucugaaaguguaacucagaugaugccuccaacccuguggcugcccuucacacuuacaggccuaaccccagcaggaccugccagcugcuucaugaacaagucccugccucauguuaauugcaagcacucauuucacucucccugugugccaggcaauagcauaagcacuggaagaauacagauguuauagugaguccuacaauagcccuggaaggcaagagcuguuuccuuuccauuucuacaaugagucaauugcagaugaugcuauaacacuuccaguguuucugacacuucccugaagcuauaccugcuaccuucaugggccgagcuugcccuuaugaggcccacagguggcagugggcagaggggaccccgcuauaccaccucgcugcuguuccacugucugcucccguguucugaccacagcucuggugccguuucucaagccugggcuucauucaacauuuucuaucuagcucuucauggugcugcuccugcuaugguuccacagggcuucuucucgcaggucagcuccuuagagaggucucccagauuccccguaaagcagcccugcagccucugccucucucagccgcaucacccuguugcuuccuucacagcaugucucaccaucugcaaccaucuuucuguuugucgucuuguugauuugcugccuccacacugucagcuccuugggaacagagauugguuuguuuacugugcaucccuggugcccagaacagggcauggcauauuguuggugcauaauaaauauuguggaaauaa

SEQ ID NO: 647 - RNA, 116 nt, Homo Sapiens; identical to SEQ ID NO: 644

SEQ ID NO: 648 - RNA, 116 nt, Homo Sapiens; identical to SEQ ID NO: 645

SEQ ID NO: 649 - RNA, 2762 nt, Homo Sapiens
agcaaaacacacaauuuauuauaauguauuuggaacguguuucaaaauuuaccauagcuaucuauagauaucucugucuaucuagguagauagaugauagauagauagauagauagguagguagauagauagauagauagguuagauagacagauauaggcugagguuagggauuuguaaucauaaaauaacucacugagugaaaaggcaagcaacagaaugggaaaugaaauuugcaaacauaaauacaauaagaacucuugaucgaaagauacuuuuuaaacucuacaaaugaauuuuuugaaaaaaaaaaaaaauauggccagguacggugucucacgccauuaaucccagcacuuugggaggaccacuugagcccgagaauuugagacuugucugggcaacacagugagagaccucugccucuacaaaaaauuuaaaagauuagccaggcaugguggccguggccuguaguccuagcuacuccuaaguagcuaggcucuuuugagucugggaggucaaggaugcagugagcucugaucaacugcugcacuccagccugggugacagagucagaaccaucuccaaaaaaaauugauguagaagaacuucuaagaagugagaguggagacagaggccaaagaugcugcucuaggcugcuccgugaauuccaggacuucugagaagcacccucuggacagcgucuuuacugcccucaaggacucagcuggucagcaauggccagccagacuccauccccaguguggagaggagguagcugaucccagaggcgcuccuagcaggcauguggaacccaagaacagcucgcccugccaaggcaauggagagcaggcuggcaaggcaggagcucaggcucugugugggcaggcaaggaggagccccgcaaccaugccaccaccccuuacuacaagaagccucuguauggcaucuugcacaaggucauggagaagaagaacccucccucaggggaccugcuaaacacauaugagcucuuccagaaggcaaaugccagcaacagccccuugcugcuuaggcuccugaaugagccauagaaaugggacuguggcagcacuggggcagccaccaacagugacccuaacaucuacuuccugauccaggagauguucuacaugcucaacacgcucacguccaacaggucccagcugcacagcaaaguggaccugcucucccugaaggugaaccccacugagaugguggccaaauuccagccgacccccaccaccccauagcagcucacgggcauggagcucaagcagaucuuggaccagagccugucaggugggguccuggccugcuggcugcuggugcagcucuuccccaagcucuucagccacagucaacuucucccaaggcugcagugccugcagcuuugaggccaagcuuaagcuggagucacugcaccugcagcucauccacaacuacauggaggucuacuaccccucggugaaggagagggcugugugacaggccgagugcuugccccagcugaguaaguucuucagccgcuucugggcccagcgggagauggagaacagccagccugguggccaggcugccagcuugaggcugagcaguggaccccggccacuuccuggaccacaaagaugaggaggagggccugucucuggacaggagcagcaccaucgccucagaccacgugguggacauguaggcccucaccuaguuccuggaugaagccucuucacccggugaguuugccgucuuccuccuccacuggcucuucccugagcucuuccacuacagcaagcugggugagcaggacagcugcuacggggacggcggcaagcaggagcuggacccgcagaggcugcagaucaucagcaacuacacggaggucuacuucccccacaugcaggaggaggaggccuggcugcagcggugcgcccagugcaucaacgacaagcuccagggccuggggcuggacgcgggcagcgaaggcaagccccccacgcaacaacugcuacaacuccuccagccugcccgaugacaucucaguaaucaggguggaggacagcuucaagggcgagcggugccgcuccaagaagaucugacugguaccuaucgacuuggacaaauuggagauccccagcccaacuuggaguugcccggcgccgacugccugcucagcaacgagcaucuucgcaguaucuaggagagcagccuguccaucggcaacuucaccucgcgccugcuggugccccuguuccccaagcucuucacccaugacaaccugcacaagcaguacagcugcagcgacucccugggcaagaagcagcuggacccguccugcaucaagcucauucgccacuaagugcaccugcucuaccucugcaccaaaaacaaucgcgucuggacccuggaguucaugggcaaccugcacuggaacacgaacagaggcgcuccuaccagcagcagugcaagguccacgugcuggccccgaguguagaaacaugaggagcuaugcaaucaauccugagagguucagggaggaguuugagggucccccgcugccccugagaggagcagcaaggacuucugcaagauccccuuggaugagguggugguccuucaccgagcuucccagugcgcucucccuaccugcuguccgacaaggaggugcgcgagaucgugcagcagagccucuccgugggcaacuuugccgcggggcuccuccaccgccgagaacuuccggcugcagu

SEQ ID NO: 650 - RNA, 1350 nt, Homo Sapiens
ggggacgcucucagcucucagugccuggcccagcuuccuucaaaauguauacuauuuacgaaauccugugcaagcucagcuuggagggucaucacucuacacccucaggugcauaugggucagucaaagccuacaccaacuuugaugcugagggggaugcuuugaacauugaaaggaccaucaggacaaaagguguggguaaguucaccauugucaacauuuugaccaacagcaggaaugcucggagagaggauguugccuuugccuagcagagaaggaccacaaaggaacuuacaucagcacugaagucagccuuacuggccaccuggagacagucauuuugggccuauugaagacaccugcucaguaugaugcuucugagcuaaaagcuuccaugaaggggcugggaacugaggaggacucccucguugagaucaucugcucaacaaccaaccaggagcuccaggaaauuaacagagucuacaaagaaauguacaaaacugaucuggagaaggacauuauuucggacacauauggugacuucugcaagcugauguuugcccuggcaaauguuagaagaccagaggauggcucugucguugauuaugaacugauugaccaagaugcccgggauuucugugaugcuggagugaagaggaaaagaacugauguucccaaguggaucagcaugaugaccgaguagagcaugucccaccuccagaaaguauuugauagguacaagagcuacagcccaucaagagagagcaucaagaaagagguuaaaggagaccuggaaaaugcuuuccugaaccugguccagugcauucagaacaagccccuguauuuugcugauuggcuguacuacuccaugaagggccgggggcucgagauaagguccugaucagaaucaucgucucccgcagugaaguggacauguugaaaauuaggucugaauucaagagaaaguauggcauguccccguacuauuacauccagcaagacacuaagaacgacuacccaaaaagcacugcuguaccugugugguggagaugacugaagcccaacauagcuugagcuuccagaaacggugcuccccacgcuuccagcuaacaggucuagaaaaccagcuuguggcuaacagucccuguggccgucccugugaagaugacauuagcauugcccccaaccucauuuuaguugcguaagcauagccuggcuuuccugucuagucucuccuguaagccaaagaaauguacauuccaagcaguuggaagugaaaucuaugaugugaaacacuuugccuccuguguacugugucauaaacagaugaauaaacugaauuuguacuuu

SEQ ID NO: 651 - RNA, 3840 nt, Homo Sapiens
ggggucgagucagugccguuugcgccaguuggaaucgaagccucuuaaaauggcagaugauuuggacuucgagacaggagaugcaggggccucagccaccuucccaaugcagugcucagcauuacguaagaauggcuuuguggugcucaaaggcuggccauguaagaucguggagaugucugcuucgaagacuggcaagcacggccacgccaagguccaucugguugguauugacaucuuuacugggaagaaauaugaagauaucugcccgucaacucauaauauggauguccccaacaucaaaaggaaugacuuccagcugauuggcauccaggauggguaccuaucacugcuccaggacagcggggagguaccagaggaccuucgucucccugagggagaccuuggcaaggagauugagcagaaguacgacuguggagaagagauccugaucacggugcugucugccaugacagaggaggcagcuguugcaaucaaggccauggcaaaauaacuggcucccaagguggcagugguggcagcagugauccuccgaaccugcagaggcccccucccccagccuggccuggcucuggccugguccuagguuggacuccuccuacacaauuuauuugacguuuuauuuugguuuuccccacccccucaaucugucagggagccccugcccuucaccuagcucccuuggccaggagcgagcgaagccauggccuuggugaagcugcccuccucuucuccccucacacuacagcccuggugggggagaagggggugggugcugcuugugguuuagucuuuuuuuuuuuuuuaaauucaaucuggaaucagaaagcgguggauucuggcaaaugguccuugugcccuccccacucauccuuggucugguccccuguugcccauagcccuuuacccugagcaccacccaacagacuggggaccagcccccucgccugccugugucucuccccaaaccccuuuagauggggagggaagaagaggagaggggaggggaccugcccccuccucaggcaucugggaagggccugcccccaugggcuuuacccuucccugcgggcucucuccccgacacauuuguuaaaaucaaaccugaauaaaacuacaaguuuaauaugaaaaaaaaaaaaaaagaaagaaagacguguaaaaugccaagaacucuaggaaacagggacaaaaacacuucaaagagaaaguucaugcacuuguuucugaccacccagggcacccuucagcacacgcugucuggaguggccugaagcaaggagugucuugugaggugcagaggaugcaaugggagcaggguccuguccccacccuaaaggaguucacaguuuaacgcaaaugagaagccagugaggacaucacuacuccugcugugaacuugggaacuagaaacacaaaaccugagucuggagggaagcuaaggaagcauucugcucuggaguagacaugagugcgugugaagcuucugaucucccaugagagcaauggggacauggggcagaaucuaaaacccaugacugaaagcaccaaauugcuaaaauggcaauaaagagacaugaggccaagauggagaagaaggaacccaggacgagggucagccucacauuuggggcucauuucccucaguuuccucacugaauuucagaagggacuaacugagaugcaaagaagcagagcagcuuuugcaccauguggaggacuagauggaaaacaaguagacugagggucugcuagugaaggugaccccuacugaaguccacuggcuuugguugggacccagaagagucacacgccaggaauagagguggacaggaaacacccugacuuuuguagggacugaaccucacugauaaccucaauugcggaugguauggagggugucuaggugugcuaggaccccugcccauuccccagaaauagacucccaucuuuucuacagcaagauaacgugcuaguaggccucaauucauugcuaaauauuuuuaacgagugucuuacauuuagccaaaaagacuagucauguggcaggaaaaauacaaugucauaugaccaaaagcuaaaagacugugaaaaugaauccagaggugacccaagcauugaauuuaacaaugccaguaccuggaccuccgcuugccccuaaaacauuacaaucaagaauguaggaagggaaaggaaacacgaagauuaaucaagcaggaaggacaagcucaguuuugcacccacugaauuugccacaaauauuguggaaaauauucucggggacauugcaguugucuacuuugguuggcacaugguucauacaacaguguuugugucagugaacaucuuacucuuccucggcagucuuucuuugcccagagauuucgcaaugacuguugaccuucaucaucaccuuuuggacuuuggcuugcacuuuagcuucuguagaucuccaugauguaaagaaguauuuuagguccauuuuaauuccugcaaaggauaaaauccuucuauuugugugcauauaaguggaccugagcccuugguuaggguguagagaggagaaggggagaaaccugagggccagaagcuguucuuucccuuaaaagggcaaacucauuuccacacuauggggacucugacagauagcauaccuuccugucuauggcuauuggaccugcaggcuuuccccuguaaauccguguucugucauugacauuuugugacuguaagacagacuugagauaagacaucuagaaaacaauaauugaacaaugaugugaauauauuucacacaacugaacuguacauuucaacaagguuaagaugguaauuaucacguuauacauuuuuuaccgcagguuaaaauguuucacagguugaaaggaaagcaacuaccuucaguucucugaguucaagaauuuguaacauuucacccccugcuccuuccugaucuucuguggagcaucuuuuuuccauccaugcucuacucagagcccacuuucccuucccugacaccagcuucacugaggcugguuggaaccuaacacaaaacauucucaguaaugacugaauucccacaaagaauuccauauagacugcauaugaguugaaucuucuaagacaugaaauauuuguucucuucuuggcuaauaugcaaugcaaauccuguugcagauguacgucauauaccucugaaauuccugauguauucaaugaaauaacaucuuuaaaguucuguguagaauguuuuuuuucugauuucuucacauacgauagaaaaaaaaacccaaaaaaacauguacuaggauuucaauagaagcaaugggugaucuaaaaagaugaaagagcaaccgcaugcgcccuacagcuaccgcuagauuuuauggggaaagcagcuggcccaguuugcagcuaggagaaaugucaaacacaugaagaaaugagaagcaaagaaaaaccaugaggcaugaacauuucauggcaaucacgauguccugguuugugagauaaugggauagaggaguagaaaacaaggagaaagaugagaagguacaaagugguucaagucaaacagcucaacugaacuuuucuuaauggaauauuuaaaaagugguacauuaaaaaacuucccccaguucacaucaaaaauucucucuucaggacuaaguuggguagagacuguucaaugugccuagauaucuucagaacuuauauauuuucuguuuucuacguauguugaagggcagugccaaaugauguguaauuaucuagguuguaaaaauaaaacauacucccccuucccuugaggauaaaaaa

SEQ ID NO: 652 - RNA, 3495 nt, Homo Sapiens
aguuucacuuucccuuuuguaacgucagcugaagggaaacaaacaaaaaggaaccagaggccacuuguauauauaggucucuucagcauuuauugguggcagaagaggaagauuucugaagagugcagcugccugaaccgagcccugccgaacagcugagaauugcacugcaaccaugagugagaacaauaagaauuccuuggagagcagccuacggcaacuaaaaugccauuucaccuggaacuugauggagggagaaaacuccuuggaugauuuugaagacaaaguauuuuaccggacugaguuucagaaucgugaauucaaagccacaaugugcaaccuacuggccuaucuaaagcaccucaaagggcaaaacgaggcagcccuggaaugcuuacguaaagcugaagaguuaauccagcaagagcaugcugaccaggcagaaaucagaagucuggucaccuggggaaacuaugccugggucuacuaucacaugggccgacucucagacguucagauuuauguagacaaggugaaacaugucugugagaaguuuuccagucccuauagaauugagaguccagagcuugacugugaggaaggguggacacgguuaaaguguggaggaaaccaaaaugaaagagcgaaggugugcuuugagaaggcucuggaaaagaagccaaagaacccagaauucaccucuggacuggcaauagcaagcuaccgucuggacaacuggccaccaucucagaacgccauugacccucugaggcaagccauucggcugaauccugacaaccaguaccuuaaaguccuccuggcucugaagcuucauaagaugcgugaagaaggugaagaggaaggugaaggagagaaguuaguugaagaagccuuggagaaagccccagguguaacagauguucuucgcagugcagccaaguuuuaucgaagaaaagaugagccagacaaagcgauugaacugcuuaaaaaggcuuuagaauacauaccaaacaaugccuaccugcauugccaaauugggugcugcuauagggcaaaagucuuccaaguaaugaaucuaagagagaauggaauguaugggaaaagaaaguuacuggaacuaauaggacacgcuguggcucaucugaagaaagcugaugaggccaaugauaaucucuuccgugucuguuccauucuugccagccuccaugcucuagcagaucaguaugaagacgcagaguauuacuuccaaaaggaauucaguaaagagcuuacuccuguagcgaaacaacugcuccaucugcgguauggcaacuuucagcuguaccaaaugaagugugaagacaaggccauccaccacuuuauagaggguguaaaaauaaaccagaaaucaagggagaaagaaaagaugaaagacaaacugcaaaaaauugccaaaaugcgacuuucuaaaaauggagcagauucugaggcuuugcaugucuuggcauuccuucaggagcugaaugaaaaaaugcaacaagcagaugaagacucugagagggguuuggagucuggaagccucaucccuucagcaucaagcuggaauggggaaugaagaauagagauguggugcccacuaggcuacugcugaaagggagcugaaauuccuccaccaaguugguauucaaaauauguaaugacugguauggcaaaagauuggacuaagacacuggccauaccacuggacaggguuauguuaacaccugaauugcugggucuugagagagcccaaggaguucugggagagggaccagauugggggguagguccacgggcuuggugauagaauuauuucucgauugacuucuugagugcaauuugaacuguaacauuugcuuagucaccuuuaguggaguaaucuacugggcuuguuucuauauuuauauaaagcagccaaauccuucauguaauauugaaguccauuuuugcaauguuguuccauacuuggagucauuuugcaucccauagagguuaguccugcauagccaguaaugugcuaaguucauccaaaagcuggcggaccaaagucuaaauagggcucaguaucccccaucgcuuaucucugccuccuuccuccuccuucccagucuaucaucaaccuugaguauucuacacaaugugaauucaagugccugauuaauugagguggcaacauaguuugagacgagggcagagaacaggaagauacauagcuagaagcgacggguacaaaaagcaauguguacaagaagacuuucagcaaguauacagagaguucaccucuacucugcccuccucauagucauaauguagcaaguaaagaaugagaauggauucuguacaauacacuagaaaccaacauaauguauuucuuuaaaaccugugugaaaaaauaaauguuccaccaguagggauaggggaaaaguaaccaaaagagagaaagagaaaggaaugcugguuuaucuuuguagauuguaaucgaauggagaaauuugcaguauuuuagccacuauuaggaauuuuuuuuuuuuguaaaaugaagacugaacucuguucaaaugcuuucaugaaccugguuugagacgguaggaaagcaacaaaacgugggaaccuggugacuaagggccuggugcaaggacuugggaaaugucauugauaauagauggugggguuuuccccccuuuagaaauguuggauauuaagugauauaaacacuucuuuuaacuccgaaaaucuucugagaaaucacaaaauucacgguaugcuuggaacgauugagauuuucuagguagaugcugaauagccuagacaucaaaguuggugugaaccaaaauagagucagcugacccagcaucagccacacucuggguuggaaaauguuugccuguuggaauuaauuuaagcuuaaguauauaucaacauuauuuuauugugcaauuaaaacaauacaaauucaugguuuuuuaaaguuaaaaauucuaaccacuguaacaacaguuuuuguguuauuuucuguauuaaacaucuuguugcacgcauuugaggucaucagggugcaaaauuuguauuccugaaaaugucauauauuuucauuaauaaauaaccuaaauaugauaaaacauaaagcaguguucugguucaucuggaauuuugcuguacuuuaaaucuuucagacucagcuacugauaaaugaaacguuacacaggugugaaccaaauccaaauaaccucgacuggucuacuaucauaaucaccugaacagaacaaaacuuuuuccucagcuuuaagaguccagggcuucggauaacagcugccaucugccaccugcuaccauugaccuacgugaacacagacauucugucuccaccuugauggugggugggcugcuccccuuuucuuuguuaaauuuugugcuuucaucacauuuucucuauucugaccucuguuaugagaaauaaaagucacugauuccauuuua

SEQ ID NO: 653 - RNA, 2691 nt, Homo Sapiens
auuuuccuccucccaacgauuuuaaauuaguuucacuuuccaguuuccucuuccuuccccuaaaagcaauuacucaaaaacggagaaaacaucagcugaugcgugcccuacucucccaccccuuuauauaguuccuucaguauuuacuugaggcagacaggaagacuucugaagaacaaaucagccuggucaccagcuuuucggaacagcagagacacagagggcagucaugagacuuuccuuuccccuuucauaaaagcacagaccuaacagcacccuggguggaaaccucuucagcauuugcuuggaaucaguaagcuaaaaacaaaaucaaccgggaccccagcuuuucagaacugcagggaaacagccaucaugagugaggucaccaagaauucccuggagaaaauccuuccacagcugaaaugccauuucaccuggaacuuauucaaggaagacagugucucaagggaucuagaagauagaguguguaaccagauugaauuuuuaaacacugaguucaaagcuacaauguacaacuuguuggccuacauaaaacaccuagaugguaacaacgaggcagcccuggaaugcuuacggcaagcugaagaguuaauccagcaagaacaugcugaccaagcagaaaucagaagucuagucacuuggggaaacuacgccugggucuacuaucacuugggcagacucucagaugcucagauuuauguagauaaggugaaacaaaccugcaagaaauuuucaaauccauacaguauugaguauucugaacuugacugugaggaaggguggacacaacugaaguguggaagaaaugaaagggcgaagguguguuuugagaaggcucuggaagaaaagcccaacaacccagaauucuccucuggacuggcaauugcgauguaccaucuggauaaucacccagagaaacaguucucuacugauguuuugaagcaggccauugagcugaguccugauaaccaauacgucaagguucucuugggccugaaacugcagaagaugaauaaagaagcugaaggagagcaguuuguugaagaagccuuggaaaagucuccuugccaaacagauguccuccgcagugcagccaaauuuuacagaagaaaaggugaccuagacaaagcuauugaacuguuucaacggguguuggaauccacaccaaacaauggcuaccucuaucaccagauugggugcugcuacaaggcaaaaguaagacaaaugcagaauacaggagaaucugaagcuaguggaaauaaagagaugauugaagcacuaaagcaauaugcuauggacuauucgaauaaagcucuugagaagggacugaauccucugaaugcauacuccgaucucgcugaguuccuggagacggaauguuaucagacaccauucaauaaggaagucccugaugcugaaaagcaacaaucccaucagcgcuacugcaaccuucagaaauauaaugggaagucugaagacacugcugugcaacaugguuuagaggguuuguccauaagcaaaaaaucaacugacaaggaagagaucaaagaccaaccacagaauguaucugaaaaucugcuuccacaaaaugcaccaaauuauugguaucuucaaggauuaauucauaagcagaauggagaucugcugcaagcagccaaauguuaugagaaggaacugggccgccugcuaagggaugccccuucaggcauaggcaguauuuuccugucagcaucugagcuugaggaugguagugaggaaaugggccagggcgcagucagcuccagucccagagagcuccucucuaacucagagcaacugaacugagacagaggaggaaaacagagcaucagaagccugcaguggugguugugacggguaggacgauaggaagacagggggccccaaccugggauugcugagcagggaagcuuugcauguugcucuaagguacauuuuuaaagaguuguuuuuuggccgggcgcaguggcucaugccuguaaucccagcacuuugggaggccgaggugggcggaucacgaggucuggaguuugagaccauccuggcuaacacagugaaaucccgucucuacuaaaaauacaaaaaauuagccaggcgugguggcuggcaccuguagucccagcuacuugggaggcugaggcaggagaauggcgugaaccuggaaggaagagguugcagugagccaagauugcgccccugcacuccagccugggcaacagagcaagacuccaucucaaaaaaaaaaaaaaaaaaaaaaaagaguuguuuucucauguucauuauaguucauuacaguuacauaguccgaaggucuuacaacuaaucacugguagcaauaaaugcuucaggcccacaugaugcugauuaguucucaguuuucauucaguucacaauauaaccaccauuccugcccucccugccaagggucauaaauggugacugccuaacaacaaaauuugcagucucaucucauuuucauccagacuucuggaacucaaagauuaacuuuugacuaacccuggaauaucucuuaucucacuuauagcuucaggcauguauuuauauguauucuugauagcaauaccauaaucaauguguauuccugauaguaaugcuacaauaaauccaaacauuucaacucuguuagaa

SEQ ID NO: 654 - RNA, 1972 nt, Homo Sapiens
agaacucuguggaugaaccuugaaggagccuccaagccugaaccaaagcacuacagaucaccugcuaucuucauagcaccaugagugaagaaucugauggaaagcuuauugaagacagccugauucagcugagaugucacuuuacauggaaguuguuaauugaagccccugaaauuccugauuuagaaaacaggaucugggaagagauucaguuccuggacaccaaauacaaugugggaauacacaaccuacuagccuaugugaaacaccugaaaggccagaaugaggaagcccuggucagcuugaaaaaggcugaagacuuaauucagaaagaacaugccaaccaagcagauauuagaagucuggugaccuggggcaacuuugccuggguguauuaccacaugggcagauuggcagaagcccagacuuaccuggacaagguggagaacacuugcaagaaguuugcaaauccuucccgcuauagaauggaguguccagagguggacugugaggaaggaugggccuuggcgaagugugguggaaagaauuaugaacgggccaagaccugcuuugaaaaggcucuggaagggaacccugaaaacccugaauucaauacuggguacgcaaucaccgucuaucgccuggauaaauuuaacacagcaucagggaggaauaaggcauuuucucugcacguccuaaaacgagcugucaggcuaaauccagaugauguauauauuaggguucuccuugcccugaagcuucaggaugaaggacaggaagcugaaggagaaaaguacauugaagaagcucugaccaguauaucuucacaggccuaugucuuucaauaugcagccaaguuuuaucgaagaaaagggucuguggauaaagcucuugagcucuuaaaaauggccuuggagacaacacccacuucugccuuccugcaucaccaaauggggcuuugcuacagggcacaaaugauccaaaucaaggaagcuacaaacuggcagccuagagggcaagauagggaaacuguggacagauugguucaauuggcuauaugcaaauuugaaaagacuauaauguuaaagcgaacauuugagauggccuauguugaccuggcugaaacguaugcagaaauaggccaccacagaaaggcugaggaacauuuucagaaaggguuacgcaugaagaucuuugaagaucagcuaaagcaagagauucauuaccacuacggccguuuccaagaacaucaugggaaaucucaagauaaagcaauuacccauuauuuaaaagguuugaaaauagaaaaaaugucccauuccagggaaaaacuucucaaugcuuuagagaaauuggcuaaaagauguauucaccagaauguacggguuguggaaagugucagccuccuugggcuuauccacaaauugaaaggagaaguaagugaugcuuugcugugcuaugagagggcucugaggcuggcugcugaccugaacccuauauuuuaacauagaggucaccauuauccauuuaauggucuuauaacuaaauagaaugacuaugaaauuaaauaaugcaaacuuaaagcuguuggaaauuuaccuuauuuugagccuugagaggaauguggcuguguggccugaguuauguagcaugcaacugcaacuucugcuuuuuccuguaaaugaucaggaaaggccuuguggcaccagacauaagacccccugaaaguaucaucccuccugauggaaugguaaagcaaucuuucuuggaacauagcaaguaguaaccgaucaaauugcuauaacguguguacugaccuuauguggaaaaugcugcaacccuguuuacugccuauguaagugaaaucuuaacuuccccauuuuggaaugcugacuccagucauuaggugucuguauuuccugagugguuacccucaagcuuugugcucaaauaaacucuauacuuaaucaua

SEQ ID NO: 655 - RNA, 3079 nt, Homo Sapiens
gcaaggacacacccacagcuuacaccauuggcugcuguuuagcucccuuauauaacacugucuugggguuuaaacguaacugaaaauccacaagacagaauagccagaucucagaggagccuggcuaagcaaaacccugcagaacggcugccuaauuuacagcaaccaugaguuugcuaugugaauaaugcugcuaugaauauggacaaauaaauaaucugcuugagucucugcuuucacuucuuuuuggguauaaaaccaaaaguggaauugcuggaucaaaugguaauucuaugguuaauuuuucugaggaauuaccauaccauuuuucacagcacuugcccccuuuuacauuccuacuagcagugcacauuucucuagauucucaccaauaauuguuauauccugcuuuuuuuuuaaaauaauagccaaccuaacagacaugaagugguaucucauugugguuuuuauuugcauuucacuaaugauuagugauauugagcaucuuugcauauguuuauuggccauuuguauauuuucuuuugggaaaugucuauuuaaguccuuugcccauuucuuaaucaguuguuuguuuuuuguugcugaguuguagagguucuuuaucuauucuguauauuaauccccuaucagguacaagauuugcaaauauuuuccuucauucugugauuugucuuaucacucuguugauaguauccuuccaugcauaaaaguuuuuaauuuugguggaguccagcuuaauuauuuuuacuguuauugccugugauuuugguaucauaucuaaugaaucacugccaauugccaaauccaauguuacaaagcuuuuuccuuucuucugaguuuuauaauuuuagggcuuacauuuaggucuuucauccauuuugaguuaauuuuuguauauggcauaaaguaaggguccaacuuuacccuuuuucaucauauauccagcuuucccacacauuuguugaaaagaccauccuuuccccauuagauggucuugucauucuuauugaaaaucauuccaccauuguuauggaaugaauugugcacuucccacccaccccugcccaaaauucuuaaguugaagccuuaacccucuuauguugaacuguuguuuggagauagagucuaaaaagagguaauaaagguuaaauaaaaucguaagagugaggccuuaauccaacagagcugguguccuuagacaccaaagcucacucucucucucucugugccacugaggaaaggccacuuaaggaugcagcaagaaggagccaucugcaauccaggaagaaauuccuugccaggaaccaaauugguugucaccuucaucuaggacuucuagccucgagaacuuacaaauggugaugaucaucaggucaaggauagucuggagcaauugagaugucacuuuacaugggaguuauccauugaugacgaugaaaugccugauuuagaaaacagagucuuggaucagauugaauuccuagacaccaaauacagugugggaauacacaaccuacuagccuaugugaaacaccugaaaggccagaaugaggaagcccugaagagcuuaaaagaagcugaaaacuuaaugcaggaagaacaugacaaccaagcaaaugugaggagucuggugaccuggggcaacuuugccuggauguauuaccacaugggcagacuggcagaagcccagacuuaccuggacaagguggagaacauuugcaagaagcuuucaaaucccuuccgcuauagaauggaguguccagaaauagacugugaggaaggaugggccuugcugaaguguggaggaaaaaauuaugaacgggccaaggccugcuuugaaaaggugcuugaaguggacccugaaaacccugaauccagcgcuggguaugcgaucucugccuaucgccuggauggcuuuaaauuagccacaaaaaaucacaagccauuuucuuugcuuccccuaaggcaggcuguccgcuuaaauccagacaauggauauauuaagguucuccuugcccugaagcuucaggaugaaggacaggaagcugaaggagaaaaguacauugaagaagcucuagccaacauguccucacagaccuaugucuuucgauaugcagccaaguuuuaccgaagaaaaggcucuguggauaaagcucuugaguuauuaaaaaaggccuugcaggaaacacccacuucugucuuacugcaucaccagauagggcuuugcuacaaggcacaaaugauccaaaucaaggaggcuacaaaagggcagccuagagggcagaacagagaaaagcuagacaaaaugauaagaucagccauauuucauuuugaaucugcaguggaaaaaaagcccacauuugagguggcucaucuagaccuggcaagaauguauauagaagcaggcaaucacagaaaagcugaagagaauuuucaaaaauuguuaugcaugaaaccagugguagaagaaacaaugcaagacauacauuuccacuauggucgguuucaggaauuucaaaagaaaucugacgucaaugcaauuauccauuauuuaaaagcuauaaaaauagaacaggcaucauuaacaagggauaaaaguaucaauucuuugaagaaauugguuuuaaggaaacuucggagaaaggcauuagaucuggaaagcuugagccuccuuggguucgucuacaaauuggaaggaaauaugaaugaagcccuggaguacuaugagcgggcccugagacuggcugcugacuuugagaacucugugagacaagguccuuaggcacccagauaucagccacuuucacauuucauuucauuuuaugcuaacauuuacuaaucaucuuuucugcuuacuguuuucagaaacauuauaauucacuguaaugauguaauucuugaauaauaaaucugacaaaauauuaguuguguucaacaauuagugaaacagaauguguguaugcauguaagaaagagaaaucauuuguaugagugcuauguaguagagaaaaaauguuaguuaacuuuguaggaaauaaaacauuggacuuacacuaaa

SEQ ID NO: 656 - RNA, 4034 nt, Homo Sapiens
aguuucugagcgcucggcaucugauucaaucuccaguuuccuguucuugcuggggcuggggucucuccuuuaacaaagacacgccgcgcggccgaguccaggggcugcagaggccuggcgcgcgcacgcgcacgcgcacgcccaccgcgcggcuucccgcgguccccggugcugaggagagagcgauccgagggacugcgccgcccggacggccugcagagcgcugccaucaugagugaaauucguaaggacaccuugaaggccauucuguuggaguuagaaugucauuuuacauggaauuuacuuaaggaagacauugaucuguuugagguagaagauacaauugggcaacagcuugaauuucuuaccacaaaaucuagacuugcucuuuauaaccuauuggccuaugugaaacaccuaaaaggccaaaauaaagacgcccuugagugcuuggaacaagcagaagaaauaauccagcaagaacacucagacaaagaagaaguacgaagccuggucacuuggggaaacuaugccuggguguauuaucacauggaccagcuugaagaagcucagaaguauacagguaagauagggaaugucuguaagaaauuguccaguccuucuaacuacaaguuggaguguccugagacugacugugagaaaggcugggcacucuugaaauuuggaggaaaguauuaucaaaaggcuaaagcggcuuuugagaaggcucuggaaguggagccugacaauccagaauuuaacaucggcuaugcuaucacaguguaucggcuggaugauucugauagagaagggucuguaaagagcuuuucucuggggccuuugagaaaggcuguuacccugaacccagauaacagcuauauuaagguuuuucuggcacugaagcuucaagauguacaugcagaagcugaaggggaaaaguauauugaagaaauccuggaccaaauaucaucccagccuuacguccuucguuaugcagccaaguucuauaggagaaaaaauuccuggaacaaagcucucgaacuuuuaaaaaaggccuuggaggugacaccaacuucuucuuuccugcaucaccagaugggacuuugcuacagggcacaaaugauccaaaucaagaaggccacacacaacagaccuaaaggaaaggauaaacuaaagguugaugagcugauuucaucugcuauauuucauuucaaagcagccauggaacgagacucuauguuugcauuugccuacacagaccuggccaacauguacgcugaaggaggccaguauagcaaugcugaggacauuuuccggaaagcucuucgucuggagaacauaaccgaugaucacaaacaucagauccauuaccacuauggccgcuuucaggaauuucaccguaaaucagaaaauacugccauccaucauuauuuagaagccuuaaaggucaaagacagaucaccccuucgcaccaaacugacaagugcucugaagaaauugucuaccaagagacuuugucacaaugcuuuagaugugcagaguuuaagugcccuaggguuuguuuacaagcuggaaggagaaaagaggcaagcugcugaguacuaugagaaggcacaaaagauagauccagaaaaugcagaauuccugacugcucucugugagcuccgacuuuccauuuaaauacauacucuaggaaauuagcucuaaguuuuucccuucauuuuggguucuccuguuuguuuuuuuuuuauuauuuuaaucccuuguuuauuauagagcuaauauuuauugaauaguuauuguguaccaagcauugugcuaaauacuuuauaugcauuaugaugaaucuugugcgguuuucuuucuuuuuuucuuuuuaauuaaaauacuauaauccauugagaaauagcaauauucuagcuauuguaacuucuaaaaaugguauggccauuagaucugugcuuuuuaucucugcucuuugaauuucucauauuauauaguaaauauauuccuacguaaaccuuugauaccuagaucaggaauacucuuccaggaguacaaaauuacauuauugauaguuaagcucuuaauuguguagcuugcaaaagacagcacuuuuuaguuacagauguuuugacuuugaugaggauauuuagcuaucaaucuaauagucaccuaaaauaucuuuuuuguuggaaaaaaguuuauaauaaaaaaguuugucaucucuagugacuucaauaaagaaaaaacuagaagaggagaaaaaggauuuccucaaauuuuaaauauguaacuucagggauucaauccccaaauguuuauuaaguagcuagaaauaauuauguggaaaaaaaugaauaauggaaaauagugagucucaaauuguucucuuuuuuuuuuuaacuaaaacaaaucugcaaugaaucuagaugcaauuaauuuuauuccuuccaacuaaaauuacaauauuuuuagguuaaaauuauugagauauaaagcagccauugggaaauugggagaaaugauaaacaaauggaaaaagaagaugucccuaaccuacacccauagauuaccaagguuucaguguacuaguuuugaaucuguucugaauggaguuuuuauacccucaauuucuggccuuuggcuauuuuagcauuucaaagugacuucuaugaagcuuuuuuuuuaaugugaaauuuucagaauguuguuuuuuucauguagauacuccaggaagaguuaagcacugcuuucaguuuuaauauccaccuugaggggucgcugcuugagggcucuuaucccaggggacuuuuuaauucggauguuacuuaauguggcuucucuaauguaguuucuuugauuaccgacuacacaauuauguaccaucacaguauuaguggaaaaguaccaugugauuuaauucuccauuccuccaauguaacucuuaaaauuauuauguauguguguguguuuuacuuuuuguuuuuuaucaucuuuaaaauuucuauuaugguuugauuauuauaaaaauaaugaauucucacuguaaauuucaaaaaaaaauuacaaaaguaugugaauuuaaaaaugagagcaguccucucacccuaccacaguuccacacccucaagguaaacuuauaacuuauaauuugauauguaaacuuccagaucuuuuuucuaugcguaaucagacauacauauauacugcaguguaucucacguauuaauuuuuaaaaaucuuuuguuuuacuuaauucuguuuuuauuauuauuauuauuuuguuugaucuauuaaggaagaacaaggaagggaaugaucuuuacucaagaauuucagaaagucagcacugaaguccugaccuaucaguagacacauuugucccuuucagauauuuuaggauauucuagcaaagcaggccauuucucccaccugaaaguacauaacuucuaucacuugccacauaauuaaaagaacucacauuaagcgguuacucagacaguuaaucauagaaaagauuauuugcuucaucaguucauagaaaagauuauuugcuucaucaguuaacuuguuuuuauaaaucagggcuguguucauacacagaaggggccugagauuucugcacuuuaaacaagcuccuccuaggugaggaugcuguggcuguucuaauuacauuuugaguaguaaggucuacagcauuguuccucaaacuuggcuacguauuggaaucaccuaaaaaguuaaaacaaaacauggaugucugggucccgccccauagagaaugacuuaauuggcauggggugcaguccaggcaucaugauuuuuagauuucccaguuggaacuugugcagcaaaguuugggagcuacugauggacaugugaaaaguaaguauaaauggaauaaaauuaauuaggcuaauaggcuuaacccaggaaauccuaaguuccuugaauauccaguuugcauuuggacuccucaucauauacuugguauauaauacucuaauaaaagcugccugaguugaauugua

SEQ ID NO: 657 - RNA, 81 nt, Homo Sapiens
auucaggccgguccugcagagaggaagcccuucugcuuacagguauuggaagggcuuccucucugcaggaccggccugaau

SEQ ID NO: 658 - RNA, 85 nt, Homo Sapiens
cuuuguggaacagugcaauguuuuccuugccuguggcaagaccacuucgguucaaggcuaagaaacuagacuguuccuacagaga

SEQ ID NO: 659 - RNA, 380 nt, Homo Sapiens
uuggcucucauauuuaaaaaugaaauugucuguaauacuuucccacucuccggcaccugaguccauggcuuuggcagccauagugaucaugaacuuccggcuauguccuagagucauuuaucuccgaggaugucaggaggaaccccaaaaugucaucaagacacuggcuacaggucuaaacuccaauaaaauccagcuggguuacaucaauucagacaucuggauaaaaggaugaaugaaaccauguacauaauacagaauuaugcaugccaggaaaaaaaauuauacugccuaaaagcugcaaccuucaugacaucaaaucuauuuuaacacuggcugguuaugugaggaaaaggcuaauaaaaaaaaauucuggcuga

SEQ ID NO: 660 - RNA, 2174 nt, Homo Sapiens
acuauauugaauagaagcgaagagacagaguauacuugucuuguuccuaauccagaagaaaaguuugaaucuuuuaccauugaguuaauccaagaugccuuuuuucccccuucagaagcuugagugcccaaggguuugauaaauguggaaaauaaccgcuguucgaauauccuguuggccugcugaagaaaugacuggcugaggcuguaaagaaaucuuguggucauucucauggaaagaggauuggagccccgauucuuugaucucauuauugaccaguugauugagaagacuguccuccuguccccacccaaucacaauaaguggugaugugagguguggaagaaacacgggagcagccuuccucaggacaccucuuguuuaucucucuagcucugaaaucacaugaagcuguggauggagagucaccugauagucccagaaacccgucccagcccaaggaugaugaguaaccagacguugguaaccgaguucauccugcagggcuuuucggagcacccagaauaccggguguucuuauucagcuguuuccucuuccucuacucuggggcccucacagguaauguccucaucaccuuggccaucacguucaacccugggcuccacgcuccuauguacuuuuucuuacucaacuuggcuacuauggacauuaucugcaccucuuccaucaugcccaaggcgcuggccagucuggugucggaagagagcuccaucuccuacgggggcugcauggcccagcucuauuuccucacgugggcugcauccucagagcugcugcuccucacggucauggccuaugaccgguacgcagccaucugccacccgcugcauuacagcagcaugaugagcaagguguucugcagcgggcuggccacagccguguggcugcucugcgccgucaacacggccauccacacggggcugaugcugcgcuuggauuucuguggccccaaugucauuauccauuucuucugcgaggucccuccccugcugcuucucuccugcagcuccaccuacgucaacggugucaugauuguccuggcggaugcuuucuacggcauagugaacuuccugaugaccaucgcguccuauggcuucaucgucuccagcauccugaaggugaagacugccugggggaggcagaaagccuucuccaccugcucuucccaccucaccguggugugcauguauuacaccgcugucuucuacgccuacauaagcccggucucuggcuacagcgcagggaagagcaaguuggcuggccugcuguacacugugcugaguccuacccucaacccccucaucuauacuuugagaaacaaggaggucaaagcagcccucaggaagcuuuucccuuucuucagaaauuaacuugugucuucugaaguuuuuguccuuggagacugcaguuuuaguggagucugaugagcaaguuucuggacugggagguaaauagacuuguuuuuucuaacccagcagaaccugugcauggaugagcugggagugcugguucccugagacuuggugauggggggauugcgguaggugugacccaccagccucugagacaccagaucucuuggucugacuccaagguggugucagugcugaguuggcagagaaacacagggccuaggaggagaaaaguguuccuuguguuuucaacucauagccacaucaaacauuuuccuuuuguauguacaacacucaggguguaaauucuaaaaucacaccuagaauucagcugugugggucuaaaaaguuaggcagaauuguggaccccacagccccugaaggguugucagacugaagcuuuguuuuaaggugaccacuggccucuaggaaaccuucuacccccauuaucuuaccucaacuguuuccucuggagccacuuggacuucaaaaauaguuugauuuuaaugcaaacuguuguuucugcuuuugucuuuucuucuuacuaacacuucagauucugaguaucugaccuaccuaauuggccuggagcgaggacagcugccaugagucagcucuaauaaguuaaacggcauuguaguaaggcauugcuauccuuccauuguuucagauaaaacugggugaacgaauccucugugucuaauaaagacaggucuugugcuugugcuccaugcuauuac

SEQ ID NO: 661 - RNA, 2301 nt, Homo Sapiens
ggccagagaggagccaggagccaugaggguggcauuaggcaugcucuggcucuuggcccuugcguggcccccccaggcccggggcuucugccccucucaaugcagcugcagccuccauaucaugggugauggcagcaaggccaggacaguagugugcaacgaccccgacaugacccugcccccggcguccauccccccggacaccuccagacugcgccuggagcggacggccauacgcaggguuccuggcgaggccuucaggccccugggccgccuggagcagcuguggcugccuuacaacgcccucagcgagcucaacgcccucaugcugcggggccugcgacgccugcgggagcugcggcugcccgggaaccgccuggccgccuuccccugggcggcgcucagggacgcccccaagcugcggcugcuggaccugcaggccaaccgccucucggcugugcccgcugaggccgcgcgcuuccuggagaaccucaccuuccucgaccucuccagcaaccagcugaugaggcucccgcaggagcucaucgucuccugggcucaccuggagaccgguaucuuuccucccggccaccaccccaggcggguccuagggcuacaggacaaccccugggcaugugacugccgacucuaugaccugguucaucuuuuggauggcugggccccaaacuuggccuucauugagacugaacugagaugugccagcccacguagccuggccggaguggccuucagccagcuugaacugaggaagugccagggcccagagcuccauccaggaguggccagcaucaggucccuuuuggguggcacagcacugcuacgcuguggagcuacuggagucccugggcccgagaugagcuggaggagggccaauggcaggccccuuaaugguacagugcaccaggaagucuccagugacggcacgagcuggacucugcugggccugccugcagugucccaccuugacuccggagacuacaucugccaagccaagaacuuccugggagccucugaaacuguuaucuccuugauugucacugagccaccgacuuccacagaacacagugggagcccaggagcacuaugggcaaggacagguggcggaggggaagcugcugcuuacaacaacaagcugguggccaggcaugucccccagauucccaaacccgcuguccuggccacuggacccucugugcccagcacaaaggaggagcugacccuugagcacuuccagauggaugcccugggagagcucucugaugggcgggcaggacccucagaggcacgaauggugaggucugugaagguggugggggacacuuaccacagcguguccuugguguggaaggcaccccaggcuaagaacacaacugccuucaguguccucuacgcggucuuugggcagcacagcaugcggcgggugauugugcagccugggaagaccagagugaccaucacugggcuguugcccaagaccaaguauguggcgugugucugugugcagggccuggugccccggaaggagcaguguguuauuuucuccaccaaugaagugguggaugcugagaacacucagcagcuuaucaaugugguggugaucaguguggccaucgucauugcccugccucucacgcugcuugucugcugcagugcucuucagaagcgcugccgaaagugcuucaacaaggacuccacugaggccacaguuaccuacgucaaccuagagagacugggcuacagcgaggacggcuuggaggagcugucccggcacagugucagcgaggcugacaggcuucucucagcucguuccaguguggacuuucaggccuuuggagucaaagggggcaggagaaucaaugaguacuucugcugagggauaugccuccgcaacucacacaccugccugcccacgcuccuucuuuagcucugacaccugaguacacgaucacccacucuuaccugcucggguaccugcuuacucagauacuuacacacaacaacagcagcagcagcugcuacugcaacaaccgcuaacacuuguuaagcacuuacuacagacuagaaaguguucuaagugcuaaauucuuguaacaaucauuugcagcaggcaucacuauucucuccauuucccuggggugggggguuaagaaacuugccuguaucagucagcuuuugcuguauaacaaaugaaagcaaaaucuuggugauguauagcagugaacacuuauuuucacacucacaggccuguggguugauuaggguggcucugcucuguguguu

SEQ ID NO: 662 - RNA, 5885 nt, Homo Sapiens
cagccccagcaagaacaggaaacuggagauugaaucagaugccgagcgcucagaaacugaaacuuaagaaaucgaaacuaaacguaagcuucagaaaccgaaacuuaauagaagagcucaagagccgcggccagacguuugcggaguccagggucuuucggaguugaauuugcagcugggcuccuucacuuuggucucggcuuuuaucugccucccugauagguuuuuggucuuggugacuucaagaaugaagcugcggacucucgcugugagugcuacaguuguuaaagauggcgugucuggaguuuguuccuuucgauguucagaugugucuggaguuucuuccuucuggugaguucguggucuugcugacuucaggagugcagcugcagaccuucacagugaguguuacagaucuuaaagguggcgcguccggaguuguucguuccucccgguggguucgugguuucacugacuucaggaguaaagccguagaccuuuguguuuugauugucagcuccugauucugcagaaaacacgaaacugagcuguacaaagaugcugaugaggggcugcagcaugcaauucacuucaccagcagucacuaaggucugaucucuuuucuaaccauaccuggaagauggaaugcuggacccaggguaugcauagaaaaugggaguuauuagaaaagcagcuuugcuugcuuuaacccaggaauuguauuucugacuuuuagacuuggacugggacuacaccaucaacuuuccuuggucuccagcuugcagacaacagauuaugggacuugccagucuccauaaucaguggagggcagaaggcuuugacauaucaaugcaccagggaucuuaccaaacuaaauuuuaagcacuuauagcucaagauucucccucugagaugaaacauacuuccacccugucaugugucagcuucagaagauaucaauugcucaagaaaguguuggacaagcagaaaagcacacugaacauuucuggacuugugaaagagcucugaauauggaucucucagggauauuccauccccaccaaugcuuuaccaaugcgagagcuggccaggcugagacauuuaaugauaacauggaacaauuuauucaggaagauagucaacuacucauguggcuuuaugauuauaaaacccacugaaaauugggucccuugauucucuugauuuuuccuaagccuuacucccuaaagucuccaauuugaugagguauuugauacuugaucucuccuugaaguaaaauuuggagcaaaauauauuggacuggaaggccugagaccucgauaagaagaaacaugaaccccagagccacaggucaggagguuuucauuauaauacuauugcccucuuaaaacaaauacuccaauugccaagguuuccucacuuaauaauuuaucucauauguguuuuugaaaguuacucugaauacuucuuauauguauaaauaaguuaguuaacaguaauuaaugcagauauuuaaauaaauacaagcaggcaggugggaugaugacuacagucacuugauaaagaacagcuagguggccgggcgcgguggcucacaccuguaaucccagcauuuugggaggcugaggcggguggaucaugaggucaagaguucgagacuagccuggccaacaugaugaaaccccgccuguacuaaaaacacaaaaauuagccagucucgcucuguagccaggcuggagugcaguggcacaaucucggcucacugcaaccuucaccuccuggguucaagaaauucaccugccucagccucccgaauaguugggacugcagaggaaaggccaugugaagauaaagaaaaggcugccaucuccaggucaggaagagaggucucaccagaaaccaacuuggacuucuagcaucuagaacuugagaaacugggaugcuacuccagaagaagacaaaucagugccucuguacaaagggaucuuugugcugccaaaagaguagaaaaguuuaucccagaaccaaaauauuucagaauuguggaaaaucaaguuuuggaaaccuacucaaaagaagaagaaauauugcuaucacagaaucccugaauuaguauacaccuagccgcuguaacaaagaugcucaaaaacauaaaugacacuguaaaagaaguuuauuucuuguucacauaacuguccaaggcugguguuccugggcaacuuccaguucucuuccaugcaaugauucaaggacacagaguucuuccauccugugacucuaccauccccuaauguuuauuguaaggauuaaaucagcuaaaccaagaaaagccucagggauggugccuggcaaacugcacgcuguuaauacauguuaguggacccuucuccacaccuuccugcuacacuaaagcagagagaauuaccuccugaaucauguuugcagaacuucugggcacagugacucaacucccagcuauucuugucauggauuuuuucucuuggagccaauccagccauggagaucacuggucuugugacuuauuuuuucucuuucaguaugaaaucauuagaacugagaaaaugaaaacauuccuguuauuacuuccugagagaaagaaacuuaguaacaugcuuugguaggaauuguucuucuuuuuccugcugugucccucuugcuggucccaccagggcucuugguccugagccugauuuacaccaggagcauaaucugaucaaaaagagggaaacuaaagaaaaaaggcaggauuguaugagggguucucacaauggcaguacauaaucccuuauaccucguauuauguagaccccuguguuuccaaguuaccuuuguaauuuagguaagugagcgcguaggcgacgcgcugguagagcuguggaccugccagccugcgaggcggaggacgggcuccaucucuuagaaacgccuacggcgcaugcucuauggggucaacuggggggcuggcaagcggcagcgcuggucuggggcggagucuccgaggcacuucccgguggcuggcugcucugauuggcugaacaaauaguccgaggguggugggcauccgcccucccgacaaggcagaccaggcccccugcagguccccuauccgcaccccggccccugagagcuggcacugcgacucgagacagcggcccggcaggacagcuccaggugagagugccggcgccgcggcgcugccaguaaaauuuaaaaauuccuuauucuccuuucagauauggcuggagucauuuguuucauauuuuccuuucaccuuuuacuugcccuaaaucugguucagaacuuuuugugggagcauuaaguuaccagaauauuuuuguguaguaaaauucaagcaaauaauaauagacuguuuuauuauacagaaugaaaaugcgguucuugggguugguggucuguuugguucucuggacccugcauucugaggggucuggagggaaacugacagcuguggauccugaaacaaacaugaaugugagugaaauuaucucuuacuggggauucccuagugaggaauaccuaguugagacagaagauggauauauucugugccuuaaccgaauuccucaugggaggaagaaccauucugacaaaggucccaaaccaguugucuuccugcaacauggcuugcuggcagauucuaguaacugggucacaaaccuugccaacagcagccugggcuucauucuugcugaugcugguuuugacguguggaugggcaacagcagaggaaauaccuggucucggaaacauaagacacucucaguuucucaggaugaauucugggcuuucagaguuccuuucuuggauuacaguuaugaugagauggcaaaauaugaccuaccagcuuccauuaacuucauucugaauaaaacuggccaagaacaaguguauuaugugggucauucucaaggcaccacuauagguuuuauagcauuuucacagaucccugagcuggcuaaaaggauuaaaauguuuuuugcccuggguccuguggcuuccgucgccuucuguacuagcccuauggccaaauuaggacgauuaccagaucaucucauuaaggacuuauuuggagacaaagaauuucuuccccagagugcguuuuugaaguggcuggguacccacguuugcacucaugucauacugaaggagcucuguggaaaucucuguuuucuucuguguggauuuaaugagagaaauuuaaauaugucuagaguggauguauauacaacacauucuccugcuggaacuucugugcaaaacauguuacacuggagccaggcuguuaaauuccaaaaguuucaagccuuugacuggggaagcagugccaagaauuauuuucauuacaaccagaguuauccucccacauacaaugugaaggacaugcuugugccgacugcagucuggagcgggggucacgacuggcuugcagaugucuacgacgucaauaucuuacugacucagaucaccaacuugguguuccaugagagcauuccggaaugggagcaucuugacuucauuuggggccuggaugccccuuggaggcuuuauaauaaaauuauuaaucuaaugaggaaauaucagugaaagcuggacuugagcuguguaccaccaagucaaugauuaugucaugugaaaauguguuugcuucauuucuguaaaacacuuguuuuucuuucccaggucuuuuguuuuuuuauauccaagaaaaugauaacuuugaagaugcccaguucacucuaguuucaauuagaaacauacuagcuauuuuuucuuuaauuagggcuggaauaggaagccagugucucaaccauaguauugucucuuuaagucuuuuaaauaucacugauguguaaaaaggucauuauauccauucuguuuuuaaaauuuaaaauauauugacuuuuugcccuucauaggacaaaguaauauauguguuggaauuuuaaaauuguguugucauugguaaaucugucacugacuuaagcgagguauaaaaguacgcaguuuucauguccuugccuuaaagagcucucuagucuaacggucuuguaguuagagaucuaaaugacauuuuaucauguuuuccugcagcaggugcauagucaaauccagaaauaucacagcugugccaguaauaaggaugcuaacaauuaauuuuaucaaaccuaacugugacagcugugauuugacacguuuuaauugcucagguuaaaugaaauaguuuuccggcgucuucaaaaacaaauugcacugauaaaacaaaaacaaaaguauguuuuaaaugcuuugaagacugauacacucaaccaucuauauucaugagcucucaauuucauggcaggccauaguucuacuuaucugagaagcaaaucccuguggagacuauaccacuauuuuuucugagauuaauguacucuuggagcccgcuacugucguuauugaucacaucugugugaagccaaagccccgugguugcccaugagaaguguccuuguucauuuucacccaaaugaagugugaacgugauguuuucggaugcaaacucagcucagggauucauuuugugucuuaguuuuauaugcauccuuauuuuuaauacaccugcuucacgucccuauguugggaaguccauauuugucugcuuuucuugcagcaucauuuccuuacaauacuguccgguggacaaaaugacaauugauauguuuuucugauauaauuacuuuagcugcacuaacaguacaaugcuuguuaaugguuaauauaggcagggcgaauacuacuuuguaacuuuuaaagucuuaaacuuuucaauaaaauugagugagacuuauaggcccaaagaa

SEQ ID NO: 663 - RNA, 2982 nt, Homo Sapiens
gugcuaaucugcgucagcuggggcuguauuuggaagaagaggcgcugccuccagucaagucuguuuuuuucagguggggacuguaggccuuugugcccugcuggaaaucgugaaaagcaagagagaagagucccaguuauucuugcugccuuugauaagugaauuuagggcaacuacuagugccaguaggcaugggggaucuaccgaugaagaagacacaaagucuccgcucucguggaguuuacagagaauaaugaaugagauuaauuaagaaaugaaugagauuaauugaaugaaauugccagacugaaugaagugaauggccugaauauaaacaauuuccaaauacagauaacacugcauaucugguguuugcaauacucccuucgcacuugaggaagaagcacuaugucuggggccaagugugacccuuugucuguugcuggguaccuuucauuucgcacuuucuccucugcugcucuccagcugcucuucugagucuucaauuuccagaccaaccucccuuaaggugacugacaguggggaccucaaccucaccuacagggauguggacugaucccauggucucagugagagacccaggcaauauuucuacaugaagcauguuggauuucugaauuauccagccucaaaugacaccgggaugggacaguguuaacccagauaagaaaacugaggcucugagaaguugagggacuuggucaaggccacaugucagugagugccagaaguuucugcuacuccuacaaaaucagaaguuccccaaauccaaaccaucucgaccuaccccugugacccgccaaaagaagcuggccuuccccauccuccugucuccgcagugccauuugccuuucagucuccuaaaaagaagcacuuacucucuuccccaaaucgcagagggaagcuucaaauacacuucuaaucauccucaguacccagcaguauauaggaaguuauugucccaaaguugugugucaugcccgaagugucugggauccccgagugccuguggugcccaagagcuaugaaucugcuaucaucaacacagaggguaccuucugaaugggcuaugucuacagugaugcugcaaauggaagcuaacccuaggaugacuggccucugacacuugagccaucccaucaucugucauggguugacccauccauccccucaaugagccugaccuucaggaccacugacagaggagcagucaauagaaauuaauuguuaaauacccagaaaaucugaaaugguauuuaauaugcaguucaucaagagcaaaaguuccuuaaaucuucaucuagaaaaguuauuuauaagggaugaauauguuguaugaauauguuguaugcaaauauuauauucaagggcaagaccaugaaaacaguuuaagaauccgacagggaauuagauaaagacaucggagugcacuugucaaaauacagcuaucaagaaugaugauguugaaaaauaguuuagcaauauaauugucuagaaccacagggagucugagauuuuacccaacuugugaguuaacaacucugcuauagcuucaugaaagaagacacaagacuccugggucaggaacaaaggucucuaauacucacagcaauaucaggagccagaauuucaggauccuuuuuccugccaguuucucaaguccuaauuaccaccgaguuacaggaaagggccagguaacacuagcacugccaucaguggcuguauuacagaacaggaacuccaagcuuaggaaacccaaaucuuuuauaguuaacaaugaacacaucugccauuguucugaagggagacgcuaccccaaucuuccacaccuguucacuauauaaauaucugugaaaagauagacagaaaaauagguggagaaugccucugcucacaagaugugcagaaacgugagaggcucauggagaacuguuucccuacaaugacaaaaugcugacgauauauuguuauguaaaauaaagcaggcauuuuucaccucauuuucaugaaauauaguguguuuauauagauauuuagaaaaguaugaaaggacauucauccagauaucaauagaagaguuuauuauuuuugcuaguuguaaguucaaacuuuucuaguaaaaauagauuacuugugaaauuauuuuuaaucuuuuuuuuuuuuugagauggagucuugcucugucgcccaggcucgagugcaguggcaugaucucagcucacugcaacauccaccuccuggguucaagcaauucuccugccucagccuccugaguagcugggauuauaggugcaugccaccaugcccagcuaauuuuuguauuuuuaguagagacgggauuucaccauguuggucaggcuggucucgaacuccugaccucgugaucugcccaccucggccucccaaagugcuagaauuacaggugugagccacugcaccccuccuaaaugucaauuuaauaacugagggagcccuuaaaauaccccgcugacuuccacacggguguguaaaauagaaucugcucacgucuuagaggagauaaguacaugcuuaauguucuuaggagagaccugccuuuugacauggaagcugugguauuguugacaagagcauaccuccuuaaaccaugcaaaccacguucacaucaaagcugccuacgaaugauuauuuuccaugaugcuaugcucccuccugccugccucaguggcaagugugacucagcaaguguauccagggcaucccucacucuuacuuauuuuugccaaaugcaguggaaauguauagacuuuuuuucauauuuauguuggcugcagagcauaaaucugaauagguucuccaaaguaagcuuuuucugcaugcauuugcucccaaugaugauagguauuaugaauugcuuuauaguaaucauuauccuuuuccauauguuuuacgguuagucugugcuauaaacuuguuugauuu

SEQ ID NO: 664 - RNA, 280 nt, Homo Sapiens
cagcuggauuaucccauuaccuucacuauggugcccaggcagcuggauuaucccauaacccucacuguggugcccaggcagccggauuaucccauuaccuucaguguggugcccaggcagccggauuaucccauuaccuucaguguggugcccaggcagcuggauuaucccauaacccucacuguggugcccaggcagcuggauuaucccauuaccuucacuauggugcccaggcagcuggauuaucccauuaccuucacuauggugcccaggcagcugg

SEQ ID NO: 665 - RNA, 1022 nt, Homo Sapiens
ggaaaauaugacaacacaccgaaaugacacccucuccacugaagcuucagacuuccucuugaauuguuuugucagaucccccagcuggcagcacuggcugucccugccccucagccuccuuuuccucuuggccguaggggccaacaccacccuccugaugaccaucuggcuggaggccucucugcaccagccccuguacuaccugcucagccuccucucccugcuggacaucgugcucugccucacugucauccccaagguccugaccaucuucugguuugaccucaggcccaucagcuucccugccugcuuccuccagauguacaucaugaauuguuuccuagccauggagucuugcacauucauggucauggccuaugaucguuauguagccaucugccacccacugagauauccaucaaucaucacugaucacuuuguagucaaggcugccauguuuauuuugaccagaaaugugcuuaugacucugcccauccccauccuuucagcacaacuccguuauuguggaagaaaugucauugagaacugcaucugugccaauaugucuguuuccagacucuccugcgaugaugucaccaucaaucaccuuuaccaauuugcuggaggcuggacucugcuaggaucugaccucauccuuaucuuccucuccuacaccuucauucugcgagcugugcugagacucaaggcagagggugccguggcaaaggcccuaagcacauguggcucccacuucaugcucauccucuucuucagcaccauccuucugguuuuuguccucacacauguggcuaagaagaaagucuccccugaugugccagucuugcucaauguucuccaccaugucauuccugcagcccuuaaccccaucauuuacggggugagaacccaagaaauuaagcagggaaugcagagguuguugaagaaagggugcuaacaaggaccacuggaucucugaauaucuaaaauaagauaauuuauuaaucacuuaaugagugaguggg

SEQ ID NO: 666 - RNA, 1806 nt, Homo Sapiens
gagaagcuaggggugaggaagcccuggggcgcugccgccgcuuuccuuaaccacaaaucaggccggacaggagagggaggggugggggacagugggugggcauucagacugccagcacuuugcuaucuacagccggggcucccgagcggcagaaaguuccggccacucucugccgcuuggguugggcgaagccaggaccgugccgcgccaccgccaggauauggagcuacugucgccaccgcuccgcgacguagaccugacggcccccgacggcucucucugcuccuuugccacaacggacgacuucuaugacgacccguguuucgacuccccggaccugcgcuucuucgaagaccuggacccgcgccugaugcacgugggcgcgcuccugaaacccgaagagcacucgcacuuccccgcggcggugcacccggccccgggcgcacgugaggacgagcaugugcgcgcgcccagcgggcaccaccaggcgggccgcugccuacugugggccugcaaggcgugcaagcgcaagaccaccaacgccgaccgccgcaaggccgccaccaugcgcgagcggcgccgccugagcaaaguaaaugaggccuuugagacacucaagcgcugcacgucgagcaauccaaaccagcgguugcccaagguggagauccugcgcaacgccauccgcuauaucgagggccugcaggcucugcugcgcgaccaggacgccgcgcccccuggcgccgcagccgccuucuaugcgccgggcccgcugcccccgggccgcggcggcgagcacuacagcggcgacuccgacgcguccagcccgcgcuccaacugcuccgacggcaugauggacuacagcggccccccgagcggcgcccggcggcggaacugcuacgaaggcgccuacuacaacgaggcgcccagcgaacccaggcccgggaagagugcggcggugucgagccuagacugccuguccagcaucguggagcgcaucuccaccgagagcccugcggcgcccgcccuccugcuggcggacgugccuucugagucgccuccgcgcaggcaagaggcugccgcccccagcgagggagagagcagcggcgaccccacccagucaccggacgccgccccgcagugcccugcgggugcgaaccccaacccgauauaccaggugcucugaggggaugguggccgcccacccgcccgagggauggugccccuagggucccucgcgcccaaaagauugaacuuaaaugccccccucccaacagcgcuuuaaaagcgaccucucuugagguaggagaggcgggagaacugaaguuuccgcccccgccccacagggcaaggacacagcgcgguuuuuuccacgcagcacccuucucggagacccauugcgauggccgcuccguguuccucggugggccagagcugaaccuugaggggcuagguucagcuuucucgcgcccucccccaugggggugagacccucgcagaccuaagcccugccccgggaugcaccgguuauuugggggggcgugagacccagugcacuccggucccaaauguagcagguguaaccguaacccacccccaacccguuucccgguucaggaccacuuuuuguaauacuuuuguaaucuauuccuguaaauaagaguugcuuugccagagcaggagccccuggggcuguauuuaucucugaggcaugguguguggugcuacagggaauuuguacguuuauaccgcaggcgggcgagccgcgggcgcucgcucaggugaucaaaauaaaggcgcuaauuuaua

SEQ ID NO: 667 - RNA, 348 nt, Homo Sapiens
aagugagaacguucaguauuugacuuuugguuccugaauuaaauguauuucuuuaauucacaggucuucagauugagaggagcagaacaugagguacugaacucaagaggucucacgugcacuuggaccugauuuacaugacaaguucucccccauuggcaugcugauaaaugagagucugaagcuuugacauaaaaaccuaaacucuaccuguguacagaacagaaacagaaugagagcgaaaaaacaacuauacugaaagcaaauugaagagaauugugaacuuucuucugaaugcauauauuuugcucgacaaguuuagcuuccauaaaaaucugaaaucuagaa

SEQ ID NO: 668 - RNA, 12318 nt, Homo Sapiens
aaccuuccaaggauucuaccgagucccugguccaaccggggccuaaagggggacaagaagcagccgaugugucaggacauucccccacuccucccucuaccuccauccucuucauuggcuccugacucaccucauuccaucaucucugagccagcagagcaaucccccaaagugcuguuaguuccccaaacagcuccagccgaccccucuuuaggucagaacauagcuaaucccuuaaucccauuuucugaugaaauggaccacacugcaucccaaaaugcccaggaucucauaggcaucccucaucuagguguuucuggauccucaacaaaauggcauuccgagcuguccccaacagaggguccccauucagcagguucauccacaccuggguuuuugagccccauggcagaacugucccauccgucucccccucccccagcacuuggaagucuucuucagcuuccagauggaagccccucauggucaauguuggaaguggcuucagguccugcauccacccagcagaucaaagcuggggugccuggaagagugcacaauggggugucuuugccaacuuuuaagaauacagaaacagcgacccaugaggcugagccuccacuuuuccagacugcagaaucaggggccauagaaaugaccagcagaaagcuagccucugccacugcaaaugacucugcuaacccgcugcauuugucagcagcuccagagaauuccagagggcccgcccuuucggcagaacacaccucuucuuuggugccuucucugcauaucaccacacugggucaagagcaagccauccuuucuggggcgguucccgcaucaccaucaacugggacagccgacuuucccuccauacuuacuuuccuccagcccacagagaaucaugccuccccaucuccugugccagaaaugcccacucuuccagcagagggcagugauggguccccuccugcaacuagagacuugcuccucucaagcaaaguuccuaaucuucuuuccacaucuuggacauuuccccgguggaaaaaggacagugugacagccauuuuagggaagaaugaagaggcaaaugugacgauuccucuccaggccuuuccaaggaaagagguuuugagucuucacacuguaaauggauuugucucugauuucagcaccgguagugucucaucucccaucauuacagcaccaaggacgaauccccuuccuucaggaccaccucuaccuuccauacucuccauacaagccacccagacuguuuucccaucucuuggcuuuuccagcaccaagccagaggcuuaugcagcugcuguggaccauucuggguugccagcuucagcuuccaaacaggugagagcaucgcccuccuccauggauguauaugauuccuuaacaauaggagacaugaaaaagccagcaaccacagauguuuucuggaguucucuuucagcagaaacuggaucucuuuccacagaaucaauaauaucuggcuugcagcagcaaacaaauuaugauuuaaauggacacacaauuagcaccacaaguugggaaacucauuuagcuccaacagcuccucccaaugguuuaacuucagcugccgaugccauaaaaucucaggauuucaaagauacugcugggcauucagugacugcagaaggguuuaguauucaggaucuaguccucgguacaagcauugagcagccugugcaacagucagacaugaccaugguuggaagccauauagaccucuggcccacaagcaauaacaaccauuccagagacuuccaaacagcugaaguugcauauuacucacccacaacucgacauuccgugucucauccucagcuacaguugcccaaccagccagcacauccucuuuugcuaaccucaccaggaccaacuucuacagguagcuugcaggaaaugcuuucagauggaacagauacagguucugaaauuuccagugacaucaauucaucaccugagagaaaugcuuccacaccauuccagaacaucuugggauaucacucugcugcugaaucuucuauaucgaccagugucuuucccaggaccuccuccagagugcugcgggcuucucagcaccccaagaaauggacaggugcagccacuaaugcagcggacacaguaucaucuaagguacagccaacagcagcagcugccgucacauuguuucugaggaaaucaaguccaccugcacugucugcagcccugguugcuaagggcaccagcagcagcccuuuggccguggccucaggaccagcuaagagcaguucgaugacuacucuugcuaaaaaugucacaaacaaggccgcaucuggcccaaagaggacaccaggggcaguccauacagccuucccauucacaccaaccuacauguaugcaagaacaggacauaccacgagcacacauacagccaugcaaggaaacauggacacugccucuggccuguugucuacaacuuaccuccccaggaaaccacaagccaugcacaccggccucccaaaccccaccaaccuggagaugcccagagcauccacgccacgcccacugacagucacggccgcgcugacauccauuacagccucagugaaggccacccgguugccaccauugcgagcagaaaacacagaugcuguccuuccugcugcaucggcugcaguggucacgacuggcaaaauggcauccaaccuggagugucagauguccaguaagcuccuggugaagacaguucucuuucucacccaaaggagagugcagaucagugaauccuugaaguucaguaucgccaaagggcucacacaggcauugcggaaggcuuuccaccagaacgaugucucagcucacguggacauucuggaauauucucauaaugucacaguugguuauuaugcuaccaaagggaaguugguguauuugccugcuguggugaucgaaaugcuggguguguauggagucagcaacgucacugcagaccugaagcaacacaccccacacuuacagucuguggcaguacuugccuccccauggaauccccagccugcaggcuacuuccagcuaaaaacagugcugcaguuugugagccaagcggacaacauacaguccugcaaguuugcucagacaauggaacagaggcugcagaaggcauuccaggaugccgagaggaaaguccugaauaccaaaagcaacuugacaauucagauugugagcacguccaaugccucccaggcagucaccuugguguacgucgugggcaaucagagcacauuccucaacggcaccgucgccagcagccuccucagccagcucucggcugagcuggugggauucuaccucaccuauccgccgcuaaccauugcugaaccacuggaauaucccaaccuugacauaucagaaacaaccagagacuauuggguaauuacagugcugcaggguguggacaauucgcuggugggccugcacaaccagagcuuugcccgggucauggagcagcgccuggcccagcuauucaugaugucccagcaacaaggccggcgguuuaaacgggccaccacccugggaagcuacacugugcagauggugaagaugcagcgugucccaggcccgaaggacccagcggagcugacuuacuauacccuguacaacgggaagccuuuguuggggaccgcagcugccaagauccugagcaccauugauucccaaaggauggccuugacccuucaucacguuguccuucugcaagcugaccccguggugaagaacccgcccaauaaccuguggaucaucgcugcagugcuggcgcccauugccguggucacggucaucaucaucaucaucacugccgugcucugcaggaagaacaagaacgacuucaagccugacaccaugauaaaccugccgcagagagcaaagccugugcaaggcuuugauuaugccaagcaacaccugggccagcaaggggcagaugaggaggucaucccugugacucaggagacagugguucucccacugcccauuagagaugcuccucaggaaagagacgucgcucaggauggaagcaccaucaagaccgccaaauccacugaaaccaggaagagcaggucgcccagugagaauggcucugucaucagcaacgaaucagggaagcccagcucagggagacgcucaccccagaauguaauggcacagcagaaagugacaaaggaggaggcaaggaagagaaauggugagaagccuucccuccaagaaccacccccagcugcucccacgcgugcccgcacacacaugcgugcacacgugugcacaaacucacacacagccacugggcucugacccucagucguucuuucuauucugccccacaagggccaggagucuguauguaccccuuggguucucaccuuaccccuugucugaauuguccugucucacuuccuccgccccuguucuuaugaaaugguguaguuccuuaggaaaaaccuuuugcggaaugaacugauguuugcuuagagguuuuucuaauucucuaguuagaaauccucuaaaauuucuaauuucuaaucacaugaauugacgcaauuucuugcaccaguuccacuaaggcagcagaucucugaaauaacugcucaucuuggagauuccucucauuuuccugcccugacuccccugauaaguuucauggguucagucugugccacugaguccagauauugcaacuccacuucucccaggaaaaaacuaacccaaaacaauaaaggaacagaucugucaucugccagcgagugacgaagaggagggagcgguucuauuugacaacuccagcaagguggccgcugaacccuuugacacaucuucugggucugugcagcucauugccauaaaacccacagcccuccccauggugccccccaccucggacaggagccaggagucaucggcaguccucaacggcgaggugaacaaagcccugaagcagaagucagacaucgagcacuaucggaacaagcugcgccucaaagccaagaggaagggauauuacgacuucccugcaguggagacgagcaagggucugaccgaaagaaagaagauguaugaaaaagccccgaaggaaauggagcauguuuuggauccagauucagaacucugugcuccauucaccgagucuaaaaacaggcaacagaugaagaacucugucuacagaagccggcagucucugaacagcccgaguccaggggaaaccgagauggaccuucuggugacucgggagcgaccccggcguggaauccgcaacagcggauacgauacugagccugaaaucauagaggaaaccaacauugacagaguuccugagccccggggcuauuccaggucucgacaggugaaaggccacucggagaccuccacacugagcucccagccauccaucgacgaggucaggcagcagaugcacaugcugcuggaggaggccuucagccuggcauccgcgggccacgcaggccagagccggcaccaagaggccuacggcucagcccagcaccugcccuauucggagguggugaccagcgcuccggggaccaugacgcggcccagggccggggugcagugggugccgaccuaccgcccagaaauguaucaguacagucugccccggccggcuuacagguuuucccagcuuccugagauggucaugggcucaccgccuccacccguaccuccccggacugguccuguggcugucgcuucucucaggcgauccaccucagacaucggcagcaagaccagaauggccgagucuacagggcccgagccggcccagcugcacgacagcgccuccuucacgcagauguccagaggcccuguguccgugacgcaguuggaucagucggcuuuaaauuacucagguaauacggugccagcaguguucgccaucccagcugccaacagaccuggcuucaccggcuacuucaucccaacgccucccucauccuauaggaaccaggccuggauguccuaugcaggagagaaugagcucccgagccagugggcagauucggugccccucccaggguacaucgaggccuacccccgaucacgguacccccagagcucucccuccaggcuuccucgucaguacagccagccagccaaccugcaccccagccuggagcaggccccggcgcccuccacagcggccucgcagcagagccuggcagaaaacgacccgucugacgcuccccugaccaacaucuccacugcggcccuugugaaggccauccgggaggagguggccaagcuggccaaaaaacagacagacauguuugaguuccaggucuaacgccuuagccccgugggacucuggacuuccaaacucugaggacucagccuuuggguuucccaugccuacguguuaggacuugagacauagcaaugggugagucuuucucacccuccauuucugaaaaggugaacuauggggcuucugggaacaggaaacucuugaacgacuagauucuuggcucauccaacugauugugggucaagucccuggcuuggggccuuauguuugauacucucucaugucaaauguuugaacuuugggcaugugcccuauggaagcuuagucacaagaggcacuagcuaaucuacagauuccuauccaaugccacauuuuaauaaaucaccggaagcgggagaauguagcucuuaucuucggugaccucugcauguuaacucuguuucuguguuaaaggcaaugcaggaguguggauuaagcaccagacuguauucucauucaaccaugaccgugcgcauuaaaaucaguuuguaagggagacacugacuccagccaagaaaccugagccccuuuuuuuuagguucauauucaaagucaaaugaacuggaugaaagucaguaccaauggcugugccuauaaauagaccugauucuuuguuucccucgucaauuaaacaaaggccaagaaagagagaagaugagagggaaugguggauuugcguugacagauuuuuuaaaagguguugccauuuuggaaauaaaaguccccuacaaguuaggaucuaacugaaagagaaucggugcuaagagcuuuuaggauccuacaaaagaaacacaguuauuugugaagguuuuucuuugccuuguuuugaagguggccugagaauggagcuucucuuuuucuugggauaauagauacaucaacuuuuacaagaaaaucucugucucuucaacaaugauguccagugugugcugcugagugguacaaaaggaaauaguacuugauuccuguuagaaacaggagugguagaaccacagucuucccaggccgcagccucuguuuauagaagcuucugaauguagaaaagcuguugaauuucauuuaaauguaaauaaccuuuuaaaaagcguauggaguuagccaguucccccuaguuaauggacauaggaagacauuugcugaaaugguaggguggccacuuugugaccaugauguugcaaguugcccucccuggcauggugaguuggcuuccagagcuguggguagaggacaucgccucacggcacugaggcaccagccgcugccuacccaucaaugcaagcaaaacagcuacugacuuuguguagcagggagauuggggacucugguucccucgccaaguguggcagccugugcaguguugggggcuuacuugguaucuguuggagaaugagguccuguccugcuuucacccaugacccaucuagcuucagcuguauccauuuucuucugagcccaucuuccauuguccucaacgaguuucuuuggucuuuacugaaagaagauaguagaaauuuaaaaguugagagaagacuagaaauggaacugauuagaaggggagguucaaacugucaaugcacagacuuuucaaagaaguuguuuauauuuuccaauggcaaacugcccuuucuggaauguucagagaugaugugucauggaaccuucaaacaagucucuuguucggaugauaauagguaguguccuuuuaguaugcugguugaucuuucauaguguuaguguuuuguuacuuaaaaaggaaaucagcuauaaauaaaauguauuuuuguaauucccguguguauauaugguauauuucuaucaauggccaguuguuguaguccaaaaccuaaaucaguuugcaaaacacuguggacagugcgagauuuuauugacagguuaacacaaugccuacgucuauccacauaggcauucaaugcacuugaaugaacaaagagccaaagaaacucagccuguucaugcaaaugguaugagucugauaaaaucagcuacauuguccugcuuuaucaauaauaauauuucauuagugcaaugauaucaaccaguacuuugucuacuugguaaaugccuggaaauacuguaugugaaaaugauguuucaagaucuuacuguaauugaaguauacguaaauguuucagaagacagugucugaaauuuggcuguuucaaugacuuacagagacugagucuacaguuugcagagcuauggcuccagagugcuaagaggguggagucacaaaucacuguggucuuuacagagccccaggaaauacugagugagucaacugagacgacuaaaaagauagcaugcuaaaucagauacugucuuaaacuagacaccauggguucaagaauaguauuaauagaugagaggaaaaccuuaaguuggaaagaaaucagucuguucauguuaucccacucauggggagacagagccacucuggucagauuuucugugagugagauguggucccuucccugaagaaucuccuaaccucauagaggugagagagaugacuggacagcugacucuaagagauggucaaaagugccucaaggaauugaaauaagguucccagagagcccugaggaggcagcaaugaacaaacacccuguucaucagaacccucuagauagucacagaagccacaaaaggaccuugguugaccuuggaggaggaagcagaaguaccacgaaguggagugacuggcccagugauucagucccaaccuccugguucacgaaccugcuugcuuuccaucucgccauguggccugcaggcuugucaguaacacauuucuuuagcugugccuagagguuuaaaaaaaagauaagggucauaugaagaacuccauaauguucuugccaagaaaaaagaugauugaguauauaacgaacuucagauacaguguauagaggaugaugcauuuguggcauaauaaauaguuuucagugcugguuuugauaugaguuuucugcauucaugaaaaagaaaugcauuuuggcuuuuuccagaaagaguaccaucaaggaaacggagaccucaacugcuguucuagacugugggggugcauuccugucucagcaccaaggaucccaacaggcaggcagggaggcccuugacuuugugucacugugaggcagcagaguccaugcucugcaucaggggaggugcaguaaagguccauuguguggcuugagaccuaugaucugaggcuugugcauaauaagauggcagcuguuaccuacagagcaaggaguuuccucuuucaggguagauuauguaagaaucaauucccuggucccaggagaaguuuuauugugaguuuguuaauuuaagaacucacucagcagaaggacauguaaugucugaguaaucuugauggaagaaaggaaauagaucugugauuaaaacacacacacacacacacacacacacacacacacacccuacuucggagagagaauguagaauggaggaggugaggaauuuaacuaauagagaugcuuuuucuaacaggcagaaauuagagaaauggaucaaaagauuuaaacauugauuacauauaaacgaguuuccuuuuuuucuacauagcacacaggugcucaacauuuaaugaauaauauaacagauacugucuuaaaaguuuaaaaacaggauuuguacuuaauccuaaauuccucuuaucacacaccagaaaauaauuuggauuuuauuuacaaacuacauccaaauacucuuaaggaaagagugucauuuagcuuggaguagggacugacuggggucuaaguguuggaaauuaaauucugccauucaguccaaccucaaagguguuccaggcaaggaguuuugcaaggacuagaaacccuuucacacuugaagugcagguguuggcugaaagaauagagggacauuucacaaacacagaacacggcuccccuacaggaaagggauggagacagcuaccuuugcucuugcucucacauucucuguccucauggacuuucuucucuguuucccucugccuaucuaucugccugguucucuugcuucuccuggccaaccagcuuucucauuagugcauauguagcugaaaaauccaccccucaagaacccacuccacacaaccuuuccuuuucaguacccaccacgcucugacuagcaucucugugaugccuaaggcaaauuuuugaggaucugauugguuuaguucaucugccuaugggugagccacccuggggucaggugccuguccaaucaccuguuaccaaggaggcagggccgugucauuuaagcauggccccauggacugacccuuucagcagggacuuuuauugggggcugguacccagaagaaggagcaugagugggcaagaccuucaaaaagaaccuacuacacacuggaacugacuaguacuccugggaugccaugccacgcagcagccagcacucggagagcaguccccuggauacuaccacacagagaaaaggggcaucuucacuugcacaucaggugagggugcacacacuugaaacucugcuagacuggccagagcugccccagccacuucucaccccaccaccaguuauugauacagccgcugggucuaggaagcgauuucugaacaaggcccaguuagcacaaugucuugcucagcagacaauaaauacuuguaaauugaauugcaugaucuuagcucaggugcuacuaauguggcucacggccacacacuugcauggauaagaaaaccaaugagccccucaacagagucuuuugaaacaaaauugguuucaagugaaacuuacauuauuuuuuggcugugaccuucugaauauaauaacuuaguguccugagaauugaaaggccucuugauuucuuaggugaacuguuacagaauccuagccugugguaaaugcuaaaauguaagguguuucugagaaggaauauuuaggaaauauaauugugccacacacacauuacuuuagaagauaugcaguugcucugauucugcagguuuaaaaaaaaugggaaguuugugauauggcagaaucugucuccauuggucaaaccauacuucagugagagccauuauaagugaaaucuaaaaauugaucguuuucauucucugacuuuggucagacuuuugcaaauuauggagagaggccaucaacauauuuuacauaaauuacuguggccccaucuuauuucuccucauuucuuccuuauguuuaaacacgcccccaucucacacacaaacugagaaaagauuuguaucaaacagaaucagaggcauaugaauggacuggaaauugugaaaaagguauaaauauccuagaccuugaucaacucacuuuaaacuggucucugauuccucaucugucaaaugaguauaagacccucuguacuucccauggugauuuugaggagcacaugcauaauguaucugaaaauggcuugacaagcacuugaagccauucuuacuaaauuauuaguuuuguaauucgguuuuauccaggaaaauauuuuagcuccuccuaucugcugaauuaauuuauacagucacauguuccaugacaccauguuuugccaaggaaaaauaaagaaauuccuaaauuugaaauugcccacaagaucuagccucaucuggaguugcuguuauuguccuuguugucuaugauuuggaggauauguaaguacuuguacaugugcuuuaacucugggugaaaaaccccaaccggugagucuuuaaaaccauauuagacacauugggcaaaguacugagcagaagcuuugaauguagcuguuguuauuuuaaugcuucgcuuucuaaugaacuuuguacguccuuagccucugccgggaacagaguguucauaugcuguuagaauuuuuuauuguaaaauaaaaugacaaaggcuuucauaccccaaaa

SEQ ID NO: 669 - RNA, 183 nt, Homo Sapiens
cccagacuccaggcugggugacagagugagacccugucucuuaaaaaaaagugcugggauuacaggcaugagccaccgcgcccggccucauguagaacuuuuaauugaacuuuuuguccccguuuacauuauaaugugaaaauaaaagaugaaaaucaaaaugaaagcauuuguugauuugaa

SEQ ID NO: 670 - RNA, 77 nt, Homo Sapiens
ccucgagagcugauaagaacagaggcccagauugaaguugaauagugcugggccuuuguuuuuaccaaguucccugg

SEQ ID NO: 671 - RNA, 1445 nt, Homo Sapiens
cuuagagggagcuguguuuuggugaccucugaaacucaguacugcagcgaaugagcuccugaccuugaggaguacuuaacagaauuaugucucgaagaaucauugugggaacccuucaaagaacccagcgaaacaugaauucuggaaucucgcaagucuuccagagggaacucaccugccccaucugcaugaacuacuucauagacccggucaccauagacugugggcacagcuuuugcaggcccuguuucuaccucaacuggcaagacaucccaauucuuacucagugcuuugaaugcauaaagacaauacagcagagaaaccucaaaacuaacauucgauugaagaagauggcuucccuugccagaaaagccagucucuggcuauuccugagcucugaggagcaaauguguggcauucacagggagacaaagaagauguucugugaaguggacaggagccugcucuguuugcugugcuccagcucucaggagcaccgguaucacagacacugucccgcugagugggcugcugaggaacacugggagaagcuuuuaaagaaaaugcagucuuuaugggaaaaagcuugugaaaaucagagaaaccugaauguggaaaccaccagaaucagccacuggaaggcuuuuggagacauauuauacaggagugaguccgugcugcugcacaugccccagccucugaaucuagcgcucagggcagggcccaucacuggacugagggacaggcucaaccaauucugaguggauauuacucugcaucacaaugaagccaacagucauaucuuccgauguggagauuugagaagcauuuguauuggaugugaccgucaaaauccgccccauaucacugcaacaccuacaaguuuucuugcauggggugcucagacuuucaccucuggcaaauauuacugggagguccaugugggggacucuuggaauugggcuuuuggugucuguaauaaguauuggaaagggaagaaucagaauggcaauauauauggagaggagggacucuuuagucuuggguguguuaagaacgacauucagugcagucucuuuaccaccuccccaauuacacugcaguaugucccaagaccuaccaaccauguagaauuauuccuggauugugaagcuagaacugugagcuucguugauguuagucaaagcuccccuauauacaccaucccuaauugcuccuucucacuuccucucagaccuaucuuuuucuguauucuccucugaccagagacaaaucagaaauguguucaucugcugugggaaccccuuuaucccagaaagcccucuuccuugugccuuaucaaacaggacaaauagguucgguuuuaugucuugaauugcauucuaauguuauuaaaacucauuuauuguguuacuauuaaauguaguaaaaacacuaaaaguaua

SEQ ID NO: 672 - RNA, 939 nt, Homo Sapiens
augauggguagaaggaaugacacaaauguggcugacuucauccuuacgggacugucagacucugaagagguccagauggcucuguuuaugcuauuucuccucauauaccuaauuacuaugcuggggaauguggggaugcuauugauaauccgccuggaccuccagcuucacacucccauguauuuuuuccuuacucaccugucauuuauugaccucaguuacucaacugucgucacaccuaaaaccuuagcgaacuuacugacuuccaacuauauuuccuucacgggcugcuuugcccagauguucuguuuugucuucuuggguacugcugaauguuaucuucucuccucaauggccuaugaucgcuaugcagcgaucugcaguccucuacacuacacaguuauuaugcccaaaaggcucugccucgcucucaucacugggccuuaugugauuggcuuuauggacuccuuugucaaugugguuuccaugagcagauugcauuucugugacucaaacauaauucaucacuuuuucugugacacuuccccaauuuuagcucuguccugcacugacacagacaacacugaaaugcugauauucauuaucgcugguuccacccugauggugucccuuaucacaauaucugcauccuauguguccauucucucuaccauccugaaaauuaauuccacuucaggaaagcagaaagcuuucucuacuugcgucucucaucucuugggagucaccaucuucuauggaacuaugauuuuuacuuacuuaaagccaagaaagucuuauuccuugggaagagaucaaguggcuccuguguuuuauacuauugugauucccaugcugaauccacucauuuauagucuuagaaacagagaagugaaaaaugcucucauuagagucaugcagagaagacaggacuccagguag

SEQ ID NO: 673 - RNA, 1897 nt, Homo Sapiens
aaucaagagagucucagccuuuagguagcugacacugugauaagagcauccugugaacuacccaaauaaggaggaaaacgaacgcagcugagcaugggaugccauauaaaaaucacuuaaaccagucgccacuccuuguuuccugaguuguccugugcuggaggucugcucagacgaaggucuccauggcguuagaagucuugaugcuccucgcugucuugauuuggaccggugcugagaaccuccaugugaaaauaaguugcucucuggacugguugauggucucaguuaucccaguugcagaaagcagaaaucuguauauauuugcggaugaauuacaucugggaaugggcugcccugcaaaucggauacauacauauguauaugaguuuauauaucuuguucgugauuguggcaucaggacaaggguaagaacagugauuguuuguaaaaaauacugcauguuuugucagacuuuuaugccuaguauuaaaauugucuuuuaaaaaaauaaguaguuucugaggaaacucuccuuuuucaaaccgagcuguacuuuaccccaaggaauauagaucaugacccucaggaaauccauuuggaguguuccaccucuaguguuugaugcagaaaucauggggagacuaucuggaauuaguucuucuguaagccuaucugcucaaauccuguaccaagaguccacgaggaucuagaaggcauaguaugcuggcucuaugccauacuccugaaugacuauucuguauaugaucaugauauuaaacagugguaaaacugagaaaucaguguggcuuacaccaguuucuacugagaaugaaauaaaauuggauccuaguccuuuuauugcugacuuucagacaacagcagaagaguuaggauuauuaucuucuaguccaaacuugcucugagcuaaaggagaaauggaaacuugaagcugguguuauguauuuugcaggaaaacaguuucauuuuuucauagcaaaaauauaguugguguauaucucuccuuaagucucugguuucuaaaaacccuacuucaguaaagguccugauuaguugauuagugaauguguauuucuaaauauuuguauucaguagggguauggcugauuaauuuaacauuaacuauuagguaauucauauuauacauuuaaguucuuucuguucuguguagaagauucagaaauaugucuucaaagacaaugacuugaucuaauugauaagaaccuccaauaaauauguucuaauauuuuucaggaagaauaaagaauagagagagacauauaaaugugcaagaggcaaaacuuugagcauaguguaaaauuuaacauauuaacucucacgaaaggcaaaauccuuuuaugugcagauacuuuaauucauguagauuuuccuauuaaucaguaaaguugaauccuaacaauaaugccaugugacaaccuauuuagauuauuccagaauuaaauucaauuuauuuucuagagcucaaguaaccacuaccuuaacugaaauuugauguuagguuucccuuguuccuccgaaugguucuuccacacucaaaauaauugaaugguugaguugguuaagcaaagaguuauccugccaccuaagagcauucauuaaaugauuauuuauuaccaccuacuuuauacuaucuuccuuucuuuaaacauggagucuaaauauguaauauaucaaaaaauacuucugauuugguagauuucuuauaucaagggugagaauugaacugugccauuggcuauucaauagcuuauugaauguauguuuuggaugccacauccuccuggaagcaaauuuugccaagauacuguuuauuauuauuuuuaauuaaagugauacuauuccauuuucaauuaaa

SEQ ID NO: 674 - RNA, 2095 nt, Homo Sapiens
cucuaaaguguugcauaaggcaaagauaacguuaagucuguggaggcuuccguuaucgggaaaagaugcuguagugaucuuuucugagugucuccuacuugcgacaagguggacuugggaggaaagccgucugccaaagccugaagccuccaagccaaggccuacuacaaugacccgaugaugucuacuacuccaaggcaagacagaauugaauauuguacaaacucuguuacucugcccuggugucccauuuguggagagucauuguaauguauggacagaauugaacccuucuguaacacucaaaauuuuaguagcuaguggaaaaagggaaagcaugaaggcuuuggauuucuuuucuaucacagccauaaacaaccccaauggccucccacgaaguugauaaugcagagcuggggucagccucugcccaugguaccccaggcagugaggcgggaccagaagagcugaauacuucugucuaccagcccauagauggaucaccagauuaucagaaagcaaaauuacaaguucuugggucuauucaacgugaagaggaugaggaugaagaccuuuaugauaaucuacuuccacuuaaugaauagccauccagauccugaaugcagcaaugauucuggcuuugggugucuuucuggguuccuugcaauacccauaccacuuccaaaagcacuucuuuuucuucaccuucuacacaggcuacccgauuuggggugcuguguuugugaguauucguacuccccuggcuauauguuauuucuuagauaccacugcuggagauguguuuguucuguaguucaggaaccuugucuguuguagcagggauaaaacccacaagaacauggauacagaacaguuuuggaaugaacauugccagugcuacaauugcacuaguggggacugcuuuucucucacuaaauauagcaguuaauauccagucauuaaggaguugucacucuucaucagagucaccggaccuaugcaauuacaugggcuccauaucaaauggauguugccacuggguuugauauaaggcaucauauccccuagggcauggugucucuacugcugauucucaccuugcuggaauuaugcguaaccaucucuaccauagccauguggugcaaugcaaacugcuguaauucaagagaggaaauuuccucaccucccaauucuguguaaucaagaauaccuccuuaauucugagagcaugaauauuugaccuuaaaucuccagugacucagagcuucacccacaaacucaggagaacauaagccugcucguaaagcucaauccuucuaucauggcaccaaucacaagaaccuuggacguuugacugacucuauccuuucucuccuaacuauaaauccuauuugugugucguggguauggaaggacagauauauuucuuuaggcauucuuggauaucuguaacuucuaugaucauuacuccaaaguuguuuccagaaauugguucuauuucuucuuauccaccuacuccauugcuuuaugagguuuaaggaaggaaggcgguauaaucccuauucaauauauuuuuucuaaaauccaacuucugaccgcccaguaggaagaaaaaugagacauuuuuuccauuacagagaaaugcuucuugacuuuaacaucagcauuauaaaaagugucaaauaaaaaauuaccaucauuaucauuaaaauaaauuuucacuguauuugagaugggaggguuaaggcucagggauuuuauuucagugaacugcuggaacucacacaugcccugauauguaaaugaugauuuauguuggcgagucugagagcaagcccaaauguguucuucaaaggacaaugggaaacuguaaaguagagaacuaaagaauaaggccuuuagaaucugacacaucuggguucaaauucugaaacugucacuuauuaccuguaugaacaugggcaaauuaucuaaucucucugaucuauuuuuccucaucuguaaaauagguguaauaauaacaacuacuuugucgguugcucugaggguuaaaugaaaauaaaaagaaaaugugaaacagcaccacagguacuug

SEQ ID NO: 675 - RNA, 83 nt, Homo Sapiens
cuuggaaacugugacuuuaagggaaauggcgcacagcagacccugcaaucaugccguuuugcuugaagucgcaguuucccagg

SEQ ID NO: 676 - RNA, 1830 nt, Homo Sapiens
acaguucccgccgccgaacuuagcccgcggguggggcggcccgggagccagcggggcacgugagcgauggagaccaucuggaucuaccaguuccgccucaucgugaucggggacuccaccgugggcaaguccugccuccugcaccgcuucacccagggccgcuuccccgggcugcgcucccccgccugcgaccccaccgucggcguggacuucuucucccgccugcuggagaucgagccgggcaagaggaucaagcuacagcucugggacacggcgggacaggagcgguucagaucaauaacccgaucuuauuaccgcaacucaguugguggauuuuuaguauuugacauuacuaaccgacgaucuuuugaacaugugaaagauuggcuagaagaagcaaaaauguauguacagccauuucggauuguauuucugcuagugggacauaaaugugauuuagcuucacaacgucaaguuacaagggaagaagcugaaaaacugucagcagacuguggaaugaaguauauagaaaccucagcaaaggaugcuacaaauguugaagaauccuucacaaucuugacgagagacauauaugaacuuauuaaaaagggagaaauuuguauucaggauggcugggaagggguuaaaagugguuuuguuccaaauacugugcauucuucugaggaagcaguaaagcccaggaaagaaugcuucugcugacuucaaacaugcugaagaacuaacaggaacagauugggugucaguucaggauaaauaccaacauuaacagcagaaugaugcaaugaaagaauuuaaaaagguuacaaacccacaccaauacuauuuuauaagguauuugauucagagcaugaugcuuacuuguuacacuacuagauuggguauuuugcuaaauuaccaagcaaagcagacaaucuuuuucuugaaauuaccuccauucuuacuuuguuagcauacgcugaccuuaguguccagauaugucacuauuacucauuuuucuugacaguucaaauggauuuuugugcauauauagucaauugaaaagauuuuaucaggaauuacauucucuugaguuaauuaauauugaauagcaaaaugcauuuaaauaugcacuguucaccugcagaguaaacaaucucagaaguaucgacuaggacguaaauagcaguuccuuauauaaaguaccagguuuuuuccccauucucuggaaauguuuguccucccuuaauuuugccucaacacaagaaaauaaguuuuauguccauuuuuguucccuaauuuauugcuucuaaaaaugcauuauguuuuacaaagauaucuaaggauccaagcaaacuacuuuaagcaaauauuuguaaaauuaaaaacggaggaccgcucaccaaauguuugaaauguugcuuuuuuuuuuugagacagggucuuguuuugucacccaggcuggagugcaguggggcaaucuuggcucccugcaaccucugcuuccuggguucaggugauugucaguaccuuaccucagccuccugaguagcuggaacugcagaugugcgccaccaugcccggcuaauuuuuguauuauaaguagacacaggguuucauaauguuccccaggcuggucuccaacuccucgccucaagcaauucgccccccucggccuccaaagugcuggaauuauaggcaugagcugccgugccuggacuaucagcagcacauguuuugcuguuacgguguacuguucguauuuagacaagaagaacaaaauuuauuuauguauugacauuuucaaagaaaguaaaugcaauuuacuuugaa

SEQ ID NO: 677 - RNA, 4247 nt, Homo Sapiens
gagggagggcgccggaagugacgcgaggcucugcggagaccaggagucagacuguaggacgaccucgggucccacguguccccgguacucgccggccggagcccccggcuucccggggccgggggaccuuagcggcacccacacacagccuacuuuccaagcggagccaugucugguaacggcaaugcggcugcaacggcggugagugcugagccggugaccagcacacuuugggcuucuggacgagccgugcagcgauuggccccagguugccauccucagucgucuauugucauuccagagcccuggacuaggaguaggaagaucugaauuguggccccaacucucuuucgguuauuagcucugugacccuaggaacaaacagauccuggugggacaguguacccaaggucacccagccaagaggcugagcaggacuguacgucagauccguuuaccucaguccuuaaugcaugcaguccagccagauuaagggacccuuaauacugucagcuuuccccacugugggaucuucauccucuugacuucuuuuguagccagacaucugggccucuugcuggagaagguggcagcuugcugcucuuagacucuagucuacuccauguggcaucuggauggcacugaaauuuucucaagugccuugucuguuguagauaaugaaucuauccuccagugacucagcacagguuccccagugugguccuggcugcccugccccugccagcugcaggccccacccuuccuguggccaggcugaugggccuuaucucuuuacccaccuggcugugcacagcacucccacugacaacugccuuggucaaggugggcuucagggcucaguguccugguuacugcagcggcagcaacagcagguccuacuaucgccucccucuagucucugcuucucuggaucccugaggagggcagaagguacugaggaagguuaaagggaccagccuuggaguauuuccccacucugagacucagcuggccacaggccagguucugaaguuccuuucuuccaagccagugauucugguucuuggacaagguguugaggaacacuagaaacagaggggacugugaccuggggacuuuuucugcaggaagaaaacagcccaaagaugagagugauucgcguggguacccgcaagagccagcagcuugcucgcauacagacggacagugugguggcaacauugaaagccucguacccuggccugcaguuugaaaucagugaguuuucuggaaaggaguggaagcuaaugggaagcccaguaccccgagaggagagaacacaacauuucuggcuuugccuauagcuaaagcccgucccgcugccccgagauuccuucugggcugcucccaguucugaaggugcuuuccucugaauaccuccagcucugacuaccuggauuagccuggcauuuaacaucuugagcuuugggucuuuuuaugaguguuucuggucuuccugcucgauuguauauacucagagggcaggaaccagggauuaugugccucuguccccaucaugaaucguagcacagcgcuaggcucaguaaaugcugaucaauaaugagcaccugauugauugacucucuccucaguugcuauguccaccacaggggacaagauucuugauacugcacucucuaagauuggagagaaaagccuguuuaccaaggagcuugaacaugcccuggagaagaaugaaguggaccugguuguucacuccuugaaggaccugcccacugugcuuccuccuggcuucaccaucggagccaucugcaaguaagagucuugcaaguaaggggcuugggcagggguaggcaucaugugaaccuuugccuuucccuuuggggccugacccucugcuucaggguuaucuccucugcccugaggaguguugacugguggcagaaaacucaagaaauaccagugaguuggcaaucgagagagaauagaggugaucugaacuuaaaucucuucccucauucugugcccuucccuccucccccaggcgggaaaacccucaugaugcuguugucuuucacccaaaauuuguugggaagacccuagaaacccugccagagaagaguguggugggaaccagcucccugcgaagagcagcccagcugcagagaaaguucccgcaucuggaguucaggaguauucggggaaaccucaacacccggcuucggaagcuggacgagcagcaggaguucagugccaucauccuggcaacagcuggccugcagcgcaugggcuggcacaaccggguggggcagguagggccugccccuauccucuccccagcucaucugcaucuccuuucugccuuacagucauccccaauuuaggauuuuuagacuuuaugauugugugaaagcgauauacguucaguagaaacuguacuuaguacccauacagccauucuguuuuuuacuuucaguacaguauucauuacaugagauauucacuuuauuguaaaacaggcuuggugucagaugauuuuguccaacuauaauaggcuaaucuuaaguguucugagcacauguaagguaggcuagguguauuaaaugcauuuucagcuuguuuucaacuuaacaauggguuuaucaggauguaacccuauuguaagucaaggaccaucugucuucacuucuugaccaccccaccucuaacaccguaggcugggaagauugugaaucagaggccagacucuaggcuuucauggagaaaauuuacaaaaaaaaaaaaaaagaggccagacucacacuuaggccuacccaggcuuucuagaugauagggaacucccaucucacugccaggugcuuuuagacacccccguguccacccuuuugacucccuguuccgccuccacagauccugcacccugaggaaugcauguaugcugugggccagguacacuugaccagggaagccacauggugacauaugccuucccuuuguucucaaccaagaagcuugucucacaaccuucugcaucugcuuccccagaauagcauucucagggaggggcagaccuugggaugcuaccgguccaaaaggcgcuggggagcaaguagauagagguggucccaugcuuugcgccauugguuggggaaagaucaggccugauguccuaggauguuuuuccaucagggggccuugggcguggaagugcgagccaaggaccaggacaucuuggaucuggugggugugcugcacgaucccgagacucugcuucgcugcaucgcugaaagggccuuccugaggcaccugguagggccugugcuccaccuguggagggcuggggacuuggagagcugggaaagguggcagggaagauuucuuacaugaaugcucuguauacagugcuaacucauucuuguugaauguuguguauggauaggaccaggucugggcccacaguugccuuuucagugauguccucaggucuguggucacagggugguguuaagagcccuugcagcucacaagaacuucuuguuacaggaaggaggcugcagugugccaguagccgugcauacagcuaugaaggaugggcaaguaaguggggggaaaugggcgggaagccagggaaaggaggacuguggcauuucuuccugugcaucccagguuucuagguaguccccucucagacugugcugaggcaacuguuuucuuccccagcuguaccugacuggaggagucuggagucuagacggcucagauagcauacaagagaccaugcaggcuaccauccaugucccugcccagcaugaagauggcccugaggaugacccacaguugguaggcaucacugcucguaacauuccacgagggccccaguuggcugcccagaacuugggcaucagccuggccaacuuguugcugagcaaaggagccaaaaacauccuggauguugcacggcagcuuaacgaugcccauuaacugguuuguggggcacagaugccuggguugcugcuguccagugccuacaucccgggccucagugccccauucucacugcuaucuggggagugauuaccccgggagacugaacugcaggguucaagccuuccagggauuugccucaccuuggggccuugaugacugccuugccuccucaguaugugggggcuucaucucuuuagagaaguccaagcaacagccuuugaauguaaccaauccuacuaauaaaccaguucugaaggugu

SEQ ID NO: 678 - RNA, 23856 nt, Homo Sapiens
gggagucccggguccccuucccacugcgcgcggauuucccucucugaggaaguuuauccuugugccuucuggaggauuucucucuagcucgacucacucuggacugacucgcucccuggcuuucucaguucguuuugggagauaacuuguuuugcuccaagccgcauccguugaccccuuacagucggauggucuagaugacugaauggaguuuugaguuggacuuuugugucccugacggaguugggccugaucccagagcacuggggguggggaggagguguuacuguaaaaugcaaguuggauaaaaggaggaccucucgccaagggccccaaugaguggcacacagucuacuaucaccgacagcuucuuaucaucccucuuguggucaguaaaaucaucugacaaaugccuuuccaaggaugucgaauguauauauaaagaaaaagcuuaggauugcuaagggagugguauuuuggugaggauuucauuuucuucuacuccauggaaacgagccuuuugagcuuuugcuugucugcugauuuguccggugauccagcaaaguaguuaagauacuuaaacaugguguucaacuucuuauuccuccagcuuauugauucuugcuauuggaaaguuaccauaagauuuaaaucucuuauucugguucaguaggaugaauaaauuuaguaacaaaaucuuacaaguaaaguaacuacaucuauccuuauuuuuucuuuguuucagguuuccccucaaaaaaccuauaaggcauggaaguauuuugaaccgagagucaccaacagauaagaagcagaaaguugagcgcauugcaucacaugauuuugaccccacagguaaaacacuauucauucuuucaaagaguauugagaguagugaaguucagaauaauagagcuuaagcuacccgaaacacucaggaauaguuguuugaucuguuuuaggacucucacauuccuccaauuauaucauaauaaagccuuugcauuuaguaggaaugcaagcauuuuuaacuuccaacacuguacauuccacuacagaaguaucauuguagaguauauuguaucuuuaaauagugauaauaauagaaaugguuauauaauaauuggagauuuggucagaucaagaacucaguguuaaguugaaucaugguauaagcaguaauaugucauaaaaccaaggcucuaacaacucgacacuugcguagucaucuaaaaauucaauugugauuauggugaauuggaguuuuagauaaaucaguuucacaaauuaaugauggucucauuuuagaguaaacaaaugaauagaaaucccuuucucuucagucaaaaaguauucugaacuuaaagagcugucuuucaaccuaagcagugucgaucuuuccuaggguugucaccuuaacagacuuucagauugaucuccuuuuaaaacaucuaggcuuuuuccuuuugcuuucuccuuguaagcuuacuccauauuugauucauagaaagugcuugguaaucuugcuuuuuucauuugaaacugauauauauuuuuugugcacauacuauuuuauucaguugccugucccuuugacaagagacgaaguaaaucccgcuaucucagauacauaaaaauaauguaucuauuuuuagguauuuuuacuuagaaauauaauuuuaaauauuuaauagagaauaguauguuuuauuuaucuaagacauuucauacuuuauuaguauaaacuccuuuauuuugaaaaaauauuauaaauauuaucuaggaagcacauagauaaucauuuucugcauuuuggguaguagguaaaaugaaauuccaaucaucaauuuaggaggcuuugguggugggacuauguauuaugucacuuacagaucuccaugaagagagaauuuuccauucugaugccuaauuuuguagucauggggcucagaggcuuucauuuacaugauuagguauugucuugccaauaaggucaaaaguuucugcccuauguucagaaaaauauaaucuuguuagguuuauuuuguaucuacaucugugcugugcccaucuccaaagacagauuuaagcaaagauguauacaaugcuucauaaugagaucauuauagcuuuuagugcuuuugucaucucuacaauuaucaggugauauauuuuguauacuauucauguguuguuuuguuugaacauauuuuuauugcacugucuuuucuucgauaaaucuuuaaaauaugucauuaccugugcuguuugugacuauucuaagugcugucaucuguuauguucauacuuuguguuugcacgauuuaacuugaucaugauucauucuuuuuuccccaugaauuuuuccccuuacauugucuccauauuuucuauaucucucuccuuuucucccgcucuugugcagauagcuccuccaagaagacaaagucuaguucagaggagaguagauccgagauauaugguaagcuaauguagcuaauucagccuugcccuuuggagcuugcuucaugguguuccuuuucuguucuuuuuuuccuuucuuucuuucuuuuuaaauaacugcagccuuucuugugucugcugugcauggcaugaucuacugcagggaaagggagccugggguuuuaacguggcugugauguggaagcuuaagguugcuagaaacuaacauuguagauuaagaguaggccacauugcccaucuucucccgucuuguuuaugguaggaaggugauuaucucuaauauguuugggucagguuccuccaaauaacaugaaugggcuuugaauucuugucaucuucuucccacaucucauuugcagaguuuggauuaugaagaauuugaggaauuaagucuuuuccucuaaguauaauacugguguaauuuagacguauuagcaguucuuuggaauuuuuauuucauuuuuuguuuguuuauuuuuaauugccucgucauguggaaaagucauucuuguauaauuuauccacgauggcaaaaauacguaaguauuuuaucuucauagcuugaagaauuugugccuuugagaaguuucucugaagcuuaaucggaaugggaaaauuucagaaugguaccuuuuaaauaaucuuaacaaagagcaaguuuaaccugaguggucaacuuuugcagcagaugauugaaaugcuaauauuucuagacuguguccugucuuccaaagauacaauaaccauguuugugaaguucauaccuauuuuuccuuuuccuuugcaguuuuauuugcccucuuuccuucuuuuggagucugauuaggguuuuguuuugggguuuuuuuuuuuuugguuuuuuguuuuuugagaaaagugaauaagagaggaauuaccuggagcuaagauuuuaaaaauaauuucugaaagacugauaaauuauuucuuuuuuuaggaagauuccaaauuuggccucgaagggaaaucaggucaucuuuaauagagccacaaaucuauagagcagaagcucccccaggugcagauagauguuuccuagcuugauauauaggagaggaaaaaauacaggaauugcccuccccuuuuuaagacauuugauaauucacaucugcuggcacuugagcccauaucagauacuuuuuaguauuaugaaagcucaguguuugguucuaaaccaguuaauucuucuauguuagauauauacacauaguucuuuacuuggguuuuugugaccagugcuuuuucuguguauaccuuuuacaguaguucagcaguaaauguauacugugccuugugacacaucaaguuuacgcuuuuucuuccuuccagaguauuuuggcuacugauaaguaagaacuaccuaauuccuggagacuauauuucuguucuauauaaagagcuuucuauaguuuauccucuccuuaggaacaugaacauuaucuuuauagcucuauucuuuuucgguagccuuugcaguguucuauuucgucuuccucuccauuuuccuagaucugcgauguguauuuagaagcuuguuguaugcuuuggaugaagacuaacaauuuaggaaccucugacuagaaauacuauacuaauauuuuucuuagcagugauagaaacauuaauacuaguucaggcaugccauuggcuugguagugauagaaacauuuuaagugguaauugggaaguaagguguggcuucucuguguguuuguuuuuugagaacccuugaaauaccuuuuuuggaaggaacugaguccacaaguccucaaaaagcacucaucggagggaugaguugauuagaacagaauuagcaugcuaacguaaaucucuuugacauuacaaauauuuuaucaccugugugaauagacgucuuuagauuacguacaguuagcauagaugaaaaagucucucuggggauucagaaaagcuugaaacuacugaguagaaucauagcaacuggugacauucugcuuuaguguagggucuuauuauaagcccacuucaaacuuuagagauuauacauugcuuucucgggguaaaauucauuagcugaguacuuaacaaaaaugcuaguuacucacauauuauuuauuuuaaacuuucuuggcuuuuuuuuuuuuuuuuuuuuuuuuuugagacaagaucucgcuguguggcccaggauggaguauaauggcgggaucaugacucacugcagccucaaccuccugggcucaagugauccuccuaccuaagacuccaaaguagcugggacuacaggugcacaccacugcacccagcuguuuuguuuguuuguuuguuuuuuuaauagagaugagguuguugaaggaaugauuugccaggggaaaaaaaaaaaagaaagaagucuuguucagcguugcguaaucauccagaaagaugacaauggauuugggcugacggucaguggagacaauccagucuucguacagucugucaaagaagauggagcagccaugcgggcuggaguacagacaggugaucgaaucaucaaggugaauggaacucuggugacucauucaaaucaucuggagguggugaagcuaaucaaaucugguuccuauguagcucucacuguucagggacgcccaccugggucgccccagauuccacuugccgacucugaaguagagccgucagucauuggacauaugucucccaucaugacaucuccucauucaccuggagcaucugggaauauggagagaaucacuaguccugugcucaugggggaggaaaacaaugugguucauaaccagaaaguagaaauucugagaaaaauguuacagaaagaacaggaacggcuacaguuauugcaggaagauuacaaccgaacaccugcccaaagauugcuaaaagagauccaagaggccaagaaacacauuccucagcugcaagagcaguuauccaaagccacaggcucugcucaggauggagcuguaguuacacccuccagaccuuuaggggacacccuaacagucagugaggcagaaacagauccuggagauguacugggcaggacugacuguagcaguggagaugcuucucggcccaguagugacaaugcagauagucccaagaguggcccaaaagagagaauuuaucuagaggaaaacccagagaaaagugaaacaauucaggacacucaccugauuuuuuuuuggaauauuaaagccuugagguuaaagaaaauaauaagaguuguuaaaaggcagaauuguguuuaggagacucaauauguaguguugcaacacuaggaggaaaaacuacagguacauauuauucacucaguuuaaaacuugcggaucuguuuauacaacuucagcuauagccacuauaacugcugugcaaaugacucucaaaucauaggccuacccuucuuugcugaacuccauccagaucuugcaauguuaaacugcuguuagauuuaagccaaacucauuuuuuuccuauuucuuccaaaauuuuuauuccccaauccuauauggucuuuaauuuuaguacuuauggucuucagacauccuguauguauguauguauuuauguaugcauguauuuauguauguauauauguaugaaugagacagagucuuacucuguugcccaagcugcaguacagagguuaacuguaaccucaaacuccugggcucaaacuguguacccacuuuggccucccaaguagcuaagacuauagacacacgccaccacgccuggcuaauuuauuuugguuuuuuuagagaugggucuuguuguuuuucccaggcugguuucaaacuccuggccucaagugauccucccuccuugaccucccaaagugcugcgauuacaggccugagcuaccgugcccagcacccauguuuauuauuuuauauauuaaugccucuguacugccguuuuugugcugaaucuaacuuugugaguugacaaauggaggagcuauugcaugggaaacuaucugacaaucuacaauuuauucuuagaauuuuguuaucuuuguuucuauagcaguguuugugagauuacuugaugauuuuagagcauuguaucagugauuuuucaaucaagagugauuaugccuccguggacauuugacaaaugucuggaaacgcugcagcuggcaucuggugggugcauagaggucaggggugcugcuaagugucuuagaaugcacgggcuagacccuacagccaagaacucucuggcgcaaaaugucaacagugccgcaguugagaaacccugcauuauacauuuaugaaaauuaauuaaaaaugaaaacauagaguucgaugauagccuucaauuauguaucauuaauggaaaucuuggguuaguacuucucagguauauuagccucucugcuaacuuugucuuaccauuucugcucuuauuuuuccuuucuccuauugucuucauucacuuuuucuuuaauuuuuuaauuguaaccauuuauguaagccaacuuuauuuuuuucuguaagaaguuuuaaguauguaugaauuaauaaaagaauguacagaaguguacagaaaguguuaaagucagauaaccaaguguauagugagcaaaggauauuuacuguuuccaaggggagugguuuuuuccccccaaaaaaaacucguuguuguggucuuuuucucugccagagugguacauggccuugaaaauuugugaaccccuacuuugaaaauaaaguacuucaaaggaaauaaacaaaaagaaaucucaccauuuaagugaaccaugucuuuuugauggguuggcuuuauucuuuuucuaaauuugaccaccagguaauuuuucuguuucuuuucccugaauguugccaggacacucaaucacuugucggaagucccucaacccguauagcaccucauauuauuggagcagaagaugaugauuuugguacugaacaugaacagaucaauggacagugcagcuguuuccagagcauugaauuacuaaaaucucgcccggcucauuuggcuguuuucuuacaccauguaguuucacaauuugacccugcgacuuugcucuguuaucucuauucagaccuguauaaacauaccaauuccaaagaaacucgucgcaucuuccuugaguuucaucaguucuuucuagaucgaucagcacaccugaaaguuucuguuccugaugaaaugucugcagaucuagaaaagagaagaccugagcucauuccugaggaucugcaucgccacuauauccaaacuaugcaagaaagaguccauccagaaguucaaaggcacuuagaagauuuucggcagaaacguaguaugggacugaccuuggcugaaagcgagcugacuaaacuugaugcagagcgagacaaggaccgauugacuuuggagaaggagcggacaugugcagaacagauuguugccaaaauugaagaaguauuguaaguaauagaaguauauguggaaaugcccucucugcugagauacuaguuaugcuugaaguguccuuuggguagguuuagaaaaacugucagauuguguauguggagccguuuauuuugucauaguacuugagaaacuggauuuuuuuuuucuuuuuucugauacuuuuagauaaauuucgaugacugcucaggcuguagaggaagauaagagcuccaccaugcaguauguuauucucauguauaugaagcauuugggaguaaaagugaaagagccucgaaauuuggagcacaaacggggucggauuggauuucuucccaaaaucaagaagaaacucaaaauacagugagaaauccagacauauaaacuauuauuagacaaugugaaaagugaaauuagcaguuuacaaagagugcuauuucugauucuguucaugccuuauacuuuccuuuuacuuugccuaaacuaaauacccccuguguugcuacauaaucgucaugaacaucuuuaguggcaguagaguauucugucaguuuguaauuauuuguguuuuuguuuaguguuuacuagauuguaaagcuguaugaguacaaggaccuucuuuauuauuguauuuucaacuguuagcaaaaugcuuaguaaauauuuguugaauggaugaaugaauuguuuagaauaaguuccugguaaaugugcuauaaaacuacccuuugauuuuccaaagcugucagugauaaagaguuugaagaaaacaucuugaguuugagguguacacgguacugugugcgaacuuuuaauuagugcucugugugcauacacacguguacggguuuucauuuacacuuaacaauuucuuugaacuaaccauuagcauuacacuaugaaaaucgcaaaagaaauuuacucuguuacguaucucuuauuuuuuguacuucaacucuagcaaaguaugaagaaagauaaagaaggggaagaaaaagggaagcgaagaggauuccccagcauccugggacccccacggagaccaagccgucaugacaacagugcaauucuucagcuagaaugaauuucuggagaaaggaguuguuaggaugauuuuacugaauucccaauaugccuuguuuccauucagcguuauuucugaacuaaguacccccuauguugcuacauaauugucauaaacaucuuucgugggcugggcguggugauucacgccuguaaucccagcaguuugggaggcugaggcaggcggaucacaaguucaggagaucgagaccauccuggcuaacacaaugaagccugucucuacuaaaaauaccaacaauuagccaggcgugguggcaugcgccuguagucccagcuacucgggaggcugagguaggagaauugcuugaaccugggaggcagagguuguagugagccgagauugcaccacugcacucaagccugggugacacuggagcgagacucugccucaauaaaacaaaaagaaaagaaaaaaaaaaaacgaaaacacacaucuuuaguggcaguauucugucaaauguccguaacauaguuuacuuaccucuucugauucuguuuccauucaacuuguguuuguuaaauuaaaaaaaaaaaguguguauagaucucuccaccacacugaacgucucuuuauacauauuuacuuagucuccauauuucuaaaauuucuccaccucuccauuguacuuuauuuucugauuucccuuucaccccaggcccaauaaagagagauaagcucacuugagauggcugcaggagaaauagggauggugguaccauggggaggggucaugugaugguucuuaucucaggcaguagcacauuugaaaauacugaagccaggugcggugacucuugauuguaauuccagcacuuugcaaggccaaggcgggaggaucacuugagccugggaguucgagaccagccugagcuacauagugagacccugccucuacaacaagaacagccaaaauaagcuguguaucauggugcauguguguagucugagcuaccugggaggcugagguaguauugcuuuagucuggggaguccaggcugcugugagccaucaucucgccacuaaacuccagccugggugacagagugaaacacugucucaaaaaaaaaaaaaaaaaaaaaaagauauuggcaugguagaguggugggaguaggauugugauagugagugucccccacaaugacgaguucucccucaaaugccaugagugccucuuguugagaaacauugagaaggugugaaauuuuuagaggaaguuaaagagauggaggauuucacagaugcuaaccgugaguuccaagguauacaaaagaagaauuugaggaauuaagagauuaggguauaaaaaguugugugaggguguaggaugcuuuggauauugaacaccugagugggagucuuuggcuucuuguggugacuuugugaacaaggauaauuagcaggauggggauuggucuggauggucuuugagguacauuaugaugaugaaggugugaguguugggggagaacuggggugggagcuuacuaagaacucacaaaaauaaagacuucaucuucauucuuacaaaugaacacagcuccaugucucucagcauuccuccucccucuguccaccauuccucuccuucuuuucucaugacccuucuucuuucccuacauccuccucuuccucgcuuucgucguccugccucaccccuccuccaucuccucaucuuucugcucuaccuuccucucccuuucucucuuuucuucuuccuuccuucaucugucugucuguauguuucucugcauaacaauccacuauauauauuuuuuagggucuaccauguuucacacauuuuaccagauucuuuuacauuguccuuuuuugcuuuuagcuaauuugcaaugcagauuauuuuauuuauuuuauuuauuuauuuuugagacggagucuugcucugucacccaggcuggagugcaguggcgcaauuucggcucacugcaaccuccgccucccggguuggagcgauucuccugccucagccuuccgaguagcugggauuacaggcaugugccaccacgcccagcuaauuuuuguauuuuuaauagagacgggguuucaccauauuagccaggauggucucgaucuccugaccucaugauucgcccaccuuggccucccaaaguguugggauuauaggcuugagccaccgcacccagccgcaauacagauuauuaaccaucauuuucugaucaguuggcagagccauggaacuacagaaggcgcgccacccuaagcacuuauccacacccucaucugugaguccugaaccucaggacucugccaaguugcgccagaguggguuagcaaaugaaggaacagacgcuggauaccugccugccaauuccaugucuucuguagcuucaggggccucuuuuucccaggaaggagggaaagagaaugauacaggaucaaagcaaguuggagaaacaucagcaccuggagacaccuuagauggcacaccucguacucucaauacugucuuugauuucccaccaccuccauuagaccaagugcaggaggaggaaugugaaguagaaaguagggugacugaacaugggacaccaaagcccuuucgaaaguaaguaaaucuuaagcagcuuucaauaaaggcgcauuuuaagaaacguaaccuuuuuuccucuaaaguuucauuuuaaaggaaaagaaacccuguauaccaaucuguuauguaguauaaaagaaagcucuuaagaaacacuggucauucaaaagcuguauuuugaaguauguauaaaacagccauuuguaggagaggaugaaauuucagugcuaagucagauucaggaaucugauuagaauuuauuguaauauaaagauuugugcuguuucucauuguccaccuaaagucuucaaauugaauucacucuuuuuucuucauagguuugacaguguagcuuuuggagaaagucaaagugaggaugaacaauuugaaaaugacuuagagacagauccacccaacuggcagcagcuuguuagucgagaaguguuacugggacuaaaaccuugugaaaucaaaagacaggaagugauuaauggugaguguaaucaauuuguuguuguuguuuacaaauacugaguuuugucagagugaauuaagucucucagccuuggaguuugcuucaaaguuucuccuagccuuuuguuuuaaacaaagaggaaauuaaacuggacagauaauccuugaacucaagaaaaugcaaauguuucucugauucuuauugauaauuuaaaaggaaaauguguuaagccuuaaagauauuuaagauucauagcauuauagaucuuaaaguugaaaagucauugcaacaacuaaguuauuuuuaugcauagauuuuaaaugaggaagguaaagcccagggagauugaauucguuaagaucauacagcuaauaacguguaaggaaaaaaauucaguuccuggucuuucuguaucgaagugcaguguucuuuauuuacccuagcauguaugugauaaauguguggcaugggugcuguacccuuuacuauccuuagcaugugauaugaauaaauaucuugucucugacaauacugagacauaaugaaauuauaagccugaccccagaagugaguguuuauaggcaaauuagauaaccaaaaguacuauuauuucuuaagagggcucaaguuaaaggcuauaugauguuggggcuuacaguuuucuuaaugauguaguugugauagguggguauuauuguaaacagcuggauguguuugggaauacacuaaaaaaaauaguuuugaaugauauuuuuuauuugucaguauucaacucucagagccaguauguaggaaaauuucuuggaaucagaaugacuucagagauauuucauccuuucuaaaugauaaauaauuuauuauauaauucauuugcuacuucacuccagcuaaagacuaugauugaucccauggaauuguucuaaguaaggcaacauuucauaucucuuuccuguucagaauuguucuacacugaaagagcucauguucgaacacugaagguucuugaucaaguguucuaucagcgaguauccagagaaggaauucugucacccucagagcuacggaaaauuuuuucaaacuuggaagauauucuucaacuucauauuggauugaaugaacaaaugaaggcuguucgaaagagaaaugagaccucuguuaucgaucagauuggggaagauuugcugacauggguaaaaaauggaguaucugcaaaguacaauaaaaaugugagguaugccuguaccuguaaaaaguugaggaaaagcagaauggugguuuguaacugucacauacaaagcguuaauuuagaagaaggcauuggccagaaaucauaaaagcaaaaaucauaaauaggccuuuagauuuuacucuugcuguuuaaauaaaaucauuuuggaaaguauuuuuccaguauuguuuccuuaagaucacuuuacauacacagacaauccuugacuuacuaugguuccaacuucgacaguuuuuuuacuuuacaguggugggaaaguaauacacauucaauagaaaccauacuuugaauuuugaauuuuaaucuuuuccggagcuuggcaauaugugguauguuacucuugaugcugggcagcaacagugagccacagcuccuggucagccaugugaucacaggguaaacaaccacucuacaguguacuguacugcuagaugauuuugcccagcuguaggcuaaugcaaguguucugagcacauuuaaggucagcuaggccaagcuaugguauuugguagguucaguguauuaaaugcuuucucaacuuaagauauuuucaauuuuugaugguuuuauuaggauauaaguucaucagaaaucaaggaacaucuauacuuaaacugcuuguaaaacuacuguagaggccgggcgcaguggcucaugccuauaaucccugcacuuugggaggccgaggcaggcagaucaccugaggucaggaguuuaagaccagcuugaccaacauggagaaaccccaucucuacuaaaaauacaaaauuagccaggcaugguagugcaugucuguaaucccagcuacucgggaggcugaggcaggagaaucgcuugaaccugggagguggagguugcggugagcugagaucgagccauugcacuccagccugggcaacaagagcgaaacucagucucaaaaaaaaaaaaaaaaaaaaaccaaaaaaaacuacuguagaacugcuugaguuugggggcauuauuuucuuugguaaacccagcugcuuuuuguaguuguguggugcuuugauugacuaacaugcuaaaaaugcugccagucuccuuguuaaacauguuaaaugucauauucaucauagaguaagaauacaaaauuggagugaccuauuaaaauauugcuuuguauguguccuacuugaaaaaauacucugaauuuaucuacaaaugcgcuacaggcgggcuuuuuacaaaaugccuuuauguacaaacuuuugggaauauggcuuuaaauggaagauuauauggaaaacaucuucguaaaccauaaagcaauuaucuacaaguauagaggcuguauuaaaaaacaauguauuugacuucuacgagcaccuacuaguaaaucacuuuuuagguguuuaaccaucagaaaucuuaaaaucauggcacaugcaaacuuaaauuuacaaauuaaaaaacauuagugagaaguauaauuuuuagcaaaagaauucauaagcucauugaucucccccaagccagcuccagcugcugcacaggugaaacagcagugauuuaauuuuguuucaacacagaaaacuuacggccugcccauggucauaguggguuuuauacugaguaagaaggaaugcuaguaugccaaggauuugcuucccagaguaguaagacaguaguuguuguaaaggcuucaggguguaagaaaauuaaauuuuaggccagauguaguggcucaugcccauaaucccagcacuuugagaggccaaggcaggcggaucacuugaugucaggaguucaagaccggccuggccaacauggugaaaccccaucucuacuaaaaauacaaaaaaaauuagccaggcgugguggcacacgccuguagucccaacuacuugggaggcugagacaggagaaucacuggaaccugggaggcggagguugcagugagcugagauugcaccacuauacuccagccugggccacagaaugagacugucugaaaaaaaaaaaaaugaaaauuuagucucagucuucaggcauuuuguaucuuauauucuccaaaugucagcuugucuguguaauuuauaaguaacguaggcugaaagguaauagguugugauaggcuacaagcaagaaaacauugggacugggcacaguggcucacgccuguaaucccagcacuuuggggacaccaaggugggcagaucaccugaggucaggaguuugagaacagccuggccaacauggugaaaccccaucucuacuaaaaauacaaaaauuagcugggugugguggugugugccuguagucccaguuacuugggaggcagaggugagaaucucaugaaccucagaggcagaaguugcagugagccaagaucaugccauuguacuccagccugggcgacagagcaacacugucucaaaaaaaagaaaaaaaaaagaagaagaaaacauuggaauaugaucagaaaaggucugguugugucaagaucagaccuuuuuaauggagaaccauugauauuccacauagauaugcaguucuguguauuuugucacuugaaauauugaaaggauucugguugucugucacuuugucuggcuuguauaagcucaguuucccauucucuuuuguguucuuugcauucuuggcacaguucagcggaccaggagaggagaaauugaaacaugcugcugcuaccuuuugcaguaaccaaccuuucgcccuggaaaugaucaaaucucgucagaaaaaggauucucgauuucagacuuuugugcaagaugcugaaaguaauccacugugucgucgucuucaacugaaggauauuauucccacucaaaugcaaaggcuuacuaaguacccacuucuguuggauaauauugccaaauacacagaauggccaacagaaagggagaaggugaagaaagcugcagaucacugucgucagaucuuaaauuauguaaaucaggcugucaaggaggcagaaaacaagcagcgccuagaagauuaucagcgucgccuugauaccuccagccugaaguugucagaguacccaaauguugaagagcucaggaauuuggauuuaacaaaaaggaagaugauucaugaagggccauugguuuggaaggugaauagagauaaaacuauugauuuauacacguugcugcuggaagacauucuuguauuguuacaaaagcaggaugauagacugguuuuaaggugucauaguaagauucuggcaucuacagcugauagcaaacacacguuuagcccugucauuaaguugaguacaguguugguucgacaaguggcaacagcuacucacugaauauuauuaacuaacaacuuagcaaaagugcaguucaaaauaaaugcaaaagaguaauagcauuuaaucugguaauuuggauuuauuuauuuuuuuucuuuugagacgagggucccacccugucacccaggcuggagugcagugguacaaccuuggcacacugcaaccuccacaucccaggcucaagcaauucuucaaccucagccuccugaguagcugggacuacaggcaugcaccaccaugaccuggcuaauuuuuuuguuuuauguagaggcaggguuucgccaugcugcccaggcuggucucgaacuccugagcuccaagcgguccaccugccucggccuccuaaaguacugggauuacaggugugagccaccgugcccggccaguaauuuggauuuuugacaugcuuuuagcaaaguuucuaguaaauuauuguggaauuagugcuaauucguauaaucuuuguuuuauugaaguacaauaaauauaguacaauaaauacguuaauaugguaaguugcacaaauuuuaaguguacaucuugaugaauuuuaaaguaaauauauguaaccuuuaucuaguuuaaggggcagacuauuucaagacccuaaaaacaucccucauggccuccccaggucauaguauuagaguaaucuuguauuguuuuuuccagauaacaaagcuuuauucgucauuuccaugucagacaauggcgcucagauuuaugaacugguggcacagacaguuucugaaaagacuguagauuucucuuaagguauaguuuuggacucucgccuuaauaguguguugccaaaauaaagauauucucuggcagaguggguuuuguuguuguuguuguuguuguuguuguuguuguuguugguugauuugguuuuuguuuaguuuugcuuucugaguauauuuaaaggauauuucuuuuuucuuuuuuguauuuuggauuucuuuccaacuuucugaagcuggcaggaccuaaucugucggauggcugcaucagugaaggagcaauccacaaagccaauuccauuaccacagucaacaccuggcgaaggagauaaugaugaagaagauccuucaaaauuaaaagaggagcagcauggcauuucagucacugguuugcagaguccagguacacucuucugaagaguucaauggagaaugugcucuauuaucuguuaaaaugcuggccggaugugguggcucaugccuguaaucccagugcuuugggaggucgagauaggcguaucacacagagauuugggauuagaaucuaccuuaauaucgucaaaaccucagucucauucacugaguaccucugggaaaucagagguacgugaucuguuuguggcugagagacaguuugcaaaggaacaacauacagaugggacacuaaaggaaguuggagaagauuaucaaaucgcaaucccagauucacaccugccugucucagaagaacggugggcauuggaugcacuaagaaauuuggguuuguugaagcaguugcuggugcaacagcuagguuugacugagaagagcguucaggaagacuggcaacauuucccaagauacagaacagccucucaggggccgcagacagacagugucauccagaacucugaaaauauuaaggccuaucauucuggugaaggacauaugcccuuuagaacuggaacuggugacauugcaacuuguuacaguccacggacuucaacugaaucuuuugcuccacgggauucagugggacuggcaccccaggauagccaggcaaguaacauuuuaguaauggaccacaugauuaugaccccagagaugccuaccauggagccagaagggggucuugaugacaguggagagcacuuuuuugaugcccgugaagcacauagugaugagaauccaucagaaggugauggagcaguuaacaaggaagagaaggauguuaauuuacgcaucucaggaaacuauuugauccuugauggcuaugacccagugcaggagaguuccacagaugaggagguugcuuccucacuuacccugcagcccaugacaggcaucccugcuguggaauccacccaccagcagcaacauucuccucagaauacucacuccgauggggcaauuucaccauucacccccgaauuucugguccagcagcgcuggggagcuauggaguauuccuguuuugagauccagagucccuccucuugugcagauucacagagccagaucauggaguacauucauaagauagaggcugaccuugaacacuuaaagaagguggaggaaaguuacaccauucuuugccaaaggcuggcuggaucagcccucacagacaagcacucagauaaaaguuagagccgcauguccuggaggugacugcagguuguuggauuuggaguaucggccgugucucaccacauccuggcuccaguguggaugcagagagagugugacagaggaucugccugugaaccaccugggauuagucaagucccaaggugcccagagugggacuaguucuucacaguguggcagcugcacuaaucuguuugugagggaauauccauucccucacucuacucuccucacuaucggaaauucauuuugauucagaauaaaaaccaaauguauagagcuuuggguguaggauaugaaauuguacuuagauuuaagaaaaagagaaaaucagauguauuuauuugacuucauuccguauuugaaagcacauuuuaauuuuuauuugccuuguuuuguuuuaauugaguagugagaguuuuagaccuuugucuuuaguacacccaaggaucaacugcuccugaagcaaagaggucaggauggaguaugcagaaguuggguagagagguuaagaagaggaggaagugagacggggaagggaggagcaccuugcuucacuauacaguauuccaagcucucugcuguccaguaggcugcuucucugagggucaccucaaagguaugcuaugccguguggcucuuaugugcccaggugguguggucagagaguggaugggcuuccucccgcccugaggcaagcaccucuucucuguagcugggaucaaccacaauuaauaggaauccucaacauacuaaauagcaggcacuugaaaauggguguguuuucuuccauugucgucuuuucuauugaggguugggauuugggugggagaggaaagcaaauuuuauuuucuugacuauaaauuuguuauucuugguaucauuucauuuuuauaauuauacauuagacauuggcacuuguguaaaacugucccugcagauugagcaggaaguaaaaacaaauggaaaugcuucggauaguggcagggguggggguugcuaaggaaagggugggaugggaguggguaaagaguuugggaagguuaucuaacugaaucacuacugaguugaaucauggcuaucauuagccacagguacugcugauuauaaggccaguaaaauuuuaguaccuggagguuugacucuaauuuuugcacugauggugccaaagggcccugagucaaaaggauagccaaggguggaguggaaaaagauauggugaaggcagaacugcucacaccagcuccagaagcacguccucugacuucacugccgcagcucuuuccacacggggccgugauugacccuaaaaauugcagaccagcacauacacuggacacugcaggcaagguguugguaacugccugcucuaggaugaauaguagcguuagcagcacccuacagaggguaaguuucagaauuguaauuugagaacuccuucaauuauauugacuuucuuugguuuuccuugugcauuagguauauauuuuuugaaguauuuuugccaacuaaaaugaagucuguaaauucuguuaauaaacaaggaguucauccguugcucacaucuuucauuggugcccucugaacucuguggguugcuaggauguaauuuuaaugcuucccugcaguccaaagaugauuuuuucaccacaaaugguaagggaugcccaccuacuuuuauaaacaccacugcaacuuaacaaguuuauuuaucuauguccagauuucuguuucuguccuaaauugaucuguguuuuuagguggaucaacuuggaucuuuagaccucaucuauaaauugaaauuauauuuuuagucauaagccaaguacaaucuaacucagaaugggauuaaaaauuuuagaagcagaagcuaauauauaaaugaaguuugggauuuggaacuuucuguaucucuuaggaggaacaaguaaaaaccaaaugguuacauugugcugcuagaaauaaugucauucucaauuaaaaggguuacaccuguagccacuugacacuaacaccaucgagggcaauuaaucaggagaaaaguaaauauaaaaacuuugcucuuaacgucacacacuacaggguaauuauguaauucucuagcacucaauuaagaagcuuguagguuagcaaaauuucaguuucucuaguucagccagugucuuguccuuaguaauuauuugcuuucccugcaguucaauuucuccuuggaacucuaacaggacuaacuggaaaaauacuuugaccauagcucuaguacuuccaaauaaauucauaucuagauuuucaaacaaagccccaagaugaagucuaauucugaaaauaucucacaauuuuugaauguucuuuuuaucuuaccgaccuaacuucucuuuucccucccaacuuggccucccacacguuccauuucauuuuggccauuauagucacauccguuugacuuugguugugacaucuuccuuucaggaugauggaauuagaugcagucugucuuugagugagacuggucaccaucagaggaguuuuuucuaagugacgugacuagaaguugaaaucuacuucccugcuaaagggcacaggggugguguacaaagaaagcuaccuucccagagcaagcaggcugcauuuuagcuauggaagugaccugcugugacacugugcucucuucugugggcuuaaugguuccuuugcuaugaaguggcaaauuacauguagagugucuccuuccuuuucagagaacaguuaaucaaggcaaaucagcaagcccccaaagugcuguaauuuaacaucaugauuaccaccuucgaagcuauauauuuugcauacuuuaaaaucaccuaacuuggacugcuugaauuacauuggcuuuuagaaccgaaauuguaacuauguauuguauuucaugggagguauauuuuaugagcuuuuuggcuuucuuuuuucccacagcaacugccaaugaaggaugaauccccuuuuuaaaaaguuguuguuguuguuguuuauuugauuuugaguuaggagggauaauagagaaguccauuuaaaaauuauuuuuagaagcuaaagaaaguaauuaugcuuccugugaauugucuuuuacuggcaucuuuguuuuccucuuugauguuaguaaauuugguguaauacguggggcuuccauauuucaaaguggaagcuuucuucucugaagucgauauaugguuuugaauuacuagagcuuuggucaguauuuccuucccuauaugucacagagggcaccacugagaacugcgugcauaggaccucaaaauacaaaauuagcagggccucacagucagcuuccucauggcuaguuuuucccccuuauauuacaauuuuuguuuuauaagucauuuuuuuccugauauuuccaccacuuuucagagucaucuacaaaauuuuucuuuccucaagaaaagaguuccuuuugccuuauuccuuaugccuuccccacugguauugaggguuuugauaauaaauugguaggaaaaaaaaguaccuccuagaaggaagccuuccccaccauuuccaggugccaacugcuaagcagauauauuccaaaaaugguaacugucaugugcacacuguugguuauuuuuaauaagccucuuccuacuagaacauuuuauuuuccuuguucaccauacaaucauguacucuuuaacagaaauugcuuuuaaaaaauaucuggaacuaucuuuaaaaaaacuuuauuaauaaucauguauuuuuacugaucacauuuugaaaugccuaaaagacuuuauuguucuaauuauccagauguaccuuuguaaaauagcucuuuuaugaauuagcugauaaggcuguauguuucuggaacaaaauauuggucaucuaaaaacuuucuguuuucuggggucugggaaaauagaaaauaagauuucaaauauuaaauaagcuuaaaggaaccaagcaugugacuuuuuauuuguauucugguugauuugucuuguccaaguuauauuagaaaaguugaggagucgaggagccuguaauuaauuuuccugucagugacugucagacaucuuccugcuuauuagagcaucccuagcaacaaggcuaaaccuucaugacagugcuggcaggugggcuugcccuagcauguggggcagguuuguuguuuuuuuaauagcuuuauugagauauucacauaucauauaauucauccauuuaaaguguauaaucagauggguuuugguauauuauugauuuuuaauuguggugaaauauauauauaacaaaauuugcuauuguaacuauuuuuaaguauaaaguucagugagguaggccagcuuuuaugacgcaccugaagauaacuuugguuuuaauccuacccuaaaugaagcauaugccucuauuuuuccuguccccagugcugggcuucuucacauaccaacauuucugugcuuuuaccaacagcauuuuagcucagaaggcucgcuuacuuugggcauuugcuguauuuugguuuugaaauacuuguaauuugacuuauucuugggauaauauuuuaguuuucagucauucaagggcacauuuggcugacggagcuaauaagcguaauaaaaugcuuaguaguuuauaccaucuuuuaguuaaacauuuuaaagauuaagacuauucaaauguacuuugcggaaauuaaccuguuuguaugccuggcuuuguuuacaaacauauaucuauaucuauauauauagauacagauacagauacauaucugguggaacaaagaaauaccuguaccauucccacuugcucuuugauagccaccuccuaggaauggagacaauaaaacucuguauuugcaugug

SEQ ID NO: 679 - RNA, 10282 nt, Homo Sapiens
auguuuguauaaacaccguaaaccugccugguaccaccaugaaugacacaagagcuaguuuaaaaagaaagcaaagaaacaaacgcaaaacccgaaaccgcauccuccaccgcaaagguacucggauggggcgcccgcccuccccuuagucagaggacaaagggggcguggccgagcgcgcggcgcccacgugaccgcggagagcugcgcgcaggcccuucgcgcgaucugccgucauaucagcuuauggcgccggucgcugauuggcuggccgcuccagccucccggcccgcuugcuggcugcccagcugcuaggacaguuugcagagcaguggcgugcggagcggcggcggaccaccuccaguacaccugagcgggcugggccggggggcgauggaauaaaagaagauggagagacuucagcgccugggacucgggugggcgaggcggaagguguccucgcagcacggcuuuucuccgcgccgcgguugguuagcgagugcccucugggugcuaggcguugggcggaugguaggaucgcgguagcauacggauccgaguccugcgccgagugagaggagaggcuggcaggggcuaagugauggaucuuguacuccguguugcagauuacuauuuuuuuacaccauacguguauccagccacauggccagaagaugacaucuuccgacaagcuauuagucuucugauuguaacaaauguuggugcuuacauccuuuauuucuucugugcaacacugagcuauuauuuugucuucgaucaugcauuaaugaaacauccacaauuuuuaaagguaagaaauguuuuuaccuauuuucuaacgauuaaaguaaaaauaacaauaugauauauuucugagauuuuuagauuaagcugauuauauguaaccauuaaauaaaauuuuggagaccaaccacaaauggguuagauauuuucaugaggguuaaucccugcucuccuucccuuaguuuaagcaaaucuaacuuuuuaauaaaacuauaagucuaguaucguaucuugcuagaugcauauuggagcauuuuuaugcugauauugaugaguaaauaaaugcauacauuuauguaauuauuuuaauauaugauuuucacaaacugaaauguguuuuuuuaccauguuuuguuuuuuggcuagauaggggauucaaacucaguaguuuuaaaguuguuuacaaucauuuuuaaauuucgguuguuuguacuugucagugacuccaaggacugaacagcaaaaagaaaaaauagagaggauuggggauggaaguuaauuaggaaagaaaugguuauuccauaaauagaaguuuagaaugcagauuuuggaggaaggaaaaaagguuucagaauuugaaauacuuauugcauuuucucaguacaaaaggaaugauuuucuuacauaccuauuuuuauguauuuaaaauuuuaauagaaacaguuuggagguaagccccuucauguaaaagagauuuuaaaaauccaguccagaacaguuuuaugcuaguuuuguuuaacauggauuuugugauuuuuaaguauuggaaauuucacuuucagaaucaaguccgucgagagauuaaguuuacuguccaggcauugccauggauaaguauucuuacuguugcacuguucuugcuggagauaagagguuacagcaaauuacaugaugaccuaggagaguuuccauaugguaaguaaauaacacgagugucaggaagagaguagucuaagcacagguuaguuuccuuaaaaaaacaagucugcccuuuuuuuuuucaucuuuuaaaauaauuacaaauuauucaguuguuuuuuaauguucuauuuucauguguucaugucuugccacaugugcauuucuuuaguuuuucuaucaaucugaaagucugcuguagaugagauugugucuggcggaagauuggagugaucagagauggguccuugcauuuguuuucuauuaauuauugaauucaaccuucuaaaaaaaacuugaguagcuuaugucauugcugaaaguuaaaaacagauuuuuaaaaugcauuauucugcuucuuagaaacuguaacucuucuggcauacaaccacccacuuuucugugccuguauacuucauuguuuacauuacacaaaugaaguccugaggugcauagugguuugggcucugaauuuuguuucucuuagcaacuuacaugguuguauuuucaugucaaaaaaaucuugagauuauguaauauauuagucauaguacugugcggauauucauaaguuauguaaaugauaccuaauuguuagaccuucagauuguuacucuuuuuuguauuauaaacagcccuguagugaguaaacuuuugugaaauucugaaacuuuuucaagauacauuucuaggaucuaguauguaaaaagcaagaaucauaguauuuauugaaggcugauaugugucagugacaguucucagcucuucacaagaaucaguccauuguuuuccuacaauucuaugagauagguacuaucacugugcuccuuuuauaggugagucaaugagguguacagagaguuucaguaacgaguuggugguagaucugagacuuggacucaggcuugcaggcaccagcacccccacacuuuaaguaagaaguuaguuauugccgggcgcgguggcucaauccuguaaucccagcacuuugggagaccgagguaggaggaucacgaggucaggaguaugagaccauccuggccaacauggugaaaccccaucucuacuaaaauacaaaaaauuagcggggugugguggugcacaccuguagucccagcuacucaggagggugaggcaggagaaucccuugaaccugggaggcagagauugcgccacugcacuccagccugggcgacagagcgagacuccgucucaggaacaaaaaauuauauacuagaguaaugaauuggcugggcuuugaaaaauggauaugauuaugaguuaaaauaaagggagagaggacauuuuagguucuugaaccccuaugaugaaagauacagagguaaaacuuccaagacagugggaggacauugaguaaaccugccugguuagaguagaaauacaggagugaugagguuggaaagauccgaaagggguggaguauggaauaaaugcuaaauuuaaaguauuuaguggaaaguauauuuuaagcagggagauaauguguaaagauggguuuuaggaagauuaauaugaaggaagugaugauucccagagauuuaaauaauaaagaugucuuaggaguauccugucucacaaauaucuuuauaguuuaauuaagaaguacuuuagguagaacauuucaaguacuuaugcgagggaaaugaggaaaugaccagauuccaagaagccaagagagauuaguuuauaauauacugaauuagccagaacagaucauuuauaauguuugagucuaggaucccauuuugcacucagauggacaugugaaaagugaacucuaaucccaggagcugaguuuugauucuucuguuucccguuuucuuuucuaggauuguuugaacuugucguuaguauaauaucuuuccucuuuuucacugacauguucaucuacuggauucacagaggccuucaucauagacugguauauaagguaaagucauuuguggugaaaagagaaaaaagguuacacauuucagcaauguaugauuauaaauucuguucucuauuuccaagaauuuccucuacccauauuaaaugucuaaguagccauaaucauaacagguacagggugcauuuuguucauauucuucuuuaugggucuaaggggcugucuuaaaauucgucuguuccgguaacagguacacauggacuuacagagggaacaauagacauuagagacuccagacgccuacauaaaccucaccauauuuggaagauuccuacuccauuugcaagucaugcuuuucacccuauugauggcuuucuucagagucuaccuuaccauauauacccuuuuaucuuuccauuacacaaggugguuuauuuaagucuguacaucuugguuaauaucuggacaauuuccauucaugacggugauuuucgugucccccaaaucuuacagccauuuauuaauggcucagcucaucauacagaccaccauauguucuuugacuauaauuauggacaauauuucacuuugugggauaggauuggcggcucauucaaaaauccuucauccuuugaggggaagggaccgcucaguuaugugaaggagaugacagagggaaagcgcagcagccauucaggaaauggcuguaagaaugaaaaauuauucaauggagaguuuacaaagacugaauagauuauugcccaguuauucuuaaguaaggacaaagaaggaaauaucaucguauuucuuuuuuuuaauaaggaaaaaauaauauccauacagucaagauacauaguaaaugguaucauuuggaaaucagcaucgugggcacugcugaggaaugauccuagugguaggucagaagaagaugcugugaacaccaggacuuuaaucuuaugcuuaaaaugccagauguuguucgggggacaacuuguaucuuucuagcagcagaucuguaguuuguauagccucaacaacaauuuuaaauaagauggagaauaaauuauugaggggacuaggcuauaugcauuugccuucauccacccauguuuauuaagaaucauugugcuuaauaauaccaagacuaagcaccauaaccaagaaauacuaauguaaagauuguuucuuguuucaggaaugguuaauucuucaacguugguaugauaaugauaacuuguuuugacuugaauaaaguacuacaucaguguggaaaaaaauucugauacauuagcagcuauguaaaugaccuaauugauagcagguguaauaagacuaucgucuuccuacacauaggaggcucauucucuggacacacuaucaccuauuacauuuuacugauuaacaaauaaauuggaauuuaaaaauaucgauaucaccaugauuuaauccagaucugggauuauguagcuaaacauugugaugauuauuauuuaaaaccauuauuuaauaagaguaaaaauaugugaaucuggauauauuuaaaaaaagaaauuugaugcccagauaauauauuaggcacuacugauuuuuuaguuaaauugaugcacuacacuuuugauguuugaaguuacaaaccuguaauuuuuuuguaaaggaaauaauugccaaauaccuaggcccauugcugacgauuaguucuaaaaucuuauuccuccucuucuccccucacuuuucccuacuuccucugcaaaaagauuuaacaaauacauucauaaggaaauguguguuguaacaaauauauugcaaaaacauaguuuguaaaggcauucuauaagcuauuuauguaaaaucaauaaaaguugaucauaauuaaacuguaucaguugaguauuauagcagcacaaaguauucuuuguacagauuuugugccaauuugaagccacagaaaugauguggauuguuaauuguguuuuagaacauccccggacacucagugucacagggggaaagaaguggguaccacauucuguuuauauuucacauuuuaacuagauuugaguguuuuuagcaagaaaucagucuuaaaaucuaaugucugggauccagaagaaaaugucuuuaaucugugaguuauugucacaaugucaucuuauuuaaauguaccaauuagcauuuuguaauaggcaaaugucauuuagugcuuuucaccaaucccacucacccccggugcuccgccuugccuaagaaaaagaaauuaaggagaaguaaacuuuauuuccuaauauaaugucagcugauauuuauugagcuuuuccucuuugcccagagacuaggacccaaagaaguuaaguaacuauucccagguuuauuucucucucauaugaugucccauguggauguuuguggucaguggacagcuuuccaccuagucuuucugcgacccaggcuccuuccucuuggggcucugccuuucucucaguccauagagcccucuuuguugaaagagcacauaggaaaagaaggaaaagucuguguggaaaauguuucugggucaggccuggaaguggugcauaucucuuccgcccauguuccuuuggacagaacuccgucacauggcccaccuagagagauuuugggaaauguguccagcugugugccugggaggaagggggcaccauuuucuugagcagcuagacaguuugccguauuugugguguucuccucuuguugauguugaaauggugaaugagccauaaaguauuucagguuauccacacacuaaucaucucagugucuuuaauucuuaacuccaauaugaauguuuaaagcuuccucuagauucuuauuccuauauaacuaauagagaagaaaggacagcuuccuauggggaagacagaggcuuccucauagauguuaggaauaaucaaacuugccccugcccuuucacccgucucaaauucuggucuuuuaaagcagcguuauguuaaguaguccuaacauuguaauauacaguacugccacauucuccuacuuucuauuagaggaagucagagaauauuuauggaagugaggacccaaauuaccuucuacagaugacuuuuauaguuacaggacagaaagugaaaaucaagguuacguuuucuacuuuugugguagaaauugagaaguggguggauaugguucgagaagaccuuucagaaacacagagacugagucuuugucuuccaugcugucucugcaguacugagugaauuuccuuauacccuuguaucauguuuuccucccaucuucuagaagcuggggacagauuuggaagagaauuacacaaguucaguuuuuugauacauggauuuuacagugcaugcagguuauuuauguagagaggaggucugggagaaagauggaaacuagggagaugacugagaacaaagauauuugggauuaacacagauagaagaaaaguuugaaaccaugagauugucacagcaugaaaaaagauauucaaagacacuaaccaacuugaggggugcaguggucugaauguguccuccaaaauucaaauguggaaauguauuugccagugagauaguauguagagguggggccuugaggaagugauuaagucaugagggcucugggauuaaugacuuaaaaagaggugugaggcagcuguucagcccuucugucuccugucccuuuuuuuuuuuuuuuuuuugagauggagucuugcucuguugccccaggcuggagugcaguggcgugaucuugguucacugcaagcuccaccucccggguucacgccauucuccugccucagccucccgaguagcugggacuacaggugcccgccaccaccacgcccggcuaauuuuuuauauuuuuaguagagaugggguuucaccguguuagccaggauggucuugaucuccugaccucaugaucugccugccucggccucccaaagugcugggauuauaggugugagccaccaugcccagccccuucugucccuucuaacgugaggacccagcaacaagguaccaucuugaaagcagcaacuggggacucagcagacaccaaaccaacuggugcuuaaccgugacuucccagccuccagagcuguaagaaaauaaauuucuauuauuuauagauuacccaguugaagauacuuuguuaaggcaguacaaauggacuaagacaagggggaagaaauuugcauuccugaucuucccaacuucuucaaauucacaacacuugaaugacagucuuauuucagcacuuacugcuaucaccuauuacuuuuaugugugucuuaccuauuugagaugccagauuccuuggaaguagagaccgugucugaaucaucauuguauuaaaccacucauccuuaacaaaugcccaagccaugguuaaaguucaauaaauacuuuguugaauuuauuaauaaaauggcagaaaugucauucucuuccauauauguuuaauaaaucccugauaggugcuaagcacugcacuagguaaaaauucucuucugaugcugucuuuuuggccaaccauuuuuuuaucauuuauucauuagcugacauuugcuaagugcuuuggaggggucaaaaggggaaguaaugagaaaucaaagauggucccuacaucaaggauaaacuaucuuuuuuuagucacucaaagucauaacccuuuggaaacaaaacccaccaguaccccagauuuugaccacagaugaaucaguacuacaaggacugguuagaggguugaaugaaucuguauacucagcacuuaacacagcacucuggguaaaagaaaaaagauccucaaagauauuaguugguuacaucaagaaaggacaaacuuagguuaaucuauaacuucaucucagaggaacaggaacuuuggagauaaacagggcucugccacuugcaaguugcaccaucccugguuucuccaucuguaaauugauuaaaacacugccuaucuaauaagauuaaauaaguuagaagcauucaguuaaaugucaacugaaacuauuguucauguaaauugugcuugaugcuuuuucuuucuagauucaaugauuauugucauuuuaccuccauaggcccucaauagaaaucaguugcagagggcagaagccuagauauuuucaccuuaaaauuggagggugaaagacauugaggugaaguagagauagaggguacacagaaaaaucguauaaguaaaacuaacaucguuaacauuauuuacuguaaguuaucuuuguaagagugguaaaauacauuguguuguuaaauaauuucauuuaaaaaaugcaucacuuuguguguuuuuauauugcuaaaaccauaaggccagucuacaagguuuguagauaaaauagaaacauaccuuccuugaaaagcagaauaaauuuuuuaaaggcaggaaggaaguguuugaaccaugugucaacaagcuuuacugucaaagcaggcuuuugguaugggaagaaaaauacuuauaaauacuuguuuuaauauuugcuuuauuaaaauacauuuaaaauacagcauuuuuaaaucucuaagcucaacuugaagauauaagaacaguaaauuugauaaaaaugagaaauuacauucccauuucuuuaacaauuuguaaauuccaauuauccugaacauuuaauaccauuuacauauuuuauuaaucacauuuucuuaaacauuugauaagagauuuaauauuuugauccaacuaccaaaaaagcagacuuguguacuugacagauuuuucuaaacacuucacaacucacgauucaaacaaagacaaaauagcauaucaaaaguuaaucacucaguuggaaagcacucauaccauaggcuuuuauucauuucuugaauaauuuuguuauaucuuccucuuuuaggcugcaaugagcuauaauugcacuacugcacuccacgcugggugacagagcaagacccuaucucuaaaaauaaaaaaguauauauauauaaaaauaucuuccucuauuauaauuuaacucauuaagccauuuauuuagauguaaacuugccccccugacaugugguaugaaacaaauagaaaccuagaaauuuagugcauauucaaauauuaagacagacacugguguggugacuuuugucugucgcuucauugggacguuuuuucuuucugaucaacuuaaugaaauuauaauuuacuauaauuaaguguagccauuuuuacuguagaguucaaugaucuuugaugaacguguacacccauguaaccaccacccccaaucaaaguaaagaacauuuucuuaccagaauaaauuuccucuccguuugcagucauucuccccagcccuaggucaccacugauccaccuucuguuacuggaagguuaguuuucuucccugauuuagaauuucauauaaauuaaaucagauaguauauacucuuguguuuaguuucuuuagcuuaacauguuuagagauauuugcuguugccugugucuguagcuuuuuguuuucauugcugaauaguauuucauuguaauauaccacaguugguuuauguauuugcugaugaauauuuguguuauuuccagcgugggauuauuaugaauaaaguugcuacaaacauuuguauacaa

SEQ ID NO: 680 - RNA, 9772 nt, Homo Sapiens
agauuauauggagcugcgggagcugccgccugggggaagagaggugcagcuucugcuagguuugugcucuccucccagggucuccuuggcuuccuuccccaaagcagcucagagcugguaugaggugaggguggggggcagccggccagccuggcuguugacggcaacuccagggcuuguuucgcgcagccuugccagcauuacccauccucaucagaaacuggcagcggcagccacagcucgggcaggcggcuccagccccaggcuggauuugcagaaucuguccuuugccuccaagcccagcuuucagcugggagagggggaagaaggggcaguggcagcaguucuucuggcucuuucucccuuucucucuuucucuuucuguguucaagucacauuacaugggauucuguucuuuugggacuucgucaucuuuuccaauauguccugggaccuccggagcuguaacggggaugcuaaggacacggucaguggauuaucgugacuguacuaaugaaaggauucaagcucuccuggagcucagaacagcugucugugagggagucagagggagagagagaaagggagccaggcagagagagagagggacuucuguaaggcggcacgaccacaccaaauaacagcagcagagggaggugggggagagggaaauaaaggggagucaugcuuaaaaugcuacagcggugugaaacagcagagcaaagaagcgcccccagcuucugagagcccuggcccgaguccccucccccguuagaaacagggcuuugggauggucauggaggugagugcccuccagccuccucagggcccccgcuccccgcccccgccccccacugcccaaugcaugaaugaaugaguuccucucugcacugcacucugcuacuguuccuaccuaauggcuuccagcacugccaguaacuccaaccgcagcacgccggccugcucgcccauccuccggaagcggucucgcucgccaaccccgcagaaccaggacggagacaccaugguggagaagggcucagaucacuccucggacaaguccccguccacaccggagcagggcgugcagcgcagcugcuccucccaguccggccggagcggcggcaagaauuccaagucucacaagcgccucucaaaaaaaagccagaguugguauaauguguuaagccccaccuacaagcagagaaaugaagacuucagaaagcucuuuaagcagcuuccagacacggagcgccucauuguugauuacucaugugcacuccaaagagacauucuccuucagggccgacucuaccucucugaaaauuggaucugcuucuacagcaacaucuuccgcugggaaacucugcugacaguccguuugaaagacaucuguuccaugacuaaagaaaaaacagcucgccucauucccaaugccauccaaguuugcacugauucagaaaagcacuucuucacuucguuuggggcccgggauaggacauauaugaugauguuccggcucuggcagaaugcucuccuugaaaagccucugugucccaaggagcucuggcacuuuguucaccagugcuaugggaacgaauugggccugaccagugaugacgaggacuacgugcccccugacgacgacuucaacacaaugggauacugugaagagaucccuguggaagagaaugaagugaaugacagcucauccaagagcagcauagagaccaagccagaugccaguccacagcugcccaagaaauccaucaccaacagcacacuaacauccacagggagcagugaggcccccgucucguuugaugggcugccccuggaggaagaggcgcuggagggagacgggucccuggaaaaggagcucgccauugacaacaucaugggggagaagauugagaugaucgcuccugugaacuccccuucacuggacuucaaugacaaugaggacauccccacugagcucagugacucuuccgacacacacgaugaagggugccaaggguucgggggggagcacugaggcuuuagcagcucuccuguauccucauuugcauccuccuguagcagcuggaaaauucagauuacaggugaaauucccuggcuggcaaucuucuguauauggacacagugaugugccagaagggcuuugcaucccugagacugaaggaagcuccauuuuuggagcccucccacaccuugcucugugugccucucauucugauuugaauucuuauuuugcuauaugaugaagcuguaauccuaaguuuaaaaaggggaguagguauugacaucaugguagaaauaggcugucuuauggaacuguaguuagggaucacagccuauuggaccagccccagccuuagcagcaguucuguacacugauucuuccagauuagucuacguucccucgaacagaccuaugccauggguuacaacuacaauuuguugucgauuagaguuaacuuacagacucucaaaaccccauucuuuggguuuaggcaacuuccagaaguagucauuuauuugaauuuuagucuaagaucaacugaauuagggagguuugaaaguguaaaagcaaaucguacauucccaaacacuuuguaaagaaggaauggguagugucagcuaaaggaaauggugugcaucccagcaaaagaaagagaccgaaagcaaagucauaaaccaugcccacgagcucagcuguccugcuccguguccucuccauacccuuguugacugugcucauauuagccagagaccuaagugcucuuggaggaugucccuggggcccccucccccuccgcugucacugucuacuuccugauccucucuucugugcaggagagguccaggccuucuaugaggaccugaguggccggcaguacgugaaugaagucuucaacuucagcguggacaagcucuaugaccuccucuucaccaacucgcccuuccagcgggauuucauggagcagcggcgcuucucugauaucaucuuccauccauggaaaaaggaggagaauggaaaccagagccgagugauucuuuacaccaucacccuuaccaacccucuggcucccaaaacugccacugucagggagacacagaccauguacaaggcgagccaggagagugaauguuacgugauagaugccgaaguccucacccacgacgugcccuaccaugacuacuucuacacaaucaaucgcuacacgcucacccguguggcucggaacaagagccgacucagggucuccacagagcugcgcuaucgaaaacagcccuggggguuagugaaaacguucaucgagaagaacuucuggagugggcuggaggacuacuuccgccauuuagcacagaccuagugauauagguggcucugugacgagaaguauuuguaaaaugccugugaaugcaucuauuuaagacguguaugccccaaauuguauacaugagggugcagauauugggaacauaugguuccuugcaauguugaacaaccccagaggaaggguuugacuggggcugggucccacaaguaccuccugaggcucaugggcaucccugaggauccucaacccacccaaccaacuucccagaauacagaauaggaaaaugguucugcagagaguugcauuggagggcugaagguggccucuccugugguccuuuugucucugauagagagcgagcuggccaaaacggagagcacuuauuuggcugagaugcacagacaaucucccaaagagaaggccagcaagacuacaacggugcggaggaggaagcguccccaugcccaccugcgagucccucaccuggaagaggugaugagcccggucaccacgcccacagaugaggaugugggccacaggaucaaacauguggcagguuccacacagacgcggcauaucccggaggacacccccaacgguuuccaccugcagagcguguccaagcugcugcugguuaucagcuguguggaucuguuucaggucuccuuccuagucuggugcugcuggucauccuuaacaugaugcucuucuacaaacucuggauguuggaauacaccacgcagacccucacugccuggcagggucuaaggcuccaagaaagguuaccccagucucagacagaaugggcccagcucuuagagucccaacaaaaguaccacgauacugagcuccaaaaauggagggaaaucaucaaauccucagugaugcuccuugaccaggugagaugccccaccuucucugcuugcccuggucuuugggagcggggacuccuucccuuaugcugugagaaagauccucgucucuaucaccacccuccagacuucucccuccaauucauucuuccuccaggccaugcauuguucuaaauggaaagccuuccuugagugggcugcuagaaaugcagguguauucuaaaaaauaagaacaauaaaaugacccacugaauuugcaccaggaaagcuguaguuuagguggaaugaaggacucgcucaucaaccuucagaacggcaucaggucccgcgacuacacgucggaaagugaagaaaagaggaaucgcuaucauugacaaggcaggaacaggguggcugcaagaggccugugcaauacauguacauagaccauauaaauauauauauauaaauauauauauauacagaauauaaauauauauauuauauacagauuuuaaaaaagagauaaugccuauguaccagggagaaggagcgggcccucccgcgcccugugcuggccggagcagcguuuucuuaugguggagcagcugaggagggcaggaaccgccucucagcaccgaccuccccugaucucccuccucccacccucuguuccccaccccuucccuugcuggccauucuuggcuuuuagaagggaaauguugagccaaaguuaugccugcgaagacccuaaggucucaaaaagaagucuuaagacggcauugcuuaaggugcuucauucccuaauccccuuuugauuuguuuccaaaauaaaagagaaucuuuucuucccuaccccaggcuuccccaggcauucucuugggaacacagaagcaucaagggagcccagucuaaacuccuaggguuggccgcccacuugauccagaccguacugagugucagauggagaggaugcuuggaaagcuaggaaggcugcauugugugguggcaggcucccgagacucguguucugaaggauacucuccuccaucaccccugcaccuuccuccgaccuguguaggguguggacccaguaagggcugggaauuucuuacuuucccacccgcuuucucucuggucuucucccaggcuggaucugggcgaagugucacuuuuuagugccuaaaguccuauuguuucucugugcccuaagagcacauuguuuauuagccaggguggagcguuuucgaccuuauuaaaccucuuuuagugcuucuaagcaagucaggucuguggcucugaggccuucacuuagagcugucagugugauuuccaggaugagucagggugugcugggcccuccaggauuugagagagggagagaaggcccuugccacguccggggugcagggucuacccacagaacacugugaguggugagcaccaagauggguugccagccucauuugcucuuugaacgaaccaacauuagccaguggagacgacugucugagacaguuugcacauagaaaaagcaucugagccacuggagggaaggauuuggcaaaggugcauguguuugggcaggaaaaggccaagugaaaucuaugcccuacgggagccauucccaauccugaguuucucagacuuggcaauggggguucuggcggggguuggaguacaaauccugcucuggucucuggccccacagagguguaagaucauuaagaaguagaaggcacuagcuucaaagagugagacauucagggccuuuucagcauuggcccacuagcaccaugcauuuaucugaauucacggggcccucugggcacauucaucaucccucauacacuaacuacuguuucuucauguaaugaccaaaagagucccaccagcuccaggcagagcuuguggagauucaugaaagagucauagccaguuuggcaugcagaggucuucagucuugcuuauucuucuccugggcuucuugacacaggggcagaagaaaccccagaugucccagaugucccagaacaucagcccaaaagacagaagauuuuaucacucaucuaccccaaagauaaaguuguauuuuuuucuuagaauggccuuuaauucccuguggcaauuacaguuuuugacuuuuccaugugagaauaaggccuugguauuucccuaagggcaggaucagaaaacaggaagguccaugcccaggugauccuccaagggaggagggugaggaggcuccagggcaugagcuagaguggauauuccuccccuagaagaggagaugggaggaaaugcaguuucauguaaucccugugaagagugccuaugcccacagcccaguggguccuuguucaguucuuguccaggccuuugggugagggacacugguagggaucaaggcucaugggcucugagccaaagaaggaggcauggugcagacugcuggaaaucucccccuuggcacagccagaagccaaaacuauucccagaaaguuuugaaugcaaaacuuguagauuccugaauuuauuccauacauaauuauuuccuuaaguuauuuaauuauuaaaggugccacggugggaccuuugggaugacuuaaaaaggguucuuuguugggagucaagugacagagcagaccuggccgcagggaguuguucugcuucugcuuuaccucucaggaccauucccaggaggaaaagguggcagagagggcaguacugaguaugucagaagagcccuccugguuuuuuagcgauuugaacccacuagacaaugugugcacauagggaauguccuuuaagaaucauggaucucuuguaggcucucuguguuccaauaauuuuuugacuaucauaccaggaaaaaaccaacaacucuauucauucccaaacaaaaucucuucccccuuagucaauagcuugcgaaagacaucuuaacucacccuugcagauaagucuuggagugaaacaaauaaauagcauuguauuccuggccauuugccuggcuaguugcugucuacaagggagcaucaaaacaucacuacuucuuauguaacuucuuccagccagugcuuuuauuguucguuuuaguuuacuggggacacacaggagucuuucuguaaugacuuaugugguaaaauguuugagaguuugcacucaauuuuaaagaauuugcaguuucuaacaaggugaagaacagcuauaggaucuaaaguuccauuacagcuuacugugaaagaauugacaagacuggccucagacaagcuaaucauggugcgacucucucccuuccucauccaccucuuuggggacaagaggauuacaucucaggccagcaagaucagcugcuugaagcucuguguaagagcacugcacugacgguuuggagaccugagccuggguccugacuuuuccauugacuaagcucuguggccuugggcaagucacucccccucucugagcuucaguauccuccugucacaggagggaguugggcuagaucaucuuuaagguagguucuagcuuugacaucaucuuggggguuaggccagaggcugggaagacuggguggacuuucucaauugcucugccaggagggaacaagcccagaggcugaagcuucccaguauuuagaggugugguagggcagugucugcauucccaggagacccagggugauuaaaauuuauucuuuagguggcuaggagggcuggggaggcccaguggaagagagagagagagagagagagagagagagagagagagagagagaucgagcuugauguauugcucaguauucacuuagaaggguuucuuucucuuuggccuaguuugugaagggaucuuccuuuggacuuucucuaaguugggagaagaacauucuuuucaauggagcucaucuucuaucucuagggucuguucagccuuucaucuauccauccuuccucuuuauugguagaagaaacaguggagaguagccacuucugguucuagcacuucucuuuuguuaagauaggguuuggauuuaguaugaagcuuuggcuaaaacccuuggguuugccuuagaacacugacacuaagaaccuggaaugacauggggaggacaaagagagcucaagaggaaugcuuugugagaaguggauucucuccgugucccugccccccacccaaacuugaacuauaccuauuacauuuccaggcaguaucccuaagaugagauccuggagaaaggacuaggggaaguaucuuucuggaugcuuguggucccagaaggguacuuucugugucauaccaugccacuucuuuaagcucuucagggcagccaaagccagcccuuuucuccuacugcccccaggagaaauagcacucuucucccuucccccagauggcagggcucuggccucccuacaccucauacccugccugccuccuccaggaggaaucuccggggccccuuccugacucuccccaccuucgccacuugucucuaggcuaugggacaaucaucccauucaccacuugacauccuugacauccuugacuuucauucccccaaccuccagcagguuggccccaauccucuucaccucuguguuuucuucuagaagaugcauuuugggucugagaggagcauuuuccuggaaggccaucuuuuaaggccccugcuugcugucauagugcagagcagaaacuugcacacuauuuagagagcucccuucccaccucucugcccagccuuguuaccucacuucugcucuggccauggcugugaagggcccagccagcucccuguuuugauguucugugcaacagcuccggggucuugugacuggagauccucaacaggcccuggagccaggacuggagucuuggcagcugaugagcagcaccuugccggccaggaggagcugaugcugacgaucuccccaacaucugaaggcuuaaagaacauugucguucuucagcccuccuugcuucucucaauacaauaagacauugcagaagcaaaaggguggccucugcuccaggcaaggcagcuggcucugucuggggcaucggccuggggcuugggugccacgugcugagauugcauagucaaaacagccauuuuugccaacaauagcuuguggcuccccacauuuuccuacccugcacucaagggccagaccacucucugcauggaccagaccaucuucccaaacccauggugcuuuuuccccaacucaaccuagacuccaagguggggagggaugggucagaggccauaguggccccuggauaauccugacgugggguggaguggggugaggcagagggagcagccccaacaccugcacugggccaucuaugggaaagaacacgggucgagugcagucgaguugucuggccaucuguauuuggaucuauaacuguacuuugccuggcgcugugcgcaaggucagaaaacuuacugcuaguaccuagaaacacacaaggcugcccagccaaaucuuaauguaaaguagcuagagccauggaaguacaguaugaauuaaaaagaaaaaaguauugaacuacaauaauaaa

SEQ ID NO: 681 - RNA, 936 nt, Homo Sapiens
auguccaagaccagccucgugacagcguucauccucacgggccuuccccaugccccagggcuggacgccccacucuuuggaaucuuccuggugguuuacgugcucacugugcuggggaaccuccucauccugcuggugaucaggguggauucucaccuccacacccccauguacuacuuccucaccaaccuguccuucauugacaugugguucuccacugucacggugcccaaaaugcugaugaccuugguguccccaagcggcagggcuaucuccuuccacagcugcguggcucagcucuauuuuuuccacuuccuggggagcaccgaguguuuccucuacacagucauguccuaugaucgcuacuuggccaucaguuacccgcucagguacaccagcaugaugagugggagcagaugugcccuccuggccaccagcacuuggcucaguggcucucugcacucugcuguccagaccauauugacuuuccauuugcccuacuguggacccaaccagauccagcacuauuugugugaugcaccgcccauccugaaacuggccugugcagacaccucagccaacgagauggucaucuuuguggacauugggcuaguggccucgggcugcuuucuccugauagugcugucuuauguguccaucgucuguuccauccugcggauccacaccucagaggggaggcacagagccuuucagaccugugccucccacugcaucgugguccuuugcuuuuuuguucccuguguuuucauuuaccugagaccaggcuccagggacgucguggauggaguuguggccauuuucuacacugugcugacaccccuucucaacccuguuguguacacccugagaaacaaggaggugaagaaagcuguguugaaacugagagacaaaguagcacauucucagggagaauaa

SEQ ID NO: 682 - RNA, 1061 nt, Homo Sapiens
gagacgggguuucaccgugucagccaggauggucucgaucuccugaccucaugauccucccaccucagccucccaaagugcugggauuacaggcgugagccgcggcgcccggcagagugcucccuugggcucuagagaggaagccccucuuagcccucagccccucuuuccucccucuccuaaaguaauuugauccucaggaauuuguuccgcccucaucuggccccggccaaaucccgauuugacaaaugccaggaaaaggaaacuguugagaaaccgaaacuacuggggaaagggagggcucacugagaaccaucccaguaacccgaccgccgcuggucuucgcuggacaccaugaaucacacuguccaaaccuucuucucuccugucaacaguggccagccccccaacuaugagaugcucaaggaggagcacgagguggcugugcugggggcgccccacaacccugcucccccgacguccaccgugauccacauccgcagcgagaccuccgugcccgaccaugucgucuggucccuguucaacacccucuucaugaaccccugcugccugggcuucauagcauucgccuacuccgugaagacuggcacccaggcucucccagaaagugagaagggaacucacaggugacuucaccccaugguggggagaacagccugugcugaggucaaggcagaaggaggaugagccccgaggcuccuggagagucugagcccggucuagggacaggaagaugguuggcgacgugaccggggcccaggccuaugccuccaccgccaagugccugaacaucugggcccugauucugggcauccucaugaccauucugcucaucgucaucccagugcugaucuuccaggccuauggauagaucaggaggcaucacugaggccaggagcucugcccaugaccuguaucccacguacuccaacuuccauuccucgcccugcccccggagccgaguccuguaucagcccuuuauccucacacgcuuuucuacaauggcauucaauaaagugcacguguuucuggugcugcug

SEQ ID NO: 683 - RNA, 1002 nt, Homo Sapiens
ucauagcagagcccuaugaaugaaucauguccauuaucaacacaucauauguugaaaucaccaccuucuucuugguugggaugccagggcuagaauaugcacacaucuggaucucuauccccaucugcagcauguaucuuauugcuauucuaggaaauggcaccauucuuuuuaucaucaagacagagcccuccuugcaugagcccauguacuauuuucuuuccauguuggcuaugucagacuuggguuugucuuuaucaucucugcccacuguguuaagcaucuuccuguucaaugcuccugaaauuucauccaaugccugcuuugcccaggaauucuucauucauggauucucaguacuggaguccucaguccuccugaucaugucauuugauagauuccuagccauccacaacccucugagauacaccucaauccugacaacugucagaguugcccaaauagggauaguauucuccuuuaagagcaugcuccugguucuucccuucccuuucacuuuaagaaacuugagauauugcaagaaaaaccaauuaucccauuccuacugucuccaccaggaugucaugaaguuggccuguucugacaacagaauugauguuaucuauggcuuuuuuggagcacucugccuuaugguagacuuuauucucauugcugugucuuacacccugauccucaagacuguacugggaauugcauccaaaaaggagcagcuuaaggcucucaauacuuguguuucacacaucugugcagugaucaucuucuaccugcccaucaucaaccuggccguuguccaccgcuuugcccggcaugucucuccccucauuaauguucucauggcaaauguucuccuacuuguaccuccacugacgaacccaauuguuuauuguguaaaaacuaaacagauuagagugagaguuguagcaaaauugugucaacggaagauuuaacagucauaugugacagaaaaccuggaaaugucug

SEQ ID NO: 684 - RNA, 1071 nt, Homo Sapiens
auuguggcauuauuugaauucagaaaagagugaaaaacuacugggaucuucauuccugggucuaauuccacauuuuuuuuuaagaacacaucuguaaaaauguucuguacuagcauauucccaggaacuucguuaaauuuaaucuggcugaauaugaugacagaacagccaaucucagggcaaguuaagggaauaguggaaugaagguucauuuuucauucucacaaacuaaugaaacccugcuuaucuuaaaccaaccugcucacuggagcagggaggacaggaccagcauaaaaggcagggcagagucgacuguugcuuacacuuucuucugacauaacaguguucacuagcaaccucaaacagacaccauggugcaucugacuccugaggagaagacugcugucaaugcccuguggggcaaagugaacguggaugcaguugguggugaggcccugggcagauuacugguggucuacccuuggacccagagguucuuugaguccuuuggggaucuguccucuccugaugcuguuaugggcaacccuaaggugaaggcucauggcaagaaggugcuaggugccuuuagugauggccuggcucaccuggacaaccucaagggcacuuuuucucagcugagugagcugcacugugacaagcugcacguggauccugagaacuucaggcucuugggcaaugugcuggugugugugcuggcccgcaacuuuggcaaggaauucaccccacaaaugcaggcugccuaucagaaggugguggcugguguggcuaaugcccuggcucacaaguaccauugagauccuggacuguuuccugauaaccauaagaagacccuauuucccuagauucuauuuucugaacuugggaacacaaugccuacuucaaggguauggcuucugccuaauaaagaauguucagcucaacuuccugauguguguaagaagguuccugaggcucuacagauagggagcacuuguuuauuuuacaaagaguacaugggaaaagagaaaagcaagggaaccguacaaggcauuaaugggugacacuucuacc

SEQ ID NO: 685 - RNA, 808 nt, Homo Sapiens
gaagaauaaaaggaagcacccuucagcaguuccacacacucgcuucuggaacgucugagguuaucaauaagcuccuaguccagacgccaugggucauuucacagaggaggacaaggcuacuaucacaagccuguggggcaaggugaauguggaagaugcuggaggagaaacccugggaaggcuccugguugucuacccauggacccagagguucuuugacagcuuuggcaaccuguccucugccucugccaucaugggcaaccccaaagucaaggcacauggcaagaaggugcugacuuccuugggagaugccacaaagcaccuggaugaucucaagggcaccuuugcccagcugagugaacugcacugugacaagcugcauguggauccugagaacuucaagcuccugggaaaugugcuggugaccguuuuggcaauccauuucggcaaagaauucaccccugaggugcaggcuuccuggcagaagauggugacugcaguggccagugcccuguccuccagauaccacugagcucacugcccaugauucagagcuuucaaggauaggcuuuauucugcaagcaauacaaauaauaaaucuauucugcugagagaucacacaugauuuucuucagcucuuuuuuuuacaucuuuuuaaauauaugagccacaaaggguuuauauugagggaaguguguauguguauuucugcaugccuguuuguguuuguggugugugcaugcuccucauuuauuuuuauaugagaugugcauuuugaugagcaaauaaaagcaguaaagacacuugu

SEQ ID NO: 686 - RNA, 688 nt, Homo Sapiens
uuaaguccaacucagcccaaaauacagcauccugacgacaaaacucagcuaucugaccacauuguuaaacuugguuauguuugcagguuaaagaggaaaugauggacaacagaggcaacucuagucuaccugacaaacuuccuaucuucccugauucugcccgcuugccacugaccagguccuucuaucuggagcccauggucacuuuccacgugcacccagaggccccggugucauccccuuacucugaggagcugccacggcugccuuuucccagcgacucucuuauccugggaaauuacagugaacccugccccuucucuuucccgaugccuuauccaaauuacagagggugcgaguacuccuacgggccagccuucacccggaaaaggaaugagcgggaaaggcagcgggugaaaugugucaaugaaggcuacgcccagcuccgccaucaucugccagaggaguauuuggagaagcgacucagcaaaguggaaacccucagagcugcgaucaaguacauuaacuaccugcagucucuucuguacccugauaaagcugagaccaagaauaacccuggaaaaguuuccuccaugauagcaaccaccagccaccaugcugacccuauguucagaauuguuugaguugcuguuuccaaauagaaaugaauaauaucacaaaauggggu

SEQ ID NO: 687 - RNA, 561 nt, Homo Sapiens
aagcaauucuccugccucagccucucgaguagcugggauuacugguaugcaccaccaugcccagcuaauuuuuguauuuuuaguagagaugggguuucaccauguuggccaggcuggucucggacugcugaccucagguaauccuccugccuugaccucccaaagugcugggauuacaggugugagccaccacgccuggccucgacccccuuuuaugcuagccucagcugaccauccugcucacuaguacacugugggucauagggggccaaaaacaugaggcugguaacauuccaucccuguuauucauagaugauauuuaaguuaaugguuguuuuuuuauugaauacauuucaaugccagguauuagaugguauuauccccauguuggagauuaggaaacuaaagugcagagaguuugaauaacaugcccgagacuauaaagcaagaauuggaagccuguucucccugucucuaaagucuucuacuuuuguguuauugaaagaccaacuuagugauggggcacuuguuugcaaagauguguaagugagacagucacug

SEQ ID NO: 688 - RNA, 465 nt, Homo Sapiens
agcagcaaagggaagcagcguccucgccaauaccugggcuguccuucaaggcucagugcaaggaaaaacaccuggguuggacaucagguagugcugacuuccagaccacugaggucaccugcauaagcgagucuggcaacaaauaaucgucuuccagaaaaugaccagaaacucagccugcuuuuugucauuucaccagccccaccaucuuuccuuuauucuagagcuccuggcacacuuacaugaaucucuugaaagaagagaaaugagagcauucauuccauacuaauacaauugugcccuauggaaaggcuuuuugcuggcagacauaguagacggaccauuucccaacuucuuuuucuuugccaccuuccagccaaagguguccauaugacacagcucuggacaggauaauuggaagucuguugugggauuucugagaaagcuuuugauuuucugacagag

SEQ ID NO: 689 - RNA, 117 nt, Homo Sapiens
gcccagcauuuccaguuuggaaugggggaguaucaucugaucuuggaagcuaagcagggucaggccugguuaguacuuggaugggagaccuccugggaauaccgggugcuguaggcu

SEQ ID NO: 690 - RNA, 806 nt, Homo Sapiens
auuccuuucaauuuuagguaaaagaaaccuuuuuaccagauagugacgaguggcuaccaugauuaauaagugacuagaccucaugguccuccucauacuaaaaggugaacagugcaagcugucgguggaucuaccauucuggggucuuggggacaguggcccucuucucacagcucccggugaaugcugcaaugaucauugguaggacuguuaggcuuuguuucucaagaggauaaucugauugggaaaagaauaagagugcagcugcagcccauccuugugaagaagguaccagugcgcucucaaagccaagucuugaaaauaauagcgaaugcuguauuggauaacagccaugccagauacagagaagccacagauggcauugucaccagaaaauggaagcacaaagcgcuuuggguaacagcaauucaagaaugacugcagagaaaaucuauuaagaaauucaaaugcagauuucaauauuuacuccuuuucauucucuuccucucucucucgcucacuugcucuuuuucucucucccaccuuguuuuucucgcucuccuuuuuuuugcauacaguuucucaguaaaauacauuugauuaaauuuuauaacaaacaagcuuaugaaaugcagauauacaaaaaggaaaacauaagaagcaugcauaauucuaccacugaaaaauacuacuaaaauuugguauuuaaacuuuugaauguuugucacugcacuugcauguguguguaaauauaaucuccaacucugcagagaaauacaagaauuguuaugaaccuuaauaaacuc

SEQ ID NO: 691 - RNA, 860 nt, Homo Sapiens
uacugggcccagucccaggacuauccaagugugaagccaacaccuuuucacaucaacuccaaguuccaugggcugacuggacuccacugggaguucuugaugucucucgugugguugugugagauaguggcugggacuggacucaucugaaggcuugacugggcuggaugcccaagauagcccacuuuuagacagagguggcuggcaguugaugcugacugucagcuggggacucagcugagaguguuaacuggagucccuagacguggcuucuccacauggcuugggcuucucauggaagggcaccuggauucugagagagagcaucccaagagacacaaguggaaaugauaaggcuucuuaugacguagacuggagguacugagacaucacuuuugcuacauuagaagguuagaugcugacauuuuaugauuucacaacuuggauccucuguccucugauacugaaucagauaguaguuuauggagcugagcagagagccagcugguccugggcacagaggaggcuguguuccaugcugaagacaagaacauaugguggacguaccauccuaacuaucugggaagggagcuucguggcuacaugggaguuaucaucugccagugccggcugcauccuggcugugcccaccucuggacucugaaucucugcaccucaguacccccaaccccaacacgacugugauguuaggcauauauuaggcaugugaagaugagaaagagaagauacagcucccauguuuaucuccaugagaagauaagccacagggagagagaaagacuguugugcacgagagggagugucaaaugccaaauggaugucagcagucggggugugcu

SEQ ID NO: 692 - RNA, 946 nt, Homo Sapiens
auggaaaauaagacagaaguaacacaauucauucuucuaggacuaaccaaugacucagaacugcagguuccccucuuuauaacguuccccuucaucuauauuaucacucugguuggaaaccugggaauuauuguauugauauucugggauuccugucuccacaaucccauguacuuuuuucucaguaacuugucucuaguggacuuuugcuacucuucagcugucacucccaucgucauggcuggauuccuuauagaagacaaggucaucucuuacaaugcaugugcugcucaaauguauaucuuuguagcuuuugccacuguggaaaauuaccucuuggccucaauggccuaugaccgcuaugcagcagugugcaaaccccuacauuacaccacaaccaugacaacaacugugugugcucgucuggccauaggcuccuaccucugugguuuccugaaugccuccauccacacuggggacacauuuagucucucuuucuguaaguccaaugaaguccaucacuuuuucugugauauuccagcagucaugguucucucuugcucugauagacauauuagcgagcuuguucuuauuuauguugugagcuucaauaucuuuauagcucuccugguuaucuugauauccuacacauucauuuuuaucaccauccuaaagaugcacucagcuucaguauaccagaagccuuuguccaccugugccucucauuucauugcagucggcaucuucuaugggacuauuaucuucauguacuuacaacccagcuccagucacuccauggacacagacaaaauggcaccuguguucuauacaauggucauccccaugcugaacccucuggucuauagucugaggaacaaggaagugaagagugcauucaagaaaguuguugagaaggcaaaauugucuguaggauggucaguuuaac

SEQ ID NO: 693 - RNA, 1838 nt, Homo Sapiens
gagaagauggcuaagaguauaucccaggauugcaaagaugucggagcccagccucagacgaauugacuuaauauuguucuagaauagccuuucagcuacaagagguuauauauaaaucaaaagcuucuugaguaaaacuucuuagaauuguagaagcugcucaauauggaacauauucucaguccuccucuggucuacaaagccugugauuucuugucuauggacagaacgucugguuuaaucuacaggaacccauaacuuccugaagcuuuaugcuuaacagugacaacgugagucaguugaauuuuauuguguuucaguccguagaguauuagcuacagaaaccuuuccauugccauacugagaaacugcagcaggcagugugccuacaggucuacaaagaaacuucagagucucacacugucacccaggcuggaaugcaguggugcgauaucagaucacugcaaccuccucuuccuugguucaagcaauucuccugccucagccuccugaguagcugggacuacugacacucaccaccacacccagaucaucuucuugagggaaagaagcugaagugcuacauaagaugcuugugcuucauaacucucagaagcugcagauucuguauaaauccuuagaaaagagcaucccugaauccauaaagguauauggcgccauuuucaacauaaaagauaaaaacccuuucaacauggaggugcugguagaugccuggccagauuaccagaucgucauuacccggccucagaaacaggagaugaaagaugaccaggaucauuauaccaacacuuaccacaucuucaccaaagcuccugacaaauuagaggaaguccugucauacuccaauguaaucagcugggagcaaacuuugcagauccaagguugccaagagggcuuggaugaagcaauaagaaagguugcaacuucaaaaucagugcagguagauuacaugaaaaccauccucuuuauaccggaauuaccaaagaaacacaagaccucaaguaaugacaagauggaguuauuugaaguggaugaugauaacaaggaaggaaacuuuucaaacauguucuuagaugcuucacaugcaggucuugugaaugaacacugggccuuugggaaaaaugagaggagcuugaaauauauugaacgcugccuccaggauuuucuaggauuuggugugcuggguccagagggccagcuugucucuuggauugugauggaacaguccugugaguugagaauggguuauacuguccccaaauacagacaccaaggcaacauguugcaaauugguuaucaucuugaaaaguaucuuucucagaaagaaaucccauuuuauuuccauguggcagauaauaaugagaaaagccuacaggcacugaacaauuugggguuuaagauuuguccuuguggcuggcaucaguggaaaugcacccccaagaaauauuguugauugauuccacuguccauuucaaaucuuucuuaucaguaaaaaaacauuaauucaaacacaagcauugugaucuacauuagcacaaaaugcaacugauuaucuaggaucuguguauuacuuaagcucacccuuaacaguuuuaccuuccuucuccucuguauucuuacagaaaauuagaagcucaauuuuauggucucauaauuuccuuuaugacagacaucucagaauuaaaaucacccaaagccaaucauuagugccaagauaacccuuuaacggcaacacuuucuuaaaugaagacuauuucuuucaugaaaaaauucacuuuuaugacuuucuuguuaaaauaaaaagucugcuuuuaaaa

SEQ ID NO: 694 - RNA, 82 nt, Homo Sapiens
cugacuuuuuuagggaguagaaggguggggagcaugaacaauguuucucacucccuaccccuccacuccccaaaaaagucag

SEQ ID NO: 695 - RNA, 1548 nt, Homo Sapiens
acgaguggugaccaccccuuccagcaggcagguucccagccccagccaagcaguguuucuccaggagccggacagccucucugucuccauggcagccuuccuaucugcuggccucggcauacuugcacccucagagaccuacccccuaccuacaaccagcucuggcugggagccccggcuggggucaccauucccaucaggcccuugcaccagcucuacuggggcccaagcuguggccgagcccacugggcagggccccaagaacccacguguguccagagugacaguucagcuggagaugaagccucugugggaggaauucaaccagcugggcacugagaugaucgucaccaaggcaggcaggaggauguucccccccuuccaggugaagauccugggcauggacucccuggccgacuacgcccugcucauggacuucaucccccuggacgacaagagauacagguaugccuuccacagcucggccuggcugguggcgggcaaggcagacccagccacaccuggccgcgugcacuuccaccccgacucgccagccaagggugcccaguggaugcgccagauuguguccuuugacaagcucaagcugaccaacaaccugcuggaugacaauggccacaucauucucaacucuaugcaccgcuaccagccccguuuccacguggucuucguggacccacgcaaggacagugagcgcuaugcccaggagaacuucaaguccuucaucuucacagagacccaguucacagcagugacagccuaucagaaccacaggaucacccagcugaaaaucgccagcaacccuuuugccaaaggcuuuagagagagugaccuggacuccuggccuguggccccacggccccugcucagugucccagcccggagucacagcagccucagucccugugugcugaagggugccacagacagggagaaagaccccaacaaagcuucagcuuccaccuccaagaccccugcuuggcuccaucaucagcugcugcccccaccugagguccugcuggccccggccaccuacaggccugucacguaucagagccuguacucuggagccccgagccaccuagggaucccaaggacccgaccagcaccauacccccuccccaacauccgggcugauagggaucaaggaggccugccucucccagcugggcuggggcuccugucccccacuguggugugccuggggccuggccaggacucccagugaugccagaagcccuggggggaagcccugcuacccuggaccuuacaccgggugugggaaucagccucugccccgcccccuccagccccaucucugucucaaggagagcaggguaggugaaagucuagagaaagaggcuaccugcccagggucacagcaaggcugggaccauggcaagcuuggaaccaggacuucuaucucccaaccccagcagccugaauacugugcccucuugcuuuggggguaacucccgaaaacccugccuuaccucucccuucccccuaacauuaaacuauuuggcauga

SEQ ID NO: 696 - RNA, 4009 nt, Homo Sapiens
gccgcgcggccaggacugucugaggggaaguucgcgagcgcuggcuauggguccuggggcgcggcuggcggcgcugcuggcggugcuggcgcucgggacaggagacccagaaagggcugcggcucggggcgacacguucucggcgcugaccagcguggcgcgcgcccuggcgcccgagcgccggcugcuggggcugcugaggcgguaccugcgcggggaggaggcgcggcugcgggaccugacuagauucuacgacaagguacuuucuuugcaugaggauucaacaaccccuguggcuaacccucugcuugcauuuacucucaucaaacgccugcagucugacuggaggaaugugguacauagucuggaggccagugagaacauccgagcucugaaggauggcuaugagaagguggagcaagaccuuccagccuuugaggaccuugagggagcagcaagggcccugaugcggcugcaggacguguacaugcucaaugugaaaggccuggcccgaggugucuuucagagagucacuggcucugccaucacugaccuguacagccccaaacggcucuuuucucucacaggggaugacugcuuccaaguuggcaagguggccuaugacaugggggauuauuaccaugccauuccauggcuggaggaggcugucagucucuuccgaggaucuuacggagaguggaagacagaggaugaggcaagucuagaagaugccuuggaucacuuggccuuugcuuauuuccgggcaggaaauguuucgugugcccucagccucucucgggaguuucuucucuacaggugaugguugugguuagaagcacacugggcuccucagagaaagaugcuuugggagcauuagaacaauucagcaucuccuucugagaugcauugagagucaugcaaagaggccagcaggccacggguagcucugccaaugcauggggcaucuugcagccaaaguggguacaaacaggcccagauaauaagaggauggccaggaaugucuugaaauaugaaaggcucuuggcagagagccccaaccacgugguagcugaggcugucauccagaggcccaauauaccccaccugcagaccagagacaccuacgaggggcuaugucagacccuggguucccagcccacucucuaccagaucccuagccucuacuguuccuaugagaccaauuccaacgccuaccugcugcuccagcccauccggaaggaggucauccaccuggagcccuacauugcucucuaccaugacuucgucagugacucagaggcucagaaaauuagagaacuugcagaaccaugggugaguguccugagaacccgccaagaauuucucuuucaucuucacaugccuggaguucaggaguguaagaauaggcaaccugaacaacuagacaccucaaagagccaaggaguucagaaugccaaccauuccauaaaacuaguccaugguggaaaaaaaucacaauagugcuugccucuagagggaaaggauuaacuggaugauguacaagaggauucucugggguauugaaaaugugcucucaauaucuuguuagggacgugguacauguggcuguaugcauuugucaaaacucaccaaaugguccacuugagaccuguguauaucauuguauguaaguuuaaccuaaaaaaagacaaauaaaaaagaacacuuccuacagaggucagugguggcaucaggggagaagcaguuacaaguggaguaccgcaucagcaaaagugccuggcugaaggacacuguugacccaaaacuggugacccucaaccaccgcauugcugcccucacaggccuugauguccggccucccuaugcagaguaucugcagguggugaacuauggcaucggaggacacuaugagccucacuuugaccaugcuacgucaccaagcagcccccucuacagaaugaagucaggaaaccgaguugcaacauuuaugaucuaucugagcucgguggaagcuggaggagccacagccuucaucuaugccaaccucagcgugccugugguuaggaaugcagcacuguuuugguggaaccugcacaggaguggugaaggggacagugacacacuucaugcuggcuguccuguccuggugggagauaaguggguggccaacaaguggauacaugaguauggacaggaauuccgcagacccugcagcuccagcccugaagacugaacuguuggcagagagaagcugguggaguccuguggcuuuccagagaagccaggagccaaaagcugggguaggagaggagaaagcagagcagccuccuggaagaaggccuugucagcuuugucugugccucgcaaaucagaggcaagggagagguuguuaccaggggacacugagaauguacauuugaucugccccagccacggaagucagaguaggaugcacaguacaaaggaggggggaguggaggccugagagggaaguuucuggaguucagauacucucuguugggaacaggacaucucaacagucucagguucgaucagugggucuuuuggcacuuugaaccuugaccacagggaccaagaaguggcaaugaggacaccugcaggaggggcuagccugacucccagaacuuuaagacuuucuccccacugccuucugcugcagcccaagcagggagugucccccucccagaagcauaucccagaugagugguacauuauauaaggauuuuuuuuaaguugaaaacaacuuucuuuucuuuuuguaugaugguuuuuuaacacagucauuaaaaauguuuauaaaucauuucuugaaaugcaaauaaggaaccacuucacacuuccuaggauggauacaauuaaaaaacagaaaauaagugucacuacggaugugaagaaacuggaacucucaugcguugcuggugggaaugugaaauggugcagccacuguggaaaacagauuggugauuucucagaaagauaaacauagaacugucaucugacccaguuauuccacucccagguauguaucugaaagaauggaaugauagcuguacacccauggucauagcagcuuuauucacaaucgucaaaagguggaagcaauuaagaagacuaaagcugaggcaagucagauaacuugcccagagucaaaaaauuacuggaaaagcaguauucaaaacucaguuuuccgaacuucagagaccuuacuuuuaccaucuuaccaugcugucuucuaaacagguauuuauaccuuuuuauaucuggauuaucuugagccuuucccuuuccuaaaacuucuaacaauaagaaaaauacuggccagcugcaguggcucacaccuauaaucuucgcacucugggaggccaaggcagguggaucacuugaggucaggagcuugagaccagccuggccaaaauggugaaacuccaucucuacuaaaaauacaaaaauuagcugggcgugguggugcaugccuguaaucccacuacuggggugggugaggcccggaacugcuucaaccugggagguagagguugcagugagccgagauuggucccaccgcacuccagccugggcaacagagugagacuccaauucaaaaaaaaaaaaaaaaaaaggauaggacacuuuaaaggaaacacuuacugccauuucaaccuggaaccucagccuguccuauuccccacaacacuaugagccauuucuaagagaucagcuccaccgucagagacaaggcauaaucucacaagccccuccuacaugcacacugaacuucacagggaaaugacaaauuuaagaccaagggggaagaguaagaccuacuguuugacuuggccaaccauugagacacgggcagacuccagauuucgaaucuggccacucuucacacugggaaagaaaagaaaggaagagagaagguuauucaguaucuauuguaucacaucauuggaaucaaauaaauaauucuacagauuaugugagaccuaau

SEQ ID NO: 697 - RNA, 831 nt, Homo Sapiens
cugugauguggaggccauagcuccacuggacucaugaggagacugaggcucagagcaaugaagugaccugcucaaaguuaaggagcuucaguuuggacccaauuuguucugauccuaaggucacuauccuuaaucccucucccuguggggucuucccuaucuugagccuguggacagcugugcaguggcaagaaaaaggccuucagagcuacgcagaccuggcuucaaaucccagccucccugaugagcccugguggucuugcaugcuugcccuugggacucagacaccauauugugaggaagcccaagcuacaugcagaggccacuauaguuguucuggccaacagcccaagcuucagcugccagacauauaaauaaaccaacucuucaaaugauuucaguuuccagacuucagugcaucccagguaauguccagaggagcagagaugaaccauccucucugagcccugcccaaaugcagacuugagaacaaacuaaaugucauugucucaagccaccaauuuucaggguggcuugguacacagcaccagguaacaggaauagccccccucuuccucugcagcucuccccagguacaggcaagcuccccaacccaugcuucauccccaccccacagacagaaccuggagucaguccucccacccacaacugugccuuccaaacuaagcucaaagcccagcucuguugcuuucagaugggugcccuagggcaagucaccaacccuauaugacaaaucccucugugucaaaugggaauuauaauagugccccugaggagucuuggagagauuuaauaaagugccuggaacau

SEQ ID NO: 698 - RNA, 1595 nt, Homo Sapiens
agugcuguacaaagagacagaggcuguuagcuauggcugagcuuugucuaaagcaagggcaaaacucuuuaagcugugcccagaguugaaggagucuuuauauuucugauagaagacaguggcaaaaaaaaaaggcguaagaauuuugaagcuauguucaaagguauccuucagaguggauuggauaacuucgugauaaaccacaugcuaaagaacaacguggcuggacaaacaucuauccagacccuaguaccuaauacggaucaaaagucgaccaguguaaaaagaagacaaccacaaaaaaaaaacaguuaagauguuggaauaccugggcaaagauguucuucaugguguuuuuaauuauuuggcaaaacacgauguucugacauugaaggaagaggaaaagaaaaaauauuaugauaccaaaauugaagacaaggcccugaucuugguagacucuuugcgaaagaaucgcguggcucaucaaauguuuacccaaacacuucucaauauggaccaaaagaucaccaguguaaaacgcucuucugcaaaucgaggcuggaccaccugagucagcagaaucuacaaauauacucaaacuuuguccucgugaagaauuccugagacuguguaaaaaaaaucaugaugaggaucuauccaauaaaaaagagagaggaccgcagacgccuggcucucaucauaugcaauacaaaguuugaucaccugccugcaaggaauggggcucacuaugacaucguggggaugaaaaggcugcuucaaggccugggcuacacugugguugacgaaaagaaucucacagccagggauauggagucagugcugagggcauuugcugccagaccagagcacaaguccucugacagcacguucuugguacucaugucucauggcauccuagagggaaucugcggaacugcgcauaaaaagaaaaaaccggaugugcugcuuuaugacaccaucuuccagauauucaacaaccgcaacugccucagucuaaaggacaaacccaaggucaucauuguccaggccugcagaggugaaaaacauggggaacucugggucagagacucuccagcauccuuggcacucaucucuucacagucaucugagaaccuggaggcagauucuguuugcaagauccacgaggagaaggacuucauugcuuucuguucuucaacaccacauaacguguccuggagagaccgcacaaggggcuccaucuucauuacggaacucaucacaugcuuccagaaauauucuugcugcugccaccuaauggaaauauuucggaagguacagaaaucauuugaaguuccacaggcuaaagcccagaugcccaccauagaacgagcaaccuugacaagagauuucuaccucuuuccuggcaauugaaaauuucagcuaaagaugggguccuugucacacgaccaugagaaauuagacucacagacaaucugaaaggaaaccacaggcagcccagcccuccucugucaacaucaaagagcacauuuaccaguauagcuugcauagucaauauuugguauuucaauaaaaguaaagacuguaucuuuuua

SEQ ID NO: 699 - RNA, 1221 nt, Homo Sapiens
gcuccuugcugcuuuucaacaccaccgagaaccuguagaagaaguaugucuuccuggacccccuggcuggugcuguaacaaagacccaugugaugcugggggcagagacagaggagaagcuguuugaugcccccuuguccaucagcaagagagagcagcuggaacagcaggucccagagaacuacuucuaugugccagaccugggccaggugccugagauugauguuccauccuaccugccugaccugcccagcauugccaacgaccucauguacauugccgaccugggccccggcauugcccccucugccccuggcaccauuccagaacugcccaccuuccacacugagguagccgagccucucaaggcagaccuacaagaugggguacuaacaccacccccaccgcccccaccaccacccccagcuccugaggugcuggccagugcacccccacucccacccucaaccgcggccccuguaggccaaggcgccaggcaggacgacagcagcagcagcacgucuccuucaguccagggagcucccagggaaguggucgaccccuccgguggcugggccacucugcuagaguccauccgccaagcugggggcaucggcaaggccaagcugcgcagcaugaaggagcgaaagcuggagaagaagaagcagaaggagcaggagcaagugagagccacgagccaaggugggcacuugaugucggaucucuucaacaagcuggucaugaggcacaagggcaucucugggaaaggaccuggggcuggugaggggcccggaggagccuuugcccgcgugucagacuccaucccuccucugccgccaccgcagcagccacagguagacgaggacaaggacgacugggaauccuagggggcuccaugacaccuucccccccagacccagacuugggccguugcucugacauggacacagccaggacaagcugcucagaccugcuucccugggagggggugacggaaccagcacuguguggagaccagcuucaaggagcggaaggcuggcuugaggccacacagcuggggcggggacuucugucugccugugcuccauggggggacggcuccacccagccugcgccacuguguucuuaagaggcuuccagagaaaacggcacaccaaucaauaaagaacugagcagaaaccaacagugugcuuuuaauaaaggaccucuagcugugcagga

SEQ ID NO: 700 - RNA, 1410 nt, Homo Sapiens
aauacucuccccagcacacggaaggggaaggggguggagguugcugcuaugagagagaaaaaaaaaacagccacaauagagauucugccuucaaagguuggcuugccaccugaagcagccacugcccagggggugcaaagaagagacagcagcgcccagcuuggaggugcuaacuccagaggccagcaucagcaacugggcacagaaaggagccgccugggcagggaccauggcacggccacaucccugguggcugugcguucuggggacccugguggggcucucagcuacuccagcccccaagagcugcccagagaggcacuacugggcucagggaaagcugugcugccagaugugugagccaggggaggcaccaccuugaagagggcagagaaccagcccuucucaggccuugaucccuuacccucuccucccaggaacauuccucgugaaggacugugaccagcauagaaaggcugcucagugugauccuugcauaccgggggucuccuucucuccugaccaccacacccggccccacugugagagcugucggcacuguaacucuggucuucucguucgcaacugcaccaucacugccaaugcugagugugccugucgcaauggcuggcagugcagggacaaggagugcaccgagugugauccucuuccaaacccuucgcugaccgcucggucgucucaggcccugagcccacacccucagcccacccacuuaccuuaugucagugagaugcuggaggccaggacagcugggcacaugcagacucuggcugacuucaggcagcugccugcccggacucucucuacccacuggccaccccaaagaucccugugcagcuccgauuuuauucgcauccuugugaucuucucuggaauguuccuuguuuucacccuggccggggcccuguuccuccaucaacgaaggaaauauagaucaaacaaaggagaaaguccuguggagccugcagagccuugucauuacagcugccccagggaggaggagggcagcaccauccccauccaggaggauuaccgaaaaccggagccugccugcucccccugagccagcaccugcgggagcugcacuacagcccuggccuccacccccaccccgccgaccauccaagggagagugagaccuggcagccacaacugcagucccauccucuugucagggcccuuuccuguguacacgugacagagugccuuuucgagacuggcagggacgaggacaaauauggaugagguggagagugggaagcaggagcccagccagcugcgccugcgcugcaggagggcgggggcucugguuguaaaacacacuuccugcugcgaaagacccacaugcuacaagacgggcaaaauaaagugacagaugaccacccugca

SEQ ID NO: 701 - RNA, 3181 nt, Homo Sapiens
uuccuugccccuccuccccgagucaccaccguccaguuccccacccugcacucguuucccgcccccccccgccccccacaaagcuguccugccuucccucuggccugggcucacuggcaggacgaccccgggagagaggguccuggagagugagaggggcagagaccgagugagccgugggcugagccugggaggccgggacugagggggaggagggaggcccgggggaagggagggagggagagagggaaggagggaggagggcgggcgagcuggagccggcaggcagcgggagcccgagagagccgcgucgggagugcggucuccauggcagugcugggcgcagccggagagagccuguccagggggcugagccccacccccaaaucccuggggcauccagaagauuccugacuggucaagaaccagaggcaaaagagaccuggaagucccagcauggggaccagaaccccccagccagccucauaguugggaaaguagccagcuugccugccccaucaauugcagggaugcuuaaggaaggccccgcccaguaugaaagcugaggauugccucugcugacccucagucuccuccccugcccucuacaucugcccucagcuggguccaucaugcaaugcugagcacuggggugagccugggggcagccugccugcugacagggcgaggauuguggggaucaugggaguguuugugaguggggcuccugggugagaccuagcccccacccccacagagcucaaggggguggggggcugaggauaggauggcucggggcggggcgggggcagaggaggccucccugcgcuccaacgcauuguccuggcuggccugugggcuccuggcgcugcuggccaaugccuggaucauccucagcaucucggccaagcagcagaagcacaagccacuggagcugcugcucugcuuccuagcgggcacacacauacucauggcagcugugccccucaccaccuuugccguggugcagcugcgucgucaggcuuccuccgacuaugacuggaacgagaguaucugcaaggucuucguguccaccuacuacacccuggcgcuggccaccugcuucacggucgccucccucuccuaccaucgcauguggauggugcgcuggcccgucaacuaccgccucagcaacgccaagaagcaggcacugcaugccgucaugggcaucuggauggucagcuucauccucuccacacugcccuccauuggcuggcacaacaacggcgagcgcuacuaugcccgcggcugccaguucauagucuccaagaucggccucggcuuuggcguuugcuucagccucuugcuacuugggggaauugucaugggucuggucuguguggccaucaccuucuaccagacacugugggcccggccccggagggcucggcaggcccggagaguggggggugguggggggaccaaagcgggugggccaggggccuuggguacccggccagcuuuugagguaccagccauugugguggaggaugcccgagggaagcggcgguccucgcuggauggcucggagucugccaagacaucccugcaggucaccaacuuggucagcgccaucgucuuucucuaugacucacucacaggggugcccaucuuggugagaucgggguccuccccaccuguucuccccaauauccaggccccagcaucaucaccugaccuccaacuucaucagccauacagcagcuccgucaucucuccuccaguuccaucauccaucuuccucuccucuguccaucccccacuccauuuguggcccccaucuugaucaucugucuuuuaguucccacuacccuguuuaccccagcuccagcaucugcuucaguucccacuccucagcuccaucaccguccuucaguuccacgaccuguccuccagcuccgucauccauccugcagcuccacgguucagccgcagaccucucauccagccgcugggcuccacucuccauucccuccuucccucgggcugccacauggucucugagcacucuuggcuggaaauguggugagcuucuucucccucaagucggacucggcgccccccuggauggugcuggcugugcuguggugcuccauggcacagacgcugcugcugcccuccuucaucugguccugcgagcgcuaccgcgccgacgugcgcacagugugggagcaaugcguggccaucaugucugaggaggauggagaugacgaugggggcugugacgacuaugcagagggccgaguuugcaaaguucgcuuugaugcuaacggagccacaggaccagggagccgggaccccgcccaggugaagcugcugccuggaaggcacaugcucuucccuccucuugagagaguccacuacuuacagcaggucccccuaucccggcgucugucccaugaugagacaaacaucuucucuaccccucgggaaccaggcuccuuccugcacaaguggucauccucugaugacauccggguccucccagcccagagccgggcccucggggguccuccugaguaccugggacaaagacacagguuggaggacgaggaggacgaggaagaggcugaagguggggggcuggccagccuucgccaauucuuggagagugggguucuggggucaggugggggacccccacgggguccuggcuucuuccgggaggagaucaccaccuucaucgaugagacaccucugccuucuccgacugccucaccagggcacucuccucgucggccccggccacugggccucucaccccgccgacucucccuuggguccccugagagcagagccguuggacuuccuuugggacuaagcgcagggagacgcugcucccugacggggggugaagaaagugcaagggcuuggggaggauccuggggcccaggcaaccccaucuuuccccagcugacccugugagcccaagcaggccugcugaacucagaggagaaagccugagugaguaacaccucauucuggccgagaguagggcagcugccuccagacucuggggagacgggcgcuagauuuggggcucagaaggcccugcucucucccauccaagugaccagaugcccuacucagcuuccaucaccccuagcaauauguauuaaagucugaaguguugccauggaaa

SEQ ID NO: 702 - RNA, 2013 nt, Homo Sapiens
gccuggcaagguuuagcggaggccugcagucugucugcuccucagcaccaugaauucgacuccaugcagcucuccaucuuugaaaaagacuucuuuugagcuaacuuucuuauacugguaccuuucuaaucucacuacaauauguaacauugguguucgaucucaaguauuucugaauauauuccccuauccacagaaauauacucugggggaaaaaaaauagaacaaauucuugccguccugaccauugaacaagagacuaauuagacaauggggcuagaaaaaccucaaaguaaacuggaaggaggcaugcauccccagcugauaccuucgguuauugcuguaguuuucaucuuacuucucagugucuguuuuauugcaaguuguuuggugacucaucacaacuuuucacgcuguaagagaggcacaggagugcacaaguuagagcaccaugcaaagcucaaaugcaucaaagagaaaucagaacugaaaagugcugaagggagcaccuggaacuguuguccuauugacuggagagccuuccaguccaacugcuauuuuccucuuacugacaacaagacgugggcugagagugaaaggaacuguucagggaugggggcccaucugaugaccaucagcacggaagcugagcagaacuuuauuauucaguuucuggauagacggcuuuccuauuuccuuggacuuagagaugagaaugccaaaggucaguggcguuggguggaccagacgccauuuaacccacgcagaguauucuggcauaagaaugaacccgacaacucucagggagaaaacuguguuguucuuguuuauaaccaagauaaaugggccuggaaugauguuccuuguaacuuugaagcaaguaggauuuguaaaauaccuggaacaacauugaacuagaaacucagaaagugguccuugugauggaaagagaaaagaaaaaccaauuagaauaaggcagaauguacgugcgucauuggaacacagaaaacaugcugguucauacagcguuuuuagucauaauggucuuuuuuauuuuguuugauucauucgagacaacauguguguauguguguguguguguguguagauaaugugguuuuuguaugguguuugauggaaggaauaaucuuucuuugcuuucuuaguaguauuucaagguguuuacuuuucaauuggugugcacugaaugcauguauggaagaauagcgugaauaaugcaaucucuuugucauuuuuccccuucucagacucuuagcucuuaaaauucaaagaugggauauucuaacugguaguggugcaucauuuuuaacccaaauauugcaagcacuuuaaagauuugaaaccacauuuuuauuguuugauguuucauuuucagacuuuuuaaugucagucauuacaauuacauugcaugaggaaaauuuuuccagaacaacaguguggaauaguucugaauuaugcuguucuacagauagaaaaaaaguccaaaugccuuuaaaaauuuacuucuuacuccacccaacacguuuuugcaaagcaagaagucuuuguaagacaccuuaaacaaaguccuucaauucuacagcagaggaaauaaaaucccccagaagccaaagggcucaccuucacauuguuaguucaugacagacccaggugugcuucauuagagauaacauacauucccuuugguaucacaggaaguuacuggggauuacucgaccucauuacuuagcuaacgacuggauaaaauuucuuaauuguuugaaguaacauuguauucguguuugcauuauuaauuugaauagaaaauaaucacauuuucaacccauuuauacaaauuguuaauguuucuuuagagcuguauaacuauaguuugaacuagcaaggaaguuauuguuuugacaaccagaaauuaugcuuuucuggugcaugaaacauuaauugcaaagggcagucacauccaacuuuaauaaaauaugguggucuuucuuaaaa

SEQ ID NO: 703 - RNA, 2187 nt, Homo Sapiens
caucagcccagccugcaaggaggcgccaccggaccugcacacucaggagcagacucagcuagauuggaagagaggaugggaagacaauggaugaccuaccuguggagagaaacuacccauuccagaaccuccucucugcugaaagcugaacacucaaugggaagaccuguuugcagagaggagccagccacuccagggucuccguucugcuagaagcugaacacucguugggacacccuugcuguggaaaggacauccuuacuguggaaaugagcuacuaacugcaggagcugaggagcugcacagcaagguuaaaagagcuguaacacaaacagggcugcaacaugccccuugcuccccacagggagagaagagcucuggcccucggagaagcccagaccugggagcuccuugagcccgggcugugacucccucuuuggggcccugguuggcgucacugcauucgccagugccacuguuggaagcugcuugugaugcgccugguccagggggaagcuguuuguugugugccugguccagccaccucauggagagccugugcuggcaccuggagcugcccaaccugggcagcagcuugugugugugacugcacaguggccacgcuugcucacacaccccuagcacaccccucugcuccacccgucucaaucucccuuggauccgggauccagguugguagcaagugcgagugggcagaagcagcccagugggcccagagcaaaacucaggcaaaggugccacuagacuggccaggaaagcgacacccuaaagaucccauaaugcugauauguuaauucuauucuauaagcaccacacagaagugauagcuuuuauuucuuauuuugucuagccuggagacagagcuaaggauuccuugaacugcaaagucuuuuccaguucuuaguuuauacaauccauacucaccuucugccuaacuaagcauugucauuuuugugccaaaugaagaguaggacuccuacgauuguccucagacucucuuggcucaauccuccugcuuuaaccuuuccuacuucaaaaacuccugaaguuuugcuuccccuucuauagaauggaaauauaugucgcaauacuuacugcaaagaaaauuauauauuuuaaaaauagacuaaagagauguugugagacaucagacaucaaucagauguugugagaacugauuucugcaucagaauaucuccuugacuuuacagcuauccuuuaauccuggcucaaaguuccagaagaaagaugauccaauauaauacuccuauuuggacuuugagucauacacauuccuucuucugagaaaacgugcuucugcaugaauccucccuucauuauuuucagcucaucuauuauugaaucugaaaccccagguuaacugacugaucacucucaucaguggcagauuuugguguaacauaggacacaucacucccaauucaggucaagucccaauuaucuugccucucaauaugacauguucaauguuguauuucauucuacuucauuuuaauguaaaaagucuuuucuggugaagucagucuuuuauuuucucauaaaaauucacccuuuggguuuuucauaggguauucccauaaccaaacacacuuuacacuuuccuaguacauaacccaauacuuucuucuuuccccacaguccuuacaugaagccuacucagaccgacaucacuguaucauuuuuuuguauucugaaguccuucagcacuugauuccuuuaaguuuaaucuugguauucuauugggaaucauauggaaauguacaaugauauuuauugaaugaacaggaaacagggaaagacauugaccagaaaaaguguuuauucaucaagucuuuaaagauacaaaaacacgugucuucuguggagcucugagaacaggacuccagcaaagcacuuuucagccuuguggucuucaagcauuuccaagaucugugacauuggaaagaaaaaaaauuaagacagauuugggucuccaugagcagagaguauucuuucccuuaguucuggguagcauagugcccaaggaaaccuaaucaguacagugggaaaccaaaucuauuccaaaucauuacccauaagcaauccuauggacucucugagguuugacagagucagcggcccucuccaauaaauguguuuuucuau

SEQ ID NO: 704 - RNA, 2469 nt, Homo Sapiens
uuuuuugccgucuggucauccucgucggucuucugcuucuggguaucgacaucguuauccucaucaucuucagcugcccgcuugcccguagcugacucagcucccucaucuucaucuccauccucuuccucaccaucaccuucuuccuccccaccuucuuccucuucuucaucuaccucguugucagccuccggcuccccauuuuccucauuagcauucccgugagcaggggcgucucuuccauuuuccgccucuuccacaacuuccuucuucuccuuuaaguccucgguggugauuucggagcuggugucuacggcugcgucugacaugguggggcacgccggugacgcgaugcaggggauaaaaaagaaagcgacaguucagggacucuggcgauaaagcugccggaguccgcggcggcggaggcggcugcggcgagcaaggaggcugacgacgcacaaugcaaagacggcuuuucagagcagccaguggggcaggacaauguuuuucaucaaauguccuuagauuuggaggagguuuccccaguguauccagugguugucuuccucuugauuaauauuaaaggaggagaaaaaguguguauuggggucagugcagaaaacaaaucauccaagcacacgaaguggaauuugcuaauagcauuacuacucacccagugacuucggagucacaacccaggacacgguuuuccgcccauuucuacagacacagugagauucuucauucuucucuguuggaacagccaggaaagcggaagagaccuccagcugcacaacgaccugucccccacacccaaccacaaguuuaugaagggaugcagaacagcaugaauacugcaaaagaugcucugugcaucagguaaauggacugagggacaauguccaugaguccagaggcgcugagaagcugugcaaauauggucagcucuaucagacacuuuguaguuuagguguuugaaacaagaaaauugaaaaacugacaggaauuaggauaaguguuuaggauuuagccuugugccaacagaagaaagagguguuuagugaaaaacaugaaacaaucagguggacauaaugucugaauuuaggaauacacagauauaggagccugaaugaauauaaccuuaccaccuugggccugucagguaccuuuucucuuaguaccaggucugcuccaaaauuaggauauaucauaugcaguucugauuuccuggguuaccuaggagaccugguaaugaauggugacuaucuucuauucucauucacuuccagagaaguguccuuacccgaaugcagguggacaagcaguuaaacacaguggcuuugagugugaaggcuucuccucgcaccacagaauaaggaagggugaguucuaggaagaaaggcuggaaggcuugaagagacacgauaggagagaggccaaacccugugguuccagacaagcagaaugcgcuggccuuccacucugugaugguuucagggaccuggucaccagcucacuuauaccuaaugagcuagugaaggagcagagaagaggaguauaagcaaaucuuuuuuuuuuuuuuuuaacacaaagcauggcugauccuagaacaugauaacucaguaaccuagugugguaaaugcuaaacuugaucuaaggguuggugcuccuggugagguuuaaaguuuuuuuucucccuaccucccuuacucccuccuucccucccucccuuuauuucuuccucuuuucuuucauucuuuccuuccuuuuguucuuucuuucaaucucccuccccuccccuucccuuuccuuuauuuaagagggcugguagcauccuacuuucuauuaucuuaguuaucaauagacuaaauuagaaaaaaaauuagcauuguuuaauuaugagauaaaugaacuauaaaccuaaauauuuaccagaaaagagcagagcagaacuaaaaggaucaggaauccaggauaacaucagucauacagcaggauucaaacccucuccuaaacuaaauuccaggcaacacacaacuuacucaacuaccaccaaaucccagauccaggucucagggaaguacuuccggacuaucucuuucacuugcaauaucugagguucuucuucgaucauuggguacauuauuucuacggcuccuggggguacaccucgcagaccugguccuggaagacaacacacaggccucagugugaaccucauuuuuaucaucaauuucuuauugcugccuuauuucucaaauggaauaaggucauacgcucagggaauguuuauuauuggaacaauuuaaccuaccagcuuguuauuuuguucacuuuccuauaaaaaggcuaauccuauuuuuucuucaaauagaaucuagagcuaaauauauuuuucuuuauaaauaaaaacaaaugaccuguacauguaccuccugaaucuaaaauaaaaguugauuaaaaaaaaac

SEQ ID NO: 705 - RNA, 224 nt, Homo Sapiens
cuuucagcuaagcuguagaccucuagcagaugaacgacauauuuuccugaagggugugaagaggauacugacccaccagaaagagaccccacugcuagaacgaauaagaugugcugaaagccggagcauaacuuggccauucccaagauuuaacaacaaacuaacuacccaucauuaacaguaaagcagaaagaaaacaaucaguaagagauuauauagaccua

SEQ ID NO: 706 - RNA, 3848 nt, Homo Sapiens
ggggcaguagagugugucugggucagcugagugacuacaucaaagcucccagccuugaaaaacacaugcuguucccaggccucaagauauugaaacauuaauuagauaauuuaaaguagcguuuucuucuacaaugucugaagaagugaccuacgcgacacucacauuucaggauucugcuggagcaaggaauaaccgagauggaaauaaccuaagaaaaagagggcauccagcuccaucucccauuuggcgucaugcugcucugggucugguaacucuuugccugauguugcugauugggcuggugacauuggggaugauguguaaguauaucagcaucaaacccaacaaaggcaacuagaaaacauauuguaaaccauguacuuucagcuuggauuguagauggguccuagcauccugaaucgucugauacuuuucugcugucucauaucucuccuauucgucauaucuucccaaaaaaccggcaaaagacauuaucaggauuugguucuaaauucauuguuuuaucuugauaagcuaaacuggacuuagacaaagacucuuuguuuccaguuauucauuagaauaaagagccucuuuucugccuagacacacauucacuuaucauuccaaugcugagaaauaaagucaagaaauauguauuuuugcagauaucuaaugacauuaacucagauucagagaaauugagucaacuucagaaaaccauccaacagcagcaggauaacuuaucccagcaacugggcaacuccaacaacuuguccauggaggaggaauuucucaagucacagaucuccaguguacugaagaggcaggaacaaauggccaucaaacugugccaagagcuaaucauucauacuucagaccacagauguaauccauguccuaagauguggcaaugguaccaaaauaguugcuacuauuuuacaacaaaugaggagaaaaccugggcuaacaguagaaaggacugcauagacaagaacuccacccuagugaagauagacaguuuggaagaaaaggauuuucuuaugucacagccauuacucauguuuucguucuuuuggcugggauuaucaugggacuccucuggcagaaguugguucugggaagauggcucuguucccucuccauccuuguacgucucuaacuauugaggguaaacacaagcuuuccauggaauccugggaaaauuaauaaugauugugagaauuauaaauacagacauaaaaagaggaguacaacauacugagaaaagagcuccaguaacaaauauugaaaggagguauaguucauuucaucucugugacaaauuuauagcaaggcacugaauuuuaucuuuugguagaaauguguuuauuuaacacacacacacaccuaauacuacauucaaaguauuuuauaaauacuaacccuugaagaaagcaguuauauucccauuuuauagguagaaauauuauaauagagagauuaaguaacuugccugaggucacucagcucauaaauugcacuuuagggauugugcacucagucacucagcuauucugacucuccagcaccuacaauccaaaagggugcugcuggucauaagaacacauaucaacacauuuauuuauacuaaauaacugucaaccauuuucuaacaaaaaguaagacugaauugacugauuaguucaacaauuagugucauguugaggacuugccaauuacaauauacggcaagugucuuuuaugaauuaaaaugaacuaaaccuuccacuucaggguuuggaugaaacuauuuaaaggacaaauagaauauauaacacuuggaaaauuucaauuuuuuuaacuauuuaaaguuaugaaaaaauagacgucaacaaaaauguguaaggggauauuagguuugcuaaauucuuucacagacuauaaaacaaaaaauuuugaggaacaccucucaucauaacuacauuuaaaugaaacaacuguauuaauauuuuaaauauaauaguauuuuucuauuagauaaaauuuaagaucuuuggcaucuuaauggauuuuuaaacuuuuuauugauacauaagagauguauauguuuugggguauaugugauaauuugauacauucagauaguguguaaagaucaaauaaguggaauugggauaucgaucacuuuaaauauuuaucuuuucuuuaugcuaggagcauucaaauuauuauuuucucauuauugugaaauguacaguagauuauuguuaauuguauucacccuaauaaucuaugaaacacuaggucuuacuucuucuaucuaacagaauauuuguauucauaauggcuuuuuaucuaccuuccucccccaacaaaucauuauccaccccccucccuccuguuucacucuuuaaagcauguugucaacguuuucuuaaacugaauaauaaucacucaucuucugucaaagaugccaugcuucagcugugacucagcaguuccuuaaaucacaaacaaugguaggucuauuauuuucucccuggauacacuuuaucuucauccauuucccaauguuuugucauggcuauuucuacucaaacacuaaucccccauucucuaaucaccauuauuaaucauaucaagucaauuaguuugguuucacacuaauaauaaugacaaaaagcacaugcagaguaauacacaaacaaaaaaagugacaguuacuuuuuugugacaagagcaauauuggguaugaacugauuaauauuaaucugagguguugcuacuagacugaggguuuccaggaguaguacuaugacaucauguaaacacauucaguuuucauguuggaaucuaagaugugucccuucucccaaagggauuuuaaucauucuuggccucucuacucacucuuaaucaaaguguggaggagguggcccccacagcaggguuuggaaccuacagacccuggccccugagacaugcagcugucagacaagccagcaugucaaacacagguuagagagacugagcuuccagauugcauagccauuuccuugacuacugaguaaaggccaaggcuaagauuuaguaagccuagcccugaagcaagcaaagaauauggcaguguaaugcaggucauuuagaaaaaaacaauguugggcacaaagaaaauuuagaucugacaaguauaauuuucuaaagacauuauuucaggauuaacaucaauuucuuagcagaggaaaugaauacuauugucagaaccauaucuauauagucaaucauuuccucuuuuaacgucugucuuguucucuuuuuacccaccacauauguauaacuaugugaaaaauuauauuugugcauaauaaaaugugauaacuuuuuacaacagaaauuuaguacuaaagaacuugaccagaucaauggauccaaaggaugugcuuauuuucaaaaaggaaauauuuauauuucucgcuguagugcugaaauuuuuuggauuugcgagaagacagcugccccagugaagacugaggauuuggauuaguaugcuucuuccaaauucuccaagaaguaagagacuugugaguaagcucauaugaggaaagaggaaacuacgguaccagagccaaaccagcuuuuaaaaugacuguguauuuacauuaucagacaaaugaacuuguuuaacagaacauucuccaguuccuugucugacgucuucugauuugauguuauuauucggucuuaaaauuauaccuggggacaaaggggaauagccauacuauggcccuaugauugucucagaaucauuucacugaauuucuuugcuuucucaaauaaagacuccuuucuuucauuauuauuau

SEQ ID NO: 707 - RNA, 95 nt, Homo Sapiens
ggugagugcguuuccaagugugaagggacccuuccuguagugucuuauauacaauacaguaggaauguuccuucuuugccacucauacaccuuua

SEQ ID NO: 708 - RNA, 96 nt, Homo Sapiens
guucagggaaaaggucauuguaagguuaaugcacccauauuuuaauaucaaacuaugacaaauuugacuacagccuuuccguaccccugccaaaac

SEQ ID NO: 709 - RNA, 3353 nt, Homo Sapiens
gugagacuuuaacaucagaaaaaggauggacuuguugcaguugcuguagcauucaaagucaaguugugcuuugcgaugcugaguuuacuguuuuaaauggacuucaagcauagcccugaaguguugucccguuguucccaccuccuagagggccugacagaagagguacauaugcuaugugaucauuucaaaccaagcaucagcaacaauuaaaaauauucacuugguaucuguaguuuaauaauggaccaacaucaacauuugaauaaaacagcagagucagcaucuucagagaaaaagaaaacaagacgcugcaauggauucaagauguucuuggcagcccugucauucagcuauauugcuaaagcacuagguggaaucauuaugaaaauuuccaucacucaaauagaaaggagauuugacauauccucuucucuugcugguuuaauugauggaagcuuugaaauuggaaauuugcuugugauuguauuuguaaguuacuuuggaucuaaacuacacagaccgaaguuaauuggaauugguugucuccuuaugggaacuggaaguauuuugacaucuuuaccacauuucuucaugggauaauuuugauuauccucaguaaggcuucacaacuucaccugcugcuguacagguuuucccaucagcauuucacugaagcugcucuuucuaaguuauagguauucuaaagaaacccauauuaauccaucagaaaauucaacaucaaguuuaucaaccuguuuaauuaaucaaaccuuaucauucaauggaacaucaccugagauaguagaaaaagauuguguaaaggaaucugggucacacauguggaucuaugucuucauggggaauaugcuucguggcauaggggaaacccccauaguaccauuggggauuucauacauugaugauuuugcaaaagaaggacauucuuccuuguauuuagguaguuugaaugcaauaggaaugauugguccagucauuggcuuugcacugggaucucuguuugcuaaaauguacguggauauuggauauguagaucugagcacuaucagaauaacuccuaaggacucucguuggguuggagcuugguggcuugguuuccuugugucuggacuauuuuccauuauuucuuccauaccauuuuuuuucuugccgaaaaauccaaauaaaccacaaaaagaaagaaaaauuucacuaucauugcaugugcugaaaacaaaugaugauagaaaucaaacagcuaauuugaccaaccaaggaaaaaauguuaccaaaaaugugacugguuuuuuccagucuuugaaaagcauccuuaccaauccccuguauguuauauuucugcuuuugacauuguuacaaguaagcagcuuuauugguucuuuuacuuacgucuuuaaauauauggagcaacaguacggucagucugcaucucaugcuaacuuuuuguugggaaucauaaccauuccuacgguugcaacuggaauguuuuuaggaggauuuaucauuaaaaaauucaaauugucuuuaguuggaauugccaaauuuucauuucuuacuucgaugauauccuucuuguuucaacuucuauauuucccucuaaucugcgaaagcaaaucaguugccggccuaaccuugaccuaugauggaaauaauucaguggcaucucauguagauguaccacuuucuuauugcaacucagagugcaauugugaugaaagucagugggaaccagucugugggaacaauggaauaacuuaccugucaccuugucuagcaggaugcaaauccucaagugguauuaaaaagcauacaguguuuuauaacuguaguuguguggaaguaacuggucuccagaacagaaauuacucagcacacuugggugaaugcccaagagauaauacuuguacaaggaaauuuuucaucuauguugcaauucaagucauaaacucuuuguucucugcaacaggagguaccacauuuaucuuguugacugugaagauuguucaaccugaauugaaagcacuugcaauggguuuccagucaaugguuauaagaacacuaggaggaauucuagcuccaauauauuuuggggcucugauugauaaaacauguaugaagugguccaccaacagcuguggagcacaaggggcuuguaggauauauaauuccguauuuuuugggcagaaguauccugcaagugacauuaagacaacuagauuaucuggaagaaacaaaaagcugcugcaauuguaccuuaccucuuauagaagcauuaauuuguaauuuauauauugaucaauauauaaauuugauuucugaaacuauaaguauuagaacuacucauaguagaauuucuuuuaauuaucuaggaagaauaaauguguuuguaaguaugacccaaaugccugaaaguauaauagaaaaauaauggugaaaggauuuauauugcuuuguguauauacccaauaauaggacugauggguugaaugguaauucuguuuuauguucuuugagaaaucgucagacugcuuucuacaaugacagaacuuauuuacauucccacuaguaguguauaagcguucccuuuucuccacuaugucuucaguaucuguuaaagggucuacuugggcuuaucuauagcuuuaagauucccagcacuuguuuuauauauuguuuucauuuuugcuaugaagaaaaaauuucaaggaaaagauaccaaggcaucggacaaugaaagaaaaguaauggaugaagcaaacuuagaauucuuaaauaauggugaacauuuuguaccuucugcuggaacagauaguaaaacauguaauuuggacaugcaagacaaugcugcugccaacuaacauugcauugauucauuaagauguuauuuuugagguguuccuggucuuucacugacaauuccaacauucuuuacuuacaguggaccaauggauaagucuaugcaucuauaauaaacuauaaaaaaugggaguacccaugguuaggauauagcuaugccuuuaugguuaagauuagaauauaugauccauaaaaauuuaaagugagaggcaugguuagugugugauacaauaaaaaguaauuguuugguaguuguaacugcuaauaaaaccagugacuagaauauaagggagguaaaaaggacaagauagauuaauagccuaaauaaagagaaaagccugaugccuuuaaaaaaaaugaaacacuuuggauguauuacuuaggccaaaaucuggccuggauuuaugcuauaauauauauuuucauguuaaguuguauauuuuucagaaauuauaaauauuauuaauuuaaaauuugaa

SEQ ID NO: 710 - RNA, 3233 nt, Homo Sapiens
agcgcucuguucugcccuuucacugaaaauagcucuuccugacacaggcuuggguagugaaagcagcuuggucacaucugucccaugguguaacuaaucuuuaggaucugcagagaccugccuuccucugcaauuguaacuguaccuccaaucgugaguuucgucuggcagcuuaacugggcuaccagcgagguccucauaauggcuuuugcuccuugccucgcggagacccgacucuggaauccuuagccagugauuagaugcugcaacugcacuuccuggcuccguccucuugagcaagugaauucgcuucucugagcaucagagaaguaaucgguaaaacagggauaauaguaauuuacucaugggcuuguugagauguggucucacuauguugucuagacuggccucaaacugcugggcuccugcgauccaccuaccuuggccuuccaaagugcugggauuacaggcgugagccaccaugcccagccgcuucaucuuucuuuacucaugccuuagaggacucggucaagacaauggugcccucaggaagguuacgagagagcaagcugugcugcuuugcccaucuugggaugagcaucacccagagagagggaccagaaucccugaggccaucuugguucaucugcaccgucucuccuacaccucuucaccccuccccucuccacuucacuccaggcugcauuggggcggggaggugaucauccaaggcccuggcucuccaucgagaccccagccagguagagccccuauugccugagcaagcuugcgcaggauggggcuggagcugcacuauuuggaucuucuuggaguagaaaauucacaaauuccaaccucugcucccaaagcaaaccuccccagcccagguggcugcauccuucuccuccccuccccccaguucccugggucgccaagccggaggcuuugaaaaccagcuuguguuugguuugugaaagcaccaauguuugcaauguuugcccagcagagaaggagcauauuuucucccuuccaaaugcaaacucaaaagaugcuccaccaguuuuucuucagacuuuccacaggaaacauaaauaagaaagaaaaaugacuuuaggugcugagaccugaaauggaauuucaacccugaaggaacugccuguaacaagcacucucuguccuucagugaaggcuucgagagccuaggugcauguuucuuuccucugaguagccuucacagaugaggcaaggggaggagcugaaccaguucuuagaccugacucccagcuagaucuucagccccacacaaugaauggccggugacuggcacagcagcugagauucccuggcuacaguguucuuuuuuaucuuucuugauuguguuaggguagaacaaaugagggugcugcaacccgagaggcccagccacacugcaagccagcacaaucagagugugaaguguggacacgccccccuggaacacaaggccacaguuugccaccugcucugcccuugucuccaucucggaagaaggacaucccugaucuguggccucuguccucacggaucuuauaauuaucagacaaacacaaccacagagaggcuggaaggcagugcuucagcaucacacauauaugcaucggugaccagaguucugauuaaucuuaaugcacagauaauuggagcauuucuugcucacagcuuauagccaccaaaugacugcuuccagguuaggaguuugcagaauauguacacacacggagcccuacaaaaggcuccagacccaagaaauacaggguugaagucaguguggacaguucuaaugcagcuaauacauucuaacugauuuguugugagcuaaggguucaguguuuacacuucaaggucacuguuucugucuccugacaucugagaaccuuucuucuucuucuuuuuuuuuugagacagagucuugccgugucauccaggcuggagugcaguggcaugaucucggcucacuguaaccucugcuucccagguucaagcgauucucuugccucagccuccugaguagcugggauuauaggcaccccccgccagaccuggcaaauuuuguauuuuuaguuucgccguguuggccaggcuggucucgaacuccuggucucaagugauccacccaccuuagccucccaaagugcugggauuacaggcgugagccaccgcgccucacccaagaacuuuucuucuuaagguguuuuccuuucccauagcauucuaucuuuggauaggcccaacgaggccauugagcaucuacccuuuuuacaaaacauauuaucaaucuuauagcccauauguuuagugauaagucaacuaaacaaagcaagggaccccacuggaaggugcuugugggaaguguacccuuccaucuaggacuucacuuugauguaccaaauucugagaaagaccccagaagccauuuccuucuugcugagguuuauuuaucuuguuuaucugaagccagggccaauaacccaaauggcuuucaaauggcuacaaaagugucucagcauucgauuaaucagucccaucacagacaagucaacuaaccugcagacccacgugcuguacucauagucguugcugguucuggcaggggugaucugggaggagguauuucccggagguguuuccgaagggagaggcacuagcugaaguuggcucugagauucgaagcggaggaggaaagggaagguggagugcugaugcugacaaggugaggaagaggaggaguagagguuaccagcgcucagagcauggguuuuggaggcacacagaucugugcccaaagggcuaucaaugcucuuccacuucauugcugagcaaccugauguguucauacguucccugauguguaaaaguggcacaauacuugcgucuaccuuauaaagugccugcaagcacuaagacaaaauguagacagagcuuaaugcagugccggacucagucaacaaauagcaaauggaagucguucucauuaaacagcgaaaaggaaguaaaaaggaagacagaggaagacaaaggggagauggggaggggaugccgugggaggcuguggguggggugcagaggcugacacugcagacagcagccccucacccagcuccaucucugggcgccugggacaacacagcucucgguccagacaggcugcucagauguuuauuaagaaaccacccauaaaaguuauuggaaacuuu

SEQ ID NO: 711 - RNA, 592 nt, Homo Sapiens
acaaauaaauaacuauacaugaguguggacaggcgaagacuccaccagcacccuuaauaauagggagcaacaucuccccgcaaauuaccacaggagguuccuagaggauagugcagugguuuaagccuggccacagcugguacccacaggaaauauucagagccucaauuuagcuauuaaagacauuaaaucucuuuuagccugggggaaaacaacucucacccuuaaagcuggauuugggcuucuaacuccuggauucaucugggugaagccuagugaggaugagacagagguuuuuccuuuaaugauggaguuaacuaggaugaaccagggagcguuaugguccuaaagucaaggaaugggcuuucagauggaaaggacuugccuugucuucaaugagacuuuggacuguggacuuuugaguuaaugcaaaaaugaguuaagucuuugggggacuguuggaaaggcaugauugguuuugaaaugugaagacaugaaauuuuggaggggccgggguagaaugauaugauuuggcuguguccccacccaaaucucgucuugaauucccacguguugugggaaggauccagug

SEQ ID NO: 712 - RNA, 1076 nt, Homo Sapiens
ugcagaauaagagcaauccuaguguauuugaaaucaaaucacguauugacauucacucuucuuuuuaucuacagaccuaucagaauucagaacuaagccaugccaaauaugacaucaauuagagaauucauucuucugggauuuacagauaacccagaguuacaaguugugauauucuucuuuauguugaucacauacuuauugaguguaaguggaaacaugaucaucauuauguuaacauugucaaauauucauuugaaaacuccuauguauuucuuccucaggaauuucucuuucuuagaaauuucauuuacgacagucuucauuccuagauuucugaucaacauugcuacaggagacacaaccauuuccuauaaugcuuccauggcccaaguauuuuuuuuaauucuuuugggaucaacagaauuuuuucuucuggcugucaugucuuaugaucgcuauguggcuaucugcaaaccucuacauuauacaaccaucaugaguaacaaagucuguaauuggcuuguaaucagcuccuggcuggcugguuuucucauuauuuuuccccccgugauuaugggccuccaacuggauuuuugugacuccagcacuauugaccauuucaucugugauucuuccccuaugcugcugauugcuugcacagacacacaguuucuagagcuuauggcauuuuugcuagcaguauucacacucaugguaacuuuggccuuggugguucucuccuacacacucauccuuaaaacaauucugaagauucccucugcccagcaaaggaaaaaggcuuuuucaacuuguuccucccauaugauugugguuucuguuucuuaugggaguugcauuuuuauguguguaaaaacaucugcaaaagaagguauggcuuugagcaaagguguagcagugcuuaauaccucuguugcuccuauguugaaucccuuuauuuauaccuuaagaaaccagcaggugaaacaggcccuuagggaauucaccaaaaaaauauuaucauugaacaagcaauaaugauaacuaaaucuguggcugaaacacaaauaagccaa

SEQ ID NO: 713 - RNA, 100 nt, Homo Sapiens
ugucuauaauaaacugaaauauuugggacugaucuugaugucugccaagguuuuggcagacaucaagaucagucccaaauauuucaguuuauuauaaaca

SEQ ID NO: 714 - RNA, 779 nt, Homo Sapiens
ccgcuuccugggaaguaaggcauaaccgagaccuagccucccgguagggaaguucauccguuuaguaaacagccccaacuacgugcggacccucacggggauacgaagaauucaaccagggcuggacaagucagagugggccaaggacaagugagcauuccagagaauuucuacaugaccagcuguucauucuuuuaagaggaugacauucuucagcucaucuggaaaggauacuuccuuuaagucuguuauucacagucuccaagggcagguguaguugggaaagacauuucauauggaaaaacaaacuugauaggguaaaaaaaaaaaaaaugagauguaaucuggaggcccaagucauuuucuuaggagaaacucaaauguguuugguguuaucuaaccuucugcaguuuaucagucugaaacaaaugcauucuauucucauuugaaaaugucugaacagccaccaauuuucaaaaucacccauuuaacuagagacuuuaaagcccagaauuugcaguuacguauuucagaaugauuuaguaauuuugugagcagcucagagguuaagucuacaaugucugacuacggugcauuauugaaaauaucaguaguguaaggaucccguagauuggugauaacuuugcucuuguuauuucaacaguuaccaccaacaguuggugacuuaacaaauuaagagcauaguugccauaugcucauauuuggcaaauaugucaaaauggccauauuugccaauuuuuaagacaauaaauucacag

SEQ ID NO: 715 - RNA, 596 nt, Homo Sapiens
uuucuucuuccuuuuuugggagggggacucacuauguuguccaggcuggacucuaauuccugggcucaagcaauccuccugcuucagccuccugaguagcugugacuauaggugugugccacugcacccagcuucaguauauguaauuuuuugauacaaauaaaaaaaaauuaaaacaaaauccuacucauccugcaguuuaacaucuguaaugaauuugcuucaauuuaccuauaauucuauuaauuuuaaucauuaugaucagauauauauauuucauaauuuuaacaaacugcagcacugauuuucauguuuuuguuguuguuguuguuuuugagacggagucucacucuguugcccagggguggugauggacgucuguaaucccagcuacuggggaggcugaggcaggagaaucacuugagcccgggagguggagguugcagugagccaagauugugccauugcauuccagccagggcgacagagcaagacucuaucucaaaaaaauaaauaaauaaauaaaaaacuagaaucauuuuauuguuuagcuaaaaccccaaagcaaaugaaacaaaagauuagaacaucaccca

SEQ ID NO: 716 - RNA, 8251 nt, Homo Sapiens
cccaaguuuggggaagacaggaacugcagcgccccuccccguuucacgccacgcgcgggaccgaggaccuaggaccuggccagcugggcgugguucggagagccgggcgggaaaacgaaaccagaaauccgaaggccgcgccagagcccugcuuccccuugcaccugcgccgggcggccauggacuuguacagcaccccggccgcugcgcuggacagguucguggccagaaggcugcagccgcggaaggaguucguagagaaggcgcggcgcgcucugggcgcccuggccgcugcccugagggagcgcgggggccgccucggugcugcugccccgcgggugcugaaaacugucaagggaggcuccucgggccggggcacagcucucaaggguggcugugauucugaacuugucaucuuccucgacugcuucaagagcuauguggaccagagggcccgccgugcagagauccucagugagaugcgggcaucgcuggaauccugguggcagaacccagucccuggucugagacucacguuuccugagcagagcgugccuggggcccugcaguuccgccugacauccguagaucuugaggacuggauggauguuagccuggugccugccuucaauguccugggugagggguuccuagaccauuccaggguugggggcaaaagaucauugggaacaacacaggacuuccaauucuagcccagccaccaacuugcuguuugaccugggccagccucuaccccucucucagccucagucuggggacuaaacauauuggacuugugccagacaaaggcagagaaaccccaguuccuccuggaucugugguccugcugucaagaugcuuggcccucccacaggcaucugggaguuucccucagccacugccuggagcgguuacugcucagcccuuccacaaauacucccgaaagcuaagccaaguggacauguggcuagcaguaggggccuggggacgaaaccagaauucugcaaaaucuuguauuuuauguugaaaacaucaaugugauuuuuguguucuccuucguaauacacguaugcuugaguuaagauaaaaagucaggccggcuccggcgucaaacccaagccacaagucuacucuacccuccucaacaguggcugccaagggggcgagcaugcggccugcuucacagagcugcggaggaacuuugugaacauucgcccagccaaguugaagaaccuaaucuugcuggugaagcacugguaccaccaggugaagccacuuggaaggguuucuccagacaugugacuguuugcuuugugcuuucauagucgugaaacuguugucuuacauuuaguggccauucauguucucucucugggaauugucuguuuaugucccuugugcauuauuuucucuuggguuagcugucuuguuacugauuuguugaagcucuuuauauauuguggauacugauccuuauuuaguuaauauaaugcauucuuccaauagucuuccagucugugucuugggcuuuugcuuuguuuaaagguuauuuguaggacaaaauaucuacaguuuaauguacucagauauauccuuugaaaaaugaguuauucuuugugugucuuaagaagucuuucccuauccugccaggugcaguggcucauggcuggaaucccagcacuuugaguggccgaggcagguggaucacuugaggucaggaguucaagaccagccuggccaacauggugaaacccugucucuacuaaaaauacaaaauguagccgggcguggugguacacaccuguaauuccaguuacucgggaggcugaggcaggagaaucucuugaacccaggaggcagagguugcaguaagccaagauugcaccacugcacuccagccugggugacagagccagacuccaucucaaggaaaaaaaaaaaaaaaaaaaaagugugccuacagggguuguggaaggagacgcugcccccggucuaugcccuggaauugcugaccaucuucgccugggagcagggcuguaagaaggaugcuuucagccuagccgaaggccuccgaacuguccugggccugauccaacagcaucagcaccuguguguuuucuggacugucaacuauggcuucgaggacccugcaguugggcaguucuugcagcggcagcuuaagagacccaggccugugauccuggacccagcugaccccacaugggaccuggggaauggggcagccuggcacugggauuugcuagcccaggaggcagcauccugcuaugaccacccaugcuuucugagggggaugggggacccagugcagucuuggaaggggccgggccuuccacgugcuggaugcucagguuugggccaccccauccagcuagacccuaaccagaagaccccugaaaacagcaagagccucaaugcuguguacccaagagcagggagcaaaccucccucaugcccagcuccuggccccacuggggcagccagcaucguccccucugugccgggaauggccuuggaccugucucagauccccaccaaggagcuggaccgcuucauccaggaccaccugaagccgagcccccaguuccaggagcaggugaaaaaggccauugacaucaucuugcgcugccuccaugagaacuguguucacaaggccucaagagucaguaaaagaccugacaucagcaagagggcagguuccaggcuguagauggggcgcaggugaugggaucguaguccgacucccaggcuccuagagggucccugaucugagcuguucuucccuccacaggggggcucauuuggccggggcacagaccuaagggauggcugugauguugaacucaucaucuuccucaacugcuucacggacuacaaggaccaggggccccgccgcgcagagauccuugaugagaugcgagcgcagcuagaauccugguggcaggaccaggugcccagccugagccuucaguuuccugagcagaaugugccugaggcucugcaguuccagcugguguccacagcccugaagagcuggacggauguuagccugcugccugccuucgaugcuguggggcagcucaguucuggcaccaaaccaaauccccaggucuacucgaggcuccucaccaguggcugccaggagggcgagcauaaggccugcuucgcagagcugcggaggaacuucaugaacauucgcccugucaagcugaagaaccugauucugcuggugaagcacugguaccgccagguugcggcucagaacaaaggaaaaggaccagccccugccucucugcccccagccuaugcccuggagcuccucaccaucuuugccugggagcagggcugcaggcaggauuguuucaacauggcccaaggcuuccggacggugcuggggcucgugcaacagcaucagcagcucugugucuacuggacggucaacuauagcacugaggacccagccaugagaaugcaccuucuuggccagcuucgaaaacccagaccccugguccuggaccccgcugaucccaccuggaacgugggccacgguagcugggagcuguuggcccaggaagcagcagcgcuggggaugcaggccugcuuucugaguagagacgggacaucugugcagcccugggaugugaugccagcccuccuuuaccaaaccccagcuggggaccuugacaaguucaucagugaauuucuccagcccaaccgccaguuccuggcccaggugaacaaggccguugauaccaucuguucauuuuugaaggaaaacugcuuccggaauucucccaucaaagugaucaagguggucaaggguggcucuucagccaaaggcacagcucugcgaggccgcucagaugccgaccucgugguguuccucagcugcuucagccaguucacugagcagggcaacaagcgggccgagaucaucuccgagauccgagcccagcuggaggcaugucaacaggagcggcaguucgaggucaaguuugaagucuccaaaugggagaauccccgcgugcugagcuucucacugacaucccagacgaugcuggaccagaguguggacuuugaugugcugccagccuuugacgcccuaggccagcuggucucuggcuccaggcccagcucucaagucuacgucgaccucauccacagcuacagcaaugcgggcgaguacuccaccugcuucacagagcuacaacgggacuucaucaucucucgcccuaccaagcugaagagccugauccggcuggugaagcacugguaccagcaguguaccaagaucuccaaggggagaggcucccuacccccacagcacgggcuggaacuccugacuguguaugccugggagcagggcgggaaggacucccaguucaacauggcugagggcuuccgcacgguccuggagcuggucacccaguaccgccagcucuguaucuacuggaccaucaacuacaacgccaaggacaagacuguuggagacuuccugaaacagcagcuucagaagcccagugauugauuaacaaugccuccccugaauaaggaagggguaagcgguagcaccgugguugauuaguaauguuugccugaaugcagaauggcaaaguggccaugugugucuuauuuucuauaccugcccuguaguguauaggagcacugaggaaucucugagcccuggcucuagccccugcaaaguguuagauaaaaggggaaaauaguccaaccagugccacagguggacaccuagauguugccaggaauaagacugucccugggugggaauugcaggccuaucauccuggauccggcugacccgacaggcaaccugggccacaaugcccgcugggaccugcuggccaaggaagcugcagccugcacaucugcccugugcugcaugggacggaauggcauccccauccagccauggccagugaaggcugcugugugaaguugagaaaaucagcgguccuacuggaugaagagaagauggacaccagcccucagcaugaggaaauucaggguccccuaccagaugagagagauuguguacaugugugugugagcacaugugugcaugugugugcacacgugugcauguguguguuuuagugaaucugcucucccagcucacacacuccccugccucccauggcuuacacacuaggauccagacuccaugguuugacaccagccugcguuugcagcuucucugucacuuccaugacucuauccucauaccaccacugcugcuucccacccagcugagaaugcccccuccucccugacuccucucugcccaugcaaauuagcucacaucuuuccuccugcugcaauccaucccuuccucccauuggccucuccuugccaaaucuaaauaguuuauauagggauggcagagaguucccaucucaucugucagccacagucauuugguacuggcuaccuggagccuuaucuucugaaggguuuuaaagaauggccaauuagcugagaagaauuaucuaaucaauuagugaugucugccauggaugcaguagaggaaaguggugguacaagugccaugauugauuagcaaugucugcacuggauacggaaaaaagaaggugcuugcagguuuacaguguauaugugggcuauugaagagcccucugagcucgguugcuagcaggagagcaugcccauauuggcuuacuuugucugccacagacacagacagagggaguugggacaugcaugcuauggggacccucuuguuggacaccuaauuggaugccucuucaugagaggccuccuuuucuucaccuuuuaugcugcacuccuccccuaguuuacacaucuugaugcuguggcucaguuugccuuccugaauuuuuauugggucccuguuuucucuccuaacaugcugagauucugcauccccacagccuaaacugagccaguggccaaacaaccgugcucagccuguuucucucugcccucuagagcaaggcccaccagguccauccaggaggcucuccugaccucaaguccaacaacaguguccacacuagucaagguucagcccagaaaacagaaagcacucuaggaaucuuaggcagaaagggauuuuaucuaaaucacuggaaaggcuggaggagcagaaggcagaggccaccacuggacuauugguuucaauauuagaccacuguagccgaaucagaggccagagagcagccacugcuacugcuaaugccaccacuaccccugccaucacugccccacauggacaaaacuggagucgagaccuagguuagauuccugcaaccacaaacauccaucagggauggccagcugccagagcugcgggaagacggaucccaccucccuuucuuagcagaaucuaaauuacagccagaccucuggcugcagaggagucugagacauguaugauugaaugggugccaagugccagggggcggaguccccagcagaugcauccuggccaucuguugcguggaugagggagugggucuaucucagaggaaggaacaggaaacaaagaaaggaagccacugaacaucccuucucugcuccacaggagugccuuagacagccugacucuccacaaaccacuguuaaaacuuaccugcuaggaaugcuagauugaaugggaugggaagagccuucccucauuauugucauucuuggagagaggugagcaaccaagggaagcuccucugauucaccuagaaccuguucucugccgucuuuggcucagccuacagagacuagaguaggugaagggacagaggacagggcuucuaauaccugugccauauugacagccuccaucccugucccccaucuuggugcugaaccaacgcuaagggcaccuucuuagacucaccucaucgauacugccugguaauccaaagcuagaacucucaggaccccaaacuccaccucuuggauuggcccuggcugcugccacacacauauccaagagcucagggccaguucuggugggcagcagagaccugcucugccaaguuguccagcagcagaguggcccuggccugggcaucacaagccagugaugcuccugggaagaccagguggcaggucgcaguuggguaccuuccauucccaccacacagacucugggccuccccgcaaaauggcuccagaauuagaguaauuaugagauggugggaaccagagcaacucaggugcaugauacaaggagagguugucaucuggguagggcagagaggagggcuugcucaucugaacagggguguauuucauuccaggcccucagucuuuggcaauggccacccugguguuggcauauuggccccacuguaacuuuugggggcuucccggucuagccacacccucggauggaaagacuugacugcauaaagaugucaguucucccugaguugauugauaggcuuaauggucacccuaaaaacacccacauaugcuuuucgauggaaccagguaaguugacgcuaaaguucuuauggaaaaauacacacgcaauagcuaggaaaacacagggaaagaagaguucugagcagggccuagucuuagccaauauuaaaacauacuaugaagccucugauacuuaaacagcauggcgcugguacguaaauagaccaaugcaguuagguggcucuuuccaagacucuggggaaaaaaguaguaaaaagcuaaaugcaaucaaucagcaauugaaagcuaagugagagagccagagggccuccuuggugguaaaagaggguugcauuucuugcagccagaaggcagagaaagugaagaccaaguccagaacugaauccuaagaaaugcaggacugcaaagaaauugguguguguguguguguguguguguguguguguguuuaauuuuuaaaaaguuuuuauugagauacaagucaauaccauaaagcucucacccuucuaaaguguacaauucaguggugugaguauauucauaagauuuauacuuggugucuauucauaagacuuauauccagcauauucauaacuagagccauaucacagaugcauucaucauaauaauuccagacauuuucaucacccuaaaaggaaacccugaaacccauuagcagucauuccccauuccuccaacccauucucucccuaaucccuagaaaccaccaaucugcuguguauuucaucuauugccaacauuucauauaaauggcaucauacaa

SEQ ID NO: 717 - RNA, 1330 nt, Homo Sapiens
ugcugugaggagagcugguguuccuuuggccuggggcccacccagaauggacacacuugggggcagacuggagcccaccuugcaucuggagcuaagcugucagaccugcagcuugaagcagggcagccuggcugaggcccacccagaucagccaacuugcaaacacagaagaaaccagugcuucuugugacagggucucucuuuguugccuaggcuggagugcaguggaacgaacuuggcuuauugaagcauugaccaccuggacccaagugauucuccuaccuuagccucuugaauagcugugacaacaggugugcacuaccacacccagauaaauuuuguaauuuuuauagagagggcauuugaccauguugcccaggcuggucucaaacuccugagcucaagugauacuccugccucggccucccaaagugcugggauuacagaugaagaaaaugaggcacugagagauuacauaacuucccuugagucauauuugcuuguaagugguaaggcuggauguugaacccaggacaaagggucucacucugucgcccagucuggagugcaauggugugaucacggucacugcaaccucugccucccggguucaagcgauucuccugccucagccucccaaguagcugggauuacagcggcuugcaguaaacuucuuggaggagaauuggcauugcaaggguguuacuggagaccucggcaagaaagugaaugcaaagacagaugacccaggaacccgugauggauaaggcucuugacagccaggacguggaauuacagggggucucuuugagagacaaaauaaaaaaaauagcccaguaaucuuccuuccacccuuuucucccagaucuaauuacagaugucuugacauuccuucugcauagaauuuccuuaaaagauuugccaagaagaaacauuuggaaacuguguuuuagguauaauccgucugggagucacucuugcucgcuuugucguuagaugacaaaacgcuuaauuacagcgagcacaauguauaccacauuuggaaaacuggauucuugaccuaaauaauguaccccauacugacaauggccuuuuggcaaaacuugugucucugaucucacauuaauuacuacacaaauauacuuauugugggcaccgaguuuaugggauggaguccucuugacacauguucaccauaaaaacacauuuuuuucccuuccccugacccuaaggaaaagaaaaaaaaaaagauuaacauuuuucaagaugcuguuuuagugacaugaaaacugucuguugaguguucacucggcuuuuguucuuuuucuuu

SEQ ID NO: 718 - RNA, 1184 nt, Homo Sapiens
uucuggcagaaccacuucuggaccugucccucugcaccccccauuccugcgcccucauuuaaccucccugacucugaccugggcuuggucuaucuuggggccuggcugccguccugggacgggaaggggagcagaucagaacucagccugcggcuccaggccgcugggcgcuggcugggccucacguucuccuggaaggaccaccucccuugcccuccacggggucugccuuugcucccaaggcuccgcccuggacggagcguccuucuugccugggcgucuucagaccuucaucugugacaccgggggccauguggcucaccccgaggaagagacgaggacucgcuguguuggcuguucuugagcuucugggcucaagcaauccucccuccugagcuucccagagugcuaggauuacaggugugagccacugagcccagcccauuuucuuuuuuuuuuuuuuccuggcuuccuuuccucccugucucccuggccuacccuuccucuucccucagcuguuccuucccuuucucuccagugaagacuaagggccaagcaugagccuuucuuccugcucuuuuacccuugaggcagcaggagaggauauucaccuccugacaugacagauucugacgcuaucugcuccucugugacuuugggaagcgggguaugugcugcuccugggcugaugggggaaagugccucucccagcaaugcuggugccacuuggugugcuacggccccccagggcagugcggagccaucugggacaguuagacaaugagagacgugaagccauuucaaggugcuuccuugaaaaugcuccagaaaaacagcagaggcggccucucuggggauccgguccagcccuugaaaagaaucuguuuguuucaccacugaacucaaauaagccaacagauugaaggaagggaguuuccacgcgccccuccccaccaagcaguuaccugaguuccagaguccaguccgauggaucccauuuuacccugguuuaaauuguuuccuuagaaaaaaauaaacagaaccucuucucucacucuccaguggaaaguauagaaucaaacguaaaugaaaaugacaguuucuaacaugcgcgaccuggacacgcggcugaacuccgagccucagcugcagaguggggucaaugcaccuaccuugcagcguca

SEQ ID NO: 719 - RNA, 3666 nt, Homo Sapiens
gucugcgcaagcgcuaaccaagaaacgacgguuucggguagauuguugguuaagaagaaagcugggaaagugaaggagagggggaagaaaggaagugaaaagacuuuggcuguuggaaucucagaucuggaauaggcuguauaggcuauuuauaaucucuaauugccgaggaaccugaaguucagaguuaaccagugacugacucaggacaugcaaaauggcaagacccgagguagaagagcucaccuuuccugacucucaguuuccuguucccugaaaauguaagcuaagcuggcagcccuggugaguccggaggaagaaggaggcguagcccuccgcgcucaggagauccagggcccaggagagagaaaaggggggacaagaacgaggggaaaaguggagaagagaaaccaaaauagggugugucccaaguaaauaaaugugcgucgagcccgccaagcacauucucucauagggacccuugcgccugcuguucgcguuuccuggaaugcacacucaggugucugcaccagcucaagucucugcucaaaagugaccucuucggauaaaacuucucugaccauccuauccaagcucuccagucccagcaagggggagguacauggaaggccacaggaagaaacaagaucuugagcugagcaagaacaucccagcaucuucauugacuuuaaaaguauauucuggagucuuccgugguucacuauuccaguacuacagagucauuuuuaucugugucuuuccauugcagauuccuuauauuacauggcaggagggggguaaacugagggauagugaagacaacaauaaauuaaucaagagcuuuccucauaucucagaaccuauccucuguaagaaugucagaaaagguugacugguuacaaagccaaaauggaguaugcaaaguugaugucuauucuccuggagacaaccaagcccaggacuggaaaauggacaccuccacggauccugucagagugcucagcuggcuccgcagagaccuggagaagaguacagcagaguuccaagauguucgguucaaacccggagaaucauuugguggggaaacguccaacucaggagacccacacaaagguuucucuguagacuauuacaacaccaccaccaagggcacuccagaaagauugcauuuugagaugacucacaaagagauuccuugccagggccccagggcccaacuuggcaacgggaguucaguagaugaaguuuccuucuaugcuaaccgccucacgaaucuagucauagccauggcccgcaaagagaucaaugagaagaucgauggcucugaaaacaaaugugucuaucagucauuguacauggggaaugaacccacacccaccaaaagccucaguaagauagcaucagagcuugugaaugagaccgucucugcauguuccaggaaugcugccccagacaaggcuccuggcucuggagacagagucucgggaucaucacaaagucccccaaauuugaaauacaaguccacuuugaagaucaaggagagcaccaaagaaagacaggguccagaugacaagccuccuucuaagaagucuuucuucuauaaggaaguguuugaaucucguaauggagauuaugccagagaggguggaagguucuuuccucgggagagaaagagguuucgagggcaggaaaggccugaugacuuuacggcuucuguuagugaagggaucaugaccuaugcuaacagugugguaucugauaugauggucuccaucaugaagacacugaagauccaagugaaagacacaaccauugccaccauccuacugaagaagguucugcucaagcaugcaaaagagguggucucggaucucaucgacuccuucuugaggaaucuccacagcgucacagggacccucaugacugacacacaguuugucucggcugugaaaagaacugucuucucucauggaagccaaaaggccacagauaucauggaugccaugcuaaggaagcuguacaauguaauguuugccaagaaagucccugagcaugucaggaaagcccaagacaaggcugagaguuauucccucaucuccaugaaaggaaugggugauccuaaaaaccgaaaugugaacuuugccaugaaaucugaaacuaaauugagagaaaaaauguauucugaacccaaaucagaggaggagacuugugcgaaaacucugggugagcacauuaucaaagaggggcuuaccuuguggcauaaaacucagcagaaagaauguaaaucucuagguuuccagcaugcagcauuugaagcucccaacacacagcguaagccugcaucagacauuuccuuugaguacccugaagauauuggcaaccucagccuuccuccauauccuccagagaaaccugagaauuuuauguaugauucagacuccugggccgaggaccugaucgugucugcccugcuucugauucaauaucaccuggcccagggaggaagaagggaugcacggagcuucguugaagcugcuggcaccaccaacuuuccugccaaugaaccuccuguagcucccgaugaaucuugccuuaagucugcucccauuguaggugaccaagaacaagcagaaaagaaggaccuaaggaguguuuucuuuaauuucauccggaacuuacuuagugagaccauuuucaagcgugaccagagcccugaacccaaggugccggaacagccaguuaaggaagauaggaaguugugugaaagaccguuggcgucuucuccccccaggcuauaugaggaugaugagaccccuggugcccuuucugggcugaccaagauggcugucagccagauagauggccacaugagugggcagaugguagaacaucugaugaacucagugaugaagcugugugucaucauugcuaaguccugugaugcuucguuggcagagcugggagaugacaagucuggagaugccaguaggcuaacuucggccuucccagauaguuuauaugagugcuuaccagccaagggcacagggucagcagaagcuguccugcagaaugccuaucaagcuauccauaaugaaaugagaggcacaucaggacagcccccugaagggugugcagcacccacggugauugucagcaaucacaaccuaacggacacaguucagaacaagcaacuccaagccguccuucaauggguagcugccucugagcucaaugucccuauuuuguauuuugcuggugaugaugaagggauccaggagaagcuacuucagcucucagcugcugcuguggacaaaggaugcagugugggcgagguucugcagucggugcugcgcuaugagaaggagcgccagcugaaugaggcgguggggaaugucacaccgcugcagcugcuggacuggcugauggugaaccuguaaucggcaaccccacugcuuuccccucuucuggcaguggggccggcccuuauccccgcccuucuuucucacuuccacaucucccccucuauauccucacagagcccuaacauuaucuucacaccacucucaucaaagacaugucaucuugugcuagccacuggauuuugcagauuuuccuguccaugcaagcaaggacguaaaauuaaaaaauuacaauuaaagggcucca

SEQ ID NO: 720 - RNA, 449 nt, Homo Sapiens
agcaccucagagauaccucagcccagggcacagugcacccuggggauccuuugcucccaaccaccccgaaggaugcaucuggaauuucugcuuauugggugaccaaaaaaagggagaagaggguuuguuuucaucauugccauuuuuauucacgagacugucaacuaggucaguaauucuucaaaaccaauccuggcaaagcaugggaaggaaccuucguucugcagaagcguacacacccugauaaggugucaagaaccuccguuugaguaccccucggguuaagccugacugggcugccggccacccuucaggcagagcugauguucugugaugaccuucacaucaagcaugaggucgugccccaagaaggguuucacugugcccagggagguuccccugagaaggacaagccauuggcaaauucaugaaucagaguucuguuuuua

SEQ ID NO: 721 - RNA, 2422 nt, Homo Sapiens
aauauucuacaucuaucggagcugaacuuccuaaaagacaaaguguuuaucuuucaagauucauucucccugaaucuuaccaacaaaacacuccugaggagaaagaaagagagggagggagagaaaaagagagagagagaaacaaaaaaccaaagagagagaaaaaaugaauucaucuaaaucaucugaaacacaaugcacagagagaggaugcuucucuucccaaauguucuuauggacuguugcugggauccccauccuauuucucagugccuguuucaucaccagauguguugugacauuucgcaucuuucaaaccugugaugagaaaaaguuucagcuaccugagaauuucacagagcucuccugcuacaauuauggaucagguauaauagucccaaaggugaacaucaaaauuuacaaagcaacauuuucuggcuucuagauugacuuugggacaggugagauauagcuggauuaggucuuauuuuucaaaagcaaaauguaaaauccuagaaauuuggugaugcaauuagcauuggggcagaaagucuuggggacauuauaguaaacuuuuagaauaaauuugagggguaugucugaacaguaaaucuggaaguggaagguauuauucccaggaguguaccuuguucagucaagaauuguuguccauugaacugggaauauuuucaauccagcugcuacuucuuuucuacugacaccauuuccugggcguuaaguuuaaagaacugcucagccaugggggcucaccuggugguuaucaacucacaggaggagcaggaauuccuuuccuacaagaaaccuaaaaugagagaguuuuuuauuggacugucagaccagguugucgagggucaguggcaauggguggacggcacaccuuugacaaagucucugagcuucugggauguaggggagcccaacaacauagcuacccuggaggacugugccaccaugagagacucuucaaacccaaggcaaaauuggaaugauguaaccuguuuccucaauuauuuucggauuugugaaaugguaggaauaaauccuuugaacaaaggaaaaucucuuuaagaacagaaggcacaacucaaauguguaaagaaggaagagcaagaacauggccacacccaccgccccacacgagaaauuugugcgcugaacuucaaaggacuucauaaguauuuguuacucugauauaaauaaaaauaaguaguuuuaaauguuauaauucauguuacuggcugaagugcauuuucucucuacguuagucucagguccucuucccagaauuuacaaagcaauucacuaccuuuugcuacauuugccucauuuuuuaguguucguaugaaaguacagggacacggagccaagacagagucuagcaaagaaggggauuuuggaaggugccuuccaaaaaucuccugaauccgggcucuguagcagguccucuucuuucuagcuucugacaagucugucuucucuucuugguuucauaccguucuuaucuccugcccaagcauauaucgucucuuuacuccccuguauaaugaguaagaagcuucuucaagucaugaaacuuauuccugcucagaauaccgguguggccuuucuggcuacaggccuccacugcaccuucuuagggaagggcaugccagccaucagcuccaaacaggcuguaaccaaguccacccaucccuggggcuuccuuugcucugccuuauuuucaauugacugaauggaucucaccagauuuuguaucuauugcucagcuaggacccgaguccaauagucaauuuauucuaagcgaacauucaucuccacacuuuccugucucaagcccauccauuauuucuuaacuuuuauuuuagcuuucggggguacauguuaaaggcuuuuuauauagguaaacucaugucguggagguuuguuguacagauuauuucaucacccagguauuaagcccagugccuaauauuguuuuuuucggcuccucucccuccuccuaccuuccgcccucaaguagacuccagugucuguuauucccuucuuuguguuuaugaauucucaucauuuagcucccacuuauaagugaggacaugcaguauuugguuuucuguucccauguuugcuaaggauaauggucuccaguucuaccgauguucccacaaaagacauaaucuucuuuuuuaaggcugcuuaguauuccaugguaucuauguaucacauuuucucuauccaaucuauuguugacucacauuuagauugauuccauguuuuugcuauugugaauagugcugcaaugaacauucgugugcaugugucuuuaugguagaaagauuuauauuucucugaguauguauccaguaauagcccauucauuuauugcauaaaauucuaccaauac

SEQ ID NO: 722 - RNA, 6384 nt, Homo Sapiens
auacaagagaugugagaagcaccauaaaaggcguugugaggaguugugggggagugagggagagaagagguugaaaagcuuauuagcugcuguacgguaaaagugagcucuuacgggaaugggaauguaguuuuagcccuccagggauucuauuuagcccgccaggaauuaaccuugacuauaaauaggccaucaaugaccuuuccagagaauguucagagaccucaacuuuguuuagagaucuuguguggguggaacuuccuguuugcacacagagcagcauaaagcccaguugcuuugggaaguguuugggaccagauggauuguagggaguaggguacaauacagucuguucuccuccagcuccuucuuucugcaacauggggaagaacaaacuccuucauccaagucugguucuucuccucuugguccuccugcccacagacgccucagucucuggaaaaccgguccauuuucuauuuuauaaaaauaaagacaauucucucccacaaccaaacauggaacaaugcccuggaguauaaaaaucuauagagugccaaauaaaggaacaauuugaaauacugguguugauauugaaaaagcaagggacucuaaugucagaagagaaauccuuuugcagaugagguggugaugaauucuuuguuucaacacaacugaaggaggaacugaaggaaauaccagcugaugagugaugagaagggauucuugauaauagaguacuagggcaguauaugguucugguccccucccugcuccacacugagaccacugagaagggcuguguccuucugagcuaccugaaugagacagugacuguaagugcuuccuuggagucugucaggggaaacaggagccucuucacugaccuggaggcggagaaugacguacuccacugugucgccuucgcuaagugauuccuguccaugccaacuuucccugcugagaacaagggagugaaggucccaaagucuucauccaaugaggagguaauguuccucacuguccaagugaaaggaccaacccaagaauuuaagaagcggaccacagugaugguuaagaacgaggacagucuggucuuuguccagacagacaaaucaaucuacaaaccagggcagacagugaaauuucguguugucuccauggaugaaaacuuucacccccugaaugaguugauuccacuaguauacauucaggaucccaaaggaaaucgcaucgcacaauggcagaguuuccaguuagaggguggccucaagcaauuuucuuuuccccucucaucagagcccuuccagggcuccuacaagguggugguacagaagaaaucagguggaaggacagagcacccuuucaccguggaggaauuuguucuucccaaguuugaaguacaaguaacagugccaaagauaaucaccaucuuggaagaagagaugaauguaucaguguguggccuauacacauaugggaagccugucccuggacaugugacugugagcauuugcagaaaguauagugacgcuuccgacugccacggugaagauucacaggcuuucugugagaaauucaguggacagcuaaacagccauggcugcuucuaucagcaaguaaaaaccaaggucuuccagcugaagaggaaggaguaugaaaugaaacuucacacugaggcccagauccaagaagaaggaacagugguggaauugacuggaaggcaguccagugaaaucacaagaaccauaaccaaacucucauuugugaaaguggacucacacuuucgacagggaauucccuucuuugggcaggugcgccuaguagaugggaaaggcgucccuauaccaaauaaagucauauucaucagaggaaaugaagcaaacuauuacuccaaugcuaccacggaugagcauggccuuguacaguucucuaucaacaccaccaauguuauggguaccucucuuacuguuagggucaauuacaaggaucguagucccuguuacggcuaccagugggugucagaagaacacgaagaggcacaucacacugcuuaucuuguguucuccccaagcaagagcuuuguccaccuugagcccaugucucaugaacuacccuguggccauacucagacaguccaggcacauuauauucugaauggaggcacccugcuggggcugaagaagcucuccuucuauuaucugauaauggcaaagggaggcauuguccgaacugggacucauggacugcuugugaagcaggaagacaugaagggccauuuuuccaucucaaucccugugaagucagacauugcuccugucgcucgguugcucaucuaugcuguuuuaccuaccggggacgugauuggggauucugcaaaauaugauguugaaaauugucuggccaacaagguggauuugagcuucagcccaucacaaagucucccagccucacacgcccaccugcgagucacagcggcuccucaguccgucugcgcccuccgugcuguggaccaaagcgugcugcucaugaagccugaugcugagcucucggcguccucggugaguuccuggcagccucaggaaucaagaagggccgugccaggggcucagagcaaggaaaaaugacuggauaaguaggauaagaucaauuaaaauuauauuuaucuaggaauuaauugcuuugagcucucuugugggcuuucauugguaaggaauuauauauauauauauauauaacuacucacuucugcaguuaaaaaaauaaacaaaauacaauauauugaaguuuacaaccugcuaccagaaaaggaccucacuggcuucccugggccuuugaaugaccaggacaaugaagacugcaucaaucgucauaaugucuauauuaauggaaucacauauacuccaguaucaaguacaaaugaaaaggauauguacagcuuccuagaggacaugggcuuaaaggcauucaccaacucaaagauucguaaacccaaaauguguccacagcuucaacaguaugaaaugcauggaccugaaggucuacguguagguuuuuaugagucagauguaaugggaagaggccaugcacgccuggugcauguugaagagccucacacggagaccguacgaaaguacuucccugagacauggaucugggauuugguggugguaaacucagcagguguggcugagguaggaguaacagucccugacaccaucaccgaguggaaggcaggggccuucugccugucugaagaugcuggacuugguaucucuuccacugccucucuccgagccuuccagcccuucuuuguggagcucacaaugccuuacucugugauucguggagaggccuucacacucaaggccacgguccuaaacuaccuucccaaaugcauccggccucuguucuccuucccucucuacucccuuucuuaugugugguuucaggucagugugcagcuggaagccucucccgccuuccuagcugucccaguggagaaggaacaagcgccucacugcaucugugcaaacgggcggcaaacuguguccugggcaguaaccccaaagucauuaggaaaugugaauuucacugugagcgcagaggcacuagagucucaagagcugugugggacugaggugccuucaguuccugaacacggaaggaaagacacagucaucaagccucuguugguugaaccugaaggacuagagaaggaaacaacauucaacucccuacuuuguccaucagauaaauuacugaaaagaucauugaagaagaaauucugaaaaucacaggaaaccaguagcccauuuuuaagauauuuauauauuacuguuguauuaaaggcggacaacuuuucaggaggaguuuagguggugagguuucugaagaauuaucccugaaacugccaccaaaugugguagaagaaucugcccgagcuucugucucaguuuugggugagucuccagccccuaguggauccgggcauuaacagcuucuauuauacuauuuuuauuucccauaaauauuuacuaaaaauaauacuauaauuuuaacuucuuucuucucugagacauauuaggcucugccaugcaaaacacacaaaaucuucuccagaugcccuauggcuguggagagcagaauaugguccucuuugcuccuaacaucuauguacuggauuaucuaaaugaaacacagcagcuuacuccagagaucaaguccaaggccauuggcuaucucaacacugguuaccagagacaguugaacuacaaacacuaugauggcuccuacagcaccuuuggggagcgauauggcaggaaccagggcaacaccuggcucacagccuuuguucugaagacuuuugcccaagcucgagccuacaucuucaucgaugaagcacacauuacccaagcccucauauggcucucccagaggcagaaggacaauggcuguuucaggagcucugggucacugcucaacaaugccauaaagggaggaguagaagaugaagugacccucuccgccuauaucaccaucgcccuucuggagauuccucucacagucacucacccuguuguccgcaaugcccuguuuugccuggagucagccuggaagacagcacaagaaggggaccauggcagccauguauauaccaaagcacugcuggccuaugcuuuugcccuggcagguaaccaggacaagaggaaggaaguacucaagucacuuaaugaggaagcugugaagaaagacaacucuguccauugggagcgcccucagaaacccaaggcaccaguggggcauuuuuacgaaccccaggcucccucugcugagguggagaugacauccuaugugcuccucgcuuaucucacggcccagccagccccaaccucggaggaccugaccucugcaaccaacaucgugaaguggaucacgaagcagcagaaugcccagggcgguuucuccuccacccaggacacagugguggcucuccaugcucuguccaaauauggagcagccacauuuaccaggacugggaaggcugcacaggugacuauccagucuucagggacauuuuccagcaaauuccaaguggacaacaacaaccgccuguuacugcagcaggucucauugccagagcugccuggggaauacagcaugaaagugacaggagaaggaugugucuaccuccagacauccuugaaauacaauauucucccagaaaaggaagaguuccccuuugcuuuaggagugcagacucugccucaaacuugugaugaacccaaagcccacaccagcuuccaaaucucccuaagugucaguuacacagggagccgcucugccuccaacauggcgaucguugaugugaagauggucucuggcuucauuccccugaagccaacagugaaaaugcuugaaagaucuaaccaugugagccggacagaagucagcagcaaccaugucuugauuuaccuugauaaggaacagagcuauguauuggcauugacagagguauaugcguuauguuaguuauuuaagaaauaaucuggagaauuuaucauccccucugagagauuucugcacaauuuaauuaaggacccuauagugugcuguaggauaauaaagcuuuucccccaaaaaacaggugaauacuuaaacuaauucaaagagagaagaaagcuuccugaaaggucauuuaauugacuuuugcuuuccaggugucaaaucagacacugagcuuguucuucacgguucugcaagaugucccaguaagagaucugaaaccagccauagugaaagucuaugauuacuacgagacggaugaguuugcaauugcugaguacaaugcuccuugcagcaaagguaagccacucacacuccuccaaaaggcagucagagcuccuucagcuugccccccaaaccuucuccuucauaaaacgcuggguaaauauuugucaaaaacaucaaauuacucacacugcacauuauuauagaaaaacacauuuauuggagagggccgcugacucugucaaaccucagagaguccauaggauugcuuauggguaaugauuuggaauagauuugguuucccacuguacugauuagguuuccuugggcacuaugcuacccagaacuaagggaaagaauacucucugcucauggagacccaaaucugucuuaauuuuuuuucuuuccaaugucacagaucuuggaaaugcuugaagaccacaaggcugaaaagugcuuugcuggaguccuguucucagagcuccacagaagacacguguuuuuguaucuuuaaagacuugaugaauaaacacuuuuucuggucaaugucuuucccuguuuccuguucauucaauaaauaucauuguacauuuc

SEQ ID NO: 723 - RNA, 6227 nt, Homo Sapiens
ggacacaacccugagauuuaucccucacaaugcggaaagacagacuucuucauuuaugucuugugcuacuucuuauccugcuuucugccagugacucaaacucuacagaaccgcaguauauggugcugguccccucccugcuccacacugaggccccuaagaagggcuguguccuucugagccaccugaaugagacagugacuguaagugcuuccuuggagucuggcagggaaaacaggagccucuucacugaccugguggcggagaaggacuuauuccacugugucuccuucacucucccaaggaucucagccucuucagagguggcauuccuuagcauccagauaaaggggccuacgcaagauuucaggaagaggaacacaguucugguacugaacacccaaagucuggucuuuguccagacagacaaacccauguauaaaccaggacagacagguaaguagggaaauuccacuguuuggggcaacacugagaagggccaccugaacagccaaagucuccauuauccuagccccguagccuccugucuuauuacccaaauuaccugcuuuaucaugucugaaucuuaucggagaacuacuuuuccaguaagauuccguguugucuccguggaugaaaauuuucgcccucgaaaugaacugauuccacugauauaccuugagaacccaagaagaaaucgaauugcacaauggcagagucucaagcuagaagcuggcaucaaucaguuguccuuuccccucucaucagagcccauucagggcuccuacaggguggugguacagacagaaucagguggaaggauacagcaccccuucaccguggaggaauuugugcuucccaaguuugaggucaaaguucaggugccaaagauaaucaguaucauggaugaaaaagugaacauaacagucuguggagaauacacuuaugggaagccugucccaggacuugcaacugugagccuguguagaaaauuaucucguguucuuaauugugacaagcaggaggucugugaggaauucagucaacagcuuaacagcaauggcugcaucacccaacaaguacacaccaaaaugcuccagauuacaaauacgggcuuugaaaugaagcuuagaguggaagccaggaucagagaagaggggacagaccuggaagucacugcaaacaggaucagugaaaucacaaacauuguauccaaacucaaauucgugaaaguggauucacacuuuagacaaggaauccccuuuuuugcacaggugcuucugguggauggaaaaggugugcccauccccaauaaacucuucuucaucucugugaaugacgccaauuauuacuccaaugcaaccaccaaugagcagggucuugcacaguuuucaaucaauacuaccaguaucucgguuaauaaacuuuuuguccggguuuucacugugcaucccaacuuguguuuucacuauucauggguagcagaagaccaccagggugcucagcacacugcaaaucguguuuucuccuuaaguggaaguuacauucaccuggagccuguggcugguacccugcccuguggccacacggagacuaucacggcacacuauacacugaauagacaggccaugggagaguuaucggagcucaguuuccauuaccugaucauggcuaagggagucaucgucagaucuggaacccacacucugccuguggagucaggagacaugaaaggcaguuuugccuuauccuucccuguggagucagacguugcccccauugcacgaauguucaucuuugccauuuuaccagauggagaaguuguuggagacucugaaaaauuugagauugaaaacugucuagccaacaagguggauuugagcuucagcccagcacaaagucccccagccucacaugcccaccugcaaguagcagcugcuccgcagucccucugugcccuucgugcuguggaccaaagugugcugcucaugaagccugaggcugagcucucuguguccucaagucucaaugugagaaccuggguauuucaguugaaggugcugcauuuaauaagcuuuuucauuccacuccguaagugcugcagaccgcagcugcuucuaaugggccaucuauacgauuuucugucugagaauaagccugaguagacauagauguuuaacagguggcaauaauaauauguagcuaaauuccucagggcauuauguauuaauuaaacacagaugcaaguuacgucuucuuucuauauuuggucuauuuuuaccucuagacucuacaaugaaguuuuaauuaauccuucauaacuuaagauuuuguuaaucuuuggaagcauuuucccaaguauauaaucugcuaacugugaaggaucucaccaauuuuccugacaauguggaccagcaggaggaagaacaaggacacuguccccguccuuucuucauucauaauggagccaucuauguucccuuaucaaguaaugaagcagauauuuauagcuuccucaaggggaugggauugaagguguucacuaacucaaaaauccgaaaaccaaagucguguucagucaucccuuccgugucugcaggagcaguaggucaaggauacuauggagguaaaacagcaauuugcuuuuaauuuuauuucauguccaacaauauuacuaugcccaaaaugcuaaaaugagguaauguagcccuauuuccacuuuauacacacaaagaaaccaagauucaaauuaauuguuucuugcugaggugacuuagcuggugauagcuagaacugaucagagauuuuuuuuuagauacauccgauacuucagggcacaaaaucagauaaaauacaagauucugauguacuguaagagagggaaaaugcugacaauggaaagaaagaguaauucugauuauggaaacaggaaagacauucauagggaugcuguauuuuaaaaaacauaaagaaggacaaagggcuucacuggugacaagaaacaacgugaacaucacagaaauaucucauaauccauggggaaggaacccccacccccagccaagggaagcgagugauugugcgaccucgccugggaaaucacauuucucccaaggaucucugcaacccauggaucaggagauacccuugugagcccaugccaccagggucuugggucugauacacaaagcuuugaugcagagacuaugaaaggacacguggaaagucaaguugacaguaagaguaggaaggauauagccaugguccacuaaauggaguugaaauaacacauaaugccaugguuuguuaacugcaauaacuggaggaguuggagggcccuugacauauccaguagaaaauggaaaauaguucauuuaggugcaucauccuuuuagauauuucaauauuuaagauaagagugaagacagagaagacaaaacagugagaaaucagagucagagauagaaauuguuaccacuuggaaggacauggggcaagguguaugauauucacuaaagaaauuacuacugaugcuuucuucaguggagaaaacuguuagggugaaauugcuagaaauauauuuuuccuucaggucuaggaguaguagagagaccauauguuccucaauuaggcacauauaaugugauacccuuaaauaaugaacaaaguucagggccagucccugaaacggugcgaagcuauuuuccugagacuuggaucugggaguugguggcagugaacucaucagguguggcugagguaggaguaacagucccugacaccaucaccgaguggaaggcaggggccuucugccuguccgaagaugcuggacuugguaucucuuccacugccucucuccgagccuuccagcccuucuuuguggagcucacaaugccuuacucugugauucguggagaggucuucacacucaaggccacgguccuaaacuaccuucccaaaugcauccgggucagugugcagcugaaagccucuccagccuuccuagcuucccaaaauacaaagggagaagaauccuauuguaucuguggaaaugagagacaaaccuugucuuggacagugacuccuaaaacucuggggaaugugaacuucucagugagugcagaggcaaugcaguccuuagaacucuguggaaaugagguuguugaggucccugagauuaaaagaaaagacacagucaucaaaacccuguugguggaggcugaagguauugagcaagaaaagacuuucaguucuaugaccugugccucagaugaagacauugagcccaagagagcaaguuaaugugacucaggugguacagacaggacuaauaccugggcuuucuugguucauacguagcccuuuuaccuggauagcccaguggcugcucacugacaagcccagcugcagaagcuuagagugucccaggaugaggugcuaaugugucugagcaguuguccuugaagcucccaucaaauguggucaaagaaucugccagagcuucuuucucaguucugggugacauauuagguucugcuaugcaaaauauacaaaaucuccuccagaugccauauggcuguggagaacagaacaugguccuauuugcuccuaacaucuaugucuugaacuaucugaaugaaacccagcagcugacgcaggagaucaaggccaaggccguuggcuaucucaucacugguuaccagagacagcugaacuacaaacaccaagauggcuccuacagcaccuuuggggaacgauauggcaggaaccagggcaacacuuggcucacagcuuuuguacugaagacuuucgcccaggcucgauccuacaucuucauugaugaagcacacauuacccaaucucucacguggcucucccagaugcagaaggacaauggcuguuucaggagcucugggucacugcucaacaaugccauaaagggagguguagaagaugaagcgacccucuccgccuauguuacuauugcccuucuggaaauuccucucccagucacuaacccuauuguucgcaaugcccuguucugccuggagucagccuggaauguagcaaaggaggggacccaugggagccaugucuacaccaaggcauugcuggccuaugcuuuuucccuacugggaaagcaaaaucagaauagagaaauacugaacucacuugauaaggaagcugugaaagaagacaaccucguccauugggagcgcccucagagacccaaggcaccaguggggcaucuuuaccaaacccaggcucccucugcugagguggagaugacauccuaugugcuccucgcuuaucucacggcccagccagcccccaccucaggggaccugaccucugcaacuaacauugugaaguggaucaugaagcagcagaacgcccaaggugguuucuccuccacccaggacacagugguggcucuccaugcccuguccagguauggagcagccacuuucaccagaacugagaaaacugcacaggucaccguucaggauucacagaccuuuucuacaaauuuccaaguagacaacaacaaccuccuauuacugcagcagaucucauugccagagcucccuggagaauaugucauaacaguaacuggggaaagauguguguaucuucagacauccaugaaauacaauauucuuccagagaaagaggacuccccauuugcuuuaaaagugcagacugugccccaaacuugcgauggacacaaagcccacaccagcuuucagaucucacugaccaucaguuacacaggaaaccguccugcuuccaauauggugauuguugauguaaagaugguaucugguuuuauuccccugaaaccaacaguaaaaaugcuugaaagaucuagcucugugagccggacagaagugagcaacaaccauguccucauuuauguggaacaggugacaaaucagacgcuaaguuuuuccuucaugguucugcaagacaucccaguaggagacuugaagccagcaauuguuaaagucuaugauuacuaugagacagaugagucugugguugcugaguauaucgcccccugcagcacagauacagagcauggaaauguuugaggaccauacaggcuguauauuuugguggauucucuguccuauacauuuacuuagaaggaauggaguuauuugucucuauaaaauagacacuaaaaauauuugcugaauaaauauguacuucuggucaaacua

SEQ ID NO: 724 - RNA, 1201 nt, Homo Sapiens
uuugcccuagcaggaaacaaagucaagcgaagagaguugcuugaaucauuaaacagagaggcuaugaaagaagaggauucgauccacuggcaacguccugggaaacuucacgaagcuaagacccucuauucucaacccugggcucccucuguggaaguagagaugacaucuuaugugcuccuugccuaucuuacuguccagccugccccaucuucagaggaccugucuguggcaucacguauugugaaguggauuaccaagcagcaaaauccccaagggggcuucuccuccacucaggucugugggaagacucuagaaggaaacauaaauauauucacauauaugaagacacaaccaucugggaguugaauaauggaauggacacagugguggcucuucaagcgcucuccaaauauggaacagcaacuuucacuaaaagugagaaagcagcuuuggucaccaucaagucuucagacaccuuuucuaaagacuuccaaguugaugauggcaacugccuagugcugcaggagguccaguugccagagguuccaggggaguacagcacaaccaugucagggucaggauguguguaccuccagacaugccugagauauaacauccuucccaagaaagaagggaaaacaccuuuugcucugcagguuaauacucuccccacaaauugugauggaauggaugcucacagaacguuccagauucacaucaacauuaguuauacuggggacugacccaguuccaacauggucauuguugaugugaagaugguaucaggcuucauaccuaugagagcaucaguuaaaaagcuccagaaacagccucagauucagaggacugaagugagcaccaaccaugucccaaucuacuuugaaaagcuaacccaucaaacccugcauuuuuccuucuuuguggaacaagacauccaaauaaagaauuuaaaaccagcuacaguaaaagccuaugauuauuaugagacagaugaauucaccuuugaagaauacaaugccccuugcagugcugaaucugaauaaagaaaugcuugaaaacagcaacuuacggaccucauugggugaacuucuccagaaaugaagaacagacucaucaauagagaggacagugagagaaagaagggaagaucauuggaaauacacaaaauuuguauguugaauaaauuuauggcauuuau

SEQ ID NO: 725 - RNA, 3755 nt, Homo Sapiens
gagaugguucaacucucuuacuugguuauuuccaucucgguuauuccuugcuccagcagaauccugaaauguccauguaucucugagcagcuaugaagaagcuuccuggaaaacaauaagcaaaggaaaacaaaugugucccaucucacaugguucuacccuacuaaagacaggaagaucauaaacugacagauacugaaauuguaaaguuggaaacuacauuuugcaaagucauugaacucugagcucaguugcaguacucgggaagccaugcaggaugaagauggauacaucaccuuaaauauuaaaacucggaaaccagcucucaucuccguuggcucugcauccuccuccugguggcgugugauggcuuugauucugcugauccugugcguggggaugguugucgggcugguggcucuggggauuuggucugucaugcagcgcaauuaccuacaaggugagaaugaaaaucgcacaggaacucugcaacaauuagcaaagcgcuucugucaauaugugguaaaacaaucagaacuaaagggcacuuucaaaggucauaaaugcagccccugugacacaaacuggagauauuauggagauagcugcuauggguucuucaggcacaacuuaacaugggaagagaguaagcaguacugcacugacaugaaugcuacucuccugaagauugacaaccggaacauuguggcaaggaagagaaacuuuucuuaacaucuuucaggauucugaccauuguguuuaugaguacaucaaagccaggacucauuuaauucguugggucggauuaucucgccagaagucgaaugaggucuggaagugggaggauggcucgguuaucucagaaaauauauucccucuucucucaguccaauuuucaaaguuugaguuuuuggaagauggaaaaggaaauaugaauugugcuuauuuucauaaugggaaaaugcacccuaccuucugugagaacaaacauuauuuaaugugugagaggaaggcuggcaugaccaagguggaccaacuaccuuaaugcaaagagguggacaggauaacacagauaagggcuuuauuguacaauaaaagauauguaugaaugcaucaguagcugaaaauugcuuauuucucccuuucuucucacuggaguuauuuuuaauauuaucuuuccuaucagaauuaccuagucccuucuuugaauauacagaagccaucacgugaguuuaucauuugcuucccaauuguucuauuuuccuuuaauuuucuuucuucuuguccuucauuucuaauuaccugaacaugguaugauuuacugcaucuucagauauacacauauaacaucaaaaucaggccaauauagguuagggcuuaauuaauauaaguugugcaaaauaucuauguuugaaaucuguccaaaauaucuaaguuugaaaggcgguguaagauaguaaaaagaauauuaaacuuagaaucagcaaaauaauuuagaugucaauuaacuaaauuacaaucaugaacaaguuucauaaccucuuuaacuucccuuuucucauauuuaaaauaggaauaauaacaaccaucuuuuauaucucacaguucuacaaccuaaaauagaacuuuagaguguuaacuguaccagaaacuccaugaaagcgaacacuaugacuuccccauucacuauucucuuaccagcaccaacccgaaacccuggcucacaaaacagagagauauuuguuucucuuuguauaagauaguucaugagaaaaauagcucaaucauuaaaacauuacgcaaauagaauuacuauuccaagucuaccucugguuagauucaacaguaguaauuuucugcgcuagagaaggaaaagaaaguuugcaagaaaacucacuggguuuguaaaaugaauaaaugcuucuuaaguuucagaggcuacuagacagaaggacaaguaaaaaugcuuuaauuaguauuuuccuaacaguucugugcuuuauuuuugcugaguaacucaggaaguauuuacagaauauguggaaaggcacccuuuuacaggauaauaggaaaaaauugcauuucuuucccacagcuucccuuuuuuaacuaguggcuaccauuuacgaacaugauucucaaacaucucaacggagguuuugguuaaaacauagagaaaccaaauaggaaacucaaaugcugauguuacucagugggaagacugaggagacacagagaccuggguuuuuaccagcaucacgacacaauucucauacaaguagucuuuaauacaguuagagaaauaucacuacuuuagaacuuacucucuaucuggcuuuggauaaguaauguucucaccuugaaauggguuuaauauuauuaccuugcucauaaguuaauugugaagcucauuuaauaugauuauauaaaguaucgaucagaauaccaaguauguaauacauacucaauaaauauguguuacucuuaaagcuuugugcgcuaacacugaaagacacuugaaucuuuaucuuuuuucuagccuaucaauaauuaagcagauuuggagggcuuaggaaaaauaauagaaauaccucaaauuuuacuuguuacuucaaaugucuggagaucuuggauuugggugaugguaucaguauguuuuuuauuuugaauugucuauuuagagaaacuaaauaggaaccaauaauucagaaaacuguacaaaauuagcaacucaacuuuguuucaucucccuaaaauggaaaaacauauguguauacaucccuauagcacacauaaacuuagaagaauaauaucuuagugcauggcaacaauacaauuaaaaauguaggccaaucacugugauucuuuuucugguauucauaucuaaaguaucuuauacauaaaaucaaaauagcacaaacguuaguagcacagaucagaccaccucauuucaaauacuaaaucuucuacaugucaucuaagugaacuccagcaaaauuugacuucugucuucuucaauuuaaaacuaacuuacaggcaugccucggaaauauuguggguucaguuccagaccaccacaauaaagcaauuauugcaauaaagugagucacauuaauuauuugcuuucccaauucguguaaaaguuauguuugagcuacaacgucuucuauuaaguauacaacagcauuaugucuggaaaauguacauaguuuuauuaaaaauaguuuauugcuaaaaagaaaacccaaaucaugauauuuugaagaucagagauguggcucuccgucauuuuggcaucccacugggccgggaucuguauuucacugagaaugcucugcugcacaaacuauacaagcccccuucccucuaggcccagcuacugucacagaagaggagggggcagaagauuguaagggcugguuuuaaagaaaaaaauuaggucaaggucaaaccuccaaaucaaggagggguuacaaaaaugccuaaacagcugguaaaacaaguuuaguugcuuucuaaacgauuaugugucacuuuugcaucuaccccaaccaugaaaauuuauuugcuuauuauagaauuacaggaaaauauuuacuaacaggauaaaaaauaccuuguaacaaagccucuuggguauaauacucccaguuaugaguuauggagauaaacauaucuaucuauauauuuuuuuucagaacaaugcuuauguuugcauagcuaauugcuguaugucuuuaacaaaagccaagcuu

SEQ ID NO: 726 - RNA, 5887 nt, Homo Sapiens
gcaacggacccugggagucggccaucaugcuggccccggaggccguuagcuuagucauggcucuaaauauguaccugcaaucggauguugaggaucaccgagcccgcgacguagaaguacgggaaguucaugcgcagcugccaggccagcucgaagaaggcgagcagggugcgggagagccccuugcagaagacgccguacgaguuucuccagcauuuggcucuaggugccaagggcacaugugacaagaaggugccagcuuuauaaaccuuggaacuucuucugugucaguucugagacauacaguuuacuaaaacacaucaugaaggccuguuuugaagagaaggggaauaagacugcaucuguucauaugagguaugucgaagcacuuggauauguuuucaaaccaccaaucuugaucauuuagaaaugugcucccuuuuccaauuucauccugauaaaaauguaugaucucuggacguugccaauauuccccuccauuccaucaugagccguucucuguaauucagaaucuguggacuaagcuguagguucuccagcauuuggcucaaggccccaagggcacaugugacaagaaggcgccagcuuuuuaaacauuggaaguucuucugugucaguucugugacagaacauuuacuuaacacaucaugaaggcuaguuuggauguggaggggaauagacuccaucuauccauaugaggugagucaguuggagucucacucuguuauccaggcuggaguucagugguaggaucauggcuuacugcagucuggaacuccugggcucaaaccauccucccaccucagccuuacagguaaaauggaaagcaguuauacaaaugcuauacuaacuccucacaaagacuacccaaagauaauauuaucaucuguguuuuuuggugaucauacugaggcagagagcaguugugaaauggagucucagaaucgucgguauaugaagcagaaaaacugguuuccucucuuggcagucugacuccaagaucucuuagaaacaauuauacuguaaaaaccugaaaaagaaguaaaaaacaagauuggagacuaauacuaacaucuauucuucuuaauagcauaaucaaaaauaaauuaaacagaaaaauaaaagugaauauucauaccaagggaacugcugcagaagaauauuuugccugcuggaaccugcuguaucuacucaagaguggaaguuuucacagguaacuucuacauaucaaguaacacaggaucaaaugaaaaccuagcaacacuugguuucugccuguaucagacaggugaaauugcaagcaguuauacaaguaguguacuaacuucucauaaagccuacucaaggaggguauuguuauugugugcguuuuacagauggcuauccuaaggcugauaguaguuguaaaauauagucuaaguucauaucuauaugaaacagaguaucuggguuucuguccuggccaucagacuugaagaucauuucuuagaaacaauuauauuaucaaaacugaaaagaaauacaauccaagguuggagucuuauuuuagcaucuauuaaucuuaagccauuaaguaaucaaaaaaagaugcagcacacugucaaaauauccggagacgccagcaccaaagcccacagaggaguuaaaagugugaucacuuucuuccuacucuaugccauuuucucucugucuuuuuucauaucaguuuggaccucugaaagguuggaggaaaaucuaauuauucuuucccaggugaugggaauggcuuauccuucaugucacucauguguucugauucuuggaaacaagaagcugagacaggccucucugucagugcuacuguggcugagguacauguucaaagauggggagcccucaggucacaaagaauuuagagaaucaucuugaauauauuagaaaaaaaauagcuccuaagaaauucuuguauguuauauaaauuuauacuuccuuaagauucuuucauuguguauaacuuugugaauuuuacaaagauaugcuuggaaucaacaccauccaaacauaucacaaauuaggauauaugaaaguauguauauuaccauacagagaagaaugcgaauacuauaaagaguucuuauacaaacagauaauauagauuuuguaucaaucauucaccuuuuuugagauuuuuaaaugagaaaaccuauaauguauaaaauacauguguguauguauguaugugacacaguuacuaaaaauaggcuucuuaaacuuacaucucaaucugguagauaaaguacauaaaagaauauggaauuuuaguaccuauauuaaguguuuuuaauuuuuguauaauauuuaguaccugauuagcguguaugcaaaaaaguaauuugcuucguuuguugaauuagaagccagcugccuuacuaaacuaccacauuugcuuugcucauucucuuggcuuugcagauagaaaauuauaucaucugcauauagugacuuauaaugauuauuuuacuucuccauuuuacuacuuguaauucuuuuuugguaucaguuguauaaugaaaugguuugaacauucaaaguguuaaguaauccugaucguaacugcugucuuugcaaauggaguguuuucuaguguuuuaacaauaaacguaauacugacucuagcuuugagauaaauucuuuuaaaaauauucuucagggagaauauuuguuuccuaucuuccuguguauaguauuguaauaaaaucucuguuaaaaacuaucaaaaacugcauggcuuuucaugauuuagcuuuagaauuauuauagcauuuuuauuaguugaauuagucacaaaccauucuagauuuaaggacagaguacacagacuccuaagauaucaauagaagaagugccaaaaugauguucauccuuccuuuuguggaaacacuggcuuccauucuucucuuaauccucuccuuauggagccacaccaggcagaugaagcuacaugguauuuauuccagggaucccagcacagaagcccauguaaaaccuauaaaagcuauaauuucauuucuacuccucuuuauugugcauuauuucaucaguaucauacuaacauuggccuguccucuucuagacuucgagauauuugcuuacauuccaguguaaagcuucuucuucagaaggcaagauggacagguuacucacagugaucaaaguuuuuaagacuggaguuuccuaauuuugagauuucucuuuugauagacaccacuacuugcacauguaacaucaguuucucaucuuaucccugugaggggacugaagcuugaagaaauaguacgaugauauuccucugacuacugcuaguacuucagugaauaauaaaccaucuuuugccuucugcaaguacaacaagugacaagcuaaguuguuagcuuauaauaauuuuggcaacgaggauggaacacagcccaaagaccuggccuucugaggagaaagugaaggauccuacaagcugauuaauaggauuugcugaaaguccaugggaacugguagcuaacauguugacuaaaauguuuguaauugguaaauaaauauucuucuauuaggagcugacacguuucucccagcacaaaguugggagugacaccagagccuccugcaagaugcuucugauucugcugucaguggcccugcuggccuucagcucagcucaggauuuaaaugaagagaugucagccaggaagauguuccccucguaauaucagauggaggagacucugagcaguuccuagaugaggagcgucagggaccaccuuugggaggacagcaaucucaacccucugcuggugaugggaaccaggaugauggcccucagcagggaccaccccaacaaggaggccagcagcaacaagguccaccaccuccucagggaaagccacaaggaccaccccaacaaggaggccagcagcaacaagguccaccaccuccucagggaaagccacaaggaccaccccaacagggaggccaucccccuccuccucaaggaaggccacaaggaccaccccaacagggaggccauccccguccuccucgaggaaggccacaaggaccaccccaacagggaggccaucagcaagguccucccccaccuccuccuggaaagccccagggaccaccuccccaagggggccgcccacaaggaccuccacaggggcagucuccucaguaaucuaggauucaaugacaggaagugaauaagaagauaacaguguuucaaaugccgugaaacauggcaucaugcucuaacuucaguauaccaauaaaacaaucagcuugcaauuuccaacgcagaguugggagcaacuccagagccuccuucaagaugcugcugguccugcucucagugguccuucuggcucugagcucagcucagagcacagauaaugaaagaccuggcugugcugugaaggaugcaguggagaaugcaagacugauccagggaaguccagcuaugaagaugcuacaguaaucucaguggacagcgaugaugguguccuugcuguacaggggaugcagaaucaaugaaagagauaaacaaacaucagaguacugucagacauagaggacuggauaauacauuugugucuuucuacauagugguauagaaauaucagguccccaaauucccauuuuucuuccaaucacauuuaaaauuucaauauguugcaggcagcauguguaagauuauauccaaauauuuacuccugguugcuccucuugggcaagcuugugaauaugaucaaaauauuuaaagaaggaagaagguaaagaucuaaaauaugacaugaaaauacccagagaagugugccuaaauuagcauuaggguuugagggauccuaaggaugacaaaaagggacucuucuauugaauucgugguugaugcucagcgauaguaacaauccugccuccccuaacaucuuccuccccuuccagcagcuucacagaacaugguugaugagguaacuuaggggaugcacaggguguggccagaagaccccuuucccuauagaccacuaugagcccugaaagauuuaugagguaauguucacuucauccugugcuucuuuuccuagaugugaacuaugaagacuuuacuuucaccauaccagguaaaucauguagaggacucaagucagagaccagaucagggaccccagagaccuccuccugaaggacuccuaccuagacccccuggugauagugguaaccaagaugaugguccucagcagagaccaccaaaaccaggaggccaucaccgccauccucccccaccuccuuuucaaaaucagcaacgaccaccccgacgaggacaccgucaacucucucuaccccgauuuccuucugucagccugcaggaagcaucaucauucuuccagagggacagaccagcaagacauccccaggagcaaccacucugguaaucuagaauucaguggcagguaugauuccaguucauucuccauuaaaugcccaaacugcuaccauucccaaaaaaauaaauaagaagauaacuuccuucagaaagccaugacauugaaauaauguggucauaacucuuucuucaguauaccaauaaaauauuaauagcaugcaaggaaucucagucuuugaggagauuuuaaucucacaugcaaauucaguggcuuagucagcuuccccacccugcaacuucuuccuacaaacuuccuagaggaagaccaucagccuggagacuauucgcuguaaagauuauaacggugagaauaagcucuaaaauaaaacuucuuguugugcuuuaccugacuuuucugaagcaaggacacccauucucccagaaaacccaaaggaa

SEQ ID NO: 727 - RNA, 930 nt, Homo Sapiens
augauaacuuuucugcccaucauuuuuuccauucuaauagugguuacauuugugauuggaaauuuugcuaauggcuucauagcauugguaaauuccauugagugguucaagagacaaaagaucucuuuugcugaccaaauucucacugcucuggcagucuccagaguugguuuacucuggguauuaguauuaaauugguaugcaacugaguugaauccagcuuuuaacaguauagaaguaagaauuacugcuuacaaugucugggcaguaaucaaccauuucagcaacuggcuugcuacuagccucagcauauuuuauuugcucaagauugccaauuucuccaaccuuauuuuucuucacuuaaagaggagaguuaagaguguuguucuggugauacuauuggggccuuugcuauuuuugguuugucaucuuuuugugauaaacaugaaucagauuauauggacaaaagaauaugaaggaaacaugacuuggaagaucaaacugaggagugcaauguaccuuucaaauacaacgguaaccauccuagcaaacuuaguucccuucacucugacccugauaucuuuucugcuguuaaucuguucucuguguaaacaucucaaaaagaugcagcuccauggcaaaggaucucaagaucccagcaugaagguccacauaaaagcuuugcaaacugugaccuccuuccucuuguuaugugccauuuacuuucuguccauaaucaugucaguuuggaguuuugagagucuggaaaacaaaccugucuucauguucugcgaagcuauugcauucagcuauccuucaacccacccauucauccugauuuggggaaacaagaagcuaaagcagacuuuucuuucaguuuuguggcaugugagguacugggugaaaggagagaagccuucaucuucauag

SEQ ID NO: 728 - RNA, 1687 nt, Homo Sapiens
gucgcuaaagacaaaugauggagagguuacacaaggaaaaauugcaaacacuggaagugaacauguccuuguuugcauacuagcaaaugagaauucagguuucaugucaauuucaguaugaauaauuccagccuauaacaagaacagauggugaaugagucaguuaauuugaauuguuuugaaaauaagaauguuuuccauaaagagagcauugaacuuauccauuagcaugccauggugauuucugacuugacacuggucacagcaauuaaaaguaaaaagaaugucacagcacauacacaaaucaggugcauauagaauuuaaggucaggauauucaagcaaucacaaccagugauauuacaccagcauuuuaaaaauuucuuuuugucuguucagacaugauaacuuuucugcccaucauuuuuuccauucuaauagugguuauauuuguuauuggaaauuuugcuaauggcuucauagcauugguaaauuccauugagugggucaagagacaaaagaucuccuuuguugaccaaauucucacugcucuggcggucuccagaguugguuugcucuggguguuauuacuacauugguaugcaacucaguugaauccagcuuuuuauaguguagaaguaagaauuacugcuuauaaugucugggcaguaaccaaccauuucagcagcuggcuugcuacuagccucagcauguuuuauuugcucaggauugccaauuucuccaaccuuauuuuucuucgcauaaagaggagaguuaagaguguuguucuggugauacuguuggggccuuugcuauuuuugguuugucaucuuuuugugauaaacauggaugagacuguauggacaaaagaauaugaaggaaacgugacuuggaagaucaaauugaggagugcaauguaccauucaaauaugacucuaaccaugcuagcaaacuuuguaccccucacucugacccugauaucuuuucugcuguuaaucuguucucuguguaaacaucucaagaagaugcagcuccauggcaaaggaucucaagaucccagcaccaagguccacauaaaagcuuugcaaacugugaccuccuuucuucuguuaugugccauuuacuuucuguccaugaucauaucaguuuguaauuuugggaggcuggaaaagcaaccugucuucauguucugccaagcuauuauauucagcuauccuucaacccacccauucauccugauuuugggaaacaagaagcuaaagcagauuuuucuuucaguuuugcggcaugugagguacugggugaaagacagaagccuucgucuccauagauucacaagaggggcauugugugucuucuagcagaaaacaaacuggugguguaugaaacauuuuauauuucuuacuggguuuucuguaauauauguauaugaauaauuuccacauguauaccuagaaaagucuuuuaccuaaaguuagucuagaaaaguacauauauauagauguguguguguguguguguguguaugaaaaacugaagaacauugacaauaacaugcuuuuuauuguuuuuucacaaaaacugccaaauuauagaaaauaugacaaaaauuccucaauuaugaagccauguuuauuucauacauguauuuuauauuucauuuguagaauuuauaucuauuuauaauu

SEQ ID NO: 729 - RNA, 2807 nt, Homo Sapiens
uuuuaacuugcgcgggccgcgaggcaaggcucaccugcagacccucgggccaccagcagggaggcacgcacucccccucgcagcgcgcccagcccggggucagcgguguggcugagcugggggggagcgcggggcgguggggggagccaccucccugcggggcucagcgcuggggccgggagcccggagccuccgcggggagggacgcgcuaauguugccgggaagcagcuccggguugcagggcaggaacgugcccuucccccgcggcaaacuugccgucgcugcgacggaagcaggaacuugcuaaccacaaaacccgccaggccggugcgggagcugcggagcauccgcugcgguccucgccgagacccccgcgcggauucgccgguccuucccgcgggcgcgacagagcuguccucgcaccuggauggcagcaggggcgccgggguccucucgacgccagauuuuuguguggacauaaguuuucaauucauuugagugaauacauaggaggacaauugcugaauuguaugagagaaaucucaucaucugugcagccuucuuaaagcaaacuaagaccagagggaggauuauccuugaccuuugaagaccaaaacuaaacugaaauuuaaaauguucuucgggggagaagggagcuugacuuacacuuugguaauaauuugcuuccugacacuaaggcugucugcuagucagaauugccucaaaaagagucuagaagauguugucauugacauccagucaucucuuucuaagggaaucagaggcaaugagcccguauauacuucaacucaagaagacugcauuaauucuugcuguucaacaaaaaacauaucagaaaaugaacaaagguguuuguguuggacuccauaauaagugaaguuuuuccuacuugcccuacucuuuagaaaaucgcauuucaaaaucaugcuuaugaaaccuuucauugcaggggacaaagcauguaacuugaugaucuucgacacucgaaaaacagcuagacaacccaacugcuaccuauuuuucugucccaacgaggaagccuguccauugaaaccagcaaaaggacuuaugaguuacaggauaauuacagauuuuccaucuuugaccagaaauuugccaagccaagaguuaccccaggaagauucucucuuacauggccaauuuucacaagcagucacuccccuagcccaucaucacacagauuauucaaagcccaccgauaucucauggagagacacacuuucucagaaguuuggauccucagaucacuuggagaaacuauuuaagauggaugaagcaagugcccagcuccuugcuuauaaggaaaaaggccauucucagaguucacaauuuuccucugaucaagaaauagcucaucugcugccugaaaaugugagugcgcucccagcuacgguggcaguugcuucuccacauaccaccucggcuacuccaaagcccgccacccuucuacccaccaaugcuucagugacaccuucugggacuucccagccacagcuggccaccacagcuccaccuguaaccacugucacuucucagccucccacgacccucauuucuacaguuuuuacacgggcugcggcuacacuccaagcaauggcuacaacagcaguucugacuaccaccuuucaggcaccuacggacucgaaaggcagcuuagaaaccauaccguuuacagaaaucuccaaccuaacuuugaacacagggaauguguauaacccuacugcacuuucuaugucaaauguggagucuuccacuaugaauaaaacugcuuccugggaagguagggaggccaguccaggcaguuccucccagggcaguguuccagaaaaucaguacggccuuccauuugaaaaauggcuucuuaucgggucccugcucuuugguguccuguuccuggugauaggccucguccuccuggguagaauccucucggaaucacuccgcaggaaacguuacucaagacuggauuauuugaucaaugggaucuauguggacaucuaaggauggaacucggugucucuuaauucauuuaguaaccagaagcccaaaugcaaugaguuucugcugacuugcuagucuuagcaggagguuguauuuugaagacaggaaaaugcccccuucugcuuuccuuuuuuuuuuuuggagacagagucuugcuuuguugcccaggcuggagugcaguagcacgaucucggcucucaccgcaaccuccgucuccuggguucaagcgauucuccugccucagccuccuaaguaucugggauuacaggcaugugccaccacaccugggugauuuuuguauuuuuaguagagacgggguuucaccauguuggucaggcuggucucaaacuccugaccuagugauccacccuccucggccucccaaagugcugggauuacaggcaugagccaccacagcuggcccccuucuguuuuauguuugguuuuugagaaggaaugaagugggaaccaaauuagguaauuuuggguaaucugucucuaaaauauuagcuaaaaacaaagcucuauguaaaguaauaaaguauaauugccauauaaauuucaaaauucaacuggcuuuuaugcaaagaaacagguuaggacaucuagguuccaauucauucacauucuugguuccagauaaaaucaacuguuuauaucaauuucuaauggauuugcuuuucuuuuuauauggauuccuuuaaaacuuauuccagauguaguuccuuccaauuaaauauuugaauaaaucuuuuguuacuca

SEQ ID NO: 730 - RNA, 8360 nt, Homo Sapiens
cugggcgcgagcggcugagucggcugggucucuggcgccgcagaggccgcgggcgaggaccgggaggggagagggaggagacaggaggaggagacgcgagugcgggguggcgccgguccaccuccgcagcgcuccugccucccccaggcuuuggaaggcgggcccgggcugcggcagcggcggccucggcugccuggggaggugaagucgggcugcggcggccucggucggcgcggcggagggaggcggcugacccggcgagggugggcagggggcggggcggggcucccgagggccgcggucggugcguuuuccgcaggucggugccugcagggcucuccguggccgcucgggagaggugcucuucgcucaggcucccccggagacuugagggggugcgcgcuggcgugcauggggccuguucuguccuugguuuggggaugcuccuaaggggggagaaagggauaccucgggugcuuggaggucgagagacggauacguaagugcgcaagggccacugauuagggcacgggaagggcucgcuagaaugagcucuuaaacugguuggguguaagcgguuuugggcuagucuaaaccaaacaacugagaauaaacgcgggguuccugcagguugagagaguaccugucugcaaauguccaguagugauggauugccuuguaggccccagagcaaucggggaaguuagcauucuuguucaagaagcugcugguucacuuagagcuauaaaagaauguugugaguuuggauuuucuuccaaacguucaggauugagguuagggcugguggugagggaucauguaaagagguuugaguggcucagccuuaggucccgguguggaaagcuuauucuuuuggugucaucacguggccgugggaauuauuuagaaugugaucugcccucaugagaagaaaggagcucugaagccguugcaguucuuccucccuauguggaaaaucgaauuucuggaaacauccuccguauugggagauuuugccuauguaaaggcuauccuuauuggcuagcggcacuaauuacuuuaaaaguaggauggaaguacaaguaucucaagcaucauuggguuucgagcucacuucuguggaaaagaguuuaagggaguggucuagacuuuccagggaaguuauugccuggcugugucccucuaguccuaauuuuauacuuaacuuucccccaccuccuucagccucaucuguuucaauggugcaacucuuuucauccccuuuugguuaccagucaccuucaggccauucagaggaggaaagagaggggaauaugaagucagccaagccccaagugaaccacagucagcauggggaaagccagcgggccuugagcccccugcagucuacucugaguucugcugcaucuccuucccaagcguaugagaccuauauugaaaauggacucauaugccuuaaacacaaaauuagaaacaucgagaaaaagaagcacugacauuuuguacaggauaauucuucguuguaaagggcuguccugugcauuuuaagauguuuggcagcaucccuggccucuaaccacaagauaccgguagcacucuucaccucccuucccccucccaaguugugauaaccaaaaauaucccuagauauugccagguaucuuugggggacaaaauuguucccuguugagaagcuacuguguuggggacacaugauuuaguagcucaaacuggaggauuauaaggaucgccugaaaaguggagagcaucuuaauccagaccaguuggaagcuguagagaaauaugaagaagugcuacauaauuuggaauuugccaaggagcuucaaaaaaccuuuucuggguugagccuagaugugacuacuaaaagcgcaaaagaaggcccagagaagggagcacaugcuaaaacuugaggcugagaagaaaaagcuucgaacuauacuucaaguucaguauguauugcagaacuugacacaggagcacguacaaaaagacuucaaaggggguuugaauggugcaguguauuugccuucaaaagaacuugacuaccucauuaaguuuucaaaacugaccugcccugaaagaaaugaaagucugagguaagcuaaugaauguugaagaccagauggagcagucauccuuguacuuuugggaccuuuuggaagguagugagaaagcagugguaggaacgacauacaaacacuugaaggaucuacugucuaaauugcugaacucaggcuauuuugaaaguaucccaguucccaaaaaugccaaggaaaaggaaguaccacuggaggaagaaaugcuaauacaaucagagaaaaaaacacaauuaucgaagacugaaucugucaaagagucagagucucuaauggaauuugcccagccagagauacaaccacaagaguuucuuaacagacgcuauaugacagaaguagauuauucaaacaaacaaggcgaagagcaaccuugggaagcagauuaugcuagaaaaccaaaucucccaaaacguugggauaugcuuacugaaccagauggucaagagaagaaacaggaguccuuuaaguccugggaggcuucugguaagcaccaggagguauccaagccugcaguuuccuuagaacagaggaaacaagacaccucaaaacucaggucuacucugccggaagagcagaagaagcaggagaucuccaaauccaagccaucuccuagccaguggaagcaagauacaccuaaauccaaagcaggguauguucaagaggaacaaaagaaacaggagacaccaaagcuguggccaguucagcugcagaaagaacaagauccaaagaagcaaacuccaaagucuuggacaccuuccaugcagagcgaacagaacaccaccaagucauggaccacucccaugugugaagaacaggauucaaaacagccagagacuccaaaauccugggaaaacaauguugagagucaaaaacacucuuuaacaucacagucacagauuucuccaaaguccuggggaguagcuacagcaagccucauaccaaaugaccagcugcugcccaggaaguugaacacagaacccaaagaugugaguugaucuguaucauucugcuucuguaaguguaggcauaaauaaggugucgugguaaugacuuuuuaguucucuuuuuuuuuuuuuuuugagauggagaaacacucuguuacccaggcuggagugcaguggcacuaucucugcucacuguaaccuccgccuccuggauucaagcgauucucuugccucagccuccugaguagcugggacuacaggcgcaugccaccacaccuggcuaauuuuuuuguauuuuuaguagagacggggugccuaagccugugcaucagccuguagguucuuccucuacccuuccgaaggauccaguauugaggaaagaaaaacugcaggaucugaugacucagauucaaggaacuuguaacuuuaugcaagagucuguucuugacuuugacaaaccuucaagugcaauuccaacgucacaaccgccuucagcuacuccagguagccccguagcaucuaaagaacaaaaucuguccagucaaagugauuuucuucaagagccguuacaggcuacuucuucuccaguuacuuguagcucaaaugcuugcuugguuacuaccgaucaggcuucuucuggaucugaaacagaguuuaugaccucagagacuccugagguaaaagaccaauugucuuaauuucuuuuguaucuuaaagaauagcagaaccaguuuaucuuaugaauuacaggcaugauuaguugaaugauguaacauuuauacuuuauuaauguauugcuuucuauagauauugugaucuuggaacuuuuacagguaacuuuauuguagcuuugccauauaaauagauuuaauaugguauugccuuaucuagugcaauaaauguccauuuuuaaucuaaaaaaaugaaaaguguagguagcauuaagucaaguuuuccacuauauuuacacugaaggacuuuuaggagaaaagucucuuauuuguauaaaugaaagcucaauaacuuuauuuuauuaauauuagcacuuauugaguuggaaugaguuacaaucuuguuuuggcuaacuuugucaaaaauauuuucggucagaugcaguggcucacaccugcaaucccagcacuuugggaggccgaggcagguggaucacuugaggucaggaguucaagaccagccuggccaacauggugaagccccaucucuacuaaaaauacaaaaauuagcugggugugguggcucaugccucuagucccagguacucaggaggccgaggacagagaauugcuugaacccaggaggcggggguugcagagauugugccacugcacuucagccugggugacaaagugauacuucaucucaaaaaaaauaaauaaauaaaaacauuuuaacaguauuauguuugugcuuucaauuucaauucuaaguuacaguuuuuacuaaguuugaguaaauccuugagauggacauaguaggaugaauuuugaggaguaauuuagcaacuaucagguauuuuuuguuaacuguuauagaagaauauguauucauuauagaauauaagaaaauauagauaauccuuaguuuuuauggugcuggcuugaucugaauuuaaauuaucucauuccucauuuuaagaagaggaagaagugauuguuaccaaguaacucacagcugucugcuucacaaucuaguugagauugguuuuugguauuuuuuuuaagccuuuggauuuauaaucuguuaugucaagaacuuguggcuuccuuagguaaggauuacuuaaauuggaucggaguuguuuucuguuuuagguagcugacuuagaaaccuacuaacuaauaagucuuuaaaauagagaaaaauuaacacuaaacaacuaauccaaguuuuuucuuaaauccaauucugauguauaaauuuugaauaauauuagguucuuaacuggaaauuaccauuucaggguuugaaaaggacuaggugcguauaaaaaguucagccccucaucuguuagacugauuauugguaagacucuuucacuuagucagcaagcugugcaaagcaaauacugguaugcauccucagcaauugagauuugaaauuguaagcaaaagcuauucuuuugcauuccuguguccaaaugucauccuaaagaacuugcugacuuaugccaguuuggguuuuagaguaaguuaacugcuuguuauauggcaggugauuggcugaugcugcauuucuccuccccaggcagcaauucccccaggcaagcaaccgucuucacuagcuucuccaaauccucccauggcaaagggcucugaacagggcuuccagucaccuccagcaaguaguaguucaguaaccauuaacacagcacccuuucaagccaugcagacaguauuuaacguuaaugcaccucugccuccacgaaaagaacaagaaauaaaagaauccccuuauucaccuggcuacaaucaaaguuuuaccacagcaaguacacaaacaccaccccagugccaacugccaucuauacauguagaacaaacuguccauucucaagagacugguaagaucuuugcauaugauauuuggaagacuuagagggacagccaauugaauggacagcaagucuaggaagucuguagugacacuuuagaaguauuuuccugaccaguaagcauuauuucuuuacauguuccuccaguguugagaaaaaccuaaugcccuuuuuuguguuaaguuuaccuauuaauuuuaauuuuuguagagauagaacuuagaugacggauuuaaccuugaaguagguuuguauuuuuaaaucuauuugcuuugauuaccacagacagugauugagguagaugggcacuaucuggcugcuuauaugaagguuuugaaaccauucuguuaauccuuuuaacaaaugguuaucuguccuuuucuaucuuauaauaaaagauugaagauaugacuuaguaugcucauuguacuguuugcuuagagaugggaggcuauuuugauuuuucaugcuguucuaaaucaugaaagaauagguaacuuuguacucauuucuuaauuuaaauuuaagaagcacuuguagauuuuuuguauugguauuucagaucccuauugaguuuuuuaacugaagucggagcaaaugaauugagcauucugaguacuuggcuaaucaagugaugaagagguaguaauaugaauucugggaccuaggcauagaugaccugauucuguucuccccucuacuguugaaagacagggcaggugacuuacguaagggauauuuuugucaggugccuucucagauauuaauuagaauccauuuucuuuuacucccucaucuggaguauuuagccugcuuuuuaaaaauugucguaaaguauacauaacauaaaaauuaccauuuuaaucauuuuuaacuauauaguucuguggcauuaaguacaaccaaacuguuguguaauuauuaccacuguccaccuccagaacuuuucaucuccccccaacugaaacuuuguaaucauuuaauacuaacuccuccuccuccucuccccccagccccuggcaaccaccauucuacuuucugauucugaaaaugacugcucuagguaccucauauaagugguauacaauauuugugcuuuugaaacuagcuuauuuuacuuggcaugucuuaaggguucauucauguuguagcaugggucaaaauuuucuuccuuuuuuaggcugaauaauauuccauuauauauaugaauuacguauuugagucauguagaugaauuauauacaugaauauauguaucuccuauuuauuuuuaaaggcagcaaauuguauuaaugauuuugauauauauuggcuuuuaaguauaaagacuauuaccauuuaacucuuggacccuaaaaucguuuuucuuaagcagcaaauuaucauccugauggaacuauucaaguaagcaaugguagccuugccuuuuacccagcacagacgaauguguuucccagaccuacucagccauuugucaauagccggggaucuguuagaggauguacucguggugggagauuaauaaccaauuccuaucgguccccuggugguuauaaagguuuugauacuuauagaggacucccuucaauuuccaauggaaauuauagccagcugcaguuccaagcuagagaguauucuggagcaccuuauucccaaagguguuuggaaacaucugagccucuuugguugcuggggaaggccaggauaauuuccagcaguguuauaagcgaggagggacaucuggugguccacgagcaaauucgagagcuaacugcuucauuaugagaaacucacuguugcuaauaaaacagcaggguggagugauucuucucaggugagcagcccagaaagagacaacgaaaccuuuaacaguggugacucuggacaaggagacucccguagcaugaccccuguggaugugccagugacaaauccagcagccaccauacugccaguacacgucuacccucugccucagcagaugcgaguugccuucucagcagccagaaccucuaaucuggccccuggaacuuuagaccaaccuauuguguuugaucuucuucugaacaacuuaggagaaacuuuugaucuucagcuugguagauuuaauugcccagugaauggcacuuacguuuucauuuuucacaugcuaaagcuggcagugaaugugccacuguaugucaaccucaugaagaaugaagaggucuugguaucagccuaugccaaugauggugcuccagaccaugaaacugcuagcaaucaugcaauucuucagcucuuccagggagaccagauaugguuacgucugcacaggggagcaauuuauggaaguagcuggaaauauucuacguuuucaggcuaucuucuuuaucaagauugaaagucaguacaguauugacaauaaaaggaugguguucuaauuagugggauugaaggaaaaguagucuuugcccucaugacugauugguuuaggaaaauguuuuuguuccuagagggaggagguccuuacuuuuuuguuuuccuuccugaggugaaaaaucaagcugaaugacaauuagcacuaaucuggcacuuuauaaauugugauguagccucgcuagucaagcugugaauguauauuguuugcacuuaauccuuaacuguauuaacguucagcuuacuaaacugacugccucaaguccaggcaaguuacaaugccuuguugugccucaauaaaaaaguuacaugcac

SEQ ID NO: 731 - RNA, 1242 nt, Homo Sapiens
gcccguccccaucugcgggcuuuccaaggugcugugcugggguuugccgagcuccgcagcccgggucaaccagccgacgguggcggaacggcgggcaggucggcggaguuagauggccgcaaaggugggcaggcucggugugauaagguuccaacugggucugaucgcuuccguccgcgagcgccggguccaccaaaugucggcggcgagcgcuggcuuugaugguuaacuugggauuucuaaguauucuguggacagucgagggcuggaaaaaaaacagaaacaugaauuugauugguuucacaagagacauggcagaccaaagaacauacgaugaguacuuugcuaaaugcccuguuuauucucccaaccgggcucauaaaaguacggacacauuugguggguugagagaucucuauguagucgugacccuguaauuauacuugacgagagcggugaugacagacaggcggcacagaaaucugcccuucuuuggugccaauugagcauggugacaacagauuaaaaauggccuaugucucaaguugaagguccuguuuuucugcucugguucuuccucuguugcccaggcuggagugcaguggugagaucucggggaaaaacguggccggccggaguccucccacagacgacagugccuucccggcagcaucuccgccgggcccaagagggucguggagucgcuggcuuccucccaggaacccagaguugaucucuacaccacgccaucacugccaggggugaggaaauucuggcaccagugauucagcacuguuuuuuucucucucuucagugccucuuucagugauaugaaguuaaaaccagauacccagccgugggauugcuagaucagacagagccaauugaugaucagcagggccugaaaaugccaaaacccugaaacaacugaccuucgaaaacuucaacaucccugaacgaaacguccaaacacauuuauccaccaaucaaagacccuuuauagucugugcucugugcaucucagaagucucucuuuaccacacugucuauauacugcaugagccauuauaugaaacuccaaggcaucuuauacuauauauucaaccauguaucccuaguaccuaguacaguccugccauauaguuugcuacuaaacauuugcagaaugaaguaauuaucuuguauccagguuccaaguuuuaaggugauuucucacuaaaaauaaagcauuacaguucgcaa

SEQ ID NO: 732 - RNA, 4541 nt, Homo Sapiens
gcggaacccagcgaaggcgagagaaugaagacacgcaucgggcuguggccagacgguuggcagccagggaccuagccaagccucccugcccccgacgcccgcguccagggaucgucgaugacaguucgccugucgggacaucggaucaggcggccgccccuggggagaugagcaagucaagccacagcugaccugugaaaggccguguaacagugacuggaagaaccaggaagccuaaacaaaucaggaguaugaaagggagagaacacagugcugcgggaguuuaugccaaaggcacggacccaggcaucagcguuuaaguuuaaacugucuagaggguacgucacaccguagagggacggcgcgggaggaauaaauuucucugugauugguuggugaagguuuucaaaccggagcugugggcgcggcgcugcucugccguugggugaggcgcggagcgaagugaaggguggcccagguggggccaggcugacugaagugaguagugggggugccagaccaggugcgucugccgcuggauugugauaggaagcagaguguucguguguguaucuccuagcuauggacuaaauaauacauggggggaaauaaacaaguauucaugagggugaaaaugugacccagcaggaaaauuacaacuauuuucaauugacguugaauagggugaguaaauuuuagcuuuuugaguuacaauuuggcugagauaucagaguuaaugagucauggaauuuaagugauuuacugaagauuauacuacugguagauagaagagcuaaaggagagccaaaggaaaucaacauuugaauugacuacccaauguccugccccuguuucuguccuguagcacuuaggaaacuggcaaaauuauuauauuaaucaauaggcuugacuugaagaaccacauuuucuuguuggucagucacuugcuaaugaacugacaugcucuuuccuauuuguuuucugcuccaagugauuggaggggcuguuauauucaaagcagaaagauggauacuaugaugcugaaugugcggaaucuguuugagcagcuugugcgccggguggagauucucagugaaggaaaugaaguccaauuuauccaguuggcgaaggacuuugaggauuuccguaaaaaguggcagaggacugaccaugagcuggggaaauacaaggaucuuuugaugaaagcagagacugagcgaagugcucuggauguuaagcugaagcaugcacguaaucagguggauguagagaucaaacggagacagagagcugaggcugacugcgaaaagcuggaacgacagauucagcugauucgagagaugcucaugugugacacaucuggcagcauucaacuaagcgaggagcaaaaaucagcucuggcuuuucucaacagaggccaaccauccagcagcaaugcugggaacaaaagacuaucaaccauugaugaaucugguuccauuuuaucagauaucagcuuugacaagacugaugaaucacuggguggcaaucccuugggggcaagaaucacaucuaauacaaucaguauagugccuaacauucugauugggacucuucuuuggugaagacuuucaaacugaagaagagagaaaagaggcgcucuacuagccgacaguuuguugauggucccccuggaccuguaaagaaaacucguuccauuggcucugcaguagaccaggcaggggaaugaauccauaguugcaaaaacuacagugacuguucccaaugauggcgggcccaucgaagcuguguccacuauugagacugugccauauuggaccaggagccgaaggaaaacagguccauugaauuugugacuaaacuggccuguguaaaacaacuagcaaaauuuuggagaguugguuucuuagaacccucuggaggcggggauuggauguauuggguaguuucuuacugcugcauaccgaggaccagagaacugcuugugucaugcuuuaccuuugaauugcuagcccacuggcauaacuuuaguuuuucuugaaacuguuuuuuuacauagccauuaguucucacuuuuggcuaugauaacagauuacuguuuaucucccaguuaaaauuggagcuaaaauuuagaaggagcaaaauguacuuuacaaccuuggaacagugacuccacccugaacagcaggcagcuggagccaagaacugagacagacagugugggcacgccacagaguaauggagggaugcgccugcaugacuuuguuucuaagacgguguuauuaaaccugaauccuguguuccauguggaaagcggauaaaauuuggcaaauuaucucugaagugucgagacugucguguggucucucauccagaaugucgggaccgcuguccccuucccugcauuccuacccugauaggaacaccugucaagauuggagagggaaugcuggcagacuuugugucccagacuucuccaaugauccccuccauuguugugcauuguguaaaugagauugagcaaagaggucugacugagacaggccuguauaggaucucuggcugugaccgcacaguaaaagagcugaaagagaaauuccucagagugaaaacuguaccccuccucagcaaaguggaugauauccaugcuaucuguagccuucuaaaagacuuucuucgaaaccucaaagaaccucuucugaccuuucgccuuaacagagccuuuauggaagcagcagaaaucacagaugaagacaacagcauagcugccauguaccaagcuguuggugaacugccccaggccaacagggacacauuagcuuuccucaugauucacuugcagagaguggcucagaguccacauacuaaaauggauguugccaaucuggcuaaagucuuuggcccuacaauaguggcccaugcugugcccaauccagacccagugacaauguuacaggacaucaagcgucaacccaaggugguugagcgccugcuuuccuugccucuggaguauuggagucaguucaugaugguggagcaagagaacauugacccccuacaugucauugaaaacucaaaugccuuuucaacaccacagacaccagauauuaaagugaguuuacugggaccugugaccacuccugaacaucagcuucucaagacuccuucaucuaguucccugucacagagaguccguuccacccucaccaagaacacuccuagauuugggagcaaaagcaagucugccacuaaccuaggacgacaaggcaacuuuuuugcuucuccaaugcucaagugaagucacaucugccuguuacuucccagcauugacugacuauaagaaaggacacaucuguacucugcucugcagccuccuguacucauuacuacuuuuagcauucuccaggcuuuuacucaaguuuaauugugcaugaggguuuuauuaaaacuauauauaucuccccuuccuucuccucaagucacauaauaucagcacuuugugcuggucauuguugggagcuuuuagaugagacaucuuuccagggguagaaggguuaguauggaauugguugugauucuuuuuggggaaggggguuauuguuccuuuggcuuaaagccaaaugcugcucauagaaugaucuuucucuaguuucauuuagaacugauuuccgugagacaaugacagaaacccuaccuaucugauaagauuagcuugucucagggugggaagugggagggcagggcaaagaaaggauuagaccagaggauuuaggaugccuccuucuaagaaccagaaguucucauuccccauuaugaacugagcuauaauauggagcuuucauaaaaaugggaugcauugaggacagaacuagugaugggaguaugcguagcuuugauuuggaugauuaggucuuuaauaguguugaguggcacaaccuuguaaaugugaaaguacaacucguauuuaucucugaugugcugcuggcugaacuuuggguucauuuggggucaaagccaguuuuucuuuuaaaauugaauucauucugaugcuuggcccccauacccccaaccuuguccaguggagcccaacuucuaaaggucaauauaucauccuuuggcaucccaacuaacaauaaagaguaggcuauaagggaagauugucaauauuuugugguaagaaaagcuacagucauuuuuucuuugcacuuuggaugcugaaauuuuucccauggaacauagccacaucuagauagaugugagcuuuuucuucuguuaaaauuauucuuaaugucuguaaaaacgauuuucuucuguagaauguuugacuucguauugacccuuaucuguaaaacaccuauuugggauaauauuuggaaaaaaaguaaauagcuuuuucaaaaugaacagucccuggaggaggauuguguguccauuuuacagcuggagaagccgagauccagaaaggacccccaaguugugggcagaauaaaucuacagcagcuuuuaacuauuaaaccaacuuagauuuugguagucuuuca

SEQ ID NO: 733 - RNA, 1693 nt, Homo Sapiens
ggagccucgcuggccucugcggccccaagcccaggaagcaggcagagcaaaggcugagggaaagagagagguuugcugaaagcuuccagggggcuugcuuaaauggccccugcuggugcugggaguugcuggcacuuguggguggggagagggagccagguugcagucaggcagcaacucgaagaauuucugguacgaugccuaaggaacucagacggaagaggccugaauguccaaggcucuagugaucugugugacuuuucucauucuaagaauaauacucagaaaagaauaaguucuuguauacacucagcauuuuacaaauguaaguuacuggucucuggggguuuccucuguggauguuuugucuccuccacccucugcaaccucccugagggcagaaacauguccuacguauucucuguugccauggugucuuauaacaagccaagaaugaagagguugaguucgaacccaacaauaugcccaugaaggcccagcugcauagacagagguggcaugcgguucaugaagaaugugcuaucagacucccccauuccagccuccucucugacugcaagugagucugcaaauaucucuggggacaaacaaaacgaucccccuccaccacagucaguuagccccacaugauguagcacuuaguucuguagugagaagcagccuggcguccuggaagauccuuggagcaggaaucagcacacccugacugcacucuggcccuauucccucaauuaaugaaacucaaccacagcuuuccccucuggagacuaaggaaucaaucgucucugaccugacuaccugaaugugugcugaggaucaaauaugauaacccuaagaagccgcacacacaaagggacuguuaucauuucaaccugcccacugagcuucacacuccauggucuuuccuucuagaaggucaucucauugaaggcaaagaggcaagcaucagcucuguguucccugcauccccacacccagugcccugcagaggaggggcauacaggaaaugcuuguaaauggaugaaugucaagccccaaaccccacggagcccuagaagcauccccuuuccagguuccuuguccucaccggcucuccucgcccuccagcagcuugcgguagguggcgaucucgauguccagggccagcuucacgcucaugaguuccugguacucacgcagcugccgugccauauccugcuugccccgcugcagggcggcuuccagcuccuccugcuuggcacgagcauccuugagcgccagcuccccacgcuccucagccucggcaauggcggccuccaacuuggcacgcugugggcagcagugcagcuguaagcuggggcucaccagucugccuuccugccugcccauccugcagugagcacccgggcaacuugcuuaagguggcuucauuggcaccaccuacucccccaaguaccagagaauccuaaggguuaaacacauagguuuggauauccaacgccuauguuccaguucuggcucugccacuuacuagcugugugaccauggaugaaucaacccugcuaagccaaaguccccucuuuucuaagagaacaucaggagauuuugaggaugaaaugagauaauauacaagauguccguggcacaaugucuagcacacagcaagugcuuaauaaaugcuauugugaucauu

SEQ ID NO: 734 - RNA, 2043 nt, Homo Sapiens
ccugcuugaagccuaacuguccaccagaaaggacugcucuuugggugaguugaacuucuuccauuauagaaagaauugaaggcugagaaacucagguaagcacuuuuguuguggguauacuuuuaccuucuuggucuccucaucucccaggugguaacaaacagaaaugacuaaagccuauauguguguguaguggaaaggagcagagggaacugaauacagagaggauccugaauacacgaugcugaauagagagaggggacuccugggggucuuuggggauggggaaggaauuaaaaaaguuggagggcacuggguuuacugagagcagcgggauggauauagaagaggacugagguuuggagcagaauaagacuaagauauuuaggcaagagauauuuagauaaaaacuuggggaaauauuugagaaugggaaaggacuaagagaaccuaaggagagaguuagggaucuugagaugaagaggccugggaaugguucaggaggauacugaauuaaggugagguccaggaacaguuuagauguccagggucccagaacuguucaagagaucuaaguugaaugcuagguucugauucccucuuccucuuccacccucugccucuuuagccucuaucauguggaacagcucugacgccaacuucuccugcuaccaugagucugugcugggcuaucguuauguugcaguuagcugggggguggugguggcugugacaggcaccgugggcaaugugcucacccuacuggccuuggccauccagcccaagcuccguacccgauucaaccugcucauagccaaccucacacuggcugaucuccucuacugcacgcuccuucagcccuucucuguggacaccuaccuccaccugcacuggcgcaccggugccaccuucugcaggguauuugggcuccuccuuuuugccuccaauucugucuccauccugacccucugccucaucgcacugggacgcuaccuccucauugcccacccuaagcuuuuuccccaaguuuucagugccaaggggauagugcuggcacuggugagcaccuggguugugggcguggccagcuuugcuccccucuggccuauuuauauccugguaccuguagucugcaccugcagcuuugaccgcauccgaggccggccuuacaccaccauccucaugggcaucuacuuugugcuugggcucagcaguguuggcaucuucuauugccucauccaccgccaggucaaacgagcagcacaggcacuggaccaauacaaguugcgacaggcaagcauccacuccaaccauguggccaggacugaugaggccaugccuggucguuuccaggagcuggacagcagguuagcaucaggaggacccagugaggggauuucaucugagccagucagugcugccaccacccagacccuggaaggggacucaucagaagugggagaccagaucaacagcaagagagcuaagcagauggcagagaaaagcccuccagaagcaucugccaaagcccagccaauuaaaggagccagaagagcuccggauucuucaucggaauuugggaaggugacucgaauguguuuugcuguguuccucugcuuugcccugagcuacauccccuucuugcugcucaacauucuggaugccagaguccaggcuccccgggugguccacaugcuugcugccaaccucaccuggcucaaugguugcaucaacccugugcucuaugcagccaugaaccgccaauuccgccaagcauauggcuccauuuuaaaaagagggccccggaguuuccauaggcuccauuagaacugugacccuagucaccagaauucaggacugucuccuccaggaccaaaguggccagguaauaggagaauaggugaaauaacacaugugggcauuuucacaacaaucucuccccagccucccaaaucaagucucuccaucacuugaucaauguuucagcccuagacugcccaaggaguauuauuaauuauuaauaaaugaauucugugcuuuuaa

SEQ ID NO: 735 - RNA, 939 nt, Homo Sapiens
augaagaaucauacaaggcagauagaauuuauucuucugggacugacggauaauucucaguuacagauuguaauuuucuuauuucuacuucuaaauuguguguugagcaugauagggaacuucacuaucauugcccucauucugcuggauucccagcucaagacuccaauguauuucuuccuccguaauuucucuuuucuggaaauuucauucacaacugcuugcauucccagauuccuaaucaccauuguuaccagggaaaagaccauuuccuguaaugguugcauaucucaguuguuuuuuuacauauucuuggggguuacagaauuuuuccuucuagcugcucuguccuaugaucgcuauguugccaucugcaaaccuuugcguuauauguccaucaugaguaacaaaguuugcuaccagcuuguauucaguucuuggguaacuggauuccugaucauuuucacuccacugauuuuaggucuuaacuuggauuucugugcuucaaauaucauugaucauuucauuugugacauuucucuuauccuacaacuuucuugcucagacacacauuuacuggaacugauugccuuuuuauuagcugugaugacacuuauugucacauuguuuuuaguaauccuuucuuacucuuacaucaucaagacaauucugaaauucccuucagcucagcaaaagaagaaagccuuuuccaccugcucuucucacaugauuguugucuccaucacuuaugguaguuguauguuuaucuacauaaagccaucagcgaaugaaagaguugcuuuaagcaaaggaguaacugugcucaauacuucaguugccccguuguuaaacccauuuauuuauacucugaggaaucagcaaguuaaacaagccuucaaagcuguauuuagaaagauauuuucugcuucagacaaguaa

SEQ ID NO: 736 - RNA, 75 nt, Homo Sapiens
ccuucuaugaugauuuuaucaaaaugacuuucguucuucugaguuugcugaagccacauuuagguacugagaagg

SEQ ID NO: 737 - RNA, 1144 nt, Homo Sapiens
gcaucccauuuagagaauucgggaagguucccugcaagcuucugugggaccacuagcaccagugggcacaucgagagcaaacacaucggagacaaauuuuucuuucuuugugaacucugccuuaacucaaagauuccugucaugacuuaaagagaaacuuucacaaugucuggagcccuugauguccugcaaaugaaggaggaggauguccuuaagcuccuugcagugggaauccaauuagguggcaccaaauugacuuccaaauggaacaguacaucuauaaaaggaaagugauggcaucuacagcauaaaucugaagaggaccugggagaagcuucugcuggcaggucaugccauuguugucauugaaaacucugcugaugucagugucauauccuccaggaauacuggccagaaggcuaugcugaaguuugcugcugccacuggagccacuccaauugcuggccacuucacuccuggaaccuuccuaaccagauccaggcagccuacugggagccacggcuucuugugguuucugaccccagggcugaccaccagucucucacagaggcaucuuguguuaacccaccugccauugcuuuaugcaacacagauucuccucugugccauuggacauugccaucacaugcaacaacaagggagcucccucagugggucagaugugguagaugcuggccugggaaguucugcacaugcguggcaccauuuccugcaacacccaugggagguaaugucuaaucucuacuucuacagagauccugaagagacugaaaaagaagagcaggcugcugcugaaaaggcugugaccaagaaggaauuucaggguaaauggacuguuucagcuccugaguucacuguuacucagccugaaguugcagacuggucugaaggcaugcaggugcccucugugccuauucagcaguuucuacugaagacuggaaggcucagccugccauggaagacugguccacagcuccacugcucaggccacugaauggguaggagcaaccacugaauggucuuaagcuguucuugcacggacucuuaagcaacaugaaaauaagguugacagaaaauaaacaucaguuucuaaaaaauaaaaaauaaaauucugugaugcaaa

SEQ ID NO: 738 - RNA, 734 nt, Homo Sapiens
guuugggguugaggggcucacuggccaguuuuuccauguuucucaaauaaaacucuggugucaucaagaaacaugguggagggagacaugaagacuuuagagacaggaaccacugcagaaauaucaggagauggggaggcagaggaaagaaaggagagaucuguggaucccgugagcaccccaaauuggaaccacuccuuaccgugccucaaggaagcaacagaccuccaaacugcaugguguaccucaaaagagcaagacccaagcaaaaagguuaaagaaguccacaauuccucaacaaaacuuugggaccagacacauuucgggauucagaacuuuuuggguuuuaaagauauaagaguaaguguucuuuauauuauuacauggcaacuccaaugcaguacucuguaauaaagcacccugauauuucuacagaaacauuuauuaaaguuuacauugaauaaaaaugcugccugauuuccugacauuaacaaugaacacagccagacucaagaggaggaagcuacugggaccacggcagucaaggaaacaccaucaacacccagucuuccucccacauuacucagagacuuuuaucuuugccauccuuaaacacauuccugcaggucuccagaucccuuccagcccaucuuagauaaaacugugcaggaaaaaugugcuucuaauauagagguuuccaucuggacaccuuguauuugaaucacaacucaaac

SEQ ID NO: 739 - RNA, 3234 nt, Homo Sapiens
acauuuuugcaugguucuugauugacuuucuggugcucugccuggaggucuuugcuuaucugugaguugccugagucacauuuuuacaugguucuggugcucugccugcaggucaagaaggagccaguaucuccaggaggagugagagagugcucugccagugugaagugugaauccuugagaggcuguggcaaggguccaugccugaauguguagaacaagaacagcuggaggcuguggcuuucuccaggaagagguuucuaaaucugccucuuagaagauaucagaaaguuaaaguauuccgugauauugaauaagucucacaagaucugguggguuuaucagggguuucugcuuuugcuucuuccucaguuucucuugcugccgccguguaagaaggaccuuuugccucccaccaugauucuaaguccuccccagccacguggaacuguaaguccaauuauaccucuuuuucuucccagucuuggguaugucuuuaucagcagugugaaaacagacuaacauaauuuugcauucugcaacuuuacugaauucauuuaucagcucuaaaaguuuccgguagagucuuuagguuauucuauacauacgaucauaucuacaaacaggauaccaggaaaugaggaucaguggggaccagcuuggaggcugacaacaacaggagaugauaaugaauagugaaaaaugccaagcagacaauaagcagaaggaacagaggaaauccacaaacuggauaauuguuucuugaguaacugaccaucaaucuagauagugguugcaguaauuucaaauucuucucuuccuuuucacuucaggugaaugaaaccuguuuucaccgagaaugagcuucugucuugauagcuuucauuuggucucuuuucgaaucagaagacccagaaaacuuggauccacuucuggcucucaucccucugggcagugugauuuggaaauugccaagacauacaguauuuuuccugccuuuccaauaccuauucaggagcaaaaaccaugauaaacucccuuugcaucuuuuguaagagagcuagacaaacgccggagaguuucucugcaguugugugaccuuggguaguuucuucaacuacagaaagagaguugagcagaugcuccggcugccacuccaucauauauuggaaacagcauuacuuuauaguaaaucaugaccacgguguauggcaaugaaguugcaucugaagcagccggcacccuaugugcuagcuggcuuuuagaccaggagacugugaaucuguggucaggaucucuuuagggcugcuaaauauauacuacccacuaucacucgcuggagcugcagacccuaguuuuagaguuucacuucuuaaagaccuucauccuuauuaaaaugguaauauccuuacugucagaauugggaagaaggauaaauacauacauggaggagcaauagaagucuaccuuauggagcauguggaacagguaaagcagcuacggcuuagaaaggcugaggaacuugccugaggcuauccagcuacugagagauaaacuggggugugaauucagagagcuugacuccugaggcuccaccugugccuauaauuccagcaugacaccugguaaugggcacucaguauaugcuuguugaucuaaacucagugugugugugugugucugugugugucuguguguguguguguguguguguguguguguguggucuuccucucacauccaaagcuacuagcacugaggaaguugggcacuuugagcugacauguuagaagucagucuacauugaagcugccaugcugaagaacucaugugggagaacacacagaaaucgagaugccugaggagccccagcuguaccagccucuagcucucugagucuucucagcaagaacugucaaacaugagagugaagcagccuucagaugacucuggccccagucuucaagugcccuagcuggugccaaguggagcagacaagcugccacccaccaagcccuucccaaauugcagacuaggaacaaaauaaauguuauuuuaagccacuaaacaagggaggugaugaguguuggggcaagagcccagcauuuggggcugucgccuugagcauuaggguguuggccgcucagccagacaucaagggaucauccagccccuucgcacucccuucugaggauggacaggaccuggagcucaggcugccgcuaauggaguuggacucaugagugagggagaaagugccugugaaugacaucauuaugcgacaucauaggacaguuuuuuuuuucuuuuauucacucgucuuucuuuuauuucaacugaugauaucagguggcuucuucaaaugauuuuuaaguaucucgaugaugaugaagaacaaagacaucaaucaggauucaggaagacagcuuuugcggaaaaugcuuaaagggaagcaucaaggauugguguugauauuugaaaguuuaagagugguauacuuuuauucagucaacacaugacaaauguaaaaggcacucauuuguuguuccuggaagaagccuggcagcauuccauucagacaucugcccuuucaucgucccacuuuuuacuuauugcaguccuuucagucugaauauuuccuccugacgcaucuucugccguccgaaaugacucccugcucccagauccuguagcccuuauuauugacaccuuucauuuagaaauuuagcacaugucacauuacaccauuauugaauaaauaaugaauaaauaaauaaauaaagauguauguccuucccaaguauaucagagaacuaucuggacaauuucuuucuuucccaauucucagaaucagcaguauucugucaagaaacauuuaucgacgaugauggcaauagucgauuaaaaucagaugaaguuuuauuuuuaaaaaaagguugagcggagagacaaggcugaagguuuggaaguugagacaaccaucuucaauaaacguuuucucaucuaagggcuguauguacaucauuuuggggaagguagagauugaaggaggaagaacaucacuggaggaagagacagcaguuugucuuucgaguuucaauaaaguuucaaaaaucuugccuaaguuauauauuuuuuuggccuuucccuuuugaugugacaauaaacuguaaugcggcugucguuuguacgaaccgauauucagcagaauaaaucugagcacuuucagaaaaa

SEQ ID NO: 740 - RNA, 6867 nt, Homo Sapiens
aucagcagcuguugcuucuguuuguucccagcuauaacugucaucaguggcuaaacuggcauaaacaggccucuacaaguggaaaaacauuuaaccccuguucuugucacacucuggguccucucaguggccagagaacagaaagaaaaucugacugugcacgagcgaagggugacaccgggcgugcagcaccgaccugaaggcaccucuucgggggagcccgaaauuugaagauucucuuuccugucggagacuacaaaccaaauaaauagaaaaaacuauccaagaugacugucacuuacuccaguaaaguagcaaaugcaacuuuuuuuggauuucauagguuacuccucaaguggagaggcagcaucuacaaacuacuguacagggaauuuauuguuuuugcuguucuuuauacagcaauaaguuugguauacagauuguuacuuacaggaguccaaaaacguuacuuugaaaaauuaucaauuuacugugacagauaugcugaacaaauuccaguaaccuuugugcuugaggcacaaaugacauuuuuuuucuggaaggcaaaaucagaagauauggauaauaauauauuuuuguccuccaaccucuaaaaaggcuaaaauucagcuaaaagcaucagugucaccaacgugucugcuguaagaaacugcuuuauaauuuccuguuauucuacaggguuuuauguuacucugguagugaaccgaugguggaaccaguuugugaauuugcccuggccagacaggcuaauguuccucaucucuagcaguguucacggaagcgacgagcacgggcgccugcuuagaaggacgcugaugcgcuacgucaaucucaccucccugcucaucuuucgcucggugagcacugcuguguacaaaagauuucccacaauggaccacgugguugaagcagcagagagggcugacucagagucugcacauggggucugcuuccaaguucuuccaacugggcauaugccuccgccacucucugacuguccuuugccugugccaagguuucugggaagaacaggaaguucagggauggcggaaaauguuuggcagauucccugaguccaaagccggagcaccugcuccugccugagggcagagaggacugagucucacuauguugccuaugcuggucuugaacuccuggccucaagcaaucuucccaccauagccucccaaagggcugggauuucuggugugagccaccacaccuggccugcccuggaaucuuaauguaaagauucuugacugucuucuaugacuacagggagccugaugagacuccacuggaauuuucagugacacuuauaaagaacuggcaugaaacccauucugccuucaaguuuugagaugcagagcuuuuaguuccucugcuaauagagccucguuugaauacucugcuugaaaggcaaaagacaucugccucaacuucaaucaaggaaaaauagagcaacuguacagcaggcagaaucucuaugaugacuggaauuuugucuaucaauggauguaauuaauccuuuggcucgagggcaauaaaauuuugucuuaaaguagcagauccugcuccaucaaaccacaacucaauugggaguaaaugcaaacauguaucuauauugagagauagauuuuacucugauuagaaagaugaaggagggauuuggggauaaacaauaugaaaauugcugagcagagcugagccagccagaagaaaaagcgauagcaagagaaacuguaggcagaugcaacggcaggauaaaauagcuaugccaggggugugauggggccugaggagagcauggcauggagacagacacgugcagggaaccaaguggugggaggacaagcccacucagaguguugccgaacuguagcaaaucaguaacuauaauuagcacagccucagcaaugacaauaaugaucauauucugaaaaaaauauuggucucugcuuaaaauggcuugaaguccugaugagggugacauuccauuucauaacaaauacuuuuggaauggacuugaccaacaaccuagagauuuucuuucaguugaccgacuuugauuuccaaagguggaguuacuuuugugaacccccaaaaucugagacaggucucaguuaauuuagaaaguuuauuuugccaagguugaggaugugcacccgugacacagccucaggugguccugaugacgugugcccaaagcggucagaacaguuugguuuuaugcauuguaggaagacaugagacaucgaucaacauauguaagauaaacauugguucagucuggaaaagccagagaugacucaaaguggggagggggcuuccgggucauagguagguaagagacaaaugguugcauucuucuggguuucugauuagucucuccaaaggaggcaaucagauaugcauuuaucucagugaauggagcaaugacuuuaauagaaugggaggcauguaugccguaagcaguucccaacuugacuuuucccuuuagcuuagugauuuuggggacccaagauauuuuccuuucacacuuuggauaaguaagaugugugacccugcaaggaauaacaaaaauuauucugcuuauauauucuuagaggauacauuaaugucucagugauugucauucaucuuucacagcacccagcaaaauacucaauaaauuugugcuaaaaacaaaaguuuuaugacaacagaugaaaggaaauuauucaaccaccucaagucuccucaucugaaauauuggguuccauucaucugguuuggaaaucuugcaacuaaagcccggaaugaagguagaaucagagacaguguugaucugcaaucauugaugacuguaagaaaugaaucgauaccgcucuuggugcagccucuuauucgguuaugacuggguugggauuccgcugguuuacacccagguugucacucuugcugucuauaccuucuucuuugcgugccugauuggacgccaguuuuuggaucccaccaaaggcuacgcagggcaugacuuggaucuuuacauucccaucuucacccuccuacaauucuucuucuaugcaggauggcuuaagguagcagagcagcuuaucaacccuuuuggagaagaugaugaugauuuugaaacuaacuggugcauugacagaaauuugcaggucucucuuuuagcuguggacgaaaugcacaugagcuuacccaagaugaagaaggacauuuacugggacgauucugcugcucgcccaccauacacauuggcagcugcugacuacugcauacccucauuucuggggucaacaguccagauggggagaucucgcuucaacccuguucccuuugccgaaugucuccuaauccccaucagugaugguuuguggcacuucucuuccaaaggggccucugaggcugaaaaccuuuccagacccaaagaaaaggaagacugaaaguggaauuucaguaguuccagcaaauaaugagaacgauuuaggagccaggagauuugccuuguugcccgcaaagcacaucuuagagaagguugccuacuccaggcuagauuugcuucugcuucuagcuagccuucuaagaccagacccacccacccagggcuccuuccaggccagagagcucaucccugcccucaguguauucucaguuuccauggauaggaaucucuuguuguaugcaugucucagccuucaugauaccuucugcaggggcagagcuucauggacauccagcaaucaucucaauuuucagaauuaauaagagcuguucuucugugaguuugauuuuagauaauuaaauaugcuuuauccuuuuccucacucucaccauugauuaaugcaaaguacuugacgauuuaacuugaaaagaaaagagaccagcaauacugauagaaucagagcaucauugugauaacucuauuuagacugcaaaugcuccaaacacucuauuucuuauguccauugaguuguuguuaccccaugguuaagauaauuuuuugaaggucucaaaauuuuuauccugaccuacuuauuuauccuaaucaucauaauucugcagauuacuacauaaauguucauguucuuuagcaaauauuaaaacacauuucucuuguuucuaaauacagaaacagaaauagggauugacaagaucucagagaaaauuccuuccccaaaagaucauugggaagauuagaugagauuguaaagcugucuggguccgacuuuccugacgaggaguggcugugggauuaugagaagcauggccaucggcauuccaugauaagaagagucaagcgguuccugagugcccacgaacaccccuccagccccagaagaagaagcuacaggaggcagacaagugacagcuccauguucuuaccccgagaugaccucagcccagccagggaccuacuggaugugcccucaagaaacccccccagggccucacccaccuggaagaaauccugcuucccagaaggaagccccacgcugcacuucagcaugggagagcuguccaccaucagggagaccagccagacaagcacuuuacagagccugaccccacaguccagugugagaacuucccccaucaaaaugccacugguaccugagguauugaucacagcagccgaagcaccagugcccacaucagggggcuaccaccaugauuccgcuaccuccaucuugagcucugaguuuacagggguucagccaagcaagacugagcagcagcagggccccaugggauccauccugucucccucagagaaggagacaccuccuggaggccccaguccccagacaguuucagccagcgcugaggaaaauauauucaacugugaagaagacccuggugauaccuuucuaaaaagguggagucuuccgggauuccugggguccagccacacuucccugggaaaccuaaguccagaccccaugagcucucagccagcucuuuuaauugacacagaaacauccucagagaucagugggaucaacauuguggcuggcucucgagucucuucugauaugcuguauuuaauggaaaaccuggacaccaaggaaacagauaucauagagcugaacaaggaaacugaggaaucacccaaaugagugccaccaaguucuaggaccugguucuagccuagauucuuaccuccccaaaagcagcauauuaggcccaggacauaccugaaggcuggucgacuuuuuaaaaaacaugaucacacuguauaagcuacuuagaacuuugaagggcauuaugauccugacuuuuugagagcugcgaaaaaucaaacgcauucacgucauccaacacaacauggcuuucaucagaaguuacacagaccacagugauuuagccaaauaagucuuaaccaaaaaaaggaaucugaaaaacauacaugacuuauaaauucauagauuauuaguuguggaaagagucucauagaucauaguccaauccccuagacccaaaggcccagacacgcaggguucucuauuucucuucuuuuuucucuuucuuuuuuucuuuagccauaaagaaaggagauggaucaccuaaugccugaaagauccccuccuuccuaacguuuuuguuugaggcuuucuaaccaucucauuccuacuuuuauaacuauuauuguuauuaucacuuccugauucuuaagcuucaucagcaccagaacacuuaauucucuucaauuuccuuuuuuacuuuucucucuuuuccuuuuauucugucauccuuuuuuucccuucccuucucccugguugugcugcuuuucuaguaaucugucccauuuuucagguuauaauauuuccucuugccaaaucuguugcuuaugucuugccaugaauuucaaaauauaagacauuggcaaagccuccuacagaaucaucaaaggugucaacaaauccagccugauacccuuccagucucacuuccaguggaaggcauauaggagugaugguuccccccgugcccuugcagccauugacauuucuuucugcuuccacuauuugguguugggcacuggagaaaaacgaagccaagagaauaugaaauuugcauagccaaaugcuauggaaccaaagaauaagaugacucacaucuguuuaacuugaacucuuaugcaaaaauccuaaucgugucgcaacacgggaccaguuacugugucuaucgggucauuugggaaugggcaggauacuggagcugggaggcuaaugggguccagagcugcauaauggggaucggauguugguacuccucccagggagcucucaggacagcuguuugucgugggcucccaagugccuaggccaugccuuacgacugcugcacuuaccauuugucauaugauggcacuugacuacauauggcuuuagaaauaaaauaacccucaaaacuagaaacagaugccuaagaaugaguggaagauggaagauauaaaaaucccacucccucagccucaauuccagugugcuaagagugauccuggugguuaaagguacaacacucgaaucuuucaaaacaacuuggcuccuaaacacaagccaacaaucucaucugcugcucaacugaaaaacauucuccacuuuuuagcauccaggcauguggaguuccuaagaaaugcacuuuauuaaugcccaacaugguaccuucccaggagauuuuaaugguaauuuucacucuaccaguguuaugugugcugacuuuagggcccacccuucacauaugguauuacucacucaaggguuuaaacuggggcauuccagaaguaccaguuuccaugaugaaaaguggaacagcagaagcgcuuaaagcaauuuuacugaa

SEQ ID NO: 741 - RNA, 2954 nt, Homo Sapiens
agacuucacguagcuugcgucgcugcuccugucuccguguaacucacaauaaagagauuuuggcaucaaccgugagcuuagggguagaaggguauauguuaggaggugggagcagaaucaauucuucaaaucuuaaugauggugaagaagagugcucaccagauucccuucuggucuggaaaaagaaaucccuucuuuuguggaugucaucucuaccaucucucggugaaaaauauuucaagagaauccuaagauggagagagcauuggaagucauccggcccaauucccuugugcaauucaaagcuucuuuguaagaaaaaugcccccagaaguuuguuugcaucaugaagaucagauuuugaggauccagucuggcucuucccuguacaaaacauuccucacaaacagaauauggacaauuguuaaaugucaaagguaaaguuauugugggaacuccuucaaaaaguucaagugagagcccauucuaugaaugaccauuuacaucuaauuuuuuucugugcuauguuacuuauucugaagugguugauccaauuccuaaaagggaauauuucauuaccuuuuauuuccuauagcauccauucugaccccuuuucgguuuaauuauucccugauuccagucuucauucacucauuuauuugaggaauauuuauugaccaacaacuaugccaggucccauucuauguguagggacuauaaaguugaacaagacagaggagguacuggccucagaauuuacauucuaguagaugagaaaguaaaaauaaacacaugaaaacaugaaugaaccggauauuguagacugugauagguguaguuuggguaaagcacagagugcaguaguaaagauaaacugcacucagaguggggcuauuuuagauggaauggagaucucugaggaaaugaaauuugagcugagaccuaaaaggucacccaaggacucaugggaaaacucaguuguuucuaucaaaauuuagcuucaugaacuccaggcccuugcaaaugaugguuaccaggugagaaaugucucacuggcaacagagguuggcagacccagcuccaguuccaucccagccaacauaccaaugucauuaaaauaaggccauucaucaagguggagacuauuacuagaaacaagcauucuaaagugccauuugagugccaggcucucaacacugggcguagcacugcuccaugaggcuuuugagagcauauacugaggcaugaccaaaaaaauuaagucccauguaagugaugcaacugcuccccaauuacuguggaaguaucugcagacuaacuauugugcguguguguuuguuugcuuuaaugaauaaauucagucaaccaaccaucuagcuauugacuaaauccauucuuuuucuuccaaaaugucuauuggcugaaguuuacugguuuuuauuucuauucgcauacguaauuuucuaaaccccauucuuauggaaccuucucuaaguuccucucuauggcccuguccauguucauacggauacacauaaagacacaaauacaccaaacuaaguuuagagcagucuggugccugccuaagacuucagccucaucuccugcuucuacccucuuuaguuuaggaaaaacagguaacguugcugagugccaaguauuguguuaguagcuuugcaugcauuuuuucauuuuaucuucacaaguuucuucuaucaccaugaucuguauguuugaccaugguguuuccuccaccugaaauucccuuggugcucugccuggggaacuguuacucauucuucaaaucucaacggaaugaucuccuccucuggaaagcucucccuacuucccuaggaagaaguaaucccuuccucaguucugcuuugauuauaacuuuauaagcaccuaucacucugcaugguauuaguucacugucauguccauuuccucuauugggauguaaauugcuuauggguaauaauuaggcuuugaaucauuuuaugaucuggccuaagacagugcuuggcacauacuauaggcucaucagaugauggcugaguagaauuaaauugaaucaaguugaaguuauacuuugauguuuaucaauuaacauguguaguguguuaaaugguggucacugaaaacauacgucugcacccuaauuccuggaaccugugaauauaaccuuacauguuaagaagaaauaugaccuuaaauggauauggagacaaggagcuuauccuggauugucugagagggcccuagaugcaaucgcauguauucugauaaguggagagaaacagaagaggaggaugcaaugugaccauguaggcagaaguuugaauggugcagccacaagccaaggagccccuggggccaucagaagcuggaagaagcaaggaauggauuccuuccuaguguuuggaaggagugugcacuugccaacaccuugguuugagacuucuggccucuggaacugugacagaauaaauaucuguuguuuugagccacccaauuguugcuaauuuguuaaagcaaccuuagaaaauuaauauagcauccacaauaaaauuucucaaaauauauguuccugugaaauggaagaguucuagggaucuaguagcauauacggaacccagauaaguuauacaaguuuuucccugaaagucuuuucagauucuuuagcgggcuaaggugcauugugaaucccaaaaacuuuagcguuuuucagcaucuauuaucacauaauccuuuccccacccauggaauuauauacuaaacuguuuuuguagauguugauguucuguagaacagaguuuuggggucuguaugacuuaagauccuucuacaauggaacacagugaggaggguauucagaggagucauagagggcauugaucuugcaauauauacucaggaaauuaccaugggcagaauaaaaugcuuuugaaaau

SEQ ID NO: 742 - RNA, 493 nt, Homo Sapiens
uuaaagaugauuuauaaaggauguguacagguuagauuucgaggggacuguuuucuguuuaagaaguaacucauuuugccgggugcgguggcucaugccuguacuuugggaggcugaggugggcuggucuccaacuccugggcuuaagugaucuucccucugugguggccucccaaaauguugggauaacaggcgugaaccacugugccuggcuggguuuucauacaugcaaguuuacacauguauuuuaucuuacaugauagacugacauucacuuagacaacucuagaagcuaaauuuguaaucuguucagauagguguuggcagcuaguaacaacuaucccauagaguuaucccauaggcaucaauauuuuaaccaaaaucuggauuggagaaacuuagucauuauggggccuaucuguuagcaaaaucgaauagucagauaugcuuugaccuuagguuccuuuagccaaaccuuuuuuguuuuucccag

SEQ ID NO: 743 - RNA, 2065 nt, Homo Sapiens
accacacagacacacaccuccuugcuggagcauucacuaggcgaggcgcuccaucggacucacuagccgcacucaugaaucggcaccaucugcaggaucacuuucuggaaauagacaagaagaacugcuguguguuccgagaugacuucauugucaagguguugccgccgguguuggggcuggaguuuaucuucgggcuucugggcaauggccuugcccuguggauuuucuguuuccaccucaaguccuggaaauccagccggauuuuccuguucaaccuggcaguggcugacuuucuacugaucaucugccugcccuuccugauggacaacuaugugaggcguugggacuggaaguuuggggacaucccuugccggcugaugcucuucauguuggcuaugaaccgccagggcagcaucaucuuccucacggugguggcgguagacagguauuuccgggugguccauccccaccacgcccugaacaagaucuccaaucggacagcagccaucaucucuugccuucuguggggcaucacuauuggccugacaguccaccuccugaagaagaagaugccgauccagaauggcggugcaaauuugugcagcagcuucagcaucugccauaccuuccaguggcacgaagccauguuccuccuggaguucuuccugccccugggcaucauccuguucugcucagccagaauuaucuggagccugcggcagagacaaauggaccggcaugccaagaucaagagagccaucaccuucaucauggugguggccaucgucuuugucaucugcuuccuucccagcgugguugugcggauccgcaucuucuggcuccugcacacuucgggcacgcagaauugugaaguguaccgcucgguggaccuggcguucuuuaucacucucagcuucaccuacaugaacagcaugcuggaccccgugguguacuacuucuccagcccauccuuucccaacuucuucuccacuuugaucaaccgcugccuccagaggaagaugacaggugagccagauaauaaccgcagcacgagcgucgagcucacaggggaccccaacaaaaccagaggcgcuccagaggcguuaauggccaacuccggugagccauggagccccucuuaucugggcccaaccucuccuuaaauaaccaugccaagaagggacauugucaccaagaaccaggaucucuggagaaacaguugggcuguugcaucgaguaaugucacuggacucggccuaagguuuccuggaacuuccagauucagagaaugcgauuuagggaaacgguggcagaugagugggagacugguugcaaggugugaccgcaggaauccuggaggaauagagaguaaagcuucuaggcaucugaaacuuuugcuucaucucugacgcucgcaggacugaagaugggcaaauuguaggcauuucugcugagcagaguuggagccagagaucuacuugugacuuguuggccuucuucccacaucugccucagacuggagggggcucagcuccuggggugauaucuagccugcuugugagcucuagcagggauaaggagagcugagauuggagggaauuguguugcuccuggagggagcccaggcaucauuaaacaagccaguaggucaccuggcuuccguggaccaauucaucuuucagacaagcuuuagcagaaauggacucagggaagagacucacacgcuuugguuaauaucuguguuuccgguggguguaauaggggauuagccccagaagggacugagcuaaacaguguuauuaugggaaaggaaauggcauugcugcuuucaaccagcgacuaaugcaauccauuccucucuuguuuauaguaaucuaaggguugggcaguuaaaacggcuucaggauagaaagcuguuucccaccucuguuugcuuuuaacauuaaaagggaaaugugccucugccccacaguuagaggggugcacguuccuccugguuccuucgcuuguguuucuguacuuaccaaaaaucuaccauuucaauaaauuuugauaggagaca

SEQ ID NO: 744 - RNA, 279 nt, Homo Sapiens
cgcgggcgaggggacggcgagcccccgcugccuaaacagaaaacggaggcgaugaucuggguaacuacgggcggagugggaggaaaccugcucugcacaguuaagauaacccggguccccagagcaccaucacuucuaagacugugaccugcuuacagauccacuccucugcccccacaguccacauguccacccugggggccauggcuuauugauucuuccauguaucagcccaagaauccccugcugccuucugaauaaagggugcaaauacacgaa

SEQ ID NO: 745 - RNA, 552 nt, Homo Sapiens
ggggccucggguuaacacugcagccgcuagaccagcucccuggcgggcgcggagcaagcuuugaccuuuggaacugggcaccgcagccccaauaucugcccugcggucagagcaaccugaacacuuccuagugaauugcaauguaaaggugaccagcgccgccacuugggugaucuuaacuucucucagccucaguugccucaucuguaaaauguguuucauucaagaaaugauuacccagugucuacuucgugcuaaacagccuugagcccuuggccuacagcaaugaauaaaaccauuugugaugcucaaagagaagauggucgguguaacgcgcuugugaugcucaaagagaagauggucggugucaugcgcuucugaugcucaaagagaucggugucacgcgcauccgugugaagacaccgccaaacaggggacagaaucucucuauguugcccaggcuggucuccaacucguggguucaagcgauccuccugccucagucucccaaagugcugggaugacaggugugggcaaccacacccagccaag

SEQ ID NO: 746 - RNA, 103 nt, Homo Sapiens
gugcuuuggcagcacauauacuaaaauuggaacgaugcagagaagauuagcauggccccugugcaaggaugacacacaaauucaugaagcguucuguauuuuu

SEQ ID NO: 747 - RNA, 2365 nt, Homo Sapiens
agaccagaaacggaagagagcgcgggggauguguuuggcguggggcgcacuguucaguugcucuccuggauggcuuuaugucuccgcgguguuuccuagagucucggcguuucuaccucuucgcacccuuuccugccacccuuuguccccuggaagcccggagacaucagcggcugcaauuuugcuacucgcugcucggcguggaacugucaggacaaaaaauaauauccaaagauauuuuggcacuaacggcgcuaucuguagcaagaaaguugagcagugugaacuguugagacuuccaaggagacuucagacaaccaagacaguguaaaggaaaacagagaaaaagacuuguuagacauuauuaagggcacgaaaguugaauugagcacaguaaauguacaaacaacaaagccacccaacagaaguucacuuaaaagcuacaacuggcgggccucaaagagcuuuaggacaugcuccaaagaagagaaaugagccccugaguccugaguugguggcagcugcaucugcugcucuguuuugacaagcaaacaagccagaacugcucaggcagcuccguagcaugaggaagagucaggggcacagagagauggagagagaccuaguuaguuucaauaacaaaauaucagauaugaaaauugccagaugugcuacagcuagaauuaauauaaggccagagcaucagauucaguuugaccaaggcuaugacaauuauccuggccuggagaagacugcugaucuuagaaacaggaaaaauauauucagggggaagagauguaauagauuucacauuauggcaguuacuaaagaagcacgugaacagacacaucaccuucacuuugggauauggaauuugauaagcaguuagccacagaauaugaacaaccccuugagaaugagauugaagaacugauccaggggacaaaagaggggaaacugagaguucccaauuaauaaugaagcagcuucauaucuaagaucucugguggacuuuuucugcccguggacgccgcugaagaagcaucguuaaagucucucuucaccuugccgucaugucuaagucagcgucuccaaaagagcccgaacagcugaggaagcucuucauuggaggguugagcuuugaaacaacugaugagagccugaggagccauuuugagcaauggggaacgcucacagacugugugguaaugagagauccaaacaccaagcgcuccaggggcuuuggguuugucacauaugccacuguggaggagguggaugcagcuaugaauacaacgccacacaagguggauggaagaguuguggaaccaaagagagcugucuccagagaagauucucaaagaccaggugcccacuuaacugugaaaaagauauuuguugguggcauuaaagaagacacugaagaacaucaccuaagagauuauuuugaacaguauggaaaaauugaaguaauugaaaucaugacugaccgaggcaguggcaagaaaaggggcuuugccuuuguaaccuuugacgaccaugacuccguggauaagauugucauucagaaauaccauacugugaagggccacaacugugaaguuagaaaagcccugccaaagcaagagauggcuagugcuucauccagccaaagaggucgaagggguucuggaaacuuuggugguggucguggagaugguuucggugggaaugacaacuuuggucguggaggaaacuucaguggucgugguggcuuugguggcagcugugguggugguggauaugguggcaguggggauggcuauaauggauuugguaaugauggaagcaauuuuggaggugguggaagcuacaaugauuuuggcaauuacaacaaucagucuucaaauuuuggacccaugaagggaggaaauuuuggaggcagaagcucuggccccuauggcgguggaggccaauacuuugcaaaaccacaaaaccaagguggcuauggcguuuccagcagcagcaguagcuauggcaguggcagaagauuuuaauuaggaaacaaagcuuagcaggagaggagagccagagaagugacagggaagcuacagguuacaacagauuugugaacucagccaagcacagugguggcagggccuagcugcuacaaagaagacauguuuuagacaaauacucauguguaugggcaaaaaacucgaggacuguauuugugacuaauuguauaacagguuauuuuaguuucuguucuguggaaaguguaaagcauuccaacaaaguguuuuaauguagauuuuuuuuuuugcacccaugcuguugauugcuaaauguaauagucugauugugacgcugaauaaaugucucu

SEQ ID NO: 748 - RNA, 2773 nt, Homo Sapiens
agcgcggaagcggggaguuaaagagucuaugccugucguggaagcuggccuggcccccggagcucccuggagucgguacugggggcuucguuuuguacgcaccguuuucucucugugcuaugggagaugucaaggaaucaaagaugcaaauaacaccagaaacuccaggaaggaucccuguuuuaaauccuuuugaaaguccuagugauuauucuaaucuccaugaacaaacucucgccaguccuucuguuuuuaaaucaacaaaauuaccaacuccagggaaauuuagauggucuauugaucaacuagcuguaauaaauccuguagaaauagacccagaagauauucaucgucaagcuuuauacuuaagucauucucgaauagauaaagauguggaagacaaaagacaaaaagccauugaagaguuuuucacuaaagaugucaucguacccucuccuuggacugaucaugaagggaaacagcuuucacaaugucauuccaguaaaugcacuaacauaaauagugacucuccaguuggaaaaaagcugaccauucauucugagaaaagcgaugcugcuugucagacauugcugucucuuccuguggauuuuaauuuagaaaauauauuaggugacuauuuuagagcugaugaauuugcagaucaaucuccuggaaaccucaguucuucaucccucagaagaaagcuguuuuuagaugggaacggaagcaucuccgacuccuuaccuucggcuucucccggaaguccucacagugguguucaaacaucacuagagauguuuuauucaauagauuugucuccuguaaaguguaggagccccuugcagacaccaaguucggggcaguuuucuucuagcccuauucaggcuagugcaaaaaaauacagcuugggaagcauaacuaguccuucgccuauuucuucacccacuuucucaccaauugaauuucagauaggagagacuccacucucagaacaaaggaaguuuacuguucauucuccugaugcuucaucuggaacaaauucuaaugggauaacuaauccguguaucagaaguccuuauauagauggcugcucgccaauuaaaaauuggucuccuaugagacuucagauguauaguggugguacucaguaucggaccucagugauucagauaccuuuuacucuugagacucaaggugaagaugaggaagauaaagagaauauuccuuccacagaugucucaucacccgccauggaugcugcuggaauacaccuacggcaguuuaguaaugaggcuucuacccaugguacacauuugguugugacugccaugucuguuacacaaaaucaguccagugcuucugagaaagaauuagcacuguugcaggauguugaaagggagaaagacaauaacacuguggauaugguugauccuauagagauagcagaugagaccacuuggauuaaggagccgguugauaauggcaguuuacccaugacugauuuuguaaguggcauugccuucaguauugaaaacucucauaugugcaugucaccucuugcugaaagcagugucauuccuugugaaagcaguaacauucagauggauaguggcuauaauacgcagaauuguggaagcaauauuauggauacaguuggggcagaaaguuacugcaaagaaagugaugcacaaacaugugaaguugagaguaaaucucaagcauuuaauaugaagcaagaccacacaacacagagguguuggaugaaaacagcaagcccuuuucaaugcagcaguccauagaaugccucugucagaaucaaagacuaagcuuaagaguuccucgcauauaucguugugcacaggaucaacaugauggugacugggaaaaaauuacuucaaguaacaugcuuagcuuucccuccuuaaugugaaaaaucaagggcuuacugacauaggaacaacagaaaugcuccuggaacuucaaguugcugaauuauaaguuuauuuuuuaucaauaaauauuuuuauacuuacauugagugauguguuuaacaacaaauugugacagagcugagugcuccuaucuuacagggucaaugaacuacuuauuaagccuuacugguagcacugaauuuagcaguucugagaacaugugaaacuauguuaaaacugaaggcacuauauauuuuuacauaaaagcuugaacauacagaugaauuauaaccuaugugaagaaaucuuagauauaaaacuaacuuuucaaagauacaaaagaaauuaaacagguuuccugaaauuuuaguucuuggucuguucaccucuguggggaaaauucuuaguuccagugauaacuguucuaguuacuacuuuuaaguauguaaauacuagaaagguaguacuagugacaucaucacguguauuguuaucuauggggcaaauguguggugcccagaauaaaauauaccucaugccuaggguagggacauccuuuccagcucaaacguggguagggaugugggagaauaagaaugugggagaaccaagagaaaaaguggggcugggagaguggaguucccguagggcauaggccugugaaguaacacuggggcagauauguauguuauauacaacuauuuuuuuaaaaaacuuauauccauguugggaguagauggguauauaacaguuuggaaauacuaucuuuggagaauguauuuuuguauuuauaaaucaacuuuuaaaaacugucucauucaaaagggaauaaagaccugugu

SEQ ID NO: 749 - RNA, 64 nt, Homo Sapiens
uaugugaccucggaugaaucacugaaauaugucugagcuucuguuucaucagaugucacauuuu

SEQ ID NO: 750 - RNA, 101 nt, Homo Sapiens
gugcucgcuucugcagcagauaugaaaauuggaacgauacagagauuagcauggcccuuaaaaauacacaaaacaaaaacaaaacauuaugccaaauuucu

SEQ ID NO: 751 - RNA, 2796 nt, Homo Sapiens
gugggucccauccuggggggugcaggagggagcuccaugugccccugcugaucugcccaucugagccucagggguccugggcacugagagcugggcugggcucagcggggguaugcauugacauuggggacagagaggggaugcugaagcgggugcugucuggguggggccugccugaucgacccagcaggugcacccagcagccggaggugcuucuagcagagugaacgcccuguccuuaggggcaugugagcugaggcugggggccuggagcugcagggggaggaauuggggagagcagaggucccaaagaugucccaaggccccaagacccuggugaaggaauggaggagccagcauuggucggcgagaggggagugggaguuggauggccuggcucugggcuggacacacgguuugcagccacagcugagcugugcuguggagcccaguucccaccugggcauguccuguccucugaggcuuccgggagccggacggccaccgcggugcaggcgcgcacucaagggcuuucgaggcucacucugucggagaggucagagacugagugucgcugcugaaggcugugguggaccgggcuggaucgcggauucuagguuagaucgcagauuugggaucgcggauuggggauuggauuggggauuugggguuggaucagggaugugggggcuggauaggggauuugaggauuggaucggggauuugggguuggauccuggauuuggggccgggucggcgguggggggcagugaaaaggugacagagagcagccccugcucaggagccggugguugggggucugagaagucaccaccaccaagaaguucuucggcuucgggagccgcgggggcgagauggcccgggcuccauagaccacgucugcacgguuccggguaccgaauccgggacgcggaacagcggaaaauccaagggcggcugucaaggaccggagguggagcgcggccuggagcgcaggagccggagaccuggaggcccgggacaagcagcacagaacugcucuacauuuggccugugccagcggccauguggaaguggucacucuccuggugaacagacaaugccaaauugacaucugugacaaagaaaagagugugccuuugauacaggcacaggcugugcauugccaagaagaggcuugugccauuauucugcuggaacguggcgccaauccaaaccuuaaggaugucuacagcaacacugcucuccaguaugcuguguauagugagagcacaucacuggcaaaaaaacugcuuucccaugaugcaaauacugaagcacuggacaagguuuauuccuuuuuuuccuaauuaguguaaaacaacacaagaaagaaaauaugcccuggaaauaggcuuuaucuuaaaacucaaacaagacuaaagcaacuuaaaauaaauggacaucuugcugcugcugacaauuuucuaacaaacugacguaucaucucucaguggcaaggcuuaagagggagaaaugggaagggaaaaggagagcaauaagaaauaugcaggucaauuggaaauuaggucaugagggaaaaugccaagaagaguuuuuuuucuuaguuuguuguucuucuaguuuauguguugagacaaggugcucuuuagcuuugggucuaauaauuuuugguuugaaaaugagagugaguugaaacuugccuauggauuaauuuuaggaggacucugaggaaaccagauuggcagugaauauguggugacaaagugagaaacacuuuagcagaaggcggaacaaauuaacuugugggaagucgggguccccaaacggagggaccggcugaagcuguggcagaagaauauaaauugugaagauuucauggacauuuauuaguucccaaaauuaacacuuuuauaauuuaauacgccugucuuuacugcagucucugaacauaaauugugaggauuucauggccauuuaucacuuccccaaucaauacucuuauaauuuccuaugccuaucuuuaaucucuuaaucccaucaucuucgucagcugaggauauaugucaccucaggacccugugaugauuguguuaacuguacaaauuguaaaacaugcguguuugaacaauaugaaaucaggacacccugaaaaagaacagaguaacagugauuuucagggaacaaggaaagauaaccauaaggucugacugccuguggggaugggcaaaauagagucauauuuuucuucucacagagagcuuauagauggacgugugaguaggagaaauauugcugaauucuuuucccagcaaggaauauuaauaauugauaauccuggggaaggaaugcauucccagggguaggccuguagacgaccacucugggauugucugucuuaugcaguugagauaagggaugaaauacacccuguucuccugcaguguccucaggcuuacuaggauugggaaauuccagccuggugaacucuagucagaccgguugucugcucuccaacccaguuuccuuuuaagauguuuaucaagacaauacaugcccagagggacauggacccucaucaguaauucuaauuucacccuugccuugugauccugcucugcccuuuugccuugugaucuuuuauugcccuuugaagcaugugaucucugugacccacucccuauucguacaccccuccgcuuuugaaaucccuaauaaaaacuugcugguuuugcagcucggggucgccaucacaguccuaccaauaugugaugacacccccggaggaccagcugu

SEQ ID NO: 752 - RNA, 303 nt, Homo Sapiens
augggcauaucugaagaaggaaacuugcucagcaccgugagccccacagugaaagcacuuuuuggcaagacuagagucucaccgauuuucccuuucucuccucgaucuccuuuccagccucuuauuccccggacuccuggcucacccuggggccccguggguccagcuucuccuuugggaccaggcuuuccaauagggcccauggggcccgguaaaccaguugggcccaaaggcccaauguugccccuuggccccucaggaccagugggacccacgucacccuuauuccccuucugccccuga

SEQ ID NO: 753 - RNA, 2407 nt, Homo Sapiens
gauuugugguuggcugagguggaggaacaaaauggcggcgccggcggcgugaccgggcccucuggcccacagccguugguagcgguggcagcaguacugcugccccaacucgcugugcccccuuucucagcccacgacaucgccacgacagcgaggcagcgaccgccaccgagaaagaggugguggcccagccuggaaccuugagaaacccucgcaaacuguggccuggcggaaauccuggugugcugcagggaucaggcugacuccacgcccuguaacaccgggaaacgccucgguggccauuuccagcagcccucauccucagccuugcgggccggugggccccggaggccuccauccuccccuagaggggucagggcugagcccagccuccaucuuugccucucaggaugacaaacaacagcggcuccaaagccgaacucguugugggagggaaauacaaacuggugcggaagaucgggucuggcuccuuuggagacguuuaucugggcaucaccaccaccaacggcgaggacguagcagugaagcuggaaucucagaaggucaagcacccccaguugcuguaugagagcaaacucuacacgauucuucaaggugggguuggcaucccccacaugcacugguauggucaggaaaaagacaacaaugugcuagucauggaccuucugggacccagccucgaagaccucuuuaauuucuguucaagaagguucaccaugaaaacuguacuuauguuagccgaccagaugaucagcagaauugaauacgugcauacaaagaauuuucuacaccgagacauuaaaccagauaacuuccugauggguacugggcgucacuguaauaaguuguuccuuauugauuuugguuuggccaaaaaguacagagacaacaggaccaggcaacacauaccguacagagaagauaaacaccucauuggcacuguccgauaugccagcaucaaugcacaucuugguauugagcagagccgccgagaugacauggaauccuuaggcuacguuuucauguauuuuaauagaaccagccugccguggcaaggacuaagggcuaugacaaaaaaacaaaaauaugaaaagauuagugagaagaagauguccaccccuguugaaguuuuauguaagggguuuccugcagaauucgccauguacuugaacuacugucgugggcugcgcuuugaggaagucccagauuacauguaucugaggcagcuauuccgcauucuuuucaggacccugaaccaccaauaugacuacacauuugauuggacgauguuaaagcagaaagcagcacagcaggcagccucuuccagugggcagggucagcaggcccaaacccagacaggcaagcaaacugaaaaaaacaagaauaaugugaaagauaacuaagcgugaaugaggaacagaagaagcagagcagaugauucgagcagcauuuguuucuccccacaucuagaaauuguaguucauauguacaccagcuaguggcugugaacaaccauuuaguugguguaaaaaacuuuauuucaauauaaacugacucuggggagcguuggugaugcuguaucccaaaguguagccucuguaauugugaauauuaacugagguagugaaacguggugucugguuuucuauugcauuuauucaaguagaaaaguuaacuaaaugguugacacacacgaauugguggagacauuguccauaugccaauuuuuuguuaaaaccuuuuauuuugaacuagacugcuuugagauaucauuucagaaggacaguauucagccacagcugcaaagguuguaaaugcuuaugauugagcauuuuuaggguuucuccaucccugggguuugcaaauuguucacauaaagagcauucuuaaaaugguuggcuucuugucuguaagccagcugaucuaguaguaaccaaaaauuccaguuuugagaauaggaaagauuccgccugcuuaccugugaagacauaagaaaaucuuaguaacuaccagauuaucuuuagaauuccacauuaacuauaucauguucucgguauuuuaaaaacaacaacaaccauauuugucacagaaauuuaguuaacaucuuacaacugaacauguauguacauggcuuagauaaauguaaucaccguaaacacccauaugaucugggauuuuguucauauuuugaaaugggagcuuuuauguuuuacaaguucacuaaaaucugaaaacuguuucuauaaggaaauaauacuuuuuuaaacaacaaccaaaaaaugccuugcugauucacuaggaaauaaaaaucuccccaauuuuuugauagucaacuucgagccauuuguuacaugauauucccuugcaaguaaauuuuauuucauua

SEQ ID NO: 754 - RNA, 48 nt, Homo Sapiens
uucucgucccaguucuucccaaaguugagaaaagcuggguugagagga

SEQ ID NO: 755 - RNA, 4924 nt, Homo Sapiens
aaaaccgcugccucugcacuuuggaaucccaucuugagacucgcuaagcgucccagccgcaucccucccgcagcgacggcggcccgggacccgcgggcugugaaccaugaacacccgcaauagaguggugaacuccgggcucggcgccuccccugccucccgcccgacccgggauccccaggacccuucugggcggcaaggggagcugagccccguggaagaccagagagaggguuuggaggcagccccuaagggcccuucgcgggagagcgucgugcacgcgggccagaggcgacuguaucagacacuaacagguaagggucaacaagaaaugugauaugggguagaagguucaaauucugccucuagguaggagcaagccuacgucccagcaagacucgcagauaaacuagccucuuacaaccagaggaguggagcugagagagugaggagcacaagugcauacaccuugauagcaccaaauauaaaccggagaaaugagauacaaagaaguauguauagucauucauuuaacauucagaaugcuucucucuuuuuacaauugguuuguuuuggugugaaguauuuuuauuuucucauuuauauagacucaccaaaucucaucaagguuuuuuguuuuuuuuaguuuugauuauaccuuuaaaaauauucuacuauuaacacuucuaaguuuguuucucuacguuaguaacagaacucaugacaugaugguagauccuggauuucuguuggcuugaacaacuuuacacuuauugccaauaaaccuccuugaggguagggaccacaucuuacucguuuuugugcucucuguacuuaaugcguacauaacauguuuaauugauguacaguaaauauaaaugcugccauuuaaaguuauagcauuauccuuuagagguggaagagaacuaaaguucauuuaguucacaaagaaauuguaggcuugcucaaguccagcuguggggcuaugcugaaauucgauggucuccuuuauuacaugauugguaggaaauuuaacuucaugacuaaugauggacagaaaggcacaaaagggaaaaagcucucuaaagagucuccaccggacauguagcuccgggugggacagcgggucagugcagaauaugacaaucacagccaugcagggacuaugggaacugccagcaguucugguaucuuacaagcuuuugauuuaaauacuuaauaggagauuaagucucaauguggucuggauuucgaaauguuucagaauuuguuuuucuaguaauggacauuugaaacaggucucaugaggagauaaggggaggcgcuggagugacagaacuaauuucucucuggcgcccccugcugucgugcagagugaacauuuaggaaaugagcccugcuccccaggaagccgacucugcacaguggucuggagugccugaaaccagagcaagggucuccaccuguagcaccgagcccucauucccuagagucgcaguaagcuugggagcauugaagauaaagcgaguaugggcaucagaauucucuggggauauguuuaccuauguguggaaaguucuuauugacgugaaaauauucuaguuuugcacacauuuucuauagguaacuuuaaaaauuaacuugauauagaguuuuaaaaaugccagaaugguaggaaaaucuauacuucuuuuaguaggagcccaggugguuuuucaaauucgaacccucugugcugacucuuggugagaaugugccacagggccgggcccaggaugaccuguacgggucagggcugaauauuguguuucuaaccuggaagccuuguucacucaugcucacauauaguuaauugccuucuaauaguuguuucuuaugcuuugaagggacugguuuucuuuuagaagucuaauaauugacgauuugauauuucucgccuggcuuaguugcggagcaggagcuggccaaccuggagaaguggaaggagcagaacagagcuaaaccgguucaccuggugcccagacggcuagguggaagccagucagaaacugaagucagacagaaacaacaacuccagcugaugcaaucuaaauacaagcaaaagacaaagacagagacguugaaaaagagacagaccaaggaagaaacacaaagacagaaauuucacgggcagaagacguagcccggccauucucugugaucuaaguagcuugaaguaacaaccuauaaucaugcuaaaaagagaagaaucuguaagaaucaagaaggaagcugaagaagcugaacuccaaaaaaugaaggcaauucagagagagaagagcaauaaacuggaggagaaaaaaagacuucaagaaaaccuuagaagagaagcauuuagagagcaucagcaauacaaaaccgcugaguucuugagcaaacugaacacagaaucgccagacagaagugccugucaaagugcuguuuguggcccacaauccucaacauggaaacuuccuauccugccuagggaucacagcugggccagaagcugggcuuacagagauucucuaaaggcagaagaaaacagaaaauugcaaaagaugaaggaugaacaacaucaaaagagugaauuacuggaacugaaacggcagcagcaagagcaagaaagagccaaaauccaccagacugaacacaggaggguaaauaaugcuuuucuggaccgacuccaaggcaaaagucaaccagguggccucgagcaaucuggaggcuguuggaauaugaauagcgguaacagcugggguucucuauuaguuuuuucgaggcaccuaaggguauaugagaaaauauugacuccuaucuggccuucaucaacugaccucgaaaagccucaugagaugcuuuuucuuaaugugauuuuguucagccucacuguuuuuaccuuaauuucaacugcccacacacuugaccgugcagucaggagugacuggcuucuccuuguccucauuuaugcauguuuggaggagcugauuccugaacucauauuuaaucucuacugccagggaaaugcuacauuauuuuucuaauuggaaguauaauuagagugauguugguaggguagaaaaagagggagucacuugaugcuuucagguuaaucagagcuaugggugcuacaggcuugucuuucuaagugacauauucuuaucuaauucucagaucagguuuugaaagcuuugggggucuuuuuagauuuuaaucccuacuuucuuuaugguacaaauauguacaaaagaaaaaggucuuauauucuuuuacacaaauuuauaaauaaauuuugaacuccuucuguauaaaugggucauuuuuauuuuuaaugaaaaguuauugggguuuucucucuugaagggucucauuuuaauucccuuuuccaggccguauagaucaaauauaguacugucauuacuguuggcucuuguuuuggucuugacuuacuaauaguguuacccugauuuucagagggggacaguuuaucuccagaaaggccaauguuuguauacacaucagcuagacacaaauauagacaucauauguaguuuguacauguuucagaaacuuguuuuuucuuugcucuguguaaccuauuuccuauugcuaguucaguuggcuuucuuauucacuucugugacccugaaccaguucucagacccuagaguguaagagcauugauuuucuacgcuguguaaucuagcucaaucccucuguccccuccgccucaccgucccccagccaccacauuguauagcaaaagcauuacauucaauccuagaauaaagguaaauacaacaaaucaucuuugcagcuggacaacuaauaauacuuugcagcauuaagagaucuucuguguuaccagucacucuguugaaaugaacuuuccgaaucucuuuauucaggaaaacaugggguuuugaaauucuugggccaagagacauaacugagggguucgcagagcuaggcaagggugcacuaggaaagggccacauuggugggugggggguaacagagaacagauggugucaggaaguuucucuggaguaaauaauguggauauucuugguuucccucuccuccgccagcugaagcuguguuagugcuguugacacuaauauaaaauguuugguccauuugaaauccuugucauugccuuauaugggggaaacucaaucccccagccuguguuggaaauaucaccaaacugauuguaaaugugcggcuguagcagacauuuuagugugguggugugcagccauuucggcccuacaccugccagccuggcuaccuuacaguuguguuccgauuuuugcgucuaugcuuggugugccucacuugcugcauuuuccagcaugcaaccaggaguugacguaggaaaaagggaugcuuucuuacuuuggaagcucucagggaaguuggugucaauuucuccuccacugccuggccuacccugcacucccaaagauuuugugcagauggguaguuccauuuuuuaaaaauugugcagauauggaaaauugugacuuacuucaugaccagaacuaucuagaauauguguggggguauaaacaucuugcuuaaccaaauaucuauguaggcagagguaaccaggagagaagcaagacuugcugccuaaaggagcccaccauuuuacuuuucacauuuaaucugccacguugaaucaauuggaauaaaaccugacucgcaggugacuggacaggaaaucccaaaguuccaccauuucuaugcuuaauuuuaauguccccccgcuuuuuuuuuuguagaaaauaaaaacaagaaaaucguuccaauguaagauguuuguuauagaaacuuuaggcaauacagguguguaauaaaauguuuaauaaacuucuaaacacuuuuguauuuggauuua

SEQ ID NO: 756 - RNA, 695 nt, Homo Sapiens
aacuaaacaaaacacgguaggucucagugugagagagcgcuuuuguucacauaggaggcugacagcuauuugcgaugagggguuuuuguuuguuuguuuguuauucaaauaacuuuuuucccccugaggaaacugaaagggaaaaugucagaaguaugugauuaaugauuuuuuaaaauagaugggaucuccccgguugaauugaaaaguagguacugaaaaagaauccauuucuaaaugguagauuuucauauguaaguuugauauuaauucuuucaaaagaguugugccugugagucagauaaaugacaggaaggucugucuaaauaccagcauccucggaagggcagcuguucagaaacauucucaaaucaugaagauaaauagaaccggaacacugaugauuccaucaacugaugguuccuuuuaaucagaucuuaaagcaaagacagaagcugaaaacauuucuaguaaauaaaaagcaaagaacucugaaugcuuagccgaccagaaccccggaaggagcccgccugguacugccaggcaugacugccuuuaguggauuuaacaauaaaaaagaagauggcgccaaaugaccaaacuacaugcgacuuucccuucccgcaagaaaagugaauaaaacuuuccacuggggcugggggaggaggcaagggaccaguccagagagauaaaau

SEQ ID NO: 757 - RNA, 321 nt, Homo Sapiens
uggggucuucauagggcagaucuccaccaugucaugcagagaugcagugcugucuucugaucaggaauuaugcucuuccacggcacucuggcucauuccacagucaauaauguuaaauggagugaaaauguaggucaguggagcuaacuuggaagucuccaggacaacucuuccuccaaauccauuggaaaacaugaagcaacaggcagaaaugccaaggauuugacugcuaaauaccagauaaguaagcugcucccccaaaaagucuucagcauacuaagcaagucguuuacuggaagaaauuuaaaccuuuuuuaaagc

SEQ ID NO: 758 - RNA, 5117 nt, Homo Sapiens
agcagcuguaggaggcagaaaggauguggcuguggaaggaaaccuuuuggguuucagcacagagucuggaauuccugcuucugaucauccuaggccacaggcaaggagcguggcagagucccccagcuauggcccuggccucccgccgucgccuccugagaacccacaggcaaagggcagggagggcgucagguuuccccguggggcggagccugaccaucugcuucccgcagugccucccgcggagguggacaugggguggguagguggcacccaccagcggggcccuccccaucuacaggcacaccugcccccuacugcuggugacacacaggcaaagcuccgggccaguguccccgagccuaggacgcaggcaggugaaucccaggagcguccccugacacaggcggaccuggggaggcaacagagucaccaggcacaggaggagaccccccagcccggggaugcggggaagaggguggcgccgucgggcucgaagguugugcugaacccagcaaaagagccucagacauggugggcacaggaucuggccggggacaaagggauggccauugggguugggggcgccugccagcgcagugaccaaggucagcagcaucugcagggacccugggaggagcgggggcggagcacggcguggggagagggcaccagggcugccaggaacccagcugugccuccaggggagcccgaggggccgggaagcccggcagcccaaggacaggcccagaaacagguucaggaaugggaccggggacagguucagggacacgcucaagaacaggcccaguggcagacccagauagaggcccaggggcaggcacaggaacaggcucagggugggacccagggacacagucagggacaggcccagaaacaguuucagaauugggcccagggacaggcucagggacacgcucaagaacaggcccaguggcagacccagauagaggcccaggggcaggcacaggaaccagcucaggguggggcccagggacagguucagggacaggcccagaaaugggcucaggggcagauucagggacaggcccagaaacagguucaaggagagguucagaaaugggcccaggaagaggcucagggacaggcccaguggcagacccagauaaaggcccagaaaugggcucaggaacagacccagaaaggggcucaggaacggguucagggucaggcccagaaaggggcucaggaacgggcccaggaacaggcucaggagcagacccagauagaggcucagggucaggcccagaagggggcucaggaacgggcucgggaacaggcccagaaaggggcucaggaacgggcucgggaacaggcccagaaaggggcucaggaacgggcucgggaacaggcccagaaaggggcucaggagcgggcucgggaacaggcccagaaaggggcucaggaacgggcucgggaacaggcccagaaaggggcucaggaacgggcucgggaacaggcccagaaaggggcucaggaacgggcucaggaacagggucgggagcagacccacauagaggcucagggucaggcccagaaaggggcucaggaaugggcucgggaucgggcucgggaucagggcugggagcagacccagauagagacucagaggcagacccagaaaggggcucaggaacgggcuugggaacagggucgggaacaggccuugacaagugggauggcgccucgggccugggagcagcccauuaguggcauagcugagggaguggaugcugcuggcaggagugggggguccagaagcccagcccccagggaugguggacagucagggggcaguggccugggggagcccagcgccggguacccacccccaggaagccgcccccucaggggcaagagcauugccaccucuccccuggggcugggaaagagcccaacugagcccaagccugaggcugggggcugcgggacuccccaggccccggcccaggagggguccccagaccacccuggggcugagagggcccugcaggacaggauggaggcaucggagcccgagcgucgcgggagguccaggcaccuggccaaguacaaagcccagagcuuccgugaccagagggccuucgauuuguccuucagaccaaugagcgucagggccagcgacacgucugagcucccaaagugaggccccgaguacacaccguggcucgcccagcacugugacauccgcccauugagggacuucaggcauuuuccugccuccaaaugcgucuuggagcauccccuacagagacgccuguuuccauaauuuucuuucccuucuucacaagcugaccuugggaggauugagcuacaugugggucggguuccugucaccccacagagccacgaggccaugggggugggaggugcgggccuguggccucaccaggcccucgggauucuuugugucuucacucgggggcgccggcucaccccucucucacacagccugcagcguggagcucacaccucccgcaguggcacggugugugcguccccuucgaucugcaggaugcuggcacuuugggacaccuccccagcucucacagggccaccucccacugcucccugcccacaccccaccaugcccugcucugacguggccgcauggcacccaccauccaugggcccaaagugaugcacaccgccccacccccaugacucgaaagaaagggcagagcuuccuccagccucagacgcccaggugggugccgggugcuguguggcugcugggccaugugguggucaccagaggguguggggacgcugggaucccaggccgaaaccagcucauccggaggaagaggccucaggaaaugcccacguuaaguucugagaaagggacagugcagagccgugggaagccaggaucccagggaggcuucgucuggaaacugggugcugggagaacgaacgggagccugcccgcccuucccugcagucccuguggguggugccacuggugccggugaccugagagccucgcugucuguccuccguccucccgaacagcauagaaguguuuccugcccuggcccgagacggcccacgacuccggcccuguucagguacugagguaaugcauguucaggcuggaauauuugaaugcugucuagaggcacaagaaggaaaucaaagccaccuguggucacauugccucgagaugguuuuuguugcuacucuggacuauuuuuuaggcucuuccuccaugcaccuauuuuaaagcacauucuuccccaugauggagccaugcaccuccgugucgcgauccaucgucccaggccacucgguggccucugaaacccggacccgugaggccacacggcugccugaguggccccggagcagcuggauuuucagcgugaaccgaugcagccugucgcccuacagccccgcacccuuguuuuugguggugcccucccuguggaaaguuaauuccugcuuuuugaaggugucuuggcaucuucugccuuugcuacugagcgguuuccugaaacagcccuaagcguucgcaaaggcgcuuuggugccugcugcgagcaccuguuuucugacucggauguuccuuuagaggaagguguuuuccagugucggcccugagagggcguucagcaggcgcguccuacccacgcggggcugaggucucuccuuccagggaagguccaucccggcagacgccaguggcuuuggcucugcagcgccaaggaggcggcguggcgucaugcuccggggagcgcacagguuuccuuccagucgaacaauuaacuucagauccagcagguuugacccacccucaccugcugggacaugcgagugcuggugucuggaaggagggccgggcugugcugagcucuggggggccgguccccacagcucccccgacagggcccccggggccuccucuauaaaucagggguccgugcucccagcccgcuucgagggguuucugcuuggcguguggguucuaagugcgagcugcuguguguggaggcuccugagcaccgggugccccucgcgcgugugggucccggggcagcccagcugcacacaggaugguccgggggugcgggugggggcagagcugagcauggcguguacuuggccacagaagucuugcuguggugccgcuggaccccugcuaggaggacaggguccccucucucacgaagcacacggaccuccagagucccugccccugcaguccugggagccugcaguuggggcuggaguuggccucucggagccacccaaacggagaggcccaugagaggggagcucagggguccagcagaggcugacagaguggccucuuuguccuguuggcggccccugcucaugccuggggcguccucccuggagcugggggagcucagggacccccaggucuguguggcugccccugccacuccaggcacagcggcacggcccucacucuuuaccuauuuggaauuggaggcaaugaguggcaagaacaugaugacagacacgggagguaaaaauauguucacuggcuguucccuuuauaaauaagaaguggugggacuugcgcugcuauuuuuaaauagaccagagaguacacuggagaaggcauugagugguuuuauuuuaagugguggaaaaaaugaugagaaucuccuccagaugacagcuccggaagugucgugccugaaccccucucacagucuggcgggcgcagagucugugagcggccaggaggccaccugcucgacuggcccguccucuccaugugccagaugcagcccagcaugacacugcccucagcucaaaaacagcacagcuacucugugugcaggaaaaaacugccagugacuucaccaggauuugagaacgguccguacguucacacuaagcugagacagcgcagguuagaagauagcgcggggaaguauucacacuucagauacgaccaucacggccacauggcuaaggcccacacccucccggggugaaauaacuacagcagaagaauggggcgcuaaccaccuccacgggcauuuuaaauaaaacccaaaguuguuuuguuuuuuuaaaaaaaaaaaaaaagaaagaaag

SEQ ID NO: 759 - RNA, 728 nt, Homo Sapiens
ugccccugaaccccagaacaaccagcuggaucaauucucauaggagccacagcgcggagacugugaaacaugguuccaaaacuguucacuucccaaauuugucugcuucuucuguuggggcuucuggcuguggagggcucacuccaugucaaaccuccacaguuuaccugggcucagggguuugacguccaucaguaggaaccagcuccaaugcaccaaugcaaugcggguaauuaacaauuaucaacggcgauggaaaaaccaaaauacuuuucuucuugcaacuuuugcuaauguaguuaauguuugugguaacccaacuauaaccugcccucauaacagaacucucaacaauugucaucauaguggaguccaggugccuuuaauguacuguaaccucacaacuccaaguccacagaauauuucaaacugcagguaugcgcagacaccagcaaacauguucuauauaguugcaugugacaacagggaucaacgacgggacccuccacaguauccagugguuccaguucaccuggauaccaucaucuaagcuccuguaucagcacuccucgucaucacucaucugccaagcuccucaaucauagccaagaucccaucccuccauguacucugggugucagcaucuguccucuucagucucuauaccccuuccacuugccugagcugaagugccuugugaagccugcaauaaacugcuuugcaaauuc

SEQ ID NO: 760 - RNA, 352 nt, Homo Sapiens
guggggagaacaaugaagacauuugcuggauuuucguuccuguuuuuguggcugcagcuggacuguaugaguagaggagaggauguggagcagagucuuuuccugaguguccgagagggagacagcuccguuauaaacugcacuuacacagacagcuccuccaccuacuuauacugguauaagcaagaaccuggagcaggucuccaguugcugacguauauuuuuucaaauauggacaugaaacaagaccaaagacucacuguucuauugaauaaaaaggauaaacaucugucucugcgcauugcagacacccagacuggggacucagcuaucuacuucugugcagagagua

SEQ ID NO: 761 - RNA, 473 nt, Homo Sapiens
ccaaaacaagagacuugccuagcccaaccuuccucacgcucgcuauucucaagaccuggguuccagccacuuuccuacuggccccgaggagaauuuccaaagagacgccugcaguguuuccacagcucagccaugcuccuguugcucauaccagugcuggggaugauuuuugcccugagagaugccagagcccagucugugagccagcauaaccaccacguaauucucucugaagcagccucacuggaguugggaugcaacuauuccuaugguggaacuguuaaucucuucugguauguccaguacccuggucaacaccuucagcuucuccucaaguacuuuucaggggauccacugguuaaaggcaucaagggcuuugaggcugaauuuauaaagaguaaauucuccuuuaaucugaggaaacccucugugcaguggagugacacagcugaguacuucugugccgugaaugc

SEQ ID NO: 762 - RNA, 340 nt, Homo Sapiens
augaugauauccuugagaguuuuacuggugauccuguggcuucaguuaagcuggguuuggagccaacggaaggagguggagcaggauccuggacccuucaauguuccagagggagccacugucgcuuucaacuguacuuacagcaacagugcuucucagucuuucuucugguacagacaggauugcaggaaagaaccuaaguugcugauguccguauacuccagugguaaugaagauggaagguuuacagcacagcucaauagagccagccaguauauuucccugcucaucagagacuccaagcucagugauucagccaccuaccucuguguggugaaca

SEQ ID NO: 763 - RNA, 410 nt, Homo Sapiens
cgaugauggaaguagcucuuauggcuggagauugcagguuuaugacugauccuauuugggaagaacaaugauggcaggcauucgagcuuuauuuauguacuuguggcugcagcuggacugggugagcagaggagagaguguggggcugcaucuuccuacccugaguguccaggagggugacaacucuauuaucaacugugcuuauucaaacagcgccucagacuacuucauuugguacaagcaagaaucuggaaaagguccucaauucauuauagacauucguucaaauauggacaaaaggcaaggccaaagagucaccguuuuauugaauaagacagugaaacaucucucucugcaaauugcagcuacucaaccuggagacucagcugucuacuuuugugcagagaaua

SEQ ID NO: 764 - RNA, 399 nt, Homo Sapiens
auuauuuuuuuuucguguuuaagguuugaauccucagugaaccagggcagaaaagaaugaugaaauccuugagaguuuuacuggugauccuguggcuucaguuaagcuggguuuggagccaacagaaggagguggagcaggauccuggaccacucaguguuccagagggagccauuguuucucucaacugcacuuacagcaacagugcuuuucaauacuucaugugguacagacaguauuccagaaaaggcccugaguugcugauguacacauacuccagugguaacaaagaagauggaagguuuacagcacaggucgauaaauccagcaaguauaucuccuuguucaucagagacucacagcccagugauucagccaccuaccucugugcaaugagcg

SEQ ID NO: 765 - RNA, 484 nt, Homo Sapiens
aggacugagcuugccugugacuggcuagggaggaaccugagacuaggggacagaaagacuagggauucacccaguaaagagagcucaucugugacugaggagccuugcuccauuucaggucuucugugauuucaauaaggaagaagaauggaaacucuccugggagugucuuuggugauucuauggcuucaacuggcuagggugaacagucaacagggagaagaggauccucaggccuugagcauccaggagggugaaaaugccaccaugaacugcaguuacaaaacuaguauaaacaauuuacagugguauagacaaaauucagguagaggccuuguccaccuaauuuuaauacguucaaaugaaagagagaaacacaguggaagauuaagagucacgcuugacacuuccaagaaaagcaguuccuuguugaucacggcuucccgggcagcagacacugcuucuuacuucugugcuacggacg

SEQ ID NO: 766 - RNA, 467 nt, Homo Sapiens
cagaagccucacacagcccaguaacuuugcuaguaccucuugagugcaagguggagaauuaagaucuggauuugagacggagcacggaacauuucacucaggggaagagcuaugaacaugcugacugccagccuguugagggcagucauagccuccaucuguguuguauccagcauggcucagaagguaacucaagcgcagacugaaauuucugugguggagaaggaggaugugaccuuggacuguguguaugaaacccgugauacuacuuauuacuuauucugguacaagcaaccaccaaguggagaauugguuuuccuuauucgucggaacucuuuugaugagcaaaaugaaauaaguggucgguauucuuggaacuuccagaaauccaccaguuccuucaacuucaccaucacagccucacaagucguggacucagcaguauacuucugugcucugagugaggc

SEQ ID NO: 767 - RNA, 409 nt, Homo Sapiens
cuggaagaccaccugggcugucauugagcucuggugccaggaggaauggacaagaucuuaggagcaucauuuuuaguucuguggcuucaacuaugcugggugaguggccaacagaaggagaaaagugaccagcagcaggugaaacaaaguccucaaucuuugauaguccagaaaggagggauuucaauuauaaacugugcuuaugagaacacugcguuugacuacuuuccaugguaccaacaauucccugggaaaggcccugcauuauugauagccauacguccagaugugagugaaaagaaagaaggaagauucacaaucuccuucaauaaaagugccaagcaguucucauugcauaucauggauucccagccuggagacucagccaccuacuucugugcagcaagca

SEQ ID NO: 768 - RNA, 54 nt, Homo Sapiens
cuuugacagcacaacucuucuuuggaaagggaacacaacucaucguggaaccag

SEQ ID NO: 769 - RNA, 63 nt, Homo Sapiens
uaacucagggcggaucugaaaagcuggucuuuggaaagggaacgaaacugacaguaaacccau

SEQ ID NO: 770 - RNA, 69 nt, Homo Sapiens
cuaaugcuggugguacuagcuauggaaagcugacauuuggacaagggaccaucuugacuguccauccaa

SEQ ID NO: 771 - RNA, 60 nt, Homo Sapiens
ugaaaaccuccuacgacaaggugauauuugggccagggacaagcuuaucagucauuccaa

SEQ ID NO: 772 - RNA, 63 nt, Homo Sapiens
uaucuaacuuuggaaaugagaaauuaaccuuugggacuggaacaagacucaccaucauaccca

SEQ ID NO: 773 - RNA, 57 nt, Homo Sapiens
uggaauauggaaacaaacuggucuuuggcgcaggaaccauucugagagucaaguccu

SEQ ID NO: 774 - RNA, 63 nt, Homo Sapiens
agaagaaaagcagcggagacaagcugacuuuugggaccgggacucguuuagcaguuaggccca

SEQ ID NO: 775 - RNA, 54 nt, Homo Sapiens
acaauaacaaugacaugcgcuuuggagcagggaccagacugacaguaaaaccaa

SEQ ID NO: 776 - RNA, 66 nt, Homo Sapiens
ugaauuauggaggaagccaaggaaaucucaucuuuggaaaaggcacuaaacucucuguuaaaccaa

SEQ ID NO: 777 - RNA, 62 nt, Homo Sapiens
gaacucaaauuccggguaugcacucaacuucggcaaaggcaccucgcuguuggucacacccc

SEQ ID NO: 778 - RNA, 61 nt, Homo Sapiens
acuaccucaggaaccuacaaauacaucuuuggaacaggcaccaggcugaagguuuuagcaa

SEQ ID NO: 779 - RNA, 62 nt, Homo Sapiens
uaaugcuggcaacaaccguaagcugauuuggggauugggaacaagccuggcaguaaauccga

SEQ ID NO: 780 - RNA, 60 nt, Homo Sapiens
ucaaacuggggcaaacaaccucuucuuugggacuggaacgagacucaccguuauuccccu

SEQ ID NO: 781 - RNA, 59 nt, Homo Sapiens
gauaggcuuugggaaugugcugcauugcggguccggcacucaagugauuguuuuaccac

SEQ ID NO: 782 - RNA, 58 nt, Homo Sapiens
ucuuauaacaccgacaagcucaucuuugggacugggaccagauuacaagucuuuccaa

SEQ ID NO: 783 - RNA, 57 nt, Homo Sapiens
uggauagcaacuaucaguuaaucuggggcgcugggaccaagcuaauuauaaagccag

SEQ ID NO: 784 - RNA, 57 nt, Homo Sapiens
ggaauaacaaugccagacucauguuuggagauggaacucagcugguggugaagccca

SEQ ID NO: 785 - RNA, 60 nt, Homo Sapiens
ggaauucaggaaacacaccucuugucuuuggaaagggcacaagacuuucugugauugcaa

SEQ ID NO: 786 - RNA, 63 nt, Homo Sapiens
ugauuuauaaccagggaggaaagcuuaucuucggacagggaacggaguuaucugugaaaccca

SEQ ID NO: 787 - RNA, 63 nt, Homo Sapiens
uuucuucugguucugcaaggcaacugaccuuuggaucugggacacaauugacuguuuuaccug

SEQ ID NO: 788 - RNA, 55 nt, Homo Sapiens
uacaacuucaacaaauuuuacuuuggaucugggaccaaacucaauguaaaaccaa

SEQ ID NO: 789 - RNA, 57 nt, Homo Sapiens
guucuaacgacuacaagcucagcuuuggagccggaaccacaguaacuguaagagcaa

SEQ ID NO: 790 - RNA, 60 nt, Homo Sapiens
gcuaucaaagauuuuacaauuucaccuuuggaaagggauccaaacauaaugucacuccaa

SEQ ID NO: 791 - RNA, 66 nt, Homo Sapiens
ccgacagaggcucaacccuggggaggcuauacuuuggaagaggaacucaguugacugucuggccug

SEQ ID NO: 792 - RNA, 63 nt, Homo Sapiens
ugaucaaagcugcaggcaacaagcuaacuuuuggaggaggaaccagggugcuaguuaaaccaa

SEQ ID NO: 793 - RNA, 52 nt, Homo Sapiens
auuuauagcacauucaucuuugggagugggacaagauuaucaguaaaaccug

SEQ ID NO: 794 - RNA, 63 nt, Homo Sapiens
ugaauucuggggguuaccagaaaguuaccuuuggaauuggaacaaagcuccaagucaucccaa

SEQ ID NO: 795 - RNA, 61 nt, Homo Sapiens
ggaaauacuggaggcuucaaaacuaucuuuggagcaggaacaagacuauuuguuaaagcaa

SEQ ID NO: 796 - RNA, 59 nt, Homo Sapiens
ugacuaugggaacaacagacucgcuuuugggaaggggaaccaagugguggucauaccaa

SEQ ID NO: 797 - RNA, 60 nt, Homo Sapiens
uggacacgggcaggagagcacuuacuuuugggaguggaacaagacuccaagugcaaccaa

SEQ ID NO: 798 - RNA, 63 nt, Homo Sapiens
uguuuucugguggcuacaauaagcugauuuuuggagcagggaccaggcuggcuguacacccau

SEQ ID NO: 799 - RNA, 62 nt, Homo Sapiens
guaugaaaguauuaccucccaguugcaauuuggcaaaggaaccagaguuuccacuucucccc

SEQ ID NO: 800 - RNA, 645 nt, Homo Sapiens
agguuuucaaaaguacugcuucccuucucauccaucucuucuggaauuggcaaaugcccucaggggucaagcaaccaccaauaacggguuuacuuuucugggagcugaacuucugauguguggaugggaggggagauggcauauggccuggugaaauagguaaguagcuuuuuuggcggggguucaugcaggcuucuggcuuacauuaagagcuauaaaaauauugccugguuuucuggcaccagugccuacucaaaauguaucaucggaacuuaucuucagaacuuauuuagaauauuauccuggggauaaaugcuaguauuacccucaaauauucuguucuucaauaauuaccugguaggaccccauggcccucuccugucuucagcuccccagcccaugucuguauccuucucacaauuucuaugguuggcugggaaaacgaccucaauuggaaguucccucuugucaguuguguguagucauggguuuuuagucauuggauuugcccauuaauuuauucucauuuguuauauauuuuccaggaauucuucauuguuuuuucuagcauucauuugguuacuuccaguguuuuaaaauaaaauauuugucacaaacaaaugaaaaaacauuccaugcucaugg

SEQ ID NO: 801 - RNA, 4444 nt, Homo Sapiens
gggacacggcgcgggauggacgcgcaggacugccaggcggccgcaucgcccgagccgcccgggcccccagcccguagcugcguggccgccuggugggacauggucgaccgcaaccugcgauauuuuccacacuccuguucaaugcucggaagaaaaauugcugcucuguaugacagcuuuacuaguaaauccuuaaaagaacacguuuuccuuccucugauagacaugcuaauuuauuuuaauuuuuucaaagccccauuucuuguggauuuaaagaaaccagaguuaaagauuccucacacagugaacuucuaccugagaguugaaccuggggugaugcuagggaucuggcacacaguccccagcugccggggggaagaugccaaggggaaggacuguugcugguaugaagcagcccuucgugaugggaacccaauuauuguuuaucuucauggcagugcagaacacagggcagcuucgcacagacugaagcugguaaaggugcugagugaugguggcuuucaugucuugucuguugacuacagaggauuuggggacucuacagguaagcccacagaggagggacugacuacggaugccauuugugucuaugaguggaccaaggcaagaaguggcaucacucccgugugucucuggggccacucucuggguacaggaguugcaacaaaugcugcaaaagugcuagaagaaaaaggaugcccaguugaugcuauugucuuggaagcuccauuuaccaacauguggguugcaaguaucaauuaucccuuguuaaagacugguucaugucuuuugcccauuuuucagagucuggcucugucguccaggcuggagugcaguggcgugauaucggcucacugcaagcuccgcuucccggguucacgccauucuccugccucagccucccgaguagcugggacuacaggcgcccgccaccaugccuggcuaauuuuucuguguuuuuaguagagacgggguuucaccguguuaggcaggaugaucucaaucuccugaccucgugauccgcccaccucggucucccaaagugccgggauuacaggcgugagccaccgcgcccagcugauaaagagagauuucuaaauuuaauguggaccaauuuaccaauauuuuucuuuaugguaacuuuuaugucauuuauaauaaaacucugcuuacccaaagauuaucaagauacucuucuauguugucuucuggaaacucuauuuuaccuuuuacauguaaaguuauaauccacagguuuagauuuuuguauggaggcagggguccacaugagugucuaauuggucuagagucauuuauuaaauggaccuuccccaccacuaugcagugcuaauguuugcauauaucagugucuauacauauagagagaggucuggugguagguucucauuucucuccauugucuaucugucaaucuuaauauacuauggucuuuuaauuacuauagcuuuauaauaugucuugauaucugguuguauaaguuccucagcuuugucuucuuauucaggauugucuuggcuauucuuaacgcuuugcauuucgguauacauuuugaaauacacuugucauguucuacagaaaacuugcugggacucugggauugcauuggaucuauuugggggacuugagauaaauuugggggacuugguaucuuucuaacauugagucuucaaauucaugaguauuguguuuuauuuauuauuuauuuauuuaauuuuacauuuauuucucauuuagguuuuguuuaguuucaguuuuaggucauauucuccuagaagcaaagccugagacagagauuugguguguuugauuuauugaggaaauguucuucaggaaaaaauccaaaagggaaugaggguaguagcacuggaaagggggaagagcagaacaaggacgugaccucaggcaaagucuagcuuuggccugauucaggcggggugcuaagcuuugaagcaaagggccuguuguuucugcccuccgcuaagguaggcaguggaggaggggcgggaggauggcguaaccucuuaggagugauggcuucugucaucuaagaauaaggagaagcagccaacacucacagcagaaguuaauuaauuuugucagucuuuucaaagaaccagcuuugacuuuaucuucuguguuauaugguuucuauauuuuuaauuucugguuuuaccuguauuauucccuuucucauauguucuuuggauuuaaguuguuauuuaaaaauuucuuuagauaguacuuaauaccaucuaauaauuuauuuuuacuauuuuuuucuaauuuauguacuaaggcauacuucaccuaaaccacacuucagccgcaaccaaauuuugaaguguguucuaauuaucauuuaguucaaaauauuuuauaauauuauugugauuuccuccuugacuauauggauuauuuagaaguaugauucauaacuucuaugcauuugggcauuugauuaugauuuuuauugauuuuuaccuuaaaucucucaagauccaagaauauacuguguaugauuuuagucuuuugaaauuuguugagacucacuuuguguaccaauguauggucaauuuuggcaaauuuuccauaugcuugaaaagaauguguucugcuguuuuucaugcaguguucuauguacgucgauugaaucgggauuauuaaccaugcuuaaauuugucaggccucugagcccaagccaagccaucgcauccccugugacuugcagguaucugcccagauggccugaaguaacugaagaaucacaaaagaagugaauaugcccugccccaccuuaacugaugacauuccaccacaaaagaaguauaaauggccgguccuugccuuaagugaugacacuaccuugugaaaguccuuuuccuggcucauccuggcucagaagcucccccacugagcaccuugugacccccaccccugcccaccagagaacaacccccuuugacuguaauuuuccauuaccuucccaaauccuauaaaacagccccaccccuaucucccuuggcugacucucuuuucggacucagcccaccugcacccaggugaaauaaacagccauguugcucacugguggucucuucacacggacgcgcaugaaauuuggugccgugacucggaucgggggaccucccuugggagaucaaucccccauccuccugcucuuugcuccaugagaaaaauccaccuaugaccuuagguccucagaccgaccagcccaagaaacaucucaccaauuucaaauccgccacucccagagccccuggaacucuggcccaaggcucucugacugacuccuucccagaucuucucggcuuagcggcugaagacugacacugcccgaucgccucggaagcccccuagaccaucacagacgccgagcuuccgguaacucucacagugcaagauuuaccggaacauuccaggauuuuuacguacacuuauggaugcccugagaaaagacaaaauaaucuuuccuaaugaugaaaauguuaaauuccuuucuucuccucuucucaucuuacauggagaggaugacaggacagugccuuuggaguaugggaaaaagggaaauuggacuagaaaaaucuacagcuuugaauggccauccuuugagucucuuucugucgcuugcagcucuaugaaauugcacgcaaugcauacaggaacaaagagagggucaagaugguuaucuuuccuccuggcuuccaacacaaccugcuuuguaaaagccccacacuguuaauaaccgugagagauuuccugagcaagcaguggucaugagucugggaggaguggaaaucuucaaugaagacuuggcccaaacaccaccugugauguauauuguucuaauguaaaauuguacugggcuggucggaugagcugaggccauugacuucucuacaaaucacuugccauuuuaacaacagaaaguacgaauguuaggcaguauggaauguucuuauuuagcuuaucauaaucuacuuuguaaaacaugcugaaaccucacuguggagaaccagaauuugguaaaaucuagauccuaucuaaaaauauguaguuauuaaacauucuguggauauuugugaauaagguaguugcuaugguccgaauaucugggccugcccccccaaauuaugcugaaaccuaaucaccagugugaugguaauaggaggugggacugagcucugaugaaugagauuagugcccuuauaaauuaugaccaaaagagcucuucacuccuccuaccauuugaggauacagugagaagccuucaucuaugaaccacaaaguagcccucaucagacacugaaucagccagugccuugcucuuggacuucccagcccccagaacugugagaaauaaauuucuguuguuuauaagcua

SEQ ID NO: 802 - RNA, 2841 nt, Homo Sapiens
cucucuugccugccgccaugugccuuucgccuucugccgugauugugaggccuccccagccauauggaaguccagcagcaggaggcgcgcgaggcaccacggccuggcggccgagagucagggaggaaccucauuuacauaacggccgccccucugucuccuggcgggggccggagucccgccccucguccaacuugaaaucuguugggucacgggccagucacuccgaccuaggcaagccugugguggagcuggaagaguuugugagggcggucccgggagcggauugggucugggaguucccagaggcggcuauaagaaccgggaacugggcgcggggagcugaguugcugguagugcccguggugcuugguucgagguggccguuaguugacuccgcggaguucaucucccugguuuucccguccuaacgucgcucgccuuucagucaggaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaagcuugcacucaagucagcguaaaccucuuugccuuucucucucucucuuuuuuuuuguuuguuucuuugaaauguccuugugccaaguacgagaucuauuguuggaagucuuugguauaugcaaaugaaaggagaggugcaacaacuuaguuuaauuauaaaaguuccaaaguuuguuuuuuaaaaacauuauucgagguuucucuuuaaugcauuuugcguguuugcugacuugagcauuuuugauuaguucgugcauggagauuuguuugagaugagaaaccuuaaguuugcacaccuguucuguagaagcuuggaaacaguaaaauauauaggagcuuaaauuguuuauuuuuauguacuacuuuaaaacuaaacugaacauugcaguaauguuaaggacagguauacuuuuugcaaacaaaugcauaaaugcaaauguaaaguaaagcugaaauugaucucaaa

SEQ ID NO: 803 - RNA, 71 nt, Homo Sapiens
cuacaaucauggcaauauuuuuugucaacagcgguucaccuagugaauguugauacuuuggguuugaguga

SEQ ID NO: 804 - RNA, 106 nt, Homo Sapiens
gucuacggccauaccacccuaaaugcacccgaucuuguuugaucucggaagcuaagcagggucgggccugguuaguacuuggaugggagaauacugucgcuagauc

SEQ ID NO: 805 - RNA, 724 nt, Homo Sapiens
caugagggcaguuucacugacaguuuaugcaggcagggggagguaagcucauauaaccuuguuccuuacggagguguagaaaaucuguagcaugauguaauguguuuuauuaaauaugcaaauauuaaccuacucaauccucauaaaaacucaguggugaacugacuguuggccuggcagaugagaaguuuuacucccccacucuccagugaaacuggugaaaaguauuuuuaaagcuuggcuugcucacagaaagcaugaaggucagugaacaugguucgagcaauaugcgugaggaggagaguggggugacaugagcaauaaggaauuaagaaugggucaaugaaauauacagcuccuuucuggaauguaccuguucugcuacaaccauggauauccugaccuuucugugccuuucagggacaaggguaauagaggaguuucagacucccucuaaaacaaaacaacaacugaacaauaaacaacagaaaaagaacacaaaaaaagacggugguacucuuuccccuuuccuugcuuucuccugcuaccaaaacaaacaacaaaaacuacauugucucauuggaugacgaagcuaaaauuuuguagcaaaucuauagaagaaaagaaguggaaaucuacucaagagcuacuguaaaacacuguauacaaaacaaccacuuugauucacauuaaaaaguguuaucuguuucuuugaauucauaag

SEQ ID NO: 806 - RNA, 97 nt, Homo Sapiens
ccacauaauugggccccaaagccaugaagaaggaagaggaaaugucuuaaagguugucgauggacaguguuugcugaacaucaaaaucacuuuccag

SEQ ID NO: 807 - RNA, 72 nt, Homo Sapiens
uggaucaaucaugacuacugguauuggaugggucuucgucagugaaugccuaucuggaacucugagguccau

SEQ ID NO: 808 - RNA, 75 nt, Homo Sapiens
ugagcaagcgaugacagccgguggugugugagucauggaggaugaauacuaagugccuggaacucugagguucaa

SEQ ID NO: 809 - RNA, 81 nt, Homo Sapiens
ggguaaguggaaagauggugggccgcagaacaugugcugaguucgugccauaugucugcugaccaucaccuuuagaagccc

SEQ ID NO: 810 - RNA, 1543 nt, Homo Sapiens
uagagggaaggcugucuagcuacaucuagggcaacaugucugucauuuaccucuaagaauuauuuagcagcuuagaacccauuccagacacugaugcauuugaaaaaccccccaaacccaccacauuuaccuccuguggaaagugcuagaaauaagaccauccuccugcagcaguugagugcccugcccgacucaccucucuggggcuuggggaugacccgcguguuuuuggcugacuugacugaggcaucucuugcacucugcaguuuaauuucccuuaagugucucccuggggacucuggaaagagugggaaggugagucugggauuggcagggugcucagggauccaaacaucagucgcccccagcagccaacagcagaagacagcuuccugugggacgggaggaaggugcuguggaccccacccagccucucccaggaagggagcuggcagccauuccacagcccgagccuggcccagcaagggagaagcucagcucuucuccccuccggccucagcaggcugcucagggacucagccuggggucacauaaggccuuuccaacaggccacucugcauccccugucggccucccaaauggugagaccaagaguguccaggacauggggaaacuggaaggcagcagccucgagggccggguccaggauccauguccuccagugaggccuggcgcccuuggccguaacccagcagaggaaagggcgggccguggacuuggagaagguuuucccuuggaccacacagaaugcggcacuggccuggacacgaucacgcuggucacucguaugcccauguucagccugcucagggagacaggaacagacuacaggagcagcaggcugaggcacgcccccaggcaccccgugaggcgggcagggcagggaagcuggugcuccaggaugcguuuccugcccgcgcaccaggcuuggcucccgggcccccacagccuguggguuuucugagcaagggacagggaggugcccaggccugguugcccaggcaggccugacaggaacuggcgagaagccacccuggagggccgggcgcaggccaaggcagggcgguggggcgcugaaccagcuccaaacugcuggcagagcuggccagagugaggaagugagguucccaagcacagaaggcaaaucaaaaaggaaugccaccuccagggaagacacuacacugccaaaggagaugcggccuugcccggcucgaaaagaggucauuuucagaacaugggacucuccaagcccugaggacaggaggcagccuggggaguaugaaccucgcaccugguaggggaccccacacccgagguaccacccaaaacacagcccagaucugcacggagggaugguucccugagcaggcgugacugucacagacaggcugggccugggggcugucgggaggcugcugucccaggcugggucuggauacaaaacuuggacugugucaagcagcgggacgcuggcaggagcaccgggaaggccagcacguggcugcaacgucucccgccuuca

SEQ ID NO: 811 - RNA, 5480 nt, Homo Sapiens
gccgcggagacccggcaguugggggaugccgacgccugggccuugaggaugcugcggaagcucaccaucgagcagaucaacgacugguucaccaucggcaagacggugaccaauguggagcugcugggcgcgccgcccgccuucccggcaggggcggccagggaggaggugcagcgccaggacguggcccccggcgcuggucccgcggcccaggcuccggcucuggcccaagcuccggcccggccggccgcugcguucgaaaggugcccucucgcggggcuccagggaccccugaccguccagggcgaguggucacuacacaacccgacgcgcggcccagagcggugccuguaaggaagcugagcuagaggcaguggugugaucauagcucacugcagccuuuaacuccugggcuccagugagcuuccugcuucaaccuccugaguagcugggacuacagauuuuauuuuguccugucuccugagauuaucagauugaaguagagacccaaauaauucucugauuacaguauuucuucuacugcuguguagauagagaacauaaauauuuguaagcaaaggucacucagccaaaggagcucagaaguagaguauauuaacaaauacagacagcucgaagcacaagagcuugaugugugucgcaguguccaaccaaccagugggccagguccaaggccaucuuuggcuaaauuaagcagugugacaugcaucccagggacaacuuauaaauauccugauuugccuauaagucgauacaaggaagagguugugucuuugauagaaaguaauuccguggugauuauccauggggccacgggaagcgguaaaagcacucagcucccgcaguauaucuuggaccacuacguucagcgcuccgccuacugcagcauuguggucacccagccccggaagauaggggcaagcagcaucgccagguggaucaguaaagagcgugccuggacccugggagguguggugggcuaccagguagggcuagagaaaauagcaacagaggacaccaggcuaauuuauaugacaacuggaguccugcuucagaaaauaguuagugccaagaguuugauggaauucacacauaucaucauugaugaaguacacgaacgaacagaagaaauggauuuccugcuauugguaguccgcaaacucuuaagaacaaauucacguuuugugaaggugguccugaugucggcuaccaucagcuguaaagaguuugcagacuacuuugcuguuccuguucaaaacaagaugaauccugcauauauuuuugaaguggaaggcaagccccauucaguugaagaguauuaucuuaaugauuuggagcacauucaucauagcaagcucucuccucaucuccuggaggaaccggugauaacuaaggauauauaugaaguugcugucucucucauucagauguuugaugacuuggauaugaaggagagugggaacaaggcuuggucgggggcccaguuuguguuggagcgaagcaguguguugguguuuuugccaggucugggugaaauaaauuauaugcaugaacuucucacaagccugguucauaaaagguugcaggucuauccacuccauucaaguguggcuuuagaagaacagaauaaugucuuuuuaaguccagucccuggguacagaaagauuauucuguccaccaauauugcagagaguucugucacaguuccagaugucaaauauguuauagauuuuuguuugacuagaacuuuggucugugaugaagauacaaauuaucagagucugcgauugaguugggcuucuaaaaccagcuguaaucagagaaaaggccgugcuggacgagugucuagaggguacuguuaccggcugguacacaaggauuucugggacaacuccaucccugaucauguuguuccugagauguuguucuuucuucucuccucuccuucucuccuccucuuucccucugaagcacugguuaugugaaucggcuaacugauuuaguuauguuauuauuucuaaucucaggcuuguuucuuuucagcguuguccauuaggaagcacgaucuugaaagugaaauuacuugacaugggugagccgagagcucugcuggccacugcccuuuccccgccuggucugagugacauugagcgcaccauccuucuacuaaaggagguuggagcacuugcagugagugggcagagagaagaugaaaacccccaugauggugaauugaccuucuuaggaagaguuuuagcccaacuuccuguaaaucagcaacuugguaaacucauaguccuuggacauguauuuggaugucuagaugaaugucuuauuauagcggcagcucuuucuuugaagaauuuuuuugcaaugccuuuccggcagcaucucgauggauauaggaacaaagugaauuucucuggcaguagcaagagugacuguauugcacuuguugaggcauuuaaaacauggaaggcuugcagacagacaggggagcugcgguacccgaaggaugaacuuaauuggggacgguuaaauuacauucaaaucaagagaauuagagagguggcugaauuauaugaagaauugaagacuagaaucucacaguucaacaugcauguugauucucggcgaccugucauggaccaagaguauauauauaagcagcgauucauccuacagguuguauuggcaggugcuuucuauccaaauuacuuuacuuuuggacagccggaugaggagauggcggugagggagcuggcuggcaaggaccccaagacaacugucguguugaaacacauuccucccuauggauuucuuuacuauaaacaacuacagucucucuuuagacaguguggucaagucaaauccauuguauuugauggugcaaaagccuuuguggaauucucacgaaauccaacagagagauuuaaaacccuuccugcaguauauauggcaauuaagaugucucaacuaaaaguuucacuugaacucagcguucauucugcagaggaaauugaagggaaggugcaaggcaugaacgucucaaagcucaggaacacaagggugaauguggacuuccagaagcagacgguagauccuaugcaagucuccuuuaacacaucagacaggucccagacaguuacagaucuccuucuaacuauugaugucacagaggugguugaagugggacacuuuuggggauacaggauugaugaaaacaacucagagauucugaaaaagcuuacugcugaaaucaaccaacugacgcuggugcccuugcccacucacccacauccagacuuggucugucuggcaccuuuugcugauuuugauaaacaacgcuacuuuagagcucaaguccuuuauguuucuggaaauucugcugagguauucuuuguagauuauggcaauaagucucauguagaucuacaucuuuugauggagauucccugucaauuucuugaacuuccuuuccaggcuuuggaauuuaagauuugcaaaaugagaccaucagcaaagucucuuguuuguggcaagcacuggagugacggggccagccagugguucgccucucuggugagcggcugcacccuccuugugaaggucuucucuguggugcacagcguccugcacguggauguguaccaguacucagggguccaggaugccaucaacauaagagacguccucauccagcagggcuaugccgagcucacggaggaguccuacgaguccaagcaaagccaugaaguucucaagggccucuuuuccaagucaguagaaaacaugacagauggcucugugcccuuucccaugaaagacgacgagaaauaucucauccggauuuuguuagagagcuuuucuaccaauaaacuggguacuccaaacuguaaggcagaacuucacgggccuuuuaacccuuaugaacuaaagugccauaguuugaccagaauauccaaauucagguguguuuggauugagaaggagagcaucaacucugucauuaucagugacgccccugaagaccuucaccagagaaugcugguugcagcuucccuuuccaucaaugcgacuggaucuacgaugcugcugagagaaaccucucugaugccucauaucccuggccucccggcucuccucagcauguuauucgcaccggugauagaguuaaggauugaucagaauggcaaguacuauacuggaguccuuugugguuugggguggaauccagcuacaggggcuuccauacugcccgagcacgacauggagcuugcguuugacguucaauucagcguggaggaugucgucgagguuaauauucucagggcugcuauuaacaagcuagucugugauggaccaaauggaugcaagugucuugggccagagagaguugcgcagcuucaagacauugcccgucagaagcuuuuagguuucugcuuuugaauaugccauagauuaaaauauuuucugaucauaacugcauaaauguugaccuuuaaacaguuuauucuaguuccaauucugugggaagcauauaggauuuaaaucuuuaaaaaaaucacagcaguguuuucaguuacuaauauauaauuaagauaauuucuuuuuuuuuuaaauuaguuuguucugucagucaaaaccaagggagaagauuguucccaaguggcaugaaaagcccuacgaguggaaucagugucuucuaugugaugucccggcaaagagucagacaccaggauaacucacugccugugaguugggaaaaaaagguugauccaaagcuggucauggagcaggccgaccgugagagcagcagagggaagaacaccuuucucuaccagcuccacaaacugguugugcucggcaccugagcauguccacagguggccuccagcacaccccucaggaagcuguggaggcuggauuccaggcucccuccgcagacugacuuuccucugugucuggguguuacagucugugcccacugcauccuaaaggccuuuucuuucuucuuuucucuuugggugauagucagagagugguguuuuuguucaggugggaaggauuggaaacucuagucuuuucuagaaacagaaaaucacuguauuaaauauuuuggaaagauuguucugaaagaagucuguuuggauaaagagcuguauuuugcuuuaaauuuauuaagguaaauauaaguaguuaaucuuagauguaagguuccagaaugugcuuacauauucuguucuguuacagugauuuaaaccaguaguauaggaaaaaacuuaaaaaaacaaaaaaaccauguaguauuuucugauuuuuuuuuccaugagggaaaauaucuaauuuuuauaagacuaaguugaguuauacuucuugguucacauuuuggaaaucagagauuacagauuacauggccauagcuuaucuguguuaaaacaauaaaagcauuaaaugaa

SEQ ID NO: 812 - RNA, 115 nt, Homo Sapiens
gucuacggccauaccacccugaacgcgcccgaucucgucugaucucggaagcuaagcagggucgggccugguuaguacuuggaugggagaauguauaaaagugguaucauaugug

SEQ ID NO: 813 - RNA, 942 nt, Homo Sapiens
auggaaagaaucaacagcacacuguugacugcguuuauccugacaggaauuccguauccacucaggcuaaggacacucuuuuuuguguucuuuuuucuaaucuacauccugacucagcugggaaaccugcuuauuuuaaucacugucugggcagacccaaggcuccaugcccgccccauguacaucuuucuugguguucucucagucauugauaugagcaucuccuccaucauugucccucgccucaugaugaacuucacuuuaggugucaaacccaucccauuugguggcuguguugcucaacucuauuucuaucacuuccugggcagcacccagugcuuccucuacacccuaauggccuaugacagguaccuggcaauaugucagccccugcgcuacccugugcucaugacugcuaagcugagcgccuugcuuguggcuggagccuggauggcaggauccauccauggggcucuccaggccauccuaaccuuccgccugcccuacugugggcccaaucagguggauuacuucuucugugacaucccugcaguguugagacuggccugugcugacacaacagucaacgagcuggugacguuuguagacauugggguggugguugccaguugcuucucccugauccuccucuccuacauacagaucauucaggccauccugagaauccacacagcugaugggcggcgccgggcuuuuucaacuuguggagcccauguaaccguggucaccguguacuaugugcccugugccuucaucuaccugaggccugaaaccaacagcccccuggauggggcagcugcccuaguccccacggccaucacuccuuuccucaacccccuuaucuacacucugcggaaccaagaggugaagcuggcccugaaaagaaugcucagaagcccaagaacuccgagugagguuuga

SEQ ID NO: 814 - RNA, 951 nt, Homo Sapiens
cccaucccuccuucaucucccuccagcauuuguuucuggaaggagucaacaccaacagcucugaccugggcagccuuccugagaaaaugcagccauuccuccuccuguuggccuuucuucugaccccuggggcugggacagaggagaucaucgggggccaugaggccaagccccacucccgccccuacauggccuuuguucaguuucugcaagagaagagucggaagagguguggcggcauccuagugagaaaggacuuugugcugacagcugcucacugccagggaagcuccauaaaugucaccuugggggcccacaauaucaaggaacaggagcggacccagcaguuuaucccugugaaaagacccaucccccauccagccuauaauccuaagaacuucuccaacgacaucaugcuacugcagcuggagagaaaggccaaguggaccacagcugugcggccucucaggcuaccuagcagcaaggcccaggugaagccagggcagcugugcaguguggcuggcugggguuaugucucaaugagcacuuuagcaaccacacugcaggaaguguugcugacagugcagaaggacugccagugugaacgucucuuccauggcaauuacagcagagccacugagauuugugugggggauccaaagaagacacagaccgguuucaaggggggacuccggggggccccucguguguaaggacguagcccaagguauucucuccuauggaaacaaaaaagggacaccuccaggagucuacaucaaggucucacacuuccugcccuggauaaagagaacaaugaagcgccucuaacagcaggcaugagacuaaccuuccucugggccugaccaucucugggacagaggcaagaauccccaaggggugggcagucgggguugcaggacuguaauaaauggaucucugguguaaauauga

SEQ ID NO: 815 - RNA, 3148 nt, Homo Sapiens
aaaagugauauuuaguuauaacagagacuaaagaagaaagacgcuuacugaauaaggugggauccaacaagaguguaguauggaaugcaauagcuuaugaauuacuuuuuuucugagggagcucaacagaaugacaccuaagaaagggaaagucuuugacacuugguacguuugugauuuuuggucauuacuugaaaauuaauaaguuugaaaucacuacucuuagaaauggaagaaagugaugacucuaaucagccuaucucagcguguaggcaagaaauucgaaagagaagaugacccagcaaaccaaugguaggcaaaucccagcaaacugauguaauagagaaaaagaaacacauggccauaccaaaaucaucuagccccaaagcuacccaucguauugguaauacuucuggaagcaaaggcagcuacucugccaaagccuaugagucuauuagaguaucuucugagcuucagcaaacuuggacaaagagaaagcauggacaggaaaugacuaguaagucucuccagacagacaccauuguagaagagaaaaaagaagucaaguuaguugaggaaaccgugguaccugaagaaaagucagcugauguuagagaagcugcuauugaauugccagagaguguucaggauguagaaauuccaccaaacauaccuucaguucaacuaaaaauggacagaucucagcagaccagccguacaggauacuggaccaugaugaacauccccccuguagaaaaaguggacaaggaacaacagacauacuuuagugaaucagaaauagugguuauuuccaggccagauaguucuucuacaaagucaaaggaagaugcccugaaacauaaaucgucgggaaagauuuuugcuagugaacacccugaauuucaaccagcaacaaacagcaaugaagaaauugggcagaaaaauaucagcagaacuucauuuacucaggagacuaaaaaaggucccccgguacuuuuagaagaugagcuuagggaagaaguaacuguaccuguuguacaagaagguucugcuguuaaaaaaguggcuucugcugaaauagagccuccaucaacagaaaaauucccagcuaaaauacagccuccauuaguugaagaggccacugcuaaagcggagcccagaccugcugaagagacccauguccaaguacagccaucaacugaagagacuccugaugcugaggcagccacugcaguugcggagaauucuguuaaaguucagccuccaccugcugaagaggccccuuuaguggaguuuccugcugaaauucagccuccaucagcugaagagucuccuucuguagagcuucuggcugaaauucugccuccaucagcugaagaguccccuucagaagagccuccugcugaaauucugccuccaccagcugaaaagucuccuucaguagagcuucuuggugaaauucggucucccucagcacaaaaggcucccauugaaguacagccuuuaccagcugagggcgcccuugaagaggccccagcuaaaguagagccucccacuguugaagagacccuugcugauguucagccucuauuaccugaagaggcuccuagagaagaggcucgagaacuucagcuuucaacagcuauggagaccccugcagaagaggcuccuacugaauuucagucuccauuaccuaaagagaccacugcagaagaggccucugcugaaauucagcuucuagcagcuacggagccuccugcagaugaaacuccugccgaagcucggucuccacuaucugaggagacuucugcagaagaggcucaugcugaaguucaaucuccauuagcugaagagaccacugcagaagaggccucugcugaaauucagcuucuagcagcuauagaggcuccugcagaugaaacuccugcugaagcucagucuccacuaucugaggagacuucugcagaagaggcuccugcugaaguucagucuccaucagcuaagggaguuucuauagaagaggccccucuugagcuucagccuccaucaggugaagagaccacugcagaagaggccucugcugcaauucagcuucuagcagcuacagaggcuucugcagaagaggcuccugcugaaguucagccuccaccagcugaggaggcccccgcugaaguucagccuccaccagcugaggaggcccccgcugaaguucagccuccaccagcugaggaggcccccgcugaaguucagccuccaccagcugaggaggcccccgcugaaguucagccuccaccagcugaggaggcccccgcugaaguucagccuccaccagcugaggaggccccugcugaaguucagucucuaccagcugaggagacuccuauagaagagacccuugcugcaguacacucucccccagcugaugaugucccugcagaagaggccuccguugacaaacauuccccaccagcugauuugcuucugacugaggaguuuccuauaggagaggccucugcugaaguuucaccuccaccaucugaacaaaccccugaagaugaggcucugguagagaaugugucuacagaauuucagucaccgcagguggcaggaauuccagcaguaaaauuaggaucgguuguuuuggaaggugaagcaaaauuugaagagguuucaaaaaucaauucuguccuuaaagauuugucuaauaccaaugauggacaggcucccacucuugaaauagaaaguguuuuucauauagaauuaaaacaacguccuccugaacuguagucagguuguaccuaagcuagcaaucagaagcuacaugguuuuggaagaacauacuuuagaaaagggugggcagcgggaaguagcuuugucaauaaggcaaauuaaaggggaccccaagacuuggaauacagguuggaaaaugaacaauaaaaacuguagcagcauaaaauuacuuguguuaauuucauucaaauuuauggcaugaaaaauaccuauuuugaaaguaaguuuauaauugaaaaaaauugcuuaaaauauccuuccuacaguaaacuuguugacacgaguaaaguuuaaucugcagccaucuuuucuugucuuugccuucccuuuauaaguaaauauaguuucuaguggaaaa

SEQ ID NO: 816 - RNA, 4803 nt, Homo Sapiens
ggaaauccggaagggagccuccgagcccaggucccgggcuggcaggggucucgccggcgcuuggaccucgucucccacccccgagcccacugcggccccagagccucgggaggggccgggcacuuccucugcccuccggccuggggcaggggccgggacgcggugggagugcagcggggacggcaccgcccgagggggcgggccccaaacuuucgugcgcguugaaagcugcuggcgcggcggggcggacuccaccccugcccggcagcccagcgccuccggccgcacuuccagcucucugcgcagcccgccgcgcagcccgccgccccagccauggcgaagccccugacggaccaggagaagcggcggcagaucagcauccgcggcaucgugggcguggagaacguggcagagcugaagaagaguuucaaccggcaccugcacuucacgcuggucaaggaccgcaacguggccaccacccgcgacuacuacuucgcgcuggcgcacacggugcgcgaccaccugguggggcgcuggauccgcacgcagcagcacuacuacgacaagugccccaagaggguauauuaccucucucuggaauuuuacaugggccgaacauuacagaacaccaugaucaaccucggucugcaaaaugccugugaugaggccauuuaccagcuuggauuggauauagaagaguuagaagaaauugaagaagaugcuggacuuggcaaugguggucuugggagacuugcugccugcuucuuggauuccauggcaacccugggacuugcagccuauggauacggcauucgguaugaauaugggauuuucaaucagaagauccgagauggauggcagguagaagaagcagaugauuggcucagauauggaaacccuugggagaagucccgcccagaauucaugcugccugugcacuucuauggaaaaguagaacacaccaacaccgggaccaaguggauugacacucaaguauucagagugcucguauagccagcguuuuguauaguauuuaguacaguagauaauacauugacuauguagcauauaguggugauauugaguauagggcaugucguguuuugaauaauagaauauauuuuuguaaauaaaucuguuacuucucuuagcgcagcccagucauuuuggagacaaaggagcugaggccaagagaggagugacuuuuauaagggucauuuugcaaccagcuuugucagaaaauugucaguucuuuuuuuuuuuuuuuuuuuuuugccagaaaauugucaguucuauaguaaccagcaugcuuaccucuuugguuuuauauuaagguguugauagcaaaauugaauaauuugaaaugucauuccuggcugggugcaguggcucacaacuguaaucccagcacuuugggaagccgaagcgggcagaucaccugaggucaggaguucaagaccagccuggccaacauggugaaucccuaucuguacuaaaaauacgaaaauuagccaggagugguggcccaugccuauagucccagcuacaugggaggcugaggcaggagaaucgcuugaaccuaggagguggagguugcagugagcugagaucaugucgcugcacuccagccuggguaacagagugagacucugucucaaaaaaaauaaaauaaaauaaaauaaaaauaaaaguuugcaguuuacacaaucaauccuggaagcauuugggcaccuguagucccagcuacucgggaggcugaggcaggagaauggugugaacuugcagugagccgagauugcaccacugcacuccagccugggcaacagagugagacuccgucucaaaaaaaaaaaaagauaaacuuuuuugaauacaaauaccauaucauuccauuccacugcauuuauaucagggcaagggcacauggagagucaacauagaaauacuguaaaggaccaucaguguggaugguuucagucacuagauuguaccaggucggggaggaaccacauguuccucuaauacccucugcagcccugagacccucuucuccauuuaggccucacacaauuuaaguugguaauggagccaggaauagaauuccauugcagucucccagccccuuguucaaccuaugucaucacacuugggaaacaaugagcagcugcuucuguuuaaucccacaggugguccuggcucugccauaugacacccccgugcccggcuacaugaauaacacugucaacaccaugcgccucuggucugcucgggcaccaaaugacuuuaaccucagagacuuuaauguuggagacuacauucaggcugugcuggaccgaaaccuggccgagaacaucucccggguccucuaucccaaugacaauuuuuuugaagggaaggagcuaagauugaagcaggaauacuuugugguggcugcaaccuugcaagauaucauccgccguuucaaagccuccaaguuuggcuccacccguggugcaggaacuguguuugaugccuucccggaucaggcaaguggccauccagcugaaugacacucacccugcacucgcgaucccugagcugaugaggauuuuuguggauauugaaaaacugcccugguccaaggcaugggagcucacccagaagaccuucgccuacaccaaccacacagugcucccggaagcccuggagcgcuggcccguggaccugguggagaagcugcucccucgacauuuggaaaucauuuaugagauaaaucagaagcauuuagauagaauuguggccuuguuuccuaaagauguggaccgucugagaaggaugucucugauagaagaggaaggaagcaaaaggaucaacauggcccaucucugcauugucgguucccaugcugugaauggcguggcuaaaauccacucagacaucgugaagacuaaagugugagccuccauuacucuggcagugggucugacacugauccauuaauggaaugaugcuacuaaaugcaggguugcacuuagggaugaggaaaggccuuguucaaauguuuaaaaguauuuucuucuauacaaaaaacucuugccuaauucaaggacuucagugagcuagaaccugacaaguuucagaauaaaaccaaugggaucacuccaaggcgcuggcuccuacucugcaacccaggacuugcagagcucauagcagagaaaauuggagaagacuaugugaaagaccugagccagcugacgaagcuccacagcuuccugggugaugaugucuuccuccgggaacucgccaaggugaagcaggagaauaagcugaaguuuucucaguuccuggagacggaguacaaagugaagaucaacccauccuccauguuugauguccaggugaagaggauacaugaguacaagcgacagcucuugaacugucugcaugugaucacgauguacaaccgcauuaagaaagacccuaagaaguuauucgugccaaggacaguuaucauuggugguaaagcugccccaggauaucacauggccaaaaugaucauaaagcugaucacuucaguggcagauguggugaacaaugacccuaugguuggaagcaaguugaaagucaucuucuuggagaacuacagaguaucucuugcugaaaaagucauuccagccacagaucugucagagcagauuuccacugcaggcaccgaagccucggggacaggcaauaugaaguucaugcuaaauggggcccuaacuaucgggaccauggauggggccaauguggaaauggcagaagaagcuggggaagagaaccuguucaucuuuggcaugaggauagaugauguggcugcuuuggacaagaaaggguacgaggcaaaagaauacuaugaggcacuuccagagcugaagcuggucauugaucaaauugacaauggcuuuuuuucucccaagcagccugaccucuucaaagauaucaucaacaugcuauuuuaucaugacagguuuaaagucuuugcagacuacgaagccuaugucaagugucaagauaaagugagucagcuguacauggugaguaaauugccaagauuuauaaagaaaaccaguuuacuaugauucauuaaaauguggguuuuuuaauuaaaugcaaauaucagauccccauguaauaucagauccccauuaagcaaucaaaaaaaaaauccaaaggccuggaacacaaugguacucaaaaacauagcugccucggggaaauucuccagugaccgaacaauuaaagaauaugcccaaaacaucuggaacguggaaccuucagaucuaaagauuucucuauccaaugaaucuaacaaagucaauggaaauugaacucuagaauugucucuagaaaacauagcuucuuacugaacuugaacauuuuuacaacauucacugguuuuuguuuuguuagcuaauaaucuauaauaguugaguaucucugggaauggggagggaaauuauauguaauagagcuuaaaaauaaagugucaauuuccaagggcuaaaaucugaugcugucaggcccaagcauuggccaggaaaggacucaguacagacaggaccacucagagaaacaguaagauaaguccacguauuuacaauacucugaaaagcaaauuguccagagaggggaagagaacuagcuguucuuuaucuucauuagaacuuuuguccuuugauuuguauucucucucuccauucagccucugcuauggucugaguguuugugucugcccaaaauucauaugcugaaagccuaaccccagaggugaugguauuagaa

SEQ ID NO: 817 - RNA, 726 nt, Homo Sapiens
auugaguuacugaucaacagugagcaauggaagcuguucaaacagaaaggaagcccagccgugagguggugcugccaacacacuccuuugaagcucggcuggccccuguggggagugcaggaggcugggggucuacucccuacgguucccagagaaaugguagcaagaagacgguguuauuucuaauuggaugaugaaagucagccuaggggacagagaccaaagggccauacguaagaagaggaggaagugaaaacaucugaaucaaagguugagguaaaacugagagacaguguuugcagugaaccaugcaguaaccuucaucuugcccccuggucuucaggaaacaagcaaguggggaaggaccgaaagaggguacuaaauuuccaaaugaucagacgugaaguuucauggcccauaauggcuacacauuugaagacucaagcaaauaaauuagaaauaaagccuaccagcaaaccaaaagauaauuacauguaaaagcaagucuccuugauuucugauacuugcacuuaugagaaugagaaaacaacgauagcacagagagaugguggacauggaggacagguccuguaggcucacuucaugggcuuuuucauacccugaccacuuuccacgcuggauucauuuuacuguagugaaacaauuggcuguagauaauguuaaaagauaggacuuugguaacaggagaauucauggauucuugaa

SEQ ID NO: 818 - RNA, 2049 nt, Homo Sapiens
ccaacauugcucugccaggacacagauccguagggucagcccugcauccugagcagcuuagagggagaagccagaccagcagugccucacaccuuguccucuucugcucuggacagauggcuccauaacgacagcuucauaauggcaguggaugggacccuaguguacaucagggucacucuucugcugcucuggcuugggguauuuuugucuauuucuggcuacugucaggcugggcccucccagcauuucacuucccuggaaguggugauccccuugaaggugaucagcaggggcagaagugcaaaggcuccuggauggcucuccuauagucugcgguuuggggaccagaaacauguuguucauaugaggguuaagaagcucuugguuucuagacaccucccaguguucaccuacacagaugagcgugcacuccuggaggaucagcucuucaucccagaugacuguuacuaucaugguuacguggagggugccccugagucucugguuguguucagugcuuguugugggggcuuuugaggaguauuaaaaauaaacggccucacucaugaaauugaacccaucaggcacucugccacauuugaacaccugguuuacaaaguaaacaguaaugagacacaauucccagcuaugagauguagcuuaacagagaaggaaguagcacgccaacaguuggaauuugaagaggcugagaacucagcucuggaaccaaaauuugcuggugacugguggacucaugcaugguuucuggagcucguuguuguggugaaccaugauuucuucauuuacucucaaagcaacaucucaaaggugcaagaggauguauuucuuguugucaacauaguggauuccauguaucagcaguuagguacuuacauaauuuugauuggaauugaaauuuggaaucaaggaaauguuuucccaaugacaagcauagaacagauccuaaaugauuucucucaacggaaacaaaucagucguucccagcuacaacauggugcugcacauacguucauaaaaaauucacuuauaaguauacuuggccuagccuacauugcaggaauaugucguccaccuauugauuguggaguugauaauuuucaaggagauaccuggucucuuuuugccaacacuguggcccaugaguuaggucauacguuggguaugcagcaugaugaagaauucuguuuuuguggggaaagagguugcaucaugaauacuuuuagagugccagcagagaaauucaccaauugcaguuacgcugauuuuaugaagaccaccuuaaaccagggaucaugucugcaaaauccuccaagauugggggaaaucuuuaugcuaaagcgcugugggaauggugugguugaaagagaagagcagugugacuguggauccguacagcagugugaacaagaugccuguuguccauugaacugcacucuaaggccuggggcucccugugcuuuugggcuuuguugcaaagacugcaaauucaugccaucaggggaacucuguagacaagaggucaaugaaugugaccuuccagaauggugcaauggaacaucccuucaguguccagaagauagauaugugcaggacgggauccccuguagugacaguuccuacugcuaucaaaagagguguaauaaccaugaccagcauugcagggagauuuuugguaaagaugcaaaaagugcaucucagaauugcuauaaagaaaucaacucucagggaaaccguuuuggucacugugguauaaauggcacaacauaccuaaaaugucauaucucugaugucuuuugugggagaguucaaugugagaaugugagagacauuccucuucuccaagaucauuuuacuuugcagcacacucauaucaauggugucaccugcugggguauugacuaucauuuaaggaugcacauaucugacauuggugcagugaaagaugguacuguguguggcccaggaaagaucugcauccacaagaagugucagucugucugucuugucacacaucugccuuccuga

SEQ ID NO: 819 - RNA, 5635 nt, Homo Sapiens
ucuugaccuuuacccacuuacgcaaggagaaggaaaucauaaugaugucaugugaucaaaggaaaccauggaaggguucacgcugauagcugauagcuuuuacagugcucauuccuaacaguggauuuacuuuagagacaggauuuugccauguuugccagguuggccuugaacuccugaccucaggugauccaccugccucgaccucccaaagugcuuggauuacaggcagaacuccguuagagaagauuuaauccggauuccaccgcugcuccacugcugcuguccucuguucuuuuccacacaaccucuaccugacuucacuuugguguggacucuggaguugaucccucugguuucauaugcuucuuuuccuacuuauaugcugauuggcuguuaccaaaggugacuagagugcuaagccagucaacagggaaaacuuggcuccugacuuugggucuuucuucucagucuauauggaagaaaacugagaaaaaauauaaaaaagaagaacacaacuaguugcgcaucuccuaaagagauggaaucgccacuuauauauguuucaguuuugcuuuugaacauauuugaauuuucaucaggaauaguauauaauaaagaugauacagagaaacgcuuugcauguucuaacaaaggguucccucaagagaaugaaauaaucaaguuguaucuuuucuuagaaaacuugaaaauccaguguuucuuccaaacugaaaaugaaauugcaucaaaagcaaugcuaaguguguucacaucaggaggacuugcucccagcuugggaaucaugaauaguacauauaauggcaucuuccacuuuaauuuaacguuguucagugaucggauuuugugguugguugauauuccuagagaaaacaucacacaaagcacagauauugcagcuguagaagaaugguuaguaagaaucacuuuacaucauggacuaaauauuuaugcuacugaaggaacucuauuggauguuauucgagaaccgauucuucaguggacuccuggggaugugauuccagaaagugaaaucaguaaauuauauccacaugugguagaucucaaagugacaaaaugccccugugccaaugauguggcauuacuaggcuucauuguggauacaauaguugaugguguuuacauaggcauaaccuuugguggauucuggcaugauuaugauaccacaugguuuaacaugacacagacuaucuauucccaacuucaagaagaauaugaagaccuuucauugguggauaugguuuuaacgaaucauuuuuuaguuauccucaccucuuugggccuuuuuguaagugaagaucuucguuauccaucacgccacagcuuaucguuuuccagggcagacuuuugugguuuugaaaggguugacuaugugaaaggaaaacugugguauaaugaaagauguuuugcuaacagagagcacuuugaaguugauuauguuacaguuaccuuugagagaaacagaacccuaagugagucaagcucuuguuuuuauagucaggaaccauuucuugaauggguacccugcuuaccucacauuuuuaaaggaauaaaaauuuuuccaacugugcuaacauuucuuguugaccaagagcgugguacuggaguuuaccucuucuauaacaaggucaggaaaacugccauugccucugugagcacccugagaaauaaugaaccaaauucacaaucaaaauuuccaauuuuucgguuuccuucaucauucucuucucccguuggaaugguauuucauccccgaagccacuuuuuguaugcuuauggcaaucagauauggcuuucaguugauggcggcaacaccuuucaauuaauagcuaacuuucaugaugauaucauaaagaagacuuuucauaguuuuuauacaucagcuauuacuuuuguuucucaacguggaaagguuuacucgacaaaggcaggaggggaggagccaagauggccgaauaggaacagcuccggucuacagcucccagcgugagcgacacagaagacgggugauuucugcauuuccaucugaggaaugggaagauacagugcagucggaaguguuacugagagaauuuucacauuauacuaugaucacuugggauuccuacauaagcugacucugggucgcuuugaagcuaguggaccacccacagccuuuggaaauucuagaaaucuuuuuggacagccuccagauaugggcuuugagacugcgcuugccccacagcacaccuccuuagaugaaauuaucuuuuuugcauauguaccugagaacgaaccccaggaaacgaucuacagcaagaaguucggcaauauacacuauggaaaagugauacacucuggguagugauaugcauuuauuuagauggcauauugguuucuagaaucuacuuuuuaaauuuuuugagauagggucuugcucugucauccaggcuggagugcaguagugcgaugacagcucacugcagccucaaucucccaggcucaagcaaugcucuggccccagccuccagaauagcugggacugcaggcacacaccaccaagcccggcuaaguuuuguauuuuuuguagagaugggguuucaccauguugcccaggcuggucucaaaccccugagcucaagggauucacccaccucagcuucccaaacugcugagguuacaagugugagccacugcagcuggccaauagaaucuaaauuuuugggccuacuuuuuugaauaauuuucuuggucaaauagaguaaguauuuuuuugacaccccacaaggccaaauacauuuauaaacuccuagaugucuugcaugcugccccaauuuuagaaaccuaggaccauuuauaucagugccaucaggccaagcuauagaaauguguuucgugaguaucaaaaauauucuggacaacacuggauacuuccuauccacugaguuuacucaaaugacaauucuuguauauccuagagaccaacacauuuaauguaguggaggcuaucuuuuaugaaauauugcauugaacaauauacagaauucucagaaaugcuuacaguaagagucaauaacccuuaaagcuaccuuuaaggccuaauaacucuuauucagaauaugaauucuggcugggugccauggcucacaccuguaaucccagaacuuugggaggccaaggccagcagaucaguugagaccaggaguuggagaccagucugaccaacauggugaaacuccaucucuacuaaaaauaaaaaaaagaaaacuggaagagcuuacauaagaaagguauugcaacauacgacuccuaaaggauuuuuguccucaguuauugcagaaaugaaagagcccuuuggauuagaagaagugaaugagagcucuuguuugucuaguucccuuuugauuaauaaagcuggaaaugucuauaaacucacucuugauucacaaguuguucaggccuuguuugaagauacagauauagagaagacuguagugcuucccggguacagcagcuuccucaucacaagcauuuuagauaauaagaaugcauuagccauugcuaccaugccugaaagugcacccaacaauaugaccuuucuaaagagcacaugguucuuauacaacuuugggcaaaggaauggacgaacauggaaaauauauucaaaaccauguaauuauugguuucaacaugaugauucaccaucccucaacaucgugaaauacauugaucugggaaacucuuauguuuuaaaagcuaaggucauacggaaugcaaaagguuuucgaaugcuugaaauaccacuacugacuguguuuguuggaaacccuaauuuguuggaaguuacagcugaagugacuuuugaugauacugacaguuauguaauaacaauuucugcagcuagcaaaguuuuacaucaggguucaacuucacuggcauuuauuauguggucagccucuacugagugcuuuguuacgacaauggugccaacacugaaaagcagcuguaguuaucucagaucuaugcaucacauuccuagcaaauuuaucccauuugaagacuggauuaguggaguucauaaagacagucaggguuuuaaccucaucaaaacuuugccgauaaacuacaggccuccaucuaauaugggaauugcuauuccacucacagauaauuuuuaucaugcagauccuagcaaacccauaccaagaaacauguuucacaugucaaagccugggcaacacagcaagacacuaucucuaaaaauaauaauaauaaaauaaaugaauggcaagagagaucaaguauaaaugaaugacaaaugggcagauauaguggagauuuaaaauaucaacauaugcuaugaagaaagacaaguaugaaauaguagguuuggagagugugcagccccacauuaucaaggccacucauuuuauguuuccgucuggaucccugcacuggcaggggccaagagcaguuaguuugguaguccugggaugcagaauucagaaugacacaggcuuucuaggucccaugcaacugcacgaggugaacggcaagcggcugaguaauacuuggguucaaauuaccaagcaagggggcaacuaaaauucagaaauacuguacuucuauucuuacuuuauuauuaaugaauugcuuuccccuuuuaacuucucaggaauuccacuucuucagggaauaaauauuuauuagauauuuaucaguuugcagaaaucccgcaacgcagaaaaacaagucaacaucuguuacuucuauuugcagaaaaccgguaaauucaaacagugugcuaauguuuccacucgggaggaguguaacugcacaaaggaucagaaguuuucacaugcuguugcuuucucggauugcagggaaaaaguuccucgcuuuaaguuuccaauuacacaauauccaguuucuuuggaaauuaucaacgaggauggacgugucccauugcaaucuccauaucugguuacugugacugaagugaacaugaggcacaacuggaaacugaaacacacugugccagaaaauauuaaaagaaugaaacaauuaguagaaccaauucuuggugcugcaguguauaauccuucaggucucaacuuaagcauaaagggcucugaacuuuuccacuuuagagugaccgucauuucaggaguaacuuuuuguaacuuaauugaagaauuucagauuuauguugaugaggcaccauugccauucccaggacacacgcuuauugccguggcaacagcgguagugcuagggggauuaauuuuuauagcauuuauguuucaacugcaaggcauccauccguggaggacauuccaaagauggauuagaagaaaccaagagaaguuuucaaguaucucucucagugagcugauucauagaucaaagucugaagagugaacacauggugaucauaauuucucuuuauuuucuaguuuuaucagccaauuccuagaacaauauauuuaaauguuaaauaugcaagcuacauaaaauccuaaagaauugucauuauaauucaaauugcuacuugucaauauauucaccauuuccuuuucuuauuuugaauacauagaaaaugucuuaugccagg

SEQ ID NO: 820 - RNA, 1259 nt, Homo Sapiens
cccgcggguugaguucagcgaacgcugcggcuaggggagggcgggaggagggagagcggacgcagggggcggggaggggcgcagggcugcgcgcucgccggcgcucucuuucgguuuggucggcggcuggaggagaguggacccccccacuuuaaggcucuguccucggcgcguucccgccgccccccggucccgacgcggggcucggggaugcccgccagcauguucagcaucgacaacauccuagccgcccggccgcgcugcaaggacucgguguugccgguggcgcacagcgcggcggcucccgucgucuucccggcccugcacggggacucgcucuacggcgccagcggcggcgccuccucggacuauggcgccuucuacccgcgccccguggcccccggcggcgcgggccucccggccgcggucagcggcucccgccucggcuacaacaacuacuucuacgggcagcugcacgugcaggcggcgcccgugggcccggccugcugcggggccgugccgccgcugggcgcccagcagugcuccugcgucccgacgcccccaggcuacgagggccccgguucggugcugguguccccgguaccgcaccagaugcugcccuacaugaacgugggcacgcugucgcgcaccgagcugcagcuucucaaccagcugcacugucggcggaagcggcggcaccgcaccaucuucacugacgagcagcucgaagcucucgagaaccucuuccaggagaccaaguacccggacgugggcacgcgcgagcagcuggcccggaaagugcaccuccgcgaggagaaaguggaggucugguuuaagaaccgccgcgccaaauggaggcggcagaagcgguccucaucagaggagucggagaacgcggagaaguggaacaagacgucgucgucgaaggcgucaccggagaagagggaagaggaagguaaaagcgauuuggacucggacagcugacggccgcgggacacuugcccguauuacuuaccuaacucgaaggacuugcacagacagacgaugcuacuuucuugcacacgcgcugccuugcgggagggggucgagaaagaggaacgaggagcuguaaauaguguacagagccgggagggucggcgucuggggucagggcgcgcacagcccagcagcccgaggccgcccgcgacuagcccccaccguaguauuuauaguuaaauuaagggugacaguacaauaaagugauggcgauguagacgggc

SEQ ID NO: 821 - RNA, 1071 nt, Homo Sapiens
gcauccccgaccagccccaaggucuucccgcugagccucgacagcaccccccaagaugggaacguggucgucgcaugccugguccagggcuucuucccccaggagccacucagugugaccuggagcgaaagcggacagaacgugaccgccagaaacuucccaccuagccaggaugccuccggggaccuguacaccacgagcagccagcugacccugccggccacacagugcccagacggcaaguccgugacaugccacgugaagcacuacacgaauuccagccaggaugugacugugcccugccgaguucccccaccucccccaugcugccacccccgacugucgcugcaccgaccggcccucgaggaccugcucuuagguucagaagcgaaccucacgugcacacugaccggccugagagaugccucuggugccaccuucaccuggacgcccucaagugggaagagcgcuguucaaggaccaccugagcgugaccucuguggcugcuacagcguguccaguguccugccuggcugugcccagccauggaaccauggggagaccuucaccugcacugcugcccaccccgaguugaagaccccacuaaccgccaacaucacaaaauccggaaacacauuccggcccgagguccaccugcugccgccgccgucggaggagcuggcccugaacgagcuggugacgcugacgugccuggcacguggcuucagccccaaggaugugcugguucgcuggcugcaggggucacaggagcugccccgcgagaaguaccugacuugggcaucccggcaggagcccagccagggcaccaccaccuacgcuguaaccagcauacugcgcguggcagcugaggacuggaagaagggggagaccuucuccugcauggugggccacgaggcccugccgcuggccuucacacagaagaccaucgaccgcauggcggguaaacccacccacaucaaugugucuguugucauggcggaggcggauggcaccugcuacugagccgcccgccuguccccaccccugaauaaacuccaugcucccccaagc

SEQ ID NO: 822 - RNA, 1110 nt, Homo Sapiens
gcuuccaccaagggcccaucggucuucccccuggcgcccugcuccaggagcaccuccgagagcacagccgcccugggcugccuggucaaggacuacuuccccgaaccggugacggugucguggaacucaggcgcccugaccagcggcgugcacaccuucccggcuguccuacaguccucaggacucuacucccucagcagcguggugaccgugcccuccagcagcuugggcacgaagaccuacaccugcaacguagaucacaagcccagcaacaccaagguggacaagagaguugaguccaaauauggucccccaugcccaucaugcccagcaccugaguuccuggggggaccaucagucuuccuguuccccccaaaacccaaggacacucucaugaucucccggaccccugaggucacgugcguggugguggacgugagccaggaagaccccgagguccaguucaacugguacguggauggcguggaggugcauaaugccaagacaaagccgcgggaggagcaguucaacagcacguaccguguggucagcguccucaccguccugcaccaggacuggcugaacggcaaggaguacaagugcaaggucuccaacaaaggccucccguccuccaucgagaaaaccaucuccaaagccaaagggcagccccgagagccacagguguacacccugcccccaucccaggaggagaugaccaagaaccaggucagccugaccugccuggucaaaggcuucuaccccagcgacaucgccguggagugggagagcaaugggcagccggagaacaacuacaagaccacgccucccgugcuggacuccgacggcuccuucuuccucuacagcaggcucaccguggacaagagcagguggcaggaggggaaugucuucucaugcuccgugaugcaugaggcucugcacaaccacuacacacagaagagccucucccugucucuggguaaaugagugccagggccggcaagcccccgcuccccgggcucucggggucgcgcgaggaugcuuggcacguaccccguguacauacuucccgggcgcccagcauggaaauaaagcacccagcgcugcccuggg

SEQ ID NO: 823 - RNA, 359 nt, Homo Sapiens
gcucuugcuguguugcagauuggcagaugccgccucccuauguggugcuggacuugccgcaggagacccuggaggaggagacccccggcgccaaccuguggcccaccaccaucaccuuccucacccucuuccugcugagccuguucuauagcacagcacugaccgugaccagcguccggggcccaucuggcaacagggagggcccccaguacugagcaggagccggcaaggcacagggaggaaguguggaggaaccucuuggagaagccagcuaugcuugccagaacucagcccuuucagacaucaccgacccgcccuuacucacaugccuuccaggugcaauaaaguggccccaagga

SEQ ID NO: 824 - RNA, 1110 nt, Homo Sapiens
gcauccccgaccagccccaaggucuucccgcugagccucugcagcacccagccagaugggaacguggucaucgccugccugguccagggcuucuucccccaggagccacucagugugaccuggagcgaaagcggacagggcgugaccgccagaaacuucccacccagccaggaugccuccggggaccuguacaccacgagcagccagcugacccugccggccacacagugccuagccggcaaguccgugacaugccacgugaagcacuacacgaaucccagccaggaugugacugugcccugcccaguucccucaacuccaccuaccccaucucccucaacuccaccuaccccaucucccucaugcugccacccccgacugucacugcaccgaccggcccucgaggaccugcucuuagguucagaagcgaaccucacgugcacacugaccggccugagagaugccucaggugucaccuucaccuggacgcccucaagugggaagagcgcuguucaaggaccaccugagcgugaccucuguggcugcuacagcguguccaguguccugccgggcugugccgagccauggaaccaugggaagaccuucacuugcacugcugccuaccccgaguccaagaccccgcuaaccgccacccucucaaaauccggaaacacauuccggcccgagguccaccugcugccgccgccgucggaggagcuggcccugaacgagcuggugacgcugacgugccuggcacgcggcuucagccccaaggaugugcugguucgcuggcugcaggggucacaggagcugccccgcgagaaguaccugacuugggcaucccggcaggagcccagccagggcaccaccaccuucgcugugaccagcauacugcgcguggcagccgaggacuggaagaagggggacaccuucuccugcauggugggccacgaggcccugccgcuggccuucacacagaagaccaucgaccgcuuggcggguaaacccacccaugucaaugugucuguugucauggcggagguggacggcaccugcuacugagccgcccgccuguccccaccccugaauaaacuccaugcucccccaagc

SEQ ID NO: 825 - RNA, 1268 nt, Homo Sapiens
cuuccaccaagggcccaucggucuucccccuggcgcccugcuccaggagcaccucugggggcacagcggcccugggcugccuggucaaggacuacuucccagaaccggugacggugucguggaacucaggcgcccugaccagcggcgugcacaccuucccggcuguccuacaguccucaggacucuacucccucagcagcguggugaccgugcccuccagcagcuugggcacccagaccuacaccugcaacgugaaucacaagcccagcaacaccaagguggacaagagaguugagcucaaaaccccacuuggugacacaacucacacaugcccacggugcccagagcccaaaucuugugacacaccucccccgugcccacggugcccagagcccaaaucuugugacacaccucccccaugcccacggugcccagagcccaaaucuugugacacaccucccccgugcccaaggugcccagcaccugaacuccugggaggaccgucagucuuccucuuccccccaaaacccaaggauacccuuaugauuucccggaccccugaggucacgugcguggugguggacgugagccacgaagaccccgagguccaguucaagugguacguggacggcguggaggugcauaaugccaagacaaagccgcgggaggagcaguacaacagcacguuccguguggucagcguccucaccguccugcaccaggacuggcugaacggcaaggaguacaagugcaaggucuccaacaaagcccucccagcccccaucgagaaaaccaucuccaaaaccaaaggacagccccgagaaccacagguguacacccugcccccaucccgggaggagaugaccaagaaccaggucagccugaccugccuggucaaaggcuucuaccccagcgacaucgccguggagugggagagcagcgggcagccggagaacaacuacaacaccacgccucccaugcuggacuccgacggcuccuucuuccucuacagcaagcucaccguggacaagagcagguggcagcaggggaacaucuucucaugcuccgugaugcaugaggcucugcacaaccgcuucacgcagaagagccucucccugucuccggguaaaugagugcgacggccggcaagcccccgcuccccgggcucucggggucgcgcgaggaugcuuggcacguaccccguguacauacuucccgggcacccagcauggaaauaaagcacccagcgcugcccugggccccugcga

SEQ ID NO: 826 - RNA, 52 nt, Homo Sapiens
uacugguacuucgaucucuggggccguggcacccuggucacugucuccucag

SEQ ID NO: 827 - RNA, 430 nt, Homo Sapiens
aggucucagagaggagccuuagcccuggacuccaaggccuuuccacuuggugaucagcacugagcacagaggacucaccauggaauuggggcugagcuggguuuuccuuguugcuauuuuagaagguguccagugugaggugcagcugguggagucugggggaggcuugguccagccuggggggucccugagacucuccugugcagccucuggauucaccuuuaguagcuauuggaugagcuggguccgccaggcuccagggaaggggcuggaguggguggccaacauaaagcaagauggaagugagaaauacuauguggacucugugaagggccgauucaccaucuccagagacaacgccaagaacucacuguaucugcaaaugaacagccugagagccgaggacacggcuguguauuacugugcgaga

SEQ ID NO: 828 - RNA, 437 nt, Homo Sapiens
agcucugggagaggagccccagccuugggauucccaaguguuuucauucagugaucaggacugaacacagaggacucaccauggaguuugggcugagcuggauuuuccuugcugcuauuuuaaaagguguccagugugaggugcagcugguggagucugggggaggcuugguaaagccuggggggucccuuagacucuccugugcagccucuggauucacuuucaguaacgccuggaugagcuggguccgccaggcuccagggaaggggcuggaguggguuggccguauuaaaagcaaaacugauggugggacaacagacuacgcugcacccgugaaaggcagauucaccaucucaagagaugauucaaaaaacacgcuguaucugcaaaugaacagccugaaaaccgaggacacagccguguauuacuguaccaca

SEQ ID NO: 829 - RNA, 425 nt, Homo Sapiens
agcccugggagagaagccccagcccugggauucucagguguuucuauugggucaacagcaauaaacaaauuaccauggaauuugggcugagcuggguuuuucuugcugguauuuuaaaagguguccagugugaggugcagcugguggagucugggggaggcuugguacagccuggggggucccugagacucuccugugcagccucuggauucaccuucaguaacagugacaugaacugggcccgcaaggcuccaggaaaggggcuggaguggguaucggguguuaguuggaauggcaguaggacgcacuauguggacuccgugaagcgccgauucaucaucuccagagacaauuccaggaacucccuguaucugcaaaagaacagacggagagccgaggacauggcuguguauuacugugugaga

SEQ ID NO: 830 - RNA, 426 nt, Homo Sapiens
auuuccuuaaauucaggguccugcucacaugggaaauacuuucugagaguccuggaccuccugugcaagaacaugaaacaccugugguucuuccuccugcugguggcagcucccagauggguccugccccaggugcagcugcaggagucgggcccaggacuggugaagccuucacagacccugucccucaccuguacugucucugguggcuccaucagcaguggugguuacuacuggagcuggauccgccagcacccagggaagggccuggaguggauuggguacaucuauuacagugggagcaccuacuacaacccgucccucaagagucgaguuaccauaucaguagacacgucuaagaaccaguucucccugaagcugagcucugugacugccgcggacacggccguguauuacugugcgaga

SEQ ID NO: 831 - RNA, 431 nt, Homo Sapiens
cagcucugggagaggagcccagcacuagaagucggcgguguuuccauucggugaucagcacugaacacagaggacucaccauggaguuugggcugagcuggguuuuccucguugcucuuuuaagagguguccagugucaggugcagcugguggagucugggggaggcgugguccagccugggaggucccugagacucuccugugcagcgucuggauucaccuucaguagcuauggcaugcacuggguccgccaggcuccaggcaaggggcuggaguggguggcaguuauaugguaugauggaaguaauaaauacuaugcagacuccgugaagggccgauucaccaucuccagagacaauuccaagaacacgcuguaucugcaaaugaacagccugagagccgaggacacggcuguguauuacugugcgaga

SEQ ID NO: 832 - RNA, 426 nt, Homo Sapiens
cucugggaguggagccccagccuugggauucccagguguuucccuucagugaucaggacugaacacacacaacucaucaugcaguuugugcugagcuggguuuuccuuguugguauuuuaaaagguguccagugugaggugcagcugguggagucugggggaggcuugguacagccuagggggucccugagacucuccugugcagccucuggauucaccgucaguagcaaugagaugagcuggauccgccaggcuccagggaaggggcuggagugggucucauccauuaguggugguagcacauacuacgcagacuccaggaagggcagauucaccaucuccagagacaauuccaagaacacgcuguaucuucaaaugaacaaccugagagcugagggcacggccguguauuacugugccagauau

SEQ ID NO: 833 - RNA, 412 nt, Homo Sapiens
agcaucauccagaaaccacaucccuccgcuagagaagccccugacggcacaguuccucacuauggacuggauuuggaggguccucuucuuggugggagcagcgacaggugcccacucccaaaugcagcuggugcagucugggccugaggugaagaagccugggaccucagugaaggucuccugcaaggcuucuggauucaccuuuacuagcucugcuaugcagugggugcgacaggcucguggacaacgccuugaguggauaggauggaucgucguuggcagugguaacacaaacuacgcacagaaguuccaggaaagagucaccauuaccagggacauguccacaagcacagccuacauggagcugagcagccugagauccgaggacacggccguguauuacugugcggca

SEQ ID NO: 834 - RNA, 437 nt, Homo Sapiens
agcucugagagcggagccccagccccagaauucccagguguuuucauuuggugaucagcacugaacacagaggacucaccauggaguuugggcugagcuggguuuuccuuguuguuauuuuacaagguguccagugugaggugcagcugguggagucugggggaggcuugguccagccuggagggucccugagacucuccugugcagccucuggauucaccuucagugaccacuacauggacuggguccgccaggcuccagggaaggggcuggaguggguuggccguacuagaaacaaagcuaacaguuacaccacagaauacgccgcgucugugaaaggcagauucaccaucucaagagaugauucaaagaacucacuguaucugcaaaugaacagccugaaaaccgaggacacggccguguauuacugugcuaga

SEQ ID NO: 835 - RNA, 4055 nt, Homo Sapiens
guugcaggcuaucguguguuaaccuguacuucugccgcagaguuuggagaaagcggcagcagauugugcugccgcaggcuggagccuggaaccuggagcccuggagccuugaauggugugugguggcaauggagagaggcagcuggcagugacagcugcuccgugcuuggcuacaggaaggaaagaaggagaaagcaccuaccauaggcuggaggcuagagccugcaggacugcggcuggccucgcuggcucgccucccuggcuggccucgcugugguugguggcagcgacggauacugcagcuggccagaguguagaaaggcaauggggagcgcaguccuggugggcccagcgguuccuguggauuggagccaggcagugugauguuaccagucaccacuccaggucccaguuccuggcccgcuugagccaaaaggagaggcuggacuuuggaggguggauaugagugccuucacugagacuggccccugccacccaguggccaggaugacaaggcagaggagaaugacccuguggccaccaccaucacaggccuaugaacuuuaguuaguaguuggucccagucaguaacacucugggagggcucaggccacaucacgaaaugugacaggauagccuugaacucaucaauugcuggguaagaaagaauuuuaaugcaauggcaaacaaccaaucaaacaagcaaacaaaaacaauaaacccuuccuugaggaccaagaagacauugauuagcuaaccuaagagcuccagguggagaccuagguccugauuggguuucugaauuugaccacuaggcagaaaacuagcacccaaaaccaguuggaauaaaauuacccaccuacaguggagccaaggcccccagauccuuuuugucaggggcaccucaaacucaacuccaaaauugaucuaaugaacuuucccaaaccacauucccuucuugcauuucugagagaauggauucccauucaucugacuacagugcuacccugaaagcagauccagagacuaagauucaccugcaggugauucauuugggucucaacucaagcauuccuuucucaagaagccuuuuaugguaugaagagugagacagaguucccugcgccaccuccauugaaucauguuaggccuuaauguaccuuuccuuuauaacacuuacugaaugauuaauuuggcauuuauuuaccuggcuauuuuauucaguguuuaggauuuauacuagauuguaagcuccucaagaguguuccaggucuaguuuaggucaccauguaucccugauuaguaccacacaucccagugcaccaugguucucaacaaauaacauguuauauaaaucaauaaaugacaggcaagguaagcugucaucaguuggagguaagcagaagacaguagagaguacagagcccuggacugugacucagaggaugagcaccagauccaguuugcugugccacagugguaagucaccuaaccuuuaugugcuuggauuccucauauguaauacaggaucacaacuauuguucucacucaugcaauacuacuauugugagaaccucaugaauuagagaaacucugaauuugcaauuuagcuuuagaacacugacaaguagcucauugauucuugccucauuccucuggaauaaaguagcuuuuuaucaaacaagugaacacauugcuuucaguggaggcagaaggaauucauuuugaaaaaugcacauagcauucuccaacccauuuuugcauauucuuuuuuaagggaaugccuugugugagaggacuagcaggguaucagaacuguuuuuugaaagaacuuuguuugcaggugcuuucaaauauguugucuucaacuaucauuuucaguguaaaaagcgggcuuggaguaagcacugccugcagaccacuuuugugagcccuccuuucagugaugugauggcaauccaggccccugcugggagagauuucugccugguuaaaccucucacagcuucuaauccucucuuucucaucuggcuuuccuuagccuucuccaaagucacucacagaaggcaucccacucaaccucaccuugggguaaaucaaaauaguccuccuucugaagcuaccggguaaaacggugguagcugugcagcugcugcugaucaacaggcuccagaaacagcagcaggaggugagcagucccugcguuggccaccaagugguagguggccagcccuaccuccaaguugcacuguuuacuuauucaucuuucaugguaaagccuccaguugccuauuaugaaaucagcaauaaucauguguccccugucugggucccugaaaagauggaaagaggcagaucaggcuggugcucugagaaugacagacaucaaacaagaaugaaaagugucacccuccuuggacuuauucaguaacucaugcccuugagcaaaggaggauuuucuaucaaaggacauggauuucugugucuuucucuugagauaacauugcugggugaccacagaaagcuggcucuggaagcacagaagcugccuuuccuugaguaauaaugucucuucaaagggagcuggagcaugaguaguguacaugccucagauuucagugaaaaguucagaggaggccugagaagaagguccugggaaugaaucaucuagaugacucaaccuugcaaagccauccaccucauuguggauaucauucaauacauuuggugcuccaucauccuauuuccauggcuauuuccucacauuuuucaaagucuguuucuugagcccugacugugucaaauagcaugcccuguuauucuugggcuucccucucuguucuaguauucagggagauuucagaggcugggguaaaucucagaccaagaagacgcaaugguuuugagguagagauccuaggaauauagaauucugagcuaugcagugguccuuugcuuucaggaaaucaaguuugauaguaucaccugaagcauacuuacauuauccacaaaugacagcuccuuacuugagcaguuaaauuguggcaagucuuaacacacagauuccucuuaaaugccaccuaaucccugccuggcuucaagccucuggcuucccuuggagaggggcagagucucucugugugagagauucuucauuucugcuuucugcccugucaguuucuacuuacuugcucuuccaccuuguccacaaggcuuaucuagcggcuguuuaccucugagcagagaaaauggaagucagcagagacaagguugaaauuucucaggaaggauuuuuuuuuuccacuuuaucgugcagcaagaguaaagccuuuuuuucggugauucuuuccuccacaauggccauuggcugcccucugucacacacaggugugacucccuuguuauuaacugucaggugggaauuucuagggaagaaggagagugcuuuguuaaccucuuaacaucuccccaaauugcaucauauucucucccuuuccccucccaguuaccuuuucuauuuuugauuuccccuuuuucagucugauuuggggauuucaguucccacuaacuuuguauaauauccuccuaucucugaaagaacaaguuccaucuccauuuuccaggagaguuuuuuuccuugcaguaagagcaccccaucaucucuccauuucuaccuccccaucccagugcucccuuuauggcaguacaauugaagagggacccacagucuugcugaaggaacaugaccuuccuacugaaguugggauuacggaauagagggagaagaggaaagauggauguuuaucugaauggucggaucuuguuuuccagaggacacaggccaaugggaaacuuuugggaaggaagucaaaaaaucaaagccagaacuggguuuugguaauuuaaucucccaaagagagaaaaguccccauacucuaauucauauuuuguuugacuugacugaagcccuuuugaauauuuuuucugcuucuguucuguucuugcaauaacaaugacauaaguuugccuuuggagacauuaaaauaguuuucuca

SEQ ID NO: 836 - RNA, 1764 nt, Homo Sapiens
aggucugggcagcgucuuccugaacagccugaagcagaagguggugacccuggcaagcagcgcagacgugcugagcaccgugcagucggccucccaggccaugcugcagagcggcugguccaugcuguugcccaccgcugagaagcaggcccgggcacucugcucuccuguccugcggaguuucaggcaaugaagugagcauaaguccaggucaucgauuggugauugaucuucuggugggcagcuugauggcugauggaggguuggagucagccuuacacgcagccauuacugcagagauccaggauacaaaaaaagaagcacggaaggaaaaagaaauuuaugaacaggaagcaaaugccucaacauuucauagaaggaggacuccauuggauaaagaccuuauuaauacggggaucugugagucuucuggcaaacaguguuugccucugguucagcucauacaacagcuucuuagguaaaucauauuagcuguauuguauuguguuuuauuuauuuacuuuuuuguuuuuugagacagaguuucgcucuuguugcccaggcccgagugcaguggugcgaucuugacucacugcaaccuccgccucccagguucaaguaauuccucugccucagccucucgagcagcugggauuacaggcaugcgccaccaugccccacuaauuuuguaauuuuauuagagacaggguuucuucauguuggucaggccggucuugaacucccaaccucaggugguccauccacuuuggccuaucaaaauguugggauuacaggcauuagccaccacgccuggccuauuuauuuacuuauuaaugguguuuuuuuuuuuuuuuuuuuuuugagauggagucuugcucuaucguccaggcuggagugcagugucacgaucuuggcucacugcaacccccgccuccuggguucaagcuauucuccugccucagccucccgaguagcugggacuacaggcgucugcaaccacaccuggcugauuuuuguauuuuuaguagagaugggguuuuaccauauuggucaggcuggucucaaauuccugacgucaggugacccaccugccuuggccucucaaaauguugggauuacagguguuagccacugugccuggccuguauuguauuuuaauaggugauuauugguuuucauauuaagauagugaaaucuagcgcaaggaucucaaaaauuuguuugaugauugaaggaauauucugaaaauuaccuaguauagauguuaggauaaagagcagacccuuuucaauauaggugagaggagaaguuggagggugugaugauacucaaaaguuuuucacugaagagaaauuggggcgugcaguaaacauguaaaaagauucuuacuaauaagcagguggaugcaaaugaaaaucaucauggaagguuauuuuuaaaacugauuguaucauugccucacuuuauauauuacagaguuauacauacuacuuuguaagauaacuuuucuuuucaaaacugaagucaaugugauagaauggugagcauuauuuuggaaggccagacuaggaggaggugggaggaagaagucagacucagccugugaacagacgcuaaccuuggcagaagccaaaacagucagacaguguuguguaaaaaugaucauucaagaagagcgaaacagcaaggugauuugugaaagagauuuauuagaaaaugaaacacauuuauaccucuguucaauaaaaaucugcuuuucgucaa

SEQ ID NO: 837 - RNA, 15969 nt, Homo Sapiens
guggugaccauguggauaauaggaucauagacaaauggugguuccaucuacagcaucaccgaaaugcuguuguuacugcuucuuucugggaucuucuugcaucuuugcuucuaaaggggcacaccuuuuauagaaguacguccaggaauagaagugaccugcuuuuucgcaaguaauugccuggaauguuuuuauguacuucucugcacucucaauacauuucaugcuucccucuauuuuuguauauuaacucauuguauuucuuaaauuuauauuuuacuuuaugaauggaagugagauuuguguaugguaaauauaauuaauucaaccccauggauacguuagucacuguccagaugauggcaagucuuucucagaagcagagggccuuggugugccagugauuuuuuuuccccauguguaagauacuuuuuuuccucauuugaaucaggagcccacaguuuuuagacaagucccaaaugaaaucuuaagcauuuguguuaucuggacuagaccuucuguaguauccuuuuuguuagaccuaguauaucucauugcagaucaggaucugagauugacuauaguucaccucuuuccaaguacacaaacuuggaugacaugacaacugaguguguaagggagagcgagacccuugcacugccauuugagcccuugugaucucaucuuguagaacauguuguacaaucauuuuauugguaucauuaguguuauuuggggcuggaauaaaaaucucagugcaccaaagagauuuccccuuuauccacguuacccugguuuuccuuuguuuucuguuuaaccuaaacgggcuuaauauaaaauagugcuuauuugguguuuuaauugucugcuucuauaacauaagcugcacuguccauuggggaacugcucaccauauugcccaaccugucuugauagguuuauacaugggaggcauucaguaauauuaauuaccucucuagaccaguguuagcaauaacaaacacuugcuagaauuuuaagacuauauaaucaaucacuuugaugucaguuaauccuaccaacacaagauuaaagguuuaaaaaucucauacguguacagccauuagugucuccuuucauacuauauuauuuuguucauuggcagcuagauuuuuagguagaacuuguguuccuuuuugcaaugcucauuuauuuuaccuggacagaaggugcucuucugucucuucuccaaaguuaauuuaucucauacuauuucuuguguuaauauuuuccaaguucaguaugcuguucugguuauaagaagaucaguguccuaaucacacacuuuuacauuauaugaaacaucauacagaguuuuguagucuguauaacaauacacagagguagcaaaauuuguaaaagagcagacuauauaguccauacuguaguaacuacucaacauugccauuauacgugaaaucggcuauaaccaauucauaaacaaaugaauuuggccguguucuaguaaaacuuauuuacaaaaacauguguuaggccagauuuggaccacaggcuguagauuucugaccucuggcuuacagcagaaguuuauuaugauccuggggaagguggauauacauggaaggcagaagcgagaagauguauuccaucccaugucauuuuucugaacccucaacguaggaaguuaaacuaaaacauggggcagaaucugcuuuaagccuuugaauucuuggcucuuaaagccagguugaggguuauguguuuuuauucuuuuauaucuccuuuucacuuaggcuuggcaacuaguucauugaaacagagccaacaagaaugagugagucacucagugauaugaagcaagcuguggucauuuaucuacuaccuuccauaccuacuuccuagguuugauaaguaguguuuguaguguaguugucaguaacuuuucucagcuuacauaaguuuauguggaauucauuuacaaaugugugauuauuacgauagauguuauuuuauaaauuucaagguucuuuaauacagcauggacauguuucuaaaucaauaaauauagcuuacccacagacuuuuuaugggauguaaaguauguauuacaacagguaaauccauuucucuguuuugggaaagcagguuaauguuuuguuuguuuuguugcugcauauaauguugcacuauauauauauucuaaugcaguuggucuccuaauucuacaggauaaaugucuagcuguggcauuguuggaucaucaguuucguuucaguuagaugcugugaaauugcucuugaaaaugguguccucugccaccacagaacgguguuguaauggaagugccaauuuucauaaaaacuugugugcaacagguauuaagaauuuuugaggucgggcgcaguagcucacgccuguaaucccagcacuuugggaggccuaggcagguggaucaccugaggucaggaguuccagaccagccugaccaacauggugaaaucccaucuccacuaaauacaaaaaauuagcugggcgugguggcauauaccuguaaucccagcuacuugggaggcuaagacaggagaauugcuugaacccaggaggcggagguugcagugagccgagauugcaccacuacacuccagccugggugaugagcgaaacuccaucucaaaaaaaaaaaaaagcuuuaaauuuuuagccaaucuaauaggugaaaauggcauuuuuaacauaagucugacuuaaacaauuaauggccguggcuaaaagaagaaucaaauaaugaugugugauuuauaagauaaggaggcaguaccccauuuuuccucacucuacccaaaaauccuguuuaucugagcaagaaaucauuaauauuuucuaaauccgcuuggaaguucauaaacgcccuaaguauaccuuauaccagcguuuuuaugacuuuguauuuuugaaauaauuuuagauucagaaucgcaagaaucaugcagagcgaccugauuuacgcuucaccuagauugacuuuuuauucugcaucguuguguucuucccccacuuccucuucuugcucucgccucccuuuauauguuuauacauagcauuaucauuuuauguacuauuugaaugauuugccgacauuaucuuccuguaacccaaaacacuucaacaucuacuuucuaagagccugagcaucuuauauugacuucgguaaaaauuucaaaauaaugaaaugugucaauaguauaaaaguauaacaguaugcaguccauauucacauuuuacccauuuuuccagagguguucuuuauagcaguuucuucccuucuacaacauccagaaaaggaucuucuauugcauucaauuaucaugucucuuuaguuuuguuuaaucugaaacaguuuccuggacuuugaucacaucaguguucuuaaaaaguaauagcuaacagauuuaaggagauaccucagauuuugaauuuuguguuuccucaugaaaagguuuaagauacucauuuugagcagaaauaauucaguauucucagucuuccuuagugaaucaucucaggugacaaauaaugucacuuugucucacuuugaauuacuuugaucucuugguucgauugguguccacuggacuuuuccacuauaguuaacauuccuucauaauuaauuuggaacuauacagguauucuauuuuucaucaaacuuccacauaguagguuuaauaugcacaggugacuuuuaccugaaucaguguugauuagaaaaaaaucuguuauugcuuagaugcauuauuuaguaucuuguacuguaaggaagaguuuguauaucauggccugucagaacagucccgcaauguguuuuaugaacugaaaauucugaaagaauaagguagugauuuauaugagaauacagggaaaggguuacccaaagagucuaaugaauuuaugucuaaaccauagaguggaaugugagagacacacagaacuccagaguugugaugcaaauacacugcacaguggaaggagaagaggaaguuuuugguaauaguguuucaucuaauguagcucuguaauguaugugugccuucauuauuggaagaguguucaacaguucacaguugaauagacugaagcaugaugcuggaaucuggguucagauucuagauccguauccuacauaucaccaaugcuuguuucucaauuuuuguuugucauuacuuuaagucucuuuaaugcauuagaguauccaagguugacagugaagggacugcauuugggagcuaucugaagacaaaaacagcuuuuugaaguuucuuucauacgucaccuuacauggccucucgcauucucuguggagaaguuuguguagauuauucagacuaccgugcagugacuguguuguuuaaaaccuauacauauccaaacucuguuuuguguucucuauaacuagggcauuagucucccaauaguaauccugcaucuuaugcuauuuaaagaagguucccagaauacagacauucuuacuuuugaacaaugacuuggguagauugaggaagugguuuuaauaaucacuuugauauauuucaaaaucugguucauuauuggugaggugcaggccaccugguauuaaugaaaauguguaauuaggaaccagugcaguggaaucagaggcuugaacaugaccuaaggcuuggucaaaaguggugaucugaauguucccugcucucuguauguaacuuuguacuuagucuucaguggcaggguugcagcagaggcccaguaaauauuguucauucaacguaugaaggagaaaauggaaguaaggccaaaaauuacugauuguaaacaaaugaagcaccaagugaauaaauguacaaauagacaaguagccaguaggaaaaaaaacaauaauuguuaccuaaagaaugaaaaccaaguggaaaaggccgccagggacauuuuaauaugcauauuguugcuuucacauauaauacaguaagggaguaucagaaaaccugaaucugccugacuaaaacauacccuguuccacaaagcuauauauaugagaguauugaaggugguuuaauaccaaauucaaaaauucagccucaguguagcaaacuuuuaaauuuuccaugauauaaaguaaguuuuaaccaacaauggaagucacagcacuaaaguacauuacuauuauaugauucucugaugguaauagaaacugugcugcaggacacguuuugauucaggaagaaauguggaguaacuccacagaggaauucauccuuucuaaguuuaaaucugaacggaacccauaugcccauacccugaagaugcauguaagggaacaacauggcuuggucuguugaaaaaagaaaagaaccuucaauuaagcauucugugaacuugauaagaggaugcagaggaacguaaaugcacucugcauaucugugauugaccuuggaacacagugauugcccucuaaagaauagccgaguaaguacuguuaucauuccaccgaucaaauuagagccucuuccuuccagugggagcagagugacauagaccaaggaaagccgaggagaagauuguagccuuuuauuucuccuuauauuuguugagguucacugcugacugauaaacgauuugcacaaaaaaauucaggccucugacucuucugguauuugauuuaucuaguaaaguuaauuccaagacaaaaguacaguugguuaaaaauaccagucucauguuuauuugaugguuugaaauauucuguuacauuguuguaucucguuugucaccuuggaauauaugacaaucauguuaucuugauuuuuuccacaagauaauuugauucuaaaaucgauucauuguuuaucuucaggaauuagagauuuuaaaaaugucaucucaugucucauucagucauuuccaagauuuagcgaguguucucccuaaugccuuggauaagaaugccuuguucaauggcuguauuuuacucauaauuagcauuccaacugcuuuggguuuuuuuagauuuacaauuuuuauuucugcaguacuuaacuuucuauauuuuauguauauuaaaacaaguuagguaggaugaagaucacuggaugauauaaauacuaauagcaaaaguagaaauaaguuguauuauauaaguuguacauagguguuacauuagguugucuuacaugaaaguauuacaaaguaugggauuugggguguauuuugaaauccuugccaguucuacuugauaaaguauugaaugguaucaugugagaggagaagaggacggaaacaggacuuaugauuuagaccucaacaacugcuagggaggguugguuuucucugagugcaugauuuuuuauaaaaaugcuauuuugccaguuuuagauccauauuaaacccacagauuaagguuuugguuuuuaaaguguaaauaggaagcuugagcugggggggaauuuggagguagagauaauacuuaaucgcugugggaaaggaugagaucuagagauagaguguaugugggaguaggaacauaugugucugagaccaugcuuuggaugcucuagcauuuagauauugagaaaaugaggaagacccauuaaaggagauuguggcuagaguuacuggugaaaaccaaaggguuguaguguuccugaagauacaugaagagugagauuaaaaauuaauggggcagcaguggcuuuugcauggcauugaaaagacacaguucaauuugaaaauugaguaucauuaaucguagugcucuuauuauugaaaaggccaaaucaaacaauaccuuugaguugauggucuguacuauaauuagguuaccauuguuagcccagcauagacacaugcugauaccugugaguugcuuucaucaauuaguaugugaagaugcaucccaguuguacaauuuuagauccucuucaucauuccacauuauauguauacaagauaaaacuugauguuuucauuacauccuuucaaucuucuaacagcaguccuuacguagcuuuaucauuggaguuuccacuugcagugucucuaucuguaccugcauucauuggccacgguagaguuuucauuacggcaggauugcauuucauuguuuuggcuugugucagacauuuagcaaagauuguugaggaaaggaauggauggaaggggccagcugaaagaaaaaguaacaaccuaaugauggauaagugaaaaaggaaugaagaaaggauggugcuaggaaucgagggaguaaagcaagauagaauguacaaaaggucgaauuuuuaaagaaaguuguagggcaagggcaagguguguugaaccuacauuuaaaauacaauaacaucacuaaagucgaggccgggugugguggcucaccccuguaaucccagcacuuugggaggccaaggcaggcagauuaccugaggucagaaguuugagaccauccuggccaacaugguaaaaccccaucucuacuaaaaauacaaaaauuagcugggcgugguggcgggcgccuguaaucccaguuacuugggaggcugaggcaggagaaucacuugaaccugggaggcggaggcugcagugagccaagaucaugucacuguacuccagccugggcgacaagaaugaaacucugucucaaaaaaaaaaaaaacccaucacuaaaaucagggagaaaaaaaccaucacuaaagucagggauaaaguaccauuguggaagguguucuuuuccagcuuaaccugaagaauuguacagucauuguacauugucauucccuaacuaauggguuagauaugagucuguagaaaauuguuuguccaacauacuuuaugccucuuaacauuucacuuaccaaauuucauuucauuccuucauuuugugucuaacagacuagaaauaaugagcuccuauugacagggauauuuuccucuucauacuuuccuuuaccuuacagagccuuuuauguagcagauauuuaauuucauaaugggucuaaacuacuuguuuagaccauggaugagugaaauuuugaugaaugagccccaaucaccugaagggugaguaaaagaagaauuucuagagacccaauaugaaguagcugcuucacacuuuuuugagaauguuauggcaugacugaggaaaucauagaugcuguagaccauguugaguuggauuguguaaauauagauucugguauuagggaacucagcaucugcuggauuagacuucuuauggugaaagucuuuuuuuagggauuaggcauaaauccccacugauauuugugcaguaauagaguauagcuccuguuuucuuuccugcuuguauagccugugccauuaguguccucuuucucacuguuuucucaaaggaaaacagucaaagaggaagccauaugcaugguagacuuuguaauccgggaaaagucaacauauuucauaguagugcacuuuuuauguguugucaguccuuagaaaggauucauuuucuccauauuauauacuacucuauuuuaaaaauuucuugggggagaauggcuguagacaggccaaugauagaaucauagaauauagucacugucuaauuacuuucaaucaagagagggaacaauaaaguacaauguaugucgcugacuucagugugaccacucaguauuucuguaacacaguauuuauauugcuguacgguagaguuauacuuauuucugugauccaguucauuuguuuaauauugggauucaaggaguguugaagaaaugucuacugauuaauaacagaugggaagaguguauguguuuuaaauaagagaccaagagagacaauaaggaaaauaagaaggaaguguuugugaaccuuucacauuacucuuacauucgggaaguccacaagacaccguaguggagauucugaggaggugaaaaccuguagaaaaaugcuuuauuaguaaggagcugacuaaguugucagaaaguguugauuuuuagaaggauauugagacauuggguauauaggguauaugacuccuugucuuccuuucauucuggcuucuuaccagcuguugugaauaaguuuaagauuucuucugacguuauaaacuucagaaaagguauggcuguuuguucaguuugaaguaguaucauauccgccaaagccuuguucaauugucuuguugauucaugguucucuucagugauaauauuauaugggauuccuacccacagccacccaauaucucaguggagaaaugcagguuuggagagaacaucugaauagaaucacgcuaagaugguacauuugcacugagaccauuguuauguggcaggcagacaugaaguauccuaggauugaucaguaugccuuaauguaaauagcugcauauagaccugauuucuuaggcuccccacuucaagcucuugaauauuguguugauauccuuaucaauacacuuugucuuguguucuguguuguuuuuccaaaauauaacgagcuccuacuugacagggauuuuuucuuucuauugucuuacgauaaaaugucaagauaaaaauguaugaguuucauuaaaguuuauugaauaaaauuugugauggaaugagugacagcgaggucaugaaugagagagaauauggaaauaauggagaaugugauauucugauagucaugcaauauucuuuuugauauaauauguaacauauauuaguauguuauauucuauguauuauuugucauauauuauuacuauauccuguugcuauauuuggauaauuugggaaucugccauguuugaugauguugaaaagagaacauaaaauguagugauuucuuaauaagguguagagguguagguauuaacucuuuaagaauauagugauuuauuuuaaaauaaugauaggaaaggaccauaaaaaugucugaauuugggaaauuagaaaauguuuucucucuggggcuuucauaugucuguucuaugugaaugucgcuuugccauggcucccucuuugcuaacucuucuuaaccccugcagagaaggaaguguagugaugguauuuugaguccaucuucagguuuauugggaaugcaagggaaaugaguuguuaccaaugggaguaaagggcuaguugcuaugccaguagcugcuacuuuugacacugcuugagcaaucugaauggcuagguuugaaucuggcuucucagucagaauuuuaccuucacucuaaugcugcuuuuuuucaaaucaccuauauuuacauaaauaugaaccaacuucagugaucuuaauucuuucccgaagauccaaguuucuuuccaucugccugaagaacuuucuuuagcacuucugguauagcagaccuacugaugauaauuuuucuuuuaguauauggugauuaguuuacuuuuuauucaacugugucuuuuuuugaagucuucuucauugaaauauauuguuacuaaauauagaauuaauggcuuucuuuaagcacuucaaagauaauccacuguuuucuggacuccguugauacuuaagucuuuauuuuuguguaauucuuuuucuuuaaaugugccauuuuucauuuuucucugacuccuaccuacuaagauauuuuuaccuaaguauugagucaguuuugguuaugaugugacucaguguguuuuuauuuauauuguuugguuguuugaacuucuugaaucuguaaauguugugcuuuauguuaaauuuggggggauuucagccauuuaaaauauaacuuuucagucucuucccccugggacuccaauuuuuacauauguauuagaccuauuaauauuuuucuauggauaccugacauucuuuuuaaaucuuauuuuugguguuuuucacuuugaacaaccuaauaauuuguuuccauccauguucacucacuguuuauucuauuuuuucccaaucugcucuuaagccuauccugugaauuuucuuuuuaauuuauuuuauuuuuuaguuccagauauuuucugcuuuuuguuuguuuuugagacagaaucuuucucugucacacaggguggagugcagugucaugguucaccgcagccuugaccuccuggucucaagugauccucucaccuuaaccuacccacuccuaaguagcuagaacuacaggugcaugccaccacgcucagcuaauuuuuuauuuuuguagagauggggucguuguguugcccaagcuggucuugaacucccagacucaagcagucuuccugccucggccucaugcccgcgccaaccaguucuuuauuuuuaauauuauguuguauuugaugugcuauccuauucauuuaguauaagcacauuuuucuuuaugucuucagcauaauuauaugcuuuuucagaauuuuaacaucaggacugcuuccaggguagcuuuauugcccuuugucuuaaguauggauuauaguuuucauucuuuguaugucaaguaauuuuggauuguaacuugaacuuugaauauacuguagaaacucugaauucuauuuuauucuucuaaaacaauauuucucagcuucagcacuacugacauuuugaacugggucauuuuguuuguguuguuguguguauuuugggaggguacuguucuauaugcauugugggguacugaguauuauccuuugucuccacucacuacuuaccaguagcauaacucucucuccuccccacauccccugccaaaaaaugccuucaguccuuucuaagcgcucuuuuuuaugguguuggggccaaaaucaugcaucuuuacucacucuuucucauugagagcuauggcuauaaaggguagugauacuuuuacuuauuuauuuuuaaggcaagcaguuaacuuagcuggauucaaacuccaggcugccucgugugcugugggaagcagccuacgcucuauucaguucuuuucuuuucauauugguuggguuacuuugagucuggccuacaugaugggcaguuuagaggucaaccaaaggauuucagcagaacuuauacacagaauuucauucaggcuucccgugucugauuggcuacagugugggaauuuccucccacuuuucagccacuacugaggaugccuuucggcaaaauuccuugaaauuggaaacuuacagggaaauuccuuuccuccaagagugcgcucuccuccaguguuggcuugcuuuugguuguucuccgugguuuuagauagcugucuuuauauuaauucuggaguuuacaguugauaucuguugggggcuuaguuugauaacauguauucuucuauuacuaguagccagaccuguaugucuuacuugaccugauggagaaaaguuucaacuuaugagacaauacugugcuagcuaguuuuacugauuuguacucuaaaguacccaagccuaaaauaguagagcugucuaucccacaugaaacuucucugauuuucacuguuuuuuauaaaaaguauacauguucacauuucuguagguuuuuuuaagcaucacaauuuuuauaaacuuucuauauuuccaaggucuaccugcuuuguauuuugccuagugagaguuuuguauucauguaggaauaaucucuuggugugaguaucuauuuuccacucauccaaaacagauagagcauugauuucacuaagcguuauguucuaguuugcuuugguauuauuauuagaaauaccuggugauuaauuugagcuaaguauucuucucuacccucauucccagcauuaucacccgcuuuuaccacuuccaagggguggaagcauucuccacaaugcauuuuuucaugccagagaaaaaucuagaaaaaaaugaauaaaacgaagaaauucuuuccccuugguaucuguagcuaacuugccuaaguguucuuucccacaguuuaagucuucaguccauaguucauaagcaaagggguguagcgagcucugaucuugccagaagagagaauaagugagcuaccccacgguggacauucuggccaucugaaaugagucgaugcauguggcuuuugucuaaaggcuacaaauaaaauguaaccacuuucuucuuugaguaguugauauagcaaauaguugaaacagaaguuuugauuggcaaaucaggaugugguagauacuuuaacaaagaguagaacuauuaccaguuuuauguguugcuguuuguaucucuuucacaguuuugauaauaucacauccuggaaagugaaacagaaaauuauuauuccauuuuaaaugacuaaauuugcuuucaugguauuuacagugaaagaguaaauuagaaagugaauggaugacuguucaugagaaaaagcaggguaaaaagauuuuauuuaauuaauugaaaauauuagggucaaaacauaggcuuauguuauguuuugugaauugugcuguguuguagacauuugaugaguccuaacauagaauugaucuagcucuugaaauaccauuuuugauugaguauaaaugggauauaggcaccuuacaacuucagaauucgaggaagaugaugugaaucuuccaauuuuaucuauuugauucaaaugguauguuuuuucacauuucucauaauuuccacgucaacucccaugaugaucaugcaggaaagcagcaugauugcacuucuuguagugcauaccaucacuaaaacauaguuacugucuuucuguggucuuaagaaaaauucagaaacagcauaccaauguacauauaagauaaauaagcuuaugugguacaguaaguguucuguucugagaaauaccuugauucguauccuaaugucugauguuauugguaguucucaaacuuccccaauucugcuuucaucuaaauucaucuuaucuaucuauuguuaaauaaucuaucaguccauuuuuaucuaucaucuauauaucugucuuuaucaaucauucgucuguaaucuaucugugccguuuggcauaagagacagaagggcauagcaguggaaacucaaaggaguuaccuccaugugaauggacaguggugauggugaucugugagguggugauguauagaaagaaaaacuagaagagagcaugcccuaacucagggaccuuguccagcaggcacucuggccuuguuauacugugcuugaauaugaaaaaaaaaaaaaucaaaauagugcugacauucuuugucuucugggucugagaaaacuuagaguagauaugaugacucugccauuucagucuuuuguauuuccacauuuagagcucaguuuuaauuauguagaauuauuucuccagccuguguuaaacuagaccauggauuggcaaacuuuuuuuguaaauugccaaauacacauuuucaguucugaaagccuuguggucuuuguugcagcuaaucuacucugcuguuguguuaugaaagcagccauagguaauuuauaauugaaugagugcgcugugccuuucuuccaauaaaacuuuacaaaagcauccugugggcuggaguuuacccuuugggaaaccagagcauuggcuaaacuggaaccugaaaaaauaaucacaucaacucagccacaugguaauaauauuuagaguauuauuucaacauuuucauuuucauaaaaauuuuuuuagcucuuuugccaaauuccaucugugagugauacaaaugacuaccacgugccauuaacaucaccuaaacagugcaaaacaagcauaguagaaguaauuggaaugauauaaaccccuugcuguaauaguuauaguugauaaauuauguuucaaaauugaaccuauuucuuccaaauuucaucuauaaaguuccaaggaguuccaaaaucuugccugccuucuuuucccaguuagcaguauugucucugagcagccauggugguauccauccuccuuggacaaugaauuuagccuauuuugacuucauuugagcaguuguaauuguuucaccacaucagaguaagauuacuacaugccagagcuauucuuuaacucagcuuguaaaaacaugauagcaucaacaauauacauagcaaaugaaugccaucuuuaauccaauuaaaugguuuuuacaaauuugcucuuguuuguugaugcuaucugcauugcaguaauuaaaggugagguaaaaagaaugaauaaacugccaaguuaaaauuaaauuugggcaauuucucuuuugcaguaauguauguauauuuacucaaaacauaugccaaauuuaguguugaaaggcucauucaaaucaauugggaaagcacguaaaugaacaauucauaaaagaaaagcauugcaaauggccaagagcauagaaaaugugcucaaucuuaccagucauuauaaggaaauaaugaaauuuguguauauaugaaauacuuaaaauauauauaaaauaaaacaauuauuugccuuuuuucaccuaucagauuaacagauuauauguguuaacaagguggggagaauuuacaacuccugauauguuaaaaucuuucaggaagguaguagaaaauauauguaagauggaaauuagcacuuuugaccaacaauuuuaguuuuagauauuuaccuauaaggauauaauaggagguguucaaagaugcauguaacucaauguaguauuaauuauaauuguaaaauaguaaauaacauuuuugucaaaucauaauguuaggaaaauuagugauggcacauuuaaccaauugaauuauauucaguucugaauaccgugaugcauguucaaauuaauugauacaaaaauccaacaacuuuagcaguuuguuuaccaguuauugaguaccaacuguguucaacauuguuauuucacucauaugaaaugauaaauguaugugcguguuaugauacggucaauaaaaccacuuuuauaggaagaauacucacaaaauacagcgaguucuggucauuauuuuauuguugcauuuguguguuuguguguuuugaauacauacaugu

SEQ ID NO: 838 - RNA, 97 nt, Homo Sapiens
uggaucgaugaugaguccccaaaaaaaacauuccuuggaaaagcugaacaaaaugagugaaaacucauaccgucauucucaucggaacugaggucca

SEQ ID NO: 839 - RNA, 98 nt, Homo Sapiens
uggaucgaugaugaguccuccaaaaaaaacauuccuuggaaaagcugaacaaaaugagugaaaacucauaccgucauucucaucggaacugaggucca

SEQ ID NO: 840 - RNA, 94 nt, Homo Sapiens
uggaucaaugaugacuuccauacguggguuccuuggaaaguugaacaaaaugagugaaaacuuuauacugucauccucuucaaacugaggucca

SEQ ID NO: 841 - RNA, 98 nt, Homo Sapiens
uggaucgaugaugacuauaaaaaaaauggaucucaucggaaucugaacaaaaugagugaccaaaucauuucugugccacuucugugagcugaggucca

SEQ ID NO: 842 - RNA, 82 nt, Homo Sapiens
gggucgaugaugagaagcuucuguuuucuugaagagaggugaugacuuaaaaaucaugcucaauaggauuaugcugaggccc

SEQ ID NO: 843 - RNA, 318 nt, Homo Sapiens
cugaggcauccaugcgaguggacugcguauccaccaauacuggguguucuaagagauggagucuugcuauguugcccaggcugguuucaaacuccuggcgucaagcaguccucccgcauuggccuccaaaagcgcugggauuacaggcaugagacacugcuccuggacugugcaauuuuaaagacuugagcaaauaaccccuuaaaaugugaguuuuaggaugguggguagggcuucaauuugaaaacuguuaccagggaaugugauuauaacaugcacaguucccacuaagugugaaaauauagcugagaagcauga

SEQ ID NO: 844 - RNA, 10870 nt, Homo Sapiens
agccgcugcgcccgagcuggccugcgaguucagggcuccugucgcucuccaggagcaaccucuacuccggacgcacaggcauuccccgcgccccuccagcccucgccgcccucgccaccgcucccggccgccgcgcuccgguacacacagcaaacgcggggucaaagagggauggucccggcccuguccccaugcccagccccguuucugcgcaccgucccucccugccuagcugaucucugacccucggcucuugugcuuccugcuacaggaucccugcugggcaccaacagcuccaccauggggcuggccuggggacuaggcguccuguuccugaugcauguguguggcaccaaccgcauuccagagucuggcggagacaacagcguguuugacaucuuugaacucaccggggccgcccgcaaggggucugggcgccgacuggugaagggccccgacccuuccagcccagcuuuccgcaucgaggaugccaaccugauccccccugugccugaugacaaguuccaagaccugguggaugcugugcgggcagaaaaggguuuccuccuucuggcaucccugaggcagaugaagaagacccggggcacgcugcuggcccuggagcggaaagaccacucuggccaggucuucagcgugguguccaauggcaaggcgggcacccuggaccucagccugaccguccaaggaaagcagcacguggugucuguggaagaagcucuccuggcaaccggccaguggaagagcaucacccuguuugugcaggaagacagggcccagcuguacaucgacugugaaaagauggagaaugcugaguuggacguccccauccaaagcgucuucaccagagaccuggccagcaucgccagacuccgcaucgcaaaggggggcgucaaugacaauuuccagggggugcugcagaaugugagguuugucuuuggaaccacaccagaagacauccucaggaacaaaggcugcuccagcucuaccaguguccuccucacccuugacaacaacguggugaaugguuccagcccugccauccgcacuaacuacauuggccacaagacaaaggacuugcaagccaucugcggcaucuccugugaugagcuguccagcaugguccuggaacucaggggccugcgcaccauugugaccacgcugcaggacagcauccgcaaagugacugaagagaacaaagaguuggccaaugagcugaggcggccuccccuaugcuaucacaacggaguucaguacagaaauaacgaggaauggacuguugauagcugcacugagugucacugucagaacucaguuaccaucugcaaaaagguguccugccccaucaugcccugcuccaaugccacaguuccugauggagaaugcuguccucgcuguuggccacaacacuggaaccccacccccaucuccaucaugcuuccauucaguuucuugcugcagcagcugguuaacugacagcuuaucugcuguacagagccaaaacuccauuaugaguacaucguaauuacccaucuggauugcaguaauggcagugaagaucuugguauagcucauuaauucugauuuuuugcuuugaggaaaagagaugaagacguggcagcaacagcucuaaguugacugcuuuuagaauuugaccuuaguggcacagaguuaagaaaaaucugcucaccagagauauugacaggcuuacuguguaagcauuggccugaucgggccuggaaguuuugccccuuucaucuguagggauaagagggccuaagagaauagcagcaaucugagcucuagagcaccaaaagaaauaaggcacgauaucguuccauggcacguuaucccuggcuuuuguuaccaguaaaaugaaugacuuugcugagacaauacuuaguguagcagguacaaguuauaaaagugauucauuacaacuaagauaaggaagaaaacaggaaaacagcacuugcccuucacacacacagaaacacacaugcacacacacacaaacacacccuugucacagcucagaauaaccaauuccauccagggaucauauuagcgauauuggcacuguaauggucguuuuuacauuuauuuucuguuccgcauucacuuaacaugugcguuaaaaggaacaaagcuagcuggagguagcaaaguuuugaacuugaaucagggauugcuaagaaaacuuacaacuaaugaccacagaaaguaaguucuuugucuucugucugauacagcuagaugugauuguagccguggugccugggcagaugguaaacaaacaugcuguccucuuaugacaauaugugcagagaaggccccaaacgcuggggugagaggaacaacaaacugacuaacucacggccgaguuggagccagaaccaacaacagcucggcugccuucacacucaucugucaaacacaugguguauggcuccccugacagaaaugacuccuauaagcuuccucauacucgcgcauucuuggaagucugagacuggaaaugccuacccagauauguuaagucaguaaaggaaaacucauuugcaaugcugagaggagaaagaaaaucaaugaauaggagagcauacacugugggaaggcucagcuguacugagccaggcaaagcauccgauuaccccacugcuguacacaucaugaccugggauaaaccccugggccguuggccuaagaaauauguugcuuuucauccuguauaacugcaacuuugugccggcucauauuauguucuagagagcucauguacaccauggugaccauaguuaauaauacuggauuguaugcuuaaaauuugcuaagagaguagaucuuaagucaucaccaaaaaaaguaacuguaagaugauggagauguguuaauuagcuugacggugguaaucacaauauauguguauaucaaaacaucacauuauacaccuuaaauguauauaauauuugucaauuauaccucaguaaagccaaaaagaaauaaauauauugcuuuucacccucuggcaaguggagggcccugaacagagcccucuaaagaacagcuuguccuaaucaucacguaccugaugaaccucuguuuccccugcagccagcgacucugcggacgauggcuggucuccaugguccgaguggaccuccuguucuacgagcuguggcaauggaauucagcagcgcggccgcuccugcgauagccucaacaaccgaugugagggcuccucgguccagacacggaccugccacauucaggagugugacaagagauuuaaacaggaugguggcuggagccacugguccccguggucaucuuguucugugacauguggugauggugugaucacaaggauccggcucugcaacucucccagcccccagaugaacgggaaacccugugaaggcgaagcgcgggagaccaaagccugcaagaaagacgccugccccaguaagugugagguccgcugcaagggugagcaugggcagcagcucugcccagcugguugccuggcaucugcagccugcaguucagugggucauagagcaggaagguuaccuacuagagaaacaaacagaagcaaaguccugcaggcucagcaacuucuuuuaaugaaaaacaaacucacccucuuccccagcauucuuuccaugugucagagaagcagagguuucuugaacgggcuuaggagagucuaugacaagucaauggaggcugggguccuuggucaccaugggacaucuguucugucaccuguggaggagggguacagaaacguagucgucucugcaacaaccccacaccccaguuuggaggcaaggacugcguuggugauguaacagaaaaccagaucugcaacaagcaggacuguccaauuggugagccacgcagcccaggaugaaacgacccaggagcuuugcucuuuuacugaaugcugcagucagcauucgaggagauuccagcuuaucgguucccuauacccuauaauaucuuacacuguguuaagugcccagcauggcaguauggcagcuuagaccaaccauuuacugugacugucucucucuccuugucucagauggaugccuguccaaucccugcuuugccggcgugaaguguacuagcuacccugauggcagcuggaaauguggugcuugucccccugguuacaguggaaauggcauccagugcacagauguugaugagugcaaagaagugccugaugccugcuucaaccacaauggagagcaccggugugagaacacggaccccggcuacaacugccugcccugccccccacgcuucaccggcucacagcccuucggccagggugucgaacaugccacggccaacaaacaggugugcaagccccguaaccccugcacggaugggacccacgacugcaacaagaacgccaagugcaacuaccugggccacuauagcgaccccauguaccgcugcgagugcaagccuggcuacgcuggcaauggcaucaucugcggggaggacacagaccuggauggcuggcccaaugagaaccuggugugcguggccaaugcgacuuaccacugcaaaaaggauaauugccccaaccuucccaacucagggcaggaagacuaugacaaggauggaauuggugaugccugugaugaugacgaugacaaugauaaaauuccagaugacaggauugacuuugggcacacuaugaacugagaugaugggauuauauucuacaucucacuaacuucuaacccacagggauccauuuuuuuaacuauguccuuuuaacuuuuguagugaucguuuuacacugagugaucaauuagccuauccacuagguagaaaguauugcugauuuucacaguuuuagacauauuaugcacaugguuugaggcuugagcuguuuucaaggacaacauuguuaagugcuccauuucuucucuuugcaggacaacuguccauuccauuacaacccagcucaguaugacuaugacagagaugaugugggagaccgcugugacaacugucccuacaaccacaacccagaucaggcagacacagacaacaauggggaaggagacgccugugcugcagacauugauggagacgguauccucaaugaacgggacaacugccaguacgucuacaauguggaccagagagacacugauauggaugggguuggagaucagugugacaauugccccuuggaacacaauccggaucagcuggacucugacucagaccgcauuggagauaccugugacaacaaucaggauauugaugaagauggccaccagaacaaucuggacaacugucccuaugugcccaaugccaaccaggcugaccaugacaaagauggcaagggagaugccugugaccacgaugaugacaacgauggcauuccugaugacaaggacaacugcagacucgugcccaaucccgaccagaaggacucugacggcgauggucgaggugaugccugcaaagaugauuuugaccaugacagugugccagacaucgaugacaucuguccugagaauguugacaucagugagaccgauuuccgccgauuccagaugauuccucuggaccccaaagggacaucccaaaaugacccuaacuggguuguacgccaucaggguaaagaacucguccagacugucaacugugauccuggacucgcuguagguuaugaugaguuuaaugcuguggacuucaguggcaccuucuucaucaacaccgaaagggacgaugacuaugcuggauuugucuuuggcuaccaguccagcagccgcuuuuauguugugauguggaagcaagucacccaguccuacugggacaccaaccccacgagggcucagggauacucgggccuuucugugaaaguuguaaacuccaccacagggccuggcgagcaccugcggaacgcccuguggcacacaggaaacaccccuggccagguaagaagcaaagcccuggaacagagagagagcuuaugggugccugacuagcacuggggaugcugugcuuugaccaagacucugaccagggagucuuagaaaguucccagcaucaccagcugcagcauugaacucugcuuuguaaaaacauaauaguguugaaaagggagcuugaccaagaauugcccugcaaauccuaaggugccuucagccuuuucaaacaaaaaaaccuccuucccuccucucugucugcuuuauaugugugcucaguggcacacaacaaauaugagaggacuuggaaaaauuccccauugcagcccucuaacuuagaucagcucaguaccuuucaagcauuguuucugauggaaugaaauagaaaucuuuaccugaaggagcuguguuucaaccuuuccuuuuccuuuuccuucaggugcgcacccuguggcaugacccucgucacauaggcuggaaagauuucaccgccuacagauggcgucucagccacaggccaaagacggguuucauuagguacgaucauacugauucacuuucacuuacagucacacugagggacaaaaagacaaaaaguauuaaauagcauugucacuaaacaagauuuuuuuucccugcagaguggugauguaugaagggaagaaaaucauggcugacucaggacccaucuaugauaaaaccuaugcuggugguagacuaggguuguuugucuucucucaagaaaugguguucuucucugaccugaaauacgaauguagagaucccuaaucaucaaauuguugauugaaagacugaucauaaaccaaugcugguauugcaccuucuggaacuaugggcuugagaaaacccccaggaucacuucuccuuggcuuccuucuuuucugugcuugcaucaguguggacuccuagaacgugcgaccugccucaagaaaaugcaguuuucaaaaacagacucagcauucagccuccaaugaauaagacaucuuccaagcauauaaacaauugcuuugguuuccuuuugaaaaagcaucuacuugcuucaguugggaaggugcccauuccacucugccuuugucacagagcagggugcuauugugaggccaucucugagcaguggacucaaaagcauuuucaggcaugucagagaagggaggacucacuagaauuagcaaacaaaaccacccugacauccuccuucaggaacacggggagcagaggccaaagcacuaaggggagggcgcauacccgagacgauuguaugaagaaaauauggaggaacuguuacauguucgguacuaagucauuuucaggggauugaaagacuauugcuggauuucaugaugcugacuggcguuagcugauuaacccauguaaauaggcacuuaaauagaagcaggaaagggagacaaagacuggcuucuggacuuccucccugauccccacccuuacucaucaccugcaguggccagaauuagggaaucagaaucaaaccaguguaaggcagugcuggcugccauugccuggucacauugaaauugguggcuucauucuagauguagcuugugcagauguagcaggaaaauaggaaaaccuaccaucucagugagcaccagcugccucccaaaggaggggcagccgugcuuauauuuuuaugguuacaauggcacaaaauuauuaucaaccuaacuaaaacauuccuuuucucuuuuuuccugaauuaucauggaguuuucuaauucucucuuuuggaauguagauuuuuuuuaaaugcuuuacgauguaaaauauuuauuuuuuacuuauucuggaagaucuggcugaaggauuauucauggaacaggaagaagcguaaagacuauccaugucaucuuuguugagagucuucgugacuguaagauuguaaauacagauuauuuauuaacucuguucugccuggaaauuuaggcuucauacggaaaguguuugagagcaaguaguugacauuuaucagcaaaucucuugcaagaacagcacaaggaaaaucagucuaauaagcugcucugccccuugugcucagaguggauguuaugggauucuuuuuuucucuguuuuaucuuuucaaguggaauuaguugguuauccauuugcaaauguuuuaaauugcaaagaaagccaugaggucuucaauacuguuuuaccccaucccuugugcauauuuccagggagaaggaaagcauauacacuuuuuucuuucauuuuuccaaaagagaaaaaaaugacaaaaggugaaacuuacauacaaauauuaccucauuuguugugugacugaguaaagaauuuuuggaucaagcggaaagaguuuaagugucuaacaaacuuaaagcuacuguaguaccuaaaaagucaguguuguacauagcauaaaaacucugcagagaaguauucccaauaaggaaauagcauugaaauguuaaauacaauuucugaaaguuauguuuuuuuucuaucaucugguauaccauugcuuuauuuuuauaaauuauuuucucauugccauuggaauagauaucucagauuguguagauaugcuauuuaaauaauuuaucaggaaauacugccuguagaguuaguauuucuauuuuuauauaauguuugcacacugaauugaagaauuguugguuuuuucuuuuuuuuguuuuguuuuuuuuuuuuuuuuuuuuugcuuuugaccucccauuuuuacuauuugccaauaccuuuuucuaggaaugugcuuuuuuuuguacacauuuuuauccauuuuacauucuaaagcaguguaaguuguauauuacuguuucuuauguacaaggaacaacaauaaaucauauggaaauuuauauuuauacuuacuguauccaugcuuauuuguucucuacuggcuuuaugucaugaaguauaugcguaaauaccauucauaaaucaauauagcauauacaaaaauaaauuacaguaagucauagcaacauucacaguuuguaugugauugagaaagacugaguugcucaggccuaggcuuagaauuugcugcguuuguggaauaaaagaacaaaaugauacauuagccugccauaucaaaaacauauaaaagagaaauuaucccuaagucaagggcccccauaagaauaaaauuucuuauuaaggucauuagaugucauugaauccuuuucaaagugcaguaugaaaacaaagggaaaaacacugaagcacacgcaacucucacagcgacauuuucugacccacgaaugaugccuugggugggcaacacgauugcauguuguggagacacuucggaaguaaauguggaugagggaggagcuguccuugcaauguugagccaagcauuacagauaccuccucuugaagaaggaauaauaaguuuaaucaaaaaagaagacuaaaaaauguaaaauuuggaaggaauccauaaaugcgugugugucuaaauacaaauuaucaugugaagaaaaggcccaaguguaccaauaagcagaccuugauuuuuggaugggcuaauuaugaauguggaauacugaccaguuaauuuccaguuuuaaugaaaacagaucaaagaagaaauuuuaugaguagguuaaaggucuggcuuugaggucuauuaaacacuagaaaggacuggcugggugagauaaaaucuuccuuguugauuuucacucucauucuauaaauacucaucuuucugaguagccaugaucacauacaaauguaaauugccaaaucauuuuauaguaccaaggugaagaagcaggaacuagaaaguguugauaauagcuguggaguuaggaaaacugaugugaaggaaauaauucuuugaaauggcaaagaauuaaauaccaucauucauuaucagaagaguucaacguuugaagugcugggagauaauucuaauucauucuuggauagugaagcaaaacugauugaaaauaccaagauaagacagaaaaagugacuggaaagaggagcuuuucuuccaggcauguuccaguuucacccuaagacugaccuucaaauaaucagguuguacugaaauaaaggacuuguuaaaaauuaaaauuaugucaucgagaugauagcuuuuuuccuccuccaacaguuuauugucauguguugugggagagcucgagugaagagcaauaaacuccaggucuuauaagaauguacauacaauaaagguggugccagcaguuuuuuuuuuucuaaagagucacauguagaaaagccuccaguauuaagcuccugaauucauuccuuaaauaaauuggcucucucucucuucuauaauuucuuuuucuuuuuauuuuugagaugaagucuugcucugucgcccaggcuggagugcagugacacaaucucggcucacugcaaccucugccuccccgguucaagcaauucucccuccugccucagccucccaaguagcugggacuacaagcgcccgccaccaagccuggcuaauucuguauuuuuaguaaagacgggguuucaccuuguuccggacaaacacuaagcccuaaagggaaauccaaaauaaaaacaucuauuuuuaauaacacuuucuaucuaaaucagggugacuuuuuaaaaaaaauccggaagcuuuuuguugaauuacguuacagacuuaguuaccaguccuuguuagaguuaccuucaguugacaugcugugaauggucccaccucuuuuauggcagaauucauuacuuaaaauaacucuauuuucuucccccuuaccuaaauaacagaaaggcucacuaugucccaaauaucauuggcagaagcaaacuauaaagucauaagcccuuugcagugcaagucuagaaauaauuuu

SEQ ID NO: 845 - RNA, 4240 nt, Homo Sapiens
gccggguuuggggguugggaccuccggcugcagguccgccugggccagacgcgcgagcgcaagcagcggguuaguggucgcgcgcccgaccuccgcagucccagccgagccgcgacccuuccggccguccccaccccaccucgccgccaugcgccuccgccgccuagcgcuguucccggguguggcgcugcuucuugccgcggcccgccucgccgcugccuccgacgugcuagaacucacggacgacaacuucgagagucgcaucuccgacacgggcucugcgggccucaugcucgucgaguucuucgcccccuguuccauuccugcuggauuugaagaggagagucuccuccagccucauugaaacucuuuuuguggauuugaugaccuuauggauauugccaaaguuuaaggcaguggauuuuagucccagccuugcagcuuacacacacaccugguugcuccccagauuucuggagauucucauucaguuacagaacucaccuucucaacgugaucccucugcaacccuuuggcuuuugaaaaggugauguacagcuggugcuagcuguauauacacugauuaggauuuucugggcagaggagccggugcuucugguggcccucugggaaagguguggacacugcaagagacuugcaccugaguaugaagcugcagcuaccagauuaaaaggaauagucccauuagcaaagguugauugcacugccaacacuaacaccuguaauaaauauggagucaguggauauccaacccugaagauauuuagagauggugaagaagcaggugcuuaugauggaccuaggacugcugauggaauugucagccacuugaagaagcaggcaggaccagcuucagugccucucaggacugaggaagaauuuaagaaauucauuagugauaaagaugccucuauaguagguuuuuucgaugauucauucagugaggcucacuccgaguuccuaaaagcagccagcaacuugagggauaacuaccgauuugcacauacgaauguugagucucuggugaacgaguaugaugauaauggagaggguaucaucuuauuucguccuucacaucucacuaacaaguuugaggacaagacuguggcauauacagagcaaaaaaugaccaguggcaaaauuaaaaaguuuauccaggaaaacauuuuugguaucugcccucacaugacagaagacaauaaagauuugauacagggcaaggacuuacuuauugcuuacuaugauguggacuaugaaaagaacgcuaaagguuccaacuacuggagaaacaggguaaugaugguggcaaagaaauuccuggaugcugggcacaaacucaacuuugcuguagcuagccgcaaaaccuuuagccaugaacuuucugauuuuggcuuggagagcacugcuggagagauuccuguuguugcuaucagaacugcuaaaggagagaaguuugucaugcaggaggaguucucgcgugaugggaaggcucuggagagguuccugcaggauuacuuugauggcaaucugaagagauaccugaagucugaaccuaucccagagagcaaugaugggccugugaagguagugguagcagagaauuuugaugaaauagugaauaaugaaaauaaagaugugcugauugaauuuuaugccccuugguguggucacuguaagaaccuggagcccaaguauaaagaacuuggcgagaagcucagcaaagacccaaauaucgucauagccaagauggaugccacagccaaugaugugccuucuccauaugaagucagaggguaaguggcuuaaaacuuaacaaaagugucuaggcaauagauaggaauaaagcuuguaaccaccaggaaaucauuacuagacauaguuuucauauucaguugaaggcagaaccacugauuccuucuuggcuuaagaguucugcaguaugggcccacauaacugcuugaaauuaauaaauguuucuuuccccaguuuuccuaccauauacuucucuccagccaacaagaagcuaaauccaaagaaauaugaagguggccgugaauuaagugauuuuauuagcuaucuacaaagagaagcuacaaaccccccuguaauucaagaagaaaaacccaagaagaagaagaaggcacaggaggaucucuaaagcaguagccaaacaccacuuuguaaaaggacucuuccaucagagaugggaaaaccauuggggaggacuaggacccauaugggaauuauuaccucucagggccgagaggacagaauggauauaaucugaauccuguuaaauuuucucuaaacuguuucuuagcugcacuguuuauggaaauaccaggaccaguuuauguuugugguuuugggaaaaauuauuuguguugggggaaauguugugggggugggguugaguuggggguauuuucuaauuuuuuuuguacauuuggaacagugacaauaaaugagaccccuuuaaacugucuuauuuuccaccagauugagaaccagauguucucuacacacuaucacuguucaauagagcuuucuucagugauggaaaugcucuguaaucuacacuguucaguacagguagcuacggagcaucugaaauauggcuagaaacuacauuuuuguuuugauuaauuuaaauagccauacaguugcuaccauacuggucacggcagcuguagacugacuggguccauaguucaucaccucaaaauucuuucaaaauuuauuaucucuuucucuccuuacauguuuauuucccaggccuacccuggugauuagaacagcugaagggccuuucuuguuaggcuguccaugcccuaaggauggguuccuguuuauccuugccacgcagcugagcuuacugcauguuuauaucucccaaggacuguucucugcucagaaaugcccugucaaggguguggcaucacgcaguuucauccaaguuguuucaggaauugcugacacugcugggugcaguucuauccccuaaagccuaggguguggcccuuuaacuuccccuucaguagaacugggaaaggcaguaccauuccuaguuaugagugaagcauccacuuucuuuuguaacaaugaggaacagaaaggauaagacugaagagugaucuuuuguccaacuaaaccauuuaucuccuuuuguagguaaauucaaauccugcccaguuauaguuuucagucacuggagaauuccagguaggagcccuacuuuaggugauccuaggaacuccuauguucagaaaagaauuuucuuccuacuauauaauuacaguauuuagcugucaauuuuaagaugaauuugguagagccuuauaguaaaguauguaucuuggucacacacaaagcuuggaaaaaguaaaagaugucuaaaccauaaucuuguaacucauaacaucugggcuggggcccggggaucuaauuguuuagagagccccaaaaguggcucagauguaaagccaggguuaagaaccaucugccuuggaagauuuaagggaaacauauaaacuuguacaaaggacacagaagcagucaguuuuaauuuuuuagccauguugguaaaaguucauuuucaguacauggguaacacccaggcccuuucccauuauauccagguaugcuacaaguucuuuuaacucuuaucagaaguuauuauuacuguuuccuuagagaggcuaccaggcuaaaauucacuuaguuugguuugucuaauguccucauuauuuuauccugaagaugaugucauuucucaggacuugaaaaugacuuggcugaacuaaagguaaaaaagccaagccucugucacuuuuccuagacuccuaggcacagcuauggagucuuugcacagugcccauacccuaaaaauuaauaaugaaaaccaaaccucaagaaccuagagcagcucucuacuugccaccauggacuccaguggucagcauaagaaaagcagauaguugcauucuauuuaguuuauagcugcuuuguuccuuuguguuucacuaagcagaggcucaaaaauucccuugauaacuucagcugccccuguucuuuuccucaaacuccaggaugagaccuuuaaugugggacaauuucuggugaagguacucacagcgacgcuuuucuucucuguaacuuggguacugcugcagagaaaaagcauccaugucaaaaaguaaaaauucucauucuaccuugc

SEQ ID NO: 846 - RNA, 4814 nt, Homo Sapiens
augaucccaaagagccugguccaggcagcggaaacccagaggggucucugcgagccaggagggaaaggaagagaggggagaaguggaggaaaaggggagacacgccccagaggaguuggaacgcaggagggaaaggggaccauacccgguagcccgagggaaaaacgaggcgagaggggagaaggcgaccccgcgcugcuacccgcggaagauuuauggcgccucccggguuccaaggacaggcugcguucgucgcugcugccaccgccggcgccgucacccggagagcccggcggaucccggacucccgcccgccgcuccucccgccgcgcaccuccgcucaccgcucgcccggcuccagccgccgccgcacuggacccccuucuucugacuccgggcccggaccccccuccucucacucagggaaaaccgcgcagggacccaggacccucaacugggccagaaagcaaagugcaaggaccagcagcaacuugugugccuggagccuugcaauggcuacgaagauggcugagauuccuucuagcccauaugagccgggacagcgaggcaugaaggauacucagagaggugaugccccucaaagaggaagcccagagccccgaauccugcaguuggcccgagugggaaacguauaucugaaggaggaaagcucaaggagugggcgacuggaagcuaagaaguggaucccaacaaaguuccuugagaaccucucugucccacacguugaccucgguggaaaccagcuuuggggcuucaggacccgggccggcagcaccggcugcgaggguugccgaaggcgcacggaucugggcgcugaaaaagccaggauuuggcaauggcuuugcuguguggccuugggcaagucacucugcguaucuggguuucacuuccuucccaauccgaaaacgggauuggguuccuugcagcccgggcauuccugaggagcggcggcauggaggcucucaccacucagcuggggccggggcgcgagggcaguuccucgcccaacuccaagcaggagcugcagccguacucgggcuccagcgcucucaaacccaaccaggugggcgagacgucgcuguacggggugcccauugugucgcuggucaucgacggccaggagcgccuaugccuggcgcagaucuccaacacccuccucaagaacuacagcuauaaugagauccacaaccgccgcguggcccugggcaucacgugcgugcagugcacgccgguacagcuggagauucugcgucgggccggggccaugcccaucucgucgcgccgcugcggcaugaucacuaagcgagaggccgaacgccugugcaagucguuccugggcgagcacaaaccacccaagcugcccgagaacuucgccuucgauguggugcacgagugcgcguggggcucgcgugguagcuucaucccugcgcguuacaacagcucucgugccaagugcaucaagugcggcuacugcagcauguacuucucgcccaacaaguucaucuuccacucgcaccgaacacccgacgccaaguacacgcagcccgaugccgccaacuucaacuccuggcgucgucaccucaaacucagugacaagucggccacagacgaacugagccaugcuugggaggacgucaaggccauguuuaauggcggcacgcgcaagcggaccuucucccuacaaggaggcggcggaggcggugccaauggcgggucgggugggcaggggaaggguggugcuggcggcgguggcggcgguggcccagggugcggugcagagauggccccaggcccgccgccccacaaaagccugcgcuguggcgaagaugaggcugccgggccuccggggccaccuccaccccacccgcagcgcggacuuggccuggcgacuggagcuaguggcccggcgggcccaggagggcccgguggcggcgccggcguacgaagcuacccggugaucccggugcccagcaaaggcuuugggcuccugcaaaagcugcccccaccacuuuucccccauccuuacggcuucccuacggccuucggccuaugccccaaaaaggacgacccgguuuuaggcgcgggcgagccaaagggcgguccuggcacugggagcggcggcggcggcgcggggacaggcgggggugcggggggcccgggagccagccacuugcccccgggggcaggggcgggcccgggcggcggcgccauguucugggggcaucaacccuccggggcagccaaggacgcagcggcaguggcugcagcggccgccgccgccacuguguacccgacguuucccauguucuggccagcagcaggcagccucccgguaccguccuaccccgcugcucagagccaagccaaggccguggcggcagccguggcggcggcagcggcggcggcagcggcagcugcuggcagcggugccccagagccccuggacggugccgagccagccaaagagaguggccucggcgcggaggagcgcugcccgagcgcucugucccgcgggccccuggacgaagacggcacggacgaggcgcugccaccgccccuggccccguugcccccgccgcccccgccgcccgcacgcaaaggcuccuacgugucggccuuccggccgguggucaaggacaccgagagcaucgcuaagcucuacgggagcgcccgggaggcguacggcgcggggccugcucgggggccgggacccggcgcugggagcggcggcuacgugagcccggacuuucugagcgagggcagcuccagcuacaauuccgccucgcccgacguggacaccgcggacgagcccgagguggacguggaauccaaccgcuuccccgacgacgaggacgcccaagaggagaccgagcccagcgcacccagcgcagggggcggcccagacggugaacagcccacuggacccccuuccgccaccuccucuggcgcggacggucccgcaaacucucccgacggcggcagcccccgcccccggcgccgccucgggccacccccagcuggccggcccgcauuuggggacuuggcagccgaagacuuggugcggagaccugagaggagcccgccaagcggcggcggcggcuacgagcugcgagagccuugcgggccccuaggaggccccgcgccggccaagguguucgcgcccgagagggaugagcacgugaagagcgcggcgguggcgcuggggcccgcggccuccuacgucugcacccccgaggcccacgagccagauaaggaagacaaucacucgcccgccgaugauuuggaaacgaggaaauccuauccagaccaaaggaguaucucccagccaaguccugcaaauacagacagaggcgaagaugggcuuaccuuggaugucacaggaacucauuugguggagaaagauaucgagaaccuggccagagaggaauugcaaaaacugcuccuggaacaaauggagcuccgcaagaagcuggaacgggaauuucagagucucaaagauaauuuucaggaucaaaugaagagggaauuggcuuaucgagaagaaauggugcaacagcugcaaauugucagagcucucgucuggcaggagccgcaauguuggcucagucauuuggauuuaaauugaaguguuucugcgcggagcuuagcccuggggagaggaggaagcccgggcugugaccccggccuuucggaggguggucugcguuuccucacuggccccuccccuugucuuccagauacccuguguaacgaacucgaccaggagcggaaggcgcgcuaugccauccagcagaaauugaaagaagcccacgacgcccugcaccauuucuccugcaagaugcugacgccccgccacugcacuggcaacugcuccuucaagccaccgcuguugcccuagggccggccuggccgcaccccugcgcccucaagccaugcugcuccuuguaaauacccgcugcugcgguggcccugagcgaggaacaagccauucggacccgaccgauguaaauacagccgcccguccgcccgccuuccucccgggcuccccggccuugcccgcccccucccgggcgucccuguccagggccccggcuugguuuccaaguguaaauaccgccucgcgccucaaaucccccuaccccgugugaacucuagggcaucggaccucaagggguuaacuggacagacggggggcgggaggggagagcgcccccucccauuguauagccuugaacccgauugugaauacaauguagcaacuucgcuggcgccugccccgcacuccccgucccguccacuucugaaacuccuguuccuaaugacaaaguggcuaugugcaauggauauaaauguacugugagucucucgguucaguauuagguucacuuuaauuuauuuaugcuguaaguuauuuuugcuuccuucuccuggacccacuuccagucccguuuugcauuccccuuuggauuuugcuuuggcuauuuuuuguuguaaccucuugauguaacagcacuuuaaaagggcgacaacugacucacgagauggcaaccaccuggagccuguuuggggagaccacccuguacccgugacuuucguuuuuaauaauaauaauaauaauaauaaggcagcuucuccagcucccaguucuggcagugcaugguaaccuucagugcccagcugacagaagcuucccucagcaucuucucuaaguggugugccacuggcaaggcaccugaccaugaacggcuucccccagcaccccaucaccugaagaauuugcagcaaguuucaag

SEQ ID NO: 847 - RNA, 472 nt, Homo Sapiens
aaguccuauuacccuuaaguuuccucuuaaaacuaacuuuaaaaguuaguuucaaauaucacucauauuguagauacaugcuauaguauuuaaugguaaaauaucauucuacaacuuccuuccaaaugguucagugaaagauaugagugagugugcauuuauuaugcuuuuauuauacauauauagagugaaugcaccaaaauguuaacuuucggaucuaaguagcaugcagguggauccuaguucauugugcuauucuuucaaauguuauguauguuucaauuuuuucauaacaaaaaguuggagaaaacagggccgggcgcgguggcucaugccuguaaucccagcacuuugggaggccgaauguugggauuacaggcgugagccacuacgcccagccuauauuugguuuucuacaaugaacauguaugacuuuugugggacagucauuuauccuaacugguugagacau

SEQ ID NO: 848 - RNA, 2258 nt, Homo Sapiens
agucacacaggugccugauacgugacuggagguguucgcugauguggccccaacccugccuuccuccccaccccacgauguuagaagaaacucaacagaguaaauuggcagcagccaagaaaaagcuaaaagaauaucagcagaggaacagcccugguguuccagcaggagugaagaugaaaaagaaaaacacuggcaguagcccugagacagccacuuuuggugguugccacucaccuggggcuagucgguaccaagaacuggaauuagcccuggacucaagcuccgcaauaaucaaucaacucaaugaaaacauagaaucauugaaacaacagaagaaacaaguggaacaucagcuggaagaagaaaagaaaaccaacagugaaauacacaaagcacagauggagcaguuagaggcaaucgacauccucacauuggaaaaggcagacuugaagaccacccuuuaccauacuaaacgugcugcccgacacuucgaagaagaguccaaggaucuggcuggccgccugcaauacuccuuacagcguauucaagaauuggagcgggcucucucugcugugucuacacagcagcaggaagaggacagguccucgagcugcagagaagcgguccuccaguggcgguuacagcagaccauaaaggagcaggcacugcugaacgcacacgugacacaggugacagagucacuuaaacaaguccagcuagagagagaugaauaugcucaacauauaaaagaagagagggcccgguggcaggagaggauguggaaaaugucggugggggcucgcacauugaagaaggagaagaagcgugucauacaucagauacaggagcuggagaggagcuuguccaaacucucuaugugaaaguggcuuggaaauuggcuaccgucggcugagcccccauccccggcacccccagcagugaccucugugguggagcagcuacaagaugaggccaaacaccugaggaaggagguggagaguuuggagggaaagcuccaauccaagguggaaaacaaccaggccuugagucuccugagcaaggaacaaaaguagaggcuccaggagcaggacgagaggcuccgagagcaggaggaguggagggugcgggagcaggagagacugugugagcaaaaugagaggcuucgggagcagcagaagacgcuacgggagcagggugagaggcugcgaaagcaggagcagaggcuaugcaagcaggaggagaggcugcgaaaggaggaggagaggcugcgaaagcaggaaaagaggcugugggaccaggaggagaggcugugggaccaggaggagaggcugugggagaaggaggagaggcuacaaaagcaggaggagaggcucaugcucucccagaaccacaagcucgacaagcagcuggccgagccacagugcagcuucgaggaucugaauaacgagaacaagagcgcacugcaguuggagcagcaaguaaaggagcugcaggagaggcugggcgagaaggagacagaaccagcugccagccaccagaaccaacagcuagagacccagcuaagccucguggcucucccuggagaaggagauggaggacaacaucuggacagugaggaggaggaggcgccucggcccacgccaaacaucccagaggaccuggagagccgggaggccacgcagagcggcuuuauggaccucccgaaggagaaggugggcaggaaggagcagguggaaaaacuagagcuuggauucauccagcucucuggagcgacagacggcaugagagaguacaucacugaauaugagagccagggggcagugccaaacacgcggcaccaggagaaggaagacaucaucaggcuggcccagaaggaggaggagaugaaggugaagcugcuggagcugcaggagcugguguugccccuugugggcgaccacgaggggcauggcaaauuccucaccgcugcccagaacccugccgaugagcccgcuccaggggccccagccccccaggaacuuggggcugccgaugagcagggugauuuuuaugaagugagccuggacgauagcgaggagccugcaccgggagcggccggggaggguucuccccaugacaaccccacugcacagcagaucgugcagcugccuccuguaaugcaggacacccaggagcacccaggcuugcccggcaaccccugugugucauucuuuuaccaggcagccgagaacagggagauaaacaucaucaucuaa

SEQ ID NO: 849 - RNA, 1167 nt, Homo Sapiens
gacucggcgccggcuuccggcgccguaagagaagcguccgcgcgggcguucuggacccgcagaguucucggcguuuccgaagcucuugguguggccgggacccgggagaaggagcagggcugguggggcugcugcagccggaaauaaucauggugcucaacaguuuggauaagaugauucaacuccagaaaaacacugccaacaucaggaauauuuguguuuuggcucauguugaccguggaaaaacuacucuggcugacugucuuauaucuagcaauggaaucaucuccagccaccuagcaggcaaguuaagguacauggacagcagagaagaugaacagauccgagggaucacuaugaaauccagugccauuucccuacauuaugcaacagguaaugaggaguaccugauuaaucugauagacucuccaggacacauggacuuuuccucagacguaucaaccgcuguucgcauuugugauggaugcaucauugugguagaugcuguggaaggagucuguccacagcccagagaauggagagacugaugugcacaggaucacaaacuuuugacucucuuccaccagaaacucaagcacugaaagcagcuuuuaugaaauguggaagugaggacacugcuccaguuaucauguuuguuuccaaaauguuugcaguugaugcuaaggccuugccucagaauaagccaaggccucucacucaagaagaaauugcucagagacgugagcgugcaagacaaaggcaugcagagaagcuugcagcagcgcagggacaggcacccuuggagcccacccaagaugggagugccauugaaacauguccaaaaggagaggagccaagaggugacgagcaacagguggaaaguaugacccccaaaccugugcuccaggaagaaaacaaccaagagucuucuauugcauuugcucggguguucagugguguggcucgaagaggaaagaaaauuuuugucuuggggcccaaauacaguccucuugaguuuuuacgaaggguaccauuaggcuucucagcuccaccagauggccucccccaagucccccacauggcauacugugcucuggaaaaccuguaucuucugaugggaagggaacuggaauaucuagaggagguaccuccaggaaaugugcuagg

SEQ ID NO: 850 - RNA, 84 nt, Homo Sapiens
gugagcgagaggcuagggcaccgcuggggggagcugccaggccauccgaggggccccagcaucugagccauguccuccugcagg

SEQ ID NO: 851 - RNA, 6226 nt, Homo Sapiens
gggagggaggggcaggcgggagccgggagggagcgagcgggcucgccgcgccugagcaaccccugccugucgcugccgcugccgcugccgcugccgccgccggcccggacucguccggagcgcagggugucugcccagcugcgcgcggcgcgcggaggcuccggcguccgccgcugcgcccuccggccccugcuccucgcgccggcccgcgugggucccggcgggcgcgaacccaccaugcagcugcaguuccggagcuggaugcuggccgcgcucacgcugcucguggucuuccucaucuucgcagacaucucagagaucgaagaagaaaucgggaauucgggaggcagagguacaaucagaucagcugugaacagcuuacauagcaaaucuaauagagcugaaguuguaauaaacggcuccucaucaccagcuguuguugacagaaguaaugaaagcaucaagcacaacauccagccagccucguccaaauggagacauaaccagacgcucucucugaggaucaggaagcagauuuuaaaguucuuggaugcugaaaaggacauuucuguccuaaagggaacccugaagccuggagauauuauucauuacaucuucgaucgagacagcaccaugaaugugucccagaaccucuacgagcuccuccccaggacuucgccacugaagaauaagcacuuugggacuugugccaucgugggcaacucgggggucuugcugaacagcggcugugggcaggagauugacgcccacagcuucgucaucaggugcaaccuggccccaguacaggaguaugcccgggauguggggcucaagacagaccugguaaccaugaaccccucggucauccagcgggccuuugaggacuuggucaaugccacguggcgggagaagcugcugcaacggcugcacagccucaauggcagcauccuguggaucccugccuucauggcccggggcggcaaggagcguguugagugggucaacgagcuuauccugaagcaccacgucaacgugcgcacugcauaccccucgcugcgccugcugcacgccguucgcgggugagcggccucccuacaggccaguaggaccgucacuaagugugggagauucuugguaggcaguaucccuuucccaggugcauuuccaucccagcuccaccacucauuugcuggauggccucagcaagucaccuggccuuucugagccuccauuccuugagagaugaggggguuuggcaaguggguuucaucuggauacuggcugaccaacaaaguccacaucaaaagacccaccaccggccucuugauguauacccuggccacacguuucugcaaacaaaucuaccucuacggcuucuggcccuuuccgcuggaucagaaccagaacccagucaaguaccacuauuaugacagccucaaguauggcuacaccucccaggccagcccgcauaccaugcccuuggaguuuaaggcccucaagagccuacaugagcagggggcuuugaaacugacugucggccagugcgauggggccacguagggugggcaccccaugggacucaguggcucacauuuccugccagcuacaccacaggcagaugggagucgggguggcacaaacaauagaacaagcaggcuagugguuuucuuuguuaaaguguaaaacagugaccagaauauauauaucuauaccugcauauauauauugaccugaguauuuauaacugugugguguucaucuagcauuaggcagauaggccacaggaagaagguguggagaacccaccugaaccagauugagacucaauccaucuuuggggguggaaggacuugacaugaaaagaagccagucccaugacuuuggaugacaaacugccuccuggcuuggagggaucuuugggcucauggaugaauggcgagccaccuguugucagcugccccaagccucugggauauguggauucggagaaagcugaggcccagaggggacacucgacccagucuaaagugggugccauucacggaggagagggagguuggagacuucaaccgggcaaaggagcacaaggaaaccaagcagcagaggccccaucagcacagagggccucguuccacgaacguagaguuugacugccuaagggacagcacgaaugacucacauguuucagacaggccuccacggcuauggagagaaggcuggaggagacacaauggaugguucauguucuggcuuagcaagagccaccaagaacuuugggugaagcaagcagaugacaaugaagaggaguaauguuccgaaucauguuuuugaaaaaucaagaccuccuguuaagggcccacuugacccuagaauaaggcaggagagugucuaaaaucuagcugcuuuggguguuuuuuaaagcaaugugaguccacugaggaggaagagacccugggauuucacccucuggguuagucucugucucacccuguuagaaugucacgagggacuguacuguccccucugucaccagggaagccacaaugagagcuugaaagggugcugucaagauaaaugucauccuucuuaaaauacauaugauugccuuuuugggugccucacagagccccagagugugagaccugaaagaauguucagcaucuagcuccaugucccugcaaccacucucuguuugccuucugcauucugcacucugcggggccuuugcagccagacugcugugucaauguuacuuucuugucacuuuccuacccugauggucacacuagcccaccccaagcuccgacauugagguuuucaucucugcagggagagguuccaauguccaccccacccccagguacccgccucuucccacagaagcaauuuuagaauuuugcaaaauucuuuuccccuuauugagauuaauauuuaagauuaaaaaaaaaauacccaaagccaaaugcaguuccaaauaguggacauaaucucccagggaaaucugggcucgaggccuacaacuuaggggcuggaaucacaggucucacauagagaaauagccagcuugaauuuguuagucguauuccuucaccugaugaauaacaguguuuuaaaacauauuugaaagguaaguaaaaaacuaccaucuugaaggugaagggaguuaagaaaaguaaucaagaccugcuccuaagcauaugagaccagauguaauuaaucaauggcaaugcagaacaggaccuuggcucuaaauuaaugguugaccggaagggauuggaggcggcagaaccauuaacccuacacaagaacacuccagcccaaaaccgugaggaaggugauauaucucugcauuuucccuuguuguugcuugaagucugugauuggggauuugcguuauaaaaugaauauuuuaaaaagcaacagcccuaauagccucugugggaacugagugguuucggacuccucacaggcgguggaaauaauuaauaccauauuuuauacaucuccagagccuuucaucuugaggaucucaaagaccguagaagacauuuaauuucuaaagcuugaagugccccgaggagcagguagaauuuccagcagggccuugguggauuaaccaaggccuuggauuccagaauguuucaugguaagcacuguggagaaccuacaugucagguucuggaguuggcccugagcucuauccaccaagccagcaccccaccaucccuuugcaggggagucaaagggccagaacuccuugggggaccagaacaugguuuuccuucugccuaucuuagucauggcuccuaaaauugaagcugauaugagcuggagugcaaggaguccuuccacccugccuucagguucucucuggagaaagguuagagaccccaggacaaucaacaugugcaccguuccccuccucggcuugaguccugcacuaccaaaauggccuggccauuugauggcggagcuccaggggccuuggcuuucucuggcucauuguccuucuccaucugggccaauuguccuucccugcccauucagaguucaauuugagccuccacugcaguuccuggugugggccagcugguguuggguggccccagggagucacacagucuguacccggccccgagauccucugcuguaacugcagggucacaggcaucccgggagaaugggccuccacccucagccagcccucacugcugacaggcaccccucugucaccuccugccaccugucagauacccagccugcccgccaucagccacccgagugguuccgaccuccauucaccucaagccccaacaggccccugucauuccacuucauggaagagacggagccuucugaaaugagaucuacccugaaaaucucuucuccuuccccuuucugagaaacgucauccccaccaguuaacguuuccuguacacccucacccucucucguccaucucuguugccucugcacaucagcacacacugacuccaccugggcuggcuccugccgccucuucccuaccuccuccacuagccgcaggaagggccuccagcacccacaacugcccuuccucuugaugccccucggcuuccccccagccuggcagcagcgucccagcgccuccacauugccccucucaccucccagcucuccacgccacuuggcucugcagcgaccccuccuagacgcucccuggccccucggcacccagaaugccacauucuuguguuuuuuuccuccuucuuucccaaucccucucaaccauguauuuauuuauauauguauguauuuuuuuauuuauuauuuauuuauugaaaccccuacuuugauugacaaaggaaucaagguagaucugaccaguauuccccucucuucuccuugucccaccacauggacaugccuuacacuggcguccucuccugagucccuccgcacucuccaucagcaaccucacaccugccuucagacccggcugcaacuuccuaagcugccccugccccagcuccucucugcaacccagcccucuccugagcucuaggcugggauuacacccgcuggagggacacucaccccaucugcucccacggcagcaccaucaacucaacaagucagaagccaaguggaucaucuguguccccuucccccacaaucccuccuuuuucuaguaaaagacccgugaucccgucagccacccagucugagaugcugacguuaucuucgacuauucuucccuguccugccuugcuaauucuucccacuagcacuaaucucgacucuuugucacuuggacuauuucagcaacagucucaucucccagauuaccucugugcacacugacacguggucccguccauccugaacaugcacagugauuuuccucucccguugcacacaaaccuuuaaaaguuccccggcccgugaacaaauguacaauucucuauucugacauuacagaccaccggauaaggccccauucuuccuuuacacccuccccuggucagccuaggagaguuguuuuuccuggaaagggugccugcguuuuacugucucugugccuuuggucuugcuauccccauccccuggaaugcucccuuuucuucccuucaaagcccaugcggaaaccacguccuucaugaagcccucccugauguaccaaccacugggaucucucccucugcugaaccaccguagcacuuuauuuguaccuuucucauggcacuuaccauauucugccuuguauuauaguuauuugugcacuuguccuuugacuguucuuagacuguaagcuugccaagggcagggacuguguuuuauucaucuguauccaucacagcacuaggcguggugcauagcacacagcaguugcucaauaaauguuuguuggauuaaauccuuaagcauuccugaccacuagaacugugcuuggcacagaguaggcacuuaauaaacuccugcugcaugaacaaaagaacaaguguggaugcuucaaaggaagacuugcacccggcugacccccagaguggggaaggggucccaccuaauaggaagaacaccaagacuuccccaagaggagaaggaacggcucccccuuucucggcgaggccaugugucuggacccugugugagaugcuuucuauacuagcccuuguugggguguugcacccauuuuacagaucaaacaaccaaguuuaucagaaauuaaagacucauuuaagaugcc

SEQ ID NO: 852 - RNA, 915 nt, Homo Sapiens
uccaauaaaaccaccaauuauaugccuuucaaaggaugucaucuucugaaagcguuccacauggcuauaaucuuauuaccucugguugaaguagucacagaccaaacuaaacggaacuggaccaagggaagaggacacagaagguaaaaggaagccagaccagcauguucucccacucuagugcuccuaccaagaggcuuugauaagcaaucacaauuguccccagugacaugaaagaaaaagugaagcacccuguagggaugcauagcaugacaucuacguagacuugggucauggaaggaaacugucaccacauacaaguucaagggaaauguucagccuccaggccgcugaaugaagcucugcccaggccuuaggaaaaggugaaaccccaacuagcaggggccccaguucaccauauccaggaagguguccuugaaccagaaauacccacguuguacuccgacaugaacaagaaauagauuucuauuauauuaagcaacagaaauuuucagauauaucaguucucgcagcaggaaggauguauugauaauggcaacauggauggagcucaaaacaucacauuuaaugaaaaaagagacuuacauaaaaaaauuauagacuauauuauuacauucaaaugaaguucaagaacaagcaaaaguuguggaaaaauaucagaaaacuugcuucugcuggagggguaggaugggauuugacugggaagaggccuaggggaacaugcuggaaugauauuaauguucuauuucuugauggagguuuggguuccacagguguauguauuugcuaaaaguuagcaaauguagaguuaagguuuguguucuuccuugugcaauacauuuuacaccaaaggaaaggcuguaaacaaauauugaacuguaguuaaucauaugu

SEQ ID NO: 853 - RNA, 77 nt, Homo Sapiens
auuuuggccaacucugaccccuuagguugaugucagaaugagguguaccaaccuagguggucagaguuggccaaaau

SEQ ID NO: 854 - RNA, 548 nt, Homo Sapiens
gucuccgcucgucgcccggcucggcgucgggagugcacucuguguggccgcugcugcaguguuguugugguugugagaaggcggcggcggcggcggaguagcagccggaccagacgcccuaguagcucagucgcugcccugcgccgggccuggcagggagccuggugagaugguggaggaggaggcugugccguggcgggccuugccauguccugcugccugucaucaagaguucauauaacuagaccugucuuggagcaauuuuuaucuuuugcaaaauaccuugaugguuuaucucauggaguaccuuugcugaagcagcuuugugaucauauuuuguuuauuaacccagccaucuggauacauacaccugcaaagguucaacuuucccuauauacauauuugucugcugaauuuauuggaacugcuaccaucuacaccaccauaugcagaauaggaacaguuauuaaagauaaugcacaccuuaaaauauuacuacuggguuauuaauccugcugacaguaguggcauuacaccuaaaggauuag

SEQ ID NO: 855 - RNA, 8226 nt, Homo Sapiens
gacuagugguggauacaugaauucacacaggugguagaauuauacagacauuaauacacacacagugaaaguaaaacuaggaaaaucugccuaagguaaguagauggaguuacugucaauguccuuguuuugcaaaacaucaccauugugagauccuacugagaaucugaaacacagccuugguuauaugcuuuuuucuuuuuuuacccuguaaaaauguuccuuuuacccuguaaaguguuccuuuuuauacugguaaguauaaaaggaacaaauuauacugguaaguaaaaauuacugauaaaguaacuuuaaacugaauaugggaaauaacugcugugcuguaugguauaaauaaauaauauauuuaucuauaacaauacuacuuuauauaauggaacuagaugucacaaauggcucuaguacuaguaaugcaauuaaucaauauaauguuuuguaggguuuuguuuuuuauacucuuuguuaagccuccaaacuagcaaguacccauuacaguaaauguacaauggauuauuucuguuuccgcguuucagucauuaacucauuaguugcauaaucuuaaggucaaauuaccuuguugaaggggacagucuggauccauuccguggagcucacaucaaaaacgucugcugcauuuucacugugcacugagaggcacggggcauuguaaccugggaggagcaaagacgguaacagcaaacaugggcuccgugauaccuuuuucagugaauuuuugaugagauaauuauagauucacauguaguuguaaaaauaauacagagagaucccuuguacacucugcccagauucaauucacaacaaaauaaaacuucagugucuggauuacaaauaauuuaaaacauagcuaaaaauguaaaaguaaaaaccugccguuuugcuaagaccagaccaucaaauauuuaagagcauuuaacuuccaggacuuguggaguaugcaugacaugagccaccaagaagaaguuuuuaaaggaagaguuaaaauaagugaaauuuuuuucuaccuucaucaguauaagcaguggaaaacacuuuugaaagggcugucccaccacauaaaacguuacauuugugcuuuuccagcauucuuuuuuuuguuugguuguauguuuuuauuuuuuauuauacuuuaaguuuuaggguacaugugcacaacgugcagguuuguuacauguguauacaugugccauguuggugugcuccacccauuaacucaucauuuaacauuaggcauaucuccuaaugcuaucccuccccccuccccccaccccacaacaggccccagugugugauguuccccuuccuguguccauguguucucauuguucaguucccaccuaugagugagaacaugcgguguuugguuuuuuguccuuucgauaguuugcugagaaugaugguuuccagcuucauccaugucccugcaagggacaugaacucaucauuuucuauggcugcauaguauuccaugguguauaugugccacauuuucuuaauccaguuuaucauuguuggacauuuggguuaguuccaagucuuugcuacugugaauagugccgcaauaaacauacgugugcaugugucuuuauagcagcaugauuuauaauccuuuggguacauacccagcaaugggauggcugagucaaaugguauuucuaguucuagaucccugaggaaucgccacacugacuuccacaaugguugaacuaguuuacagucccaccaacaguguaaaaguguuccuauuucuccacauccucucuagcacuuguuguuuccugacuuuuuaaugaucaccauucuaacuggugugagaugguaucucauugcgguuuugauuugcauuucucugauggccagugaugaugagcauuuuuucaugugucuuuuggcugcauaaaugucuucuuuugagaagugucuguucauguccuucacccacuuuuugaugggguuguuuuuuucuuguaaauuuguuugaguucauuauagauucuggguauuagcccuuugucagaugaguagauugcaaaaauuuuucucauucuguauguugccuguucacucugaugguaguuucuuuugcugugcagaagcucuuuaguuuaauuagaucccauuugucaauuuuggcuuuuguugccauugcuuuugguguuuuagacaugcagcccuugcccaugccuauguccugaaugguauugccuagguuuucuucuaggguuuuuaugguuuuaggucuaacauguaagucuuuaauccaucuugaauuaauuuuuguauaagguguaaggaagggguccaguuucagcuuucuacauauggcuagccaguuuucccagcaccauuuauuaaaucgggaauccuuuccucauuucuuguuuuugucagguuugucaaagaucagaugguuauagaugugugguauuauuucugagggcucuguucuguuccauuggucuauaucucuguuuugguaccaggcgccuccgcaaccucccaggagcucugaccaaggugccucacugggguggggaacuugccucaccuggggccauuucauauuucugaaucaugugugauaacagagaacuggaagacaagccuccagcaccucccgugcgaaugagcaggaccaucuuuagcacugggggcaaagacccuuugucagccaaucacaguuugaaaccuuugccuucuguuccagaggagaaaaagcccaggcauaaaaucaucuccauauucucaggcacagagaaaggaaguaaaaagaaagaaaaggaacggccagaaauuucuccuccaucugauuuugaacacaccauccauguuggcuuugaugcuguuacuggagaauucacuggcaugccagaacacugggcucgauuacuacagaccucaaauaucaccaaacuagagcaaaagaagaauccucaggcugugcuggaugucuacgacuccaacacagugaagcagaaguaucugaguuuuacuccuccugagaaagauggcuucccuucuggaacaccagcacugaaugccgagggaacagaagcaccugcaguagugacagaggaggaggacgaugaugaagagacugccccucccauuauugccccaccaccggaucauaugaaaucaauuuacacacggucuguaauugacccuguuccugcaccaguuggugauucaaauguugaugguggugccaagucuuuagacaaacagaaaaagaagacuaagaugacagaugaagagauuauggagaaacuaagaacuauugugagcauaggugacccuaagaaaaaaauauacaagauaugaaaaaauuggacaaggggcuucugguacaguuuucacugcuacugacguugcacugggacagaagguugcuaucaaacaaauuaauuuacagaaacagccaaagaaggaauugaucauuaaugagauucugguaaugaaagaauuaaaaaaucccaacauaguuaacuucuuggacaguuaccugguaggagaugaauuguuuguggucguggaauaccuugcuagggggucacucacugaugugguaacagaaaccugcauggaugaagcacagauugccgcuguaugcagagagaguuuacaggcauuggaguuuuuacaugcuaaucaagugauccacagagacaucaaaagugacaguguacuuuugggaauggaaggaucgguuaagcucacugacuuugguuucugugcccagaucaccccugagcagagcaaacgcaguaccguggucagaacgccauacuggauggcaccagaagugguuacacggaaggcuuauggcccuaaagucaauguauggucucuggguaucauggcuacugagaugguagaaggagagccuccauaccucaaugaaaaucccuugagggccuugugccuaauagcaacuaauggaaucccagaacuucagaauccagagacacuuuccccaauauuucgggauuucuuaaaucgauguuuggaaacagauguggaaaaaagggguucagccaaagaauuauuacagcaucuuuuccugaaacuagccaaacuguuaucuagcuugacaccacugaucauggcagcuaaagaagcaaugaagaguaaccguuaacaucacugcuguggccucauauucuuuuuuccauuuucuacaagaagccuuuuaguauaugaaaauuauuacucuuuuggggguuuaaagaaauggucugcauaaccugaaugaaagaagcaaaugacuauucucugaagacaaccaagagaaaauugcaaaaagaaaaguaugacuuuuauaugaaccccuucuuuaggguccaaaaggaauuguggacugaaucacuagccuuaggucuuucagcaaaccgccuaucagggccauuuaucauaugugagauuugcauuuuacuuugcugacuuuguuguaauagaucccauucauuguccccuuugggguauuuccaauacuugaauggcagauuggaguuuuucagaguauuuguuucaucugcuagucuuucucuccuucauagcuuuccuuuuccuggacuugcuccuuuugaguugcuuuugaguuucucaugccuagguaaguguaauagaaauuauguagcuccuuauguuggcaaaggagcucuauauaguuucacuuuuuauaaaaguuaggaccagcuguuguuacauguaauauuuuaguucagaacuugaccugaaggaagggaagaaaaguauuugauuuuuaccuuuuuuaacaaaugugaaaaagucaguuuuagaaauuuugugguaguaaguuuggcauuuguuacauguauagagagaagacuaauaaucucuauuuauaacuaaaucauugagauagaaaaagauucccauugaccguguauuucuucccauuucgucuucccuucugccuguuuccccuucaggcuuggcucuaggaaccaaagugauuuguucuuguuccaaccugggcuuugugacuuugguuagugccacuaccuucuucccuccuuucccccuucaauuuggaaauaaauuucuguauauguugcaauuuuagguuuauuuuuguucuuuuuguuuuucauuaauccucucucaccucacagauaccccccucccauggcaaauaauauaauaaccagugaauuuucgggaauuuaaaauuagcuuuuuuccacuuaaaggagaacaauauuugggacuagcaggcgcagagugagagacgugaaccuuggugaucucugauauagugagaagagauuauacucaugaaagagaauguuaguguuacagagaagcagccgauaggaaaucaacuguagagacuuggaggcggcggcauugcuccaggucaucaucagugugguauuaucuaugagaacuugagcgacagaguauuucuugaugaauuuauagaucauuugagauguugaguuacuuuuguuuuguuuucaaauagguagagacuauuaauguaaaaaaacaagaaaggaaaaugaaaugugcguguugagagcaauaauuuguuucuuuuaaagauucugaaagaucugagaccuguagcauuaauuauuugagugcccucccuucuccccuccccucccuuucucuucucuucuuucaucuccucuccuucuccuuuauucauuguuuugcuuuggaauagguuguucaaguauuugguuugguucuggcauuuuguucccaccauccccuucccccauuaacuuccccccugcuugccauccugcaguaguauaaaucaugaauaaaaaauaauuuugcuguuguaguauacauuggggaaacuagcaggguuuuauuuccauuauuuuauucccacuauaucuaugauaagauacaauuauaaggagagaagugacuguuuuuuauugauaaggcaagauuuucagaaaaaugaguaaaauaauuaaugaaacauauuuagagcacuuaguggucucuguuuucaauauaauucuugauuucauuuuucucuggaauauauuggccuucuacagcuauuacugaauuacagaaacugguuuauuucugucagaaagcugcagugccaccugaguuccaaauuuuaacauucuuuguaaacggauggauuaugauaaagaagaugcuaccaaugaaauagaaaaccaacgagaugagaagacugugauccucaugcacucagaggcacuucccuucuaagucaaagaccauucucacugacuaugugccaaggccucacuucaggcuugugacucaacaaagggcuuuuccauugauagaagcaguuugggauuuguagcuacaacuucuucgauaguuaccugcauguccauugcuggcagcugacuucagucauuaaaaccuggcucuuugguuaagggagcuacacugugguuuauucuuaaguuacauggauaaacuaaccucuagcagaaauauaguuugguuaauuuugagaugugucauuuuuaaacaaaaucuuaaaagcaauacagaauugugauuuauuaauuuuaaauuaaaacauugagaacuuguugaaagaaaaauuauaucugaaucaagauucauguuuuuuauuuuuuuuuauuuauuuauuuuuuuugauacagagucucacucugucacuuaggcuggagcgcaguggcaugaucucagcucacugcaaccuccgcuuccuggguucaagcaauucucaugccucagccuccugaguagcugagaccacaggugcgugccaccacacccagcuaauuuuuuguauuuuuaguagagacagagucucaccauguugcccaggcuugucuccaacuccugagcucaggcaaucugcccaccuuggccucccaaagugcuacaauuacaggcacgagccacuacaccuggccucauguuuuuuaaauaauugccuuuuauauuuacccuuuuugucaucacuuuagaaugaaaauucccauuuaaaucuaaaaguuacuuuaauaguccucuuguguuauuaggacaguguuacuauaguacuuauuuauuauauuuuagacuuuuucuuuuuucuucugcugcuuuuagggacaguuaaaacugggaaacuaugaaacauggaacauuuuauccuaccuagaauaguaaaugaguaauugugaagcguaagacaccgaggcuaauacaacucugucuucaugugucgagugccuggcacauaguacuaauucucuucccuuuaacauauaaauguuaagcugcuuagagucuaguaaccaccaacuguaaacgagccugugccuuuaacaagaaauuuuaaacuaccuaugaguauuucuuuauagggcucacuuaaauacguuuguauauacuguauucuagccagaauaauuuuagaucugaucagguaguagcuaaaauuagaaaaaaacaaaauagaugcuuaaagaauuugcauccauuuuugagucuaaaucuuuuuaaauauacugagauccacaucuagugaaaugucagugucaaaauauuauagauuauagcuaaaauccagauuaauacucauuugggguuuuuuauaguggaacuucauaguaauacaagaagcagauugucuuccugucucugcugcucccacaguagguauugaaacuggugaaaucaguuuuuugauaguguguguauauaagaaaaaauauauacacacauucuuuuuucucagucaacacacugauugaacacucuggcaaagaugcugugguagacgagguuggaguuagaaagaagaagcaagcacuggccuggccuugaaagaacggaagucuuucccauucacuucucuagaaugcugccaagacagaggcagaaagaaauggaugauaauucugucaagcacacuucuauucuuuauuaagagaaacaauuauguuuggaauucagcaucuuugguuggaacgcauuggcuuuuuuuucuuguugugauagaaauggaauuaaguaaaauuauaguuugucuuuucuguugucuucaaauuuuauaaugucuuuuauuuuuaauuuaaucccauucaauuauuuaauuguuauacauugacauuaacugcuguauuuuaugacuuuguucaauaauuuuguucuuucagggcuagaaauaaacuuuuuuaagaaaugugc

SEQ ID NO: 856 - RNA, 551 nt, Homo Sapiens
uuccgguuaugcaggaaggaaauugacgaacacgugacgcggucgggcggaccacugcagacugagcgguggaccgaauugggaccgcuggcuuauaagcgaucauguuucuccaguauuaccucaacgagcagggagaucgagucuauacgcugaagaaauuugacccgaugggacaacagaccugcucagcccauccugcucgguucuccccagaugacaaauacucucgacaccgaaucaccaucaagaaacgcuucaaggugcucaugacccagcaaccgcgcccuguccucugagggucccuuaaacugaugucuuuucugccaccuguuaccccucggagacuccguaaccaaacucuucggacugugagcccugaugccuuuuugccagccauacucuuuggcauccagucucucguggcgauugauuaugcuugugugaggcaaucaugguggcaucacccauaaagggaacacauuugacuuuuuuuucucauauuuuaaauuacuacaagauuauuaaagauaaaaugauuugaaaaacuc

SEQ ID NO: 857 - RNA, 612 nt, Homo Sapiens
uaugcuuugcacaguggcuggcauacaggaaacguuuaauauaugguagcuacuauaaacucgguuauuuccguguagcuuuccaugucuacauggagggagaaaaugagcagauguccauuauaauuuagcuauuacaguuuucacucuaaaguaaaaaaggcauuuagauuuauaugucuucugggaguuugguucuucugacucccuucaucugugagaccauagguacuuuuauguaauaugauaaaaauuauuagaaaaagaaaaaaacggccgggugcaguggcucacaccuguaaucccagcgcuuugggaggccaaggcaggaguaucgcuucaacucaggaggcagagguugcggugagccaagaucgcaccauugcacuccagccugggcaauaagagcgaaacucugucucaaaaaagaaaaaaauaaacuaaaaaggaaaaaagggccgggcacgguggcuuacgccuguaaucccagcacuuugggaggcugaggcaggcggaucacaaggucaggcaaugaagaccauccuggccaacauggugaaaccccgucucuacugaaaauacaaaaauuagcuggaugugguggugcacacc

SEQ ID NO: 858 - RNA, 69 nt, Homo Sapiens
uuguuaugaugagauuccacuuaagguccguguuucugaaacaaaugauuuuguggaaguucugauuua

SEQ ID NO: 859 - RNA, 1443 nt, Homo Sapiens
gcacuuggagcccagggcaggguucacagagcuauuuucaguucucuugcaggaucuccuucccagccuucagaaauugccggucugggaguugggggcaaggagaagauccugugcuccuccaaagccggagcccaaaccuaaaaaggccccugcaaagaagggagagaagguaccaaaagggaaaagggaaaagcugaggcuggccaggaggggaauaacccugcagaaaauggagaugcccaaacagaccagacacagaaagcugaaggugcugcagaugccaagugaagagaauguuuucugcagaaacagccugggguuucaggaaggcaggcccaguucaggggugccuugggagcaaagguccugucauuccaacacuaagcucucaucuccaaccagaaggaacuaugagagagagagagaaagagagagagagagaaagagagagagagagaauaugugcucaucuuaggauaagacugucagauaaaauacuagacacucuaugaaacuugaauuucauauaaauagcaaguaauuuuuuaguauaauuaugucccaaauacugcaugggacauacucauacuaaaaaaaauugucuauaugaaagugaaauuuaaauagacauccuguauuuuuuucuuccuuuuucuagcaacccagugauuccauggaaagcagaaagaaggacauaaagaaacggauacuuggugacaucuuugacucacuggaucaaaccuugccugaagcucacauuucugaaauuuccagauacaagaacaaauacuuccucuuuauuguuuuacuagauuugagacaagcuuuaaguuucucagacucuuccucuuccuaacagauuuaucagaagcugaaagcucugaucuuguugggaugcggaucgugucaggagaaggcuuacuuugcacgcuuuucuuagucugguugccuaacucaagaaccucggcauggcucuguuacuucucuacucagacaagcaucccugcagacacucacuaggcuaacucugucuuuauuuuuagaauuagaccuuuacgagaagcacaguuuugucuucaguuuccucuccccccacccggaauggccugagccgaagccagcucccuccgagaagucauuaccgccugacuugcguuugauauuuagacaccuuggucacaacaucuugcauucucucgggaugcugauuucuaacugcucuuuggccuuuccugcauugguccuccucaggcaggggaucccugcucuucuauauuagugaguagugagaaaaccaaggcucagagaaacuguggauuuucuaaggaugcuggcuccccguccccuguccaccaugagucaaagcaaugugagucccucaccagaugcaacugcccagucuuggacuuuccagugaccagaaucaugagccaaauaaac

SEQ ID NO: 860 - RNA, 1089 nt, Homo Sapiens
gcaaucuacaaggauucuaauuucuccacauccugcauuuaagacuugcaaagcugaauuaaucacaggaugaggaaguggcuucucugaaacauuuuccucuuucacauuuuaaacuuucucuuucauacaugacaugaaacacagccuacgcacgaaagugacuaggaggaaggauauuauaaagugaugcaaacagaaauuccaccagccuccauguaucaucaugugucauaacucagucaagcucagugagcauucucagcacauugccucaacagcuucaaggugagccagcucaagacuuugcucuccaccaggcagaagaugacagacugugaauuuggauauauuuacaggcuggcucaggacuaucugcagugcguccuacagauaccacaaccuggaucagguccaagcaaaacguccagagugcuacaaaauguugcguucucaguccaaaaagaaguggaaaagaaucugaagucaugcuuggacaauguuaauguuguguccguagacacugccagaacacuauucaaccaagugauggaaaaggaguuugaagacggcaucauuaacuggggaagaauuguaaccauauuugcauuugaagguauucucaucaagaaacuucuacgacagcaaauugccccggauguggauaccuauaaggagauuucauauuuuguugcggaguucauaaugaauaacacaggagaauggauaaggcaaaacggaggcugggggaaauggcacaaucacacaccuaugcugguagagucaguggcccacaagaagaggaaaauggcuuuguaaagaaguuugaaccuaaaucuggcuggaugacuuuucuagaaguuacaggaaagaucugugaaaugcuaucucuccugaagcaauacuguugaccagaaaggacacuccauauugugaaaccggccuaauuuuucugacugauauggaaacgauugccaacacauacuucuacuuuuaaauaaacaacuuugaugauguaacuugaccuuccagaguuauggaaauuuuguccccauguaaugaauaaauuguauguauuuuucucuauau

SEQ ID NO: 861 - RNA, 96 nt, Homo Sapiens
agacaugcaacucaagaauauauugagagcucauccauaguugucacugucucaaaucagugacaacuauggaugagcucuuaauauaucccaggc

SEQ ID NO: 862 - RNA, 4871 nt, Homo Sapiens
gagcgacagagcgagacucugucucaaaaacaaauaaaggaaaaagaaaaaaaugagaagcgcguguucccgacuccggugcuuuuucgcaaggucgugcuacugcgccuucugaacuacgagucccaggaggaguccagugcuggaggggcagggacggcggcggcgcagcucggaacccgccaggguccaggguccagguuccagcgcccggcggcccagcucucaagcagaucaaugcaaugccaccuggccgcuugcuuugcccacugggccuacagccggaagccugcccuucagcccucgggccugaucccaggccgccugcagccuguaaccagacacuguuugcuuccagcaggcaccccccgagcccagcuccacacaccguuccuggaucuccucuccccaggcggagcgugccccugcccaguccagugaccuucgccuguuggagcccugguuaauuuuugcccagucugccuguuguggggcuccuccccuuuggggauauaagcccggccuggggcugcuccguucucugccuggccugaggcucccugagccgccuccccaccaucaccauggccaagggcuucuauauuuccaagucccugggcauccuggggauccuccugggcguggcagccgugugcacaaucaucgcacugucagugguguacucccaggagaagaacaagaacgccaacagcucccccguggccuccaccaccccguccgccucagccaccaccaaccccgccucggccaccaccuuggaccaaaguaaagcguggaaucguuaccgccuccccaacacgcugaaacccgauuccuaccgggugacgcugagaccguaccucacccccaaugacaggggccuguacguuuuuaagggcuccagcaccguccguuucaccugcaaggaggccacugacgucaucaucauccacagcaagaagcucaacuacacccucagccaggggcacagggugguccugcguggugugggaggcucccagccccccgacauugacaagacugagcugguggagcccaccgaguaccugguggugcaccucaagggcucccuggugaaggacagccaguaugagauggacagcgaguucgagggggaguuggcagaugaccuggcgggcuucuaccgcagcgaguacauggagggcaaugucagaaaggugguggccacuacacagaugcaggcugcagaugcccggaaguccuucccaugcuucgaugagccggccaugaaggccgaguucaacaucacgcuuauccaccccaaggaccugacagcccuguccaacaugcuucccaaaggucccagcaccccacuuccagaagaccccaacuggaaugucacugaguuccacaccacgcccaagauguccacguacuugcuggccuucauugucagugaguucgacuacguggagaagcaggcauccaauggugucuugguaugaggcugggcccaucucuccuucacgugggcuggccccggcuugaggggucuucccguucucuucaucccugugccaguuucugaauuguuaggccaggguuggaaucccaccucugagugauuucagcagacagacgguggcuaugaugauuguuauucuccaaaggcccuucucuaggacccacagccuccagaccccaguagcguuccccucugcugaccaggccucuagguuuagcuugauuggccuccagcccuggcccaucagggauccccccagcccacugggcccugggacccagcccaccugccccaggaucaaacaggagccccuggucugcuucuuccucacaccuugcagauccggaucugggcccggcccagugccauugcggcgggccacggcgauuaugcccugaacgugacgggccccauccuuaacuucuuugcuggucauuaugacacacccuacccacucccaaaaucagaccagauuggccugccagacuucaacgccggcgccauggagaacuggggacuggugaccuaccgggagaacucccugcuguucgacccccuguccuccuccagcagcaacaaggagcggguggucacugugauugcucaugagcuggcccaccagugguucgggaaccuggugaccauagagugguggaaugaccuguggcugaacgagggcuucgccuccuacguggaguaccugggugcugacuaugcggagcccaccuggaacuugaaagaccucauggugcugaaugauguguaccgcgugauggcaguggaugcacuggccuccucccacccgcuguccacacccgccucggagaucaacacgccggcccagaucagugagcuguuugacgccaucuccuacagcaaggugcagcccgcuccucguggggcacggggaaggagggcgccucaguccucaggaugcucuccagcuuccuguccgaggacguauucaagcagggccuggcguccuaccuccacaccuuugccuaccagaacaccaucuaccugaaccugugggaccaccugcaggagacugccacacccuccugccuucccccagaggccgccgcuccucucccucccccaggguuggaguccaccuccucuccauccugcccccaucauuuccgcugacaucauuucccugacagcugcccccuaccccuucccugcagcucugcccaaugcuagcgucuuaagccagaggacagacauguccucuccucaccgacagccccuccagaguuccgagccucaaauucccguccagcuucuaccccacuguugcugcugcacuuccaguccaggccugucucaccagggaagcgagacccaggaucuugucacagagucacagcugaggcugugaacaaccgguccauccaacuccccaccaccgugcgggacaucaugaaccgcuggacccugcagaugggcuucccggucaucacgguggauaccagcacggggacccuuucccaggagcacuuccuccuugaccccgauuccaauguuacccgccccucagaauucaacuacguguggauugugcccaucacauccaucagagauggcagacagcagcaggacuacuggcugauagauguaagaggcccagaacgaucucuucagcacaucaggcaaugaguggguccugcugaaccucaaugugacgggcuauuaccgggugaacuacgacgaagagaacuggaggaagauucagacucagcugcagagagaccacucggccaucccugucaucaaucgggcacagaucauuaaugacgccuucaaccuggccagugcccauaaggucccugucacucuggcgcugaacaacacccucuuccugauugaagagagacaguacaugcccugggaggccgcccugagcagccugagcuacuucaagcucauguuugaccgcuccgaggucuauggccccaugaagguacggaggugcaugguaggguucaagaaccaguucgccccagugccugaaagugcacuauuaggaaguuaauagacuauugccuacuggacuccuggucagggaaccuucaaaagcaaaacaaaaaaccguggggcuccaggcaggucaggcaugagucuuugaugagauucauauuuucuuuuccccagaacuaccugaagaagcaggucacaccccucuucauucacuucagaaauaauaccaacaacuggagggagaucccagaaaaccugauggaccaguacagcgagguuaaugccaucagcaccgccugcuccaacggaguuccagagugugaggagauggucucuggccuuuucaagcaguggauggagaaccccaauaauaacccgauccaccccaaccugcgguccaccgucuacugcaacgcuaucgcccagggcggggaggaggagugggacuucgccugggagcaguuccgaaaugccacacuggucaaugaggcugacaagcuccgggcagcccuggccugcagcaaagaguuguggauccugaacagguaccugagcuacacccugaacccggacuuaauccggaagcaggacgccaccucuaccaucaucagcauuaccaacaacgucauugggcaaggucuggucugggacuuuguccagagcaacuggaagaagcuuuuuaacgauuauggugguggcucguucuccuucuccaaccucauccaggcagugacacgacgauucuccaccgaguaugagcugcagcagcuggagcaguucaagaaggacaacgaggaaacaggcuucggcucaggcacccgggcccuggagcaagcccuggagaagacgaaagccaacaucaagugggugaaggagaacaaggagguggugcuccagugguucacagaaaacagcaaauaguccccagcccuugaagucacccggcccccaugcaaggugcccacauguguccaucccagcggcuggugcagggccuccauuccuggagcccgaggcaccaguguccuccccucaaggacaaagucuccagcccacguucucucugccugugagccagucuaguuccugaugacccaggcugccugagcaccucccagccccugccccucaugccaaccccgcccuaggccuggcauggcaccugucgcccagugcccuggggcugaucucagggaagcccagcuccagggccagaugagcagaagcucucgauggacaaugaacggccuugcugggggccgcccuguacccucuuucaccuuucccuaaagacccuaaaucugaggaaucaacagggcagcagaucuguauauuuuuuucuaagagaaaauguaaauaaaggauuucuagaugagugaga

SEQ ID NO: 863 - RNA, 381 nt, Homo Sapiens
augauuucauuccauguaauauuuuugucauuaggaagaggcaaguuauuuuuaccugucaauuucuguuuuuugaaauugaaaaauucucagguacgaaucccaaaagacuuuacaugcaaccuccauguccuauucaggacuguucaaggagaagacagaaacaccauguuuagaggucauugguccaucuacucuagaaacuuccccuuggcaguggucccugccuauguuacagaagacggcaaaaauacgagccaucgugcaucuggccaguucugcaaugcucuaucccagggggaaauuccuuccucacuccagcuggugaacagcuaugcccuggagcccaggacggacaugccuuguaacuuuuuaacuuag

SEQ ID NO: 864 - RNA, 103 nt, Homo Sapiens
cugacuucagcggcagguauacuaaaauuagaaugacacagaggagauuagcauggcccccugugcaaggaagauccagauucaugccgcauuccauauuuuu

SEQ ID NO: 865 - RNA, 1740 nt, Homo Sapiens
cuugccgucagccuuuucuuugaccucuucuuucuguucauguguauuugcugucucuuagcccagacuucccguguccuuuccaccgggccuuugagaggucacagggucuugaugcuguggucuucaucugcaggugucugacuuccagcaacugcuggccugugccagggugcaagcugagcacuggaguggaguuuuccuguggagaggagccaugccuagagugggaugggccauuguucaucuucuggccccuguugucugcauguaacuuaauaccacaaccaggcauaggggaaagauuggaggaaagaugagugagagcaucaacuucucucacaaccuaggccagcuccugucuccccccagguguguggugaugccaggcaugcccuuccccagcaucaggucuccagagcugcagaagacgacggccgacuuggaucacacucuugugaguguccccaguguugcagagcucagagcccaggccaggggcccccaagaaaggcucugguggagaaccugugcaugaaggcugucaaccagcagggccaucaggcaccaaagggauucugccagcauagugcuccuggaccagugauacacccggcacccuguccuggacacgcuguuggccuggaucugagcccucguggaggucaaagccaccuuugguucugccauugcugcuguguggaaguucacuccugccuuuuccuuucccuagagccuccaccaccccgagaucacauuucucacugccuuuugucugcccaguuucaccagaaguaggccucuuccugacaggcagcugcagcacugccuggcgcugugcccuuccuuugcucugcccgcuggagacgguguuugucaugggccuggucugcagggauccugcuacaaaggugaaacccaggagaguguggaguccagaguguugccaggacccaggcacaggcauuagugcccguuggagaaaacaggggaaucccgaagaaaugguggguccuggccauccgugagaucuucccagggcagcuccccucuguggaauccaaucugucuuccauccugcguggccgagggccaggcuucucacugggccucugcaggaggcugccauuuguccugcccaccuucuuagaagcgagacagagcagacccaucugcuacugcccuuucuauaauaacuaaaguuagcugcccuggacuauucacccccuagucucaauuuaagaagauccccauggccacagggccccugccugggggcuugucaccucccccaccuucuuccugagucacuccugcagccuugcucccuaaccugccccacagccuugccuggauuucuaucucccuggcuuggugccaguuccuccaagucgauggcaccucccucccucucaaccacuugagcaaacuccaagacaucuucuaccccaacaccagcaauugugccaagggccauuaggcucucagcaugacuauuuuuagagaccccgugucugucacugaaaccuuuuuugugggagacuauuccucccaucugcaacagcugccccugcugacugcccuucucuccucccucucaucccagagaaacaggucagcugggagcuucugcccccacugccuagggaccaacaggggcaggaggcagucacugaccccgagacguuugcauccugcacagcuagagauccuuuauuaaaagcacacuguugguuucug

SEQ ID NO: 866 - RNA, 1657 nt, Homo Sapiens
aacuugccgucagccuuuucuuugaccucuucuuucucuucauguguauuugcugucucuuagcccagacuucccguguccuuuccaccgggccuuugagaggucacagggucuugaugcuguggucuugaucugcaggugucugacuuccagcaacugcuggccugugccagggugcaagcugagcacuggaguggaguuuuccuguggagaggagccaugccuagagugggaugggccauuguucaucuucuggccccuguugucugcauguaacuuaauaccacaaccaggcauacgggaaagauuggaggaaagaugagugagagcaucaacuucucugacaaccuaggccaguguguggugaugccaggcaugcccuuccccagcaucaggucuccagagcugcagaagacgacggccgacuuggaucacacucuugugaguguccccaguguugcagaggcagggccaucaggcaccaaagggauucugccagcauagugcuccuggaccagugauacacccggcacccuguccuggacaggcuguuggccugaaucugagcccucguggaggucaaagcaaccuuugguucugccauugcugcuguguggaaguucacuccugccuuuuccuuucccuagagccuccaccaccccgagaucacauuucucacugccuuuugucugcccaguuucaccagaaguaggccucuuccugacaggcagcugcaccacugccuggcgcugcgcccuuccuuugcucugcccgcuggagacgguguuugucaugggccuggucugcagggauccugcuacaaaggugaaacccaggagaguguggaauccagaguguugccaggacccaggcacaggcauuagugcccguuggagaaaacaggggaaucccgaagaaaugguggguccuggccauccgugagaucuucccagggcagcuccccucuguggaauccaaucugucuuccauccugcguggccgagggccaggcuucucacugggccucugcaggaggcugccauuuguccugcccaccuucuuagaagcgagacggagcagacccaucugcuacugcccuuucuauaauaacuaaaguuagcugcccuggacuauucacccccuagucuccauuuaaaaagauccccauggccacagggccccugccugggggcuugucaccucccccaccuucuuccugagucacuccugcagccuugcucccuaaccugccccacagccuugccuggauuucuaucucccuggcuuggugccaguuccuccaagucgauggcaccucccucccucucaaccacgugagcaaacuccaagacaucuucuaccccaacaccagcaauugugccaagggccauuaggcucucagcaugacuauuuuuagagaccccgugucugucacugaaaccuuuuuugugggagacuauuccucccaucugcaacagcugccccugcugacugcccuucucuccucccucucaucccagagaaacaggucagcugggagcuucugcccccacugccuagggaccaacaggggcaggaggcagucacugaccccgagacguuugcauccugcacagcuagagguccuuuauuaaaagcacacuguugguuucugcuc

SEQ ID NO: 867 - RNA, 655 nt, Homo Sapiens
agauugagcgcgcgcggucccgggaucuccgacgaggcccuggacccccgggcggcgaagcugcggcgcggcgcccccuggaggccgcgggaccccuggccgguccgcgcaggcgcagcggggucgcagggcgcggcggguuccagcgcggggauggcgcuguccgcggaggaccgggcgcuggugcgcgcccuguggaagaagcugggcagcaacgucggcgucuacacgacagaggcccuggaaaggaccuuccuggcuuuccccgccacgaagaccuacuucucccaccuggaccugagccccggcuccucacaagucagagcccacggccagaagguggcggacgcgcugagccucgccguggagcgccuggacgaccuaccccacgcgcuguccgcgcugagccaccugcacgcgugccagcugcgaguggacccggccagcuuccagcuccugggccacugccugcugguaacccucgcccggcacuaccccggagacuucagccccgcgcugcaggcgucgcuggacaaguuccugagccacguuaucucggcgcugguuuccgaguaccgcugaacuguggguggguggccgcgggauccccaggcgaccuuccccguguuugaguaaagccucucccaggagcagc

SEQ ID NO: 868 - RNA, 132 nt, Homo Sapiens
cuaccaccccgaacaccugaacacacccgaucuugucugaucucagaagccaagcagggucaggccugguuaguacuuggaugggagaaaugaguugcaugcaucuuuacucacugugagaacuggaagagu

SEQ ID NO: 869 - RNA, 563 nt, Homo Sapiens
uagauugcgacuuaauacuguuuuuauuaugauuuugucauauuuauuguagccaguaaaugaccugcgacauaacuauuugcaaaacaaauggggaagaccaagauaaagauaaguuauaucacaggaaagcaauugaaaaugcaaaaaugaagcaucugaaugaaggacuaauaacacugaauucagcuuuugugaaucuuaucugcagauauguacagaccacauccuaagauugacuucugccucaacagaaauacaugagccagugccuuauuggaaaugauuugcguguuuuaagaacugguguauauagguacaucuugaauguucugcuuuccuugccuuaugccuguacuucaccucagccuucaauuccauuguguuuccuugcuacuugguaucuugaaaucugguacgaaacuauugcaugaucccugcaccuuugcuucugcauauaucauagcucucuuauagugagugugcacaaucuauuucauuugauguaaucaaaguuuaauauauuggauaguuaaaaauaaaauacaacuuuaaaugcgcaa

SEQ ID NO: 870 - RNA, 1471 nt, Homo Sapiens
gcgcgcucucugcagaaaaggauuuucuacgcuccccgcccaucacuuggaucucgucuggggaggggcggauuuuuuuucuggaaguacccuucuucuccacgguggaggauuuaaggcugggcuccaaucgaggcggaggcugcagggcccgcggggcgccccccgcccggcgcacgccugcccggagcccgggaaggcgcagcccugggugggggggcccgugcacccccggaggcggcagcggcggugagugcuccccuucuucccgccuggcaccuuccgccagccaaggcagggaucgcggcagcaccaccaccccuccuguuaauuuccugcugaauugcagcucaacgcaugugcugggauuucaaguccugcccuaaucaauuuacuaccaccuccccaaccuuaaccccaaccuacacgcaccuuccuacgcuggccugugcgugcagccugcccuggccucuacugugacgccuaccacguuauauuuguaaugauuuguuuaugacuguccccauacuagggaaggcaucgagcuugaggaagaggccccauucaucuccguaccccaggcccugguacacagcaggcagugacuauauccucagcaccuagaacugugucugucaccuaauagaugcucaauaaaccugccaguaauuucagcaaaugaaacguggaacacgucaaggccagaggauggaaaaggcuccaguuuugauaaaaggaggccugcuuggcuuggaauccucucuccugcugguugggagaugcaaagauguuuccagagaggggcugaugaauugaggggaaagaaaugagcccaguaugaguccccuuucagggcugagcguguauaaaaccaaacaacuuggaaccgcuccaagagaggggauuaaagcaacauguuauucugagugauugcuuaauuuauugagcugcggcuggaucuguaaugaaauacagcccuuguaacugauaaccuccugcugccauugaacuucuacaauuaaggaauauuuucugaguuucucuggaacggcucugaauuuuuagccucugugguagggugcuucugaacauuuguuuuccaggcaauuuuuuuugaguauuaggcugauguuaauaaauaagcagcauuuuauugaguguuuugugggaaccaggaacuuuauauacauuguuucuaauccugacacuaauccugucaauauccagugaaauaaccccuauuauucccuauuuuacagaugugaagccacgagacguuaggucauuuucuagaguggugcuguccaagacaguagcugugauggcuccuuguggcuauugauguguaaauuaguuaaaauuaaauaaauuuuaacauuuacacccuagguugcacuaacaaugaguucaagugcccagcagccccguguacuguggcugauggcuaccacauuggacagugcagauauag

SEQ ID NO: 871 - RNA, 2600 nt, Homo Sapiens
auuaaucccugagacaaagguacugaaggcaaguggcugaagaacaggcuugauuggacagaugacuuggagauguucacuggacagggacagccuugugaagaucuuugugaauacccgaccucgcaagcuccagagacuacaauaauucacuugcccuagguuccaaagccagcaaguggaaaacggagacuggaauuccgcccacaggacuccaaagccugugcagcaacaccccacucccccggcaggaucaccagcaggacgcgcgggagccaggaaguaagauccguaccuccaaggcucccaugggcccaagccuccgcaucaacagacugggagggauuacguggggucccagggccggcucugaggcgggaaaacuuucuggaggcggcggccucaggccggagcgggcgcacaccgacuggaggggucggauucagggauguggguggaccgcauuuccccaucuuccccgccgcgcacuuccucuggugcaaucuccacaccccgcgccggcccgccugcaacgcgcccuggcacucaccggugggcgaaauuuccccgccuccacgugagagccagcuccgccgugacccggaaguccacuucgagucgccggcccacccucucggguuccggcuucuuccgggucgcggccuuccggcgaacgcgguuaccguggaaaccgcggccauggcggcaccgcggcaaauccccagccacauagugcgccucaagcccagcugcucuacagacucgucguucacccggacgccggugcccaccgugucucucgcgucccgcgagcugccugucucgucguggcaggucaccgagccgucaagcaagaaucugugggagcagaucugcaaggaguaugaagcugagcagccucccuuuccagaaggauauaaagucaaacaggagccugugauuacgguugcgccaguagaggaaaugcuuuuucauggcuucagugcagagcacuauuuuccgguuucccauuucaccaugaucucacguacacccuguccucaagauaaaucggaaacaaucaacccaaaaacauguucucccaaagaauauuuggaaacuuucaucuuuccuguucugcuucccggaauggcuagccugcuucaccaagcgaagaaagaaaaauguuuugagaggaaaagaaccaaauucauugccugugauuuucugacugagugguuauacaaccaaaauccaaagagggcaggggagccauucacagaauuuuucuccauuccauuuguggaggagcggcuaaagcaacacccacggccgccaaucccacucucgcuccugcugacagaagaggaagcagcccucuacauucaauccuucuggagagccugugugguucgcugugauccugagauucaagaacugcgucaguggcagaagaaacuucgcgaggccaagcacauucaccagcaagucaaaauuuucugggccaagcaagaacaaaaagugaaaugcaaaauggaggacgaugcaguaccugcagccaagaugaaaauuccaucaucuuaaccauagcuaagacguaucuuugcccauucgagcacaaguuaccuugugcaaggaaaauguccaaaugaugcucucucucuugugauuucuuuaacaagacuuggaacaugugcaaauggaaucuuuucuguacaagauaggauucauugcaaacaagcuuuaaugcaaauaguuuagaaaagaaaggaccagucuucacuuucugcauuauccccacauuuuauucauucauccagauuacuucuucagugccucaggaguauucuucuacaccagcugcuguuaaaauguacaaugaacucuagucccaaggaauacagaagugcucuuauuaccaguuuucccacuuguggccgccuuugcaaagauccauauucuaauuuaaguccccaaccucugaauuugguuuuaaguuuaccuagugacugacuacucucuuuauaaaaaagaccuuauacuuaaugaucauuuccaaaggagaccacuccuuaacuuuuacugcaaacccaacaagaugagacacuuaaacccagacagauguaacaaaggauuuuuguugucuaagucccaaaguauuauauagaaaguuccugcuuuuauggguaaacuuauuaccuuaauauguucugugguuugcuguuaaccaagauucucccauuuaaaaugccacagaccgacccucaaggcagauccgaaagccuaguaguuaguugcacuggguuguuuugacaagcuaccacacgucuuaaguaaauaguaaagccuuuauuuuuguguuaagaacagcauuuugaaaauaaaaccuaucugcccaugguuuacagccuuuuaaauuuguaauauuuauauagucguuuaugguacauauugauugucuugaaauuucuuuaacuucuuuuuuauaaguaugcaacagucagccgggggaagauaaagguacauuauaaaacacacauuaaugcauuuaauaaauauauauuaucuaucaaaagugagccuuagcucuucaucaguuaauaaaaagcaccugcugagaa

SEQ ID NO: 872 - RNA, 3309 nt, Homo Sapiens
uuggcuggugcaccuaaauaauacauauauccuccucaaccccaucggucucucugauuccuaaaucauccccaaacauuucugguggcccauauggggauuggagauaacagauuuacugucuccuuugcccaugggacuagggcccuggggcuguggaagaccuggcauccaaggcaugccaugggggaguuucacccggauggagacuggcucuccccgcauccugcccagcagugcaacugaaccugagauggggcugcaggaugacaccagcacuucaggaaccgcguugcaggugucacaccuuggauucaccauagcuggcugaaacuagcagcagcagugacucccgacuaugaccaguggauuaaccaacaagacccugauugccccacccgaauagaccuacggcgaaucccaaccaccaguaagaaggacaacugcccugcucugaccacacuggaggcuggucagucuacacauggcugaagcuugaagaucuugcaagcucugcucuagucacauccuggaagcugacuagucuacacacagccgaagcuaagaggaccaucucuagauaaguaaauguagauaaaauuuauaagccuaguuauaauuguucuguuguuacauuauuacugcaaaugcugcaaauguccaugcccagaggaagguuugccauuccuauguguaguguaagcauguuucuauuacauacacuaauguuguuaccauuucugccuauacuagaaggggagaaaucucuagaaggaugcccacacuguguacauacuaccuggguaaggaauaccauaguuaaaacucuacuguaccauaccuacaguacaggaaccaaguuaggaaccugcacauacaaccagaccaccuauucggucugugacccaggaaauaaucagcuauauguauguuaugacccuaagcucuuacccuaugaauucugguuugaaauacauauuaaaucagagggagaaaaagaaggagaguuauagcucgaacaaaagaagccccucccuccuguaaagggccuauuuccuuguacuuugaugccugcuaugcugcauauguucacaauccuaaaaaaaaacagaagcagucugcaaugguguaacacaagagaggcuuagcaggagcagcccuaagcaucuguacaaagaaccacaaaucggaugcccagacuguaacauucagugguccacacuaacacaacuccaauauuuauauucaggaaggagugcucugcuaaguaguauguuaaccaaaccaaacuguaagacaagaacaugcaauccuuuacauuuuacuaucuuaaagccagagauaccuuucuggucuacaggacagacagcacuauaacgacuugauagacuaggagcaggccuuggaguuccacuacuaauugucaaaaagacuaaaaggacucaaaugcauccaaccccgcaauucuggguccauaaucauucuauaagcauuuggauaagccagugccugagcuucccccaccaaccaaaaacuuauuugcucaacuagcugaaaacauagcuggcagcuuaggaauuuccucaugcuauguacguggaggaacuaauauggggaaccaguggccaugggaggcaaaggaauuaaugccacaagauaacuucacuucgcuuaacccugccagugaaccaacagccucagccaguguuugguuguuaaaaaccuccauaauuggaaaguaccguaucgcccguuggggaaaggcuuucacagaggcaguaggagaaauaaccugccuagggcaacaguauuaugaugagacuaaaaacaaaacucuauggagaagcacccagaauuacuccuacuuaccagauccaaauccuuuaucuccauucucuacccuaagccacacuuggcaucaacuagagguuccaaaugcuucgaaagcacccucuggccuauauuggaucuguggagcaugggcauauuggcaacugccagcuaaauggacaggagcauguguguaguaacaaucaagccauucuucuuucuaauuccucuaaagcaaggggaacucuuaugguauccaguugaugaugaaaauaaaagaagaacuagaagagcauaaucacaaaaauagacacaaaugucaaaaaggauguggacauaggagacuggaaagauaaugaauggccuccugaaagaauaauuaaauauuauuggccagcuaccugggugcaagaugggucaugggguuaccacaccccaaucuauaugcucaacugcaucauaagguugcaggcagucuuugaaauuauaaccaaugaaacaucaagggcacuagauuuauuggcaauacaagcaacacaaaugagaaaugcuauauauugaaauagauuggcauuagauuaucacuuagccucugaaggaagaguauguggaaaauuuaauuuaaccaacuguugccuagaaauugcuaauaauggccggguugucauggaaaucagagcuagaaugcacaaguuggcccauguuccaauucagacuugguccuaauggucccuggauucuuuguuuggaggaugguucucaaccuuuggaggauucaaaacccucacugguggguuuuuguuuauucuuggcaucugccucauccucccuuaccuuuuaccccuguuuauuaggaggauucagucaacuauagaggcaguaauaacucaacacacuaccgcacaguugauggcauuaaccaaauaucagccacugccaguagaagaagcucagcucugugaagagguggcaaauaguggugcuuucuauuaacaccuuuguuauaaaaagcaacaaaggggggaaauggaacaggaauuaaaagaaauuaaagaaugcauaagcaaaaacucaauuguauguagggaaacccaauuccuccugaggaagagaaagagguggaguccuuuaaaaauucacugccuguuuuuccgucuguagcuagugagccuuaucucucccuuucccaggcauugugaagacccuguuucuccagcugugcagcugcauggucacuagacagauaaacucaaguuguaaaacauguuuuuccuugaaaaguaagaaaugauguaauacaugucucaacugaauaacugucuuuguuucucacuucuguaguaagcuucccccugcacagaucuccccucucaccccaugaaaugcuuaaaagguaaccugacucuuuguucagggcucaguccuuuggauguuaaucugacugggcuggugcaccuaaauaauaaauacauccuccuc

SEQ ID NO: 873 - RNA, 4901 nt, Homo Sapiens
gaguugcuuggaggagcuuggagaaaccagaagugagauccaggagaaguaaggcccuggagugccaggagcccuucucccaaagauggagaaauaaaugaagaaauacaggaaaauaagcauuggguguuuugcaauggcuacacaaacuagucaugucuuccauggucaagaaaauauguuucuggaaaaccauugcauuaggagaaacacuggcagagauucaaagaagccacuaaagcagaagaauaugaauggacuugggcaaaauucggacaauggauuauugguuacacauguuaaccagacacaggacuuacugaggcugcaggggagugagacccagucuucagauugggaggacucugaagacuggcuuucggcucacaguuuaaaaugucagaaacucaccuuggcugaccugauaagccagggcacagaagugcuguaagucugaagcuguuccccgcaccccccacagcugcagugacacaugcaacccccugggcccgagagauccccucauaaggcuuugcuucuucagggaggagggcaccaaugucgugcagaaaauauguuucuccacccagaucauccgccauuuugagucaaagcuuucugacacuauugaagucuaucaagagagaauucaguggcucacagaaaacagcaagaaggcauuuggccucaucaaaggggccagagucagcauccucauagaugugucagccaucagcaguggcccucagaaagaagaguuccaaaaggaccucaugagccucaucgaugagcagcugagccacaaggagaagcuguuuguccuguccuuuggcaccaaugccgggucccucuggccagaccccauggaagucagcgccuccacccuccaggaacuuaagcucuggguaaagacgcugcagccugauggaggcagcaaccugcuacaagcucugaagaagaucuucacucucaagggacuggauucccugguggccaucaugagaagcugaaaaagaaaaggaagcccagaucagccuucugaaauccugucugacuacauccagcaguccaccaugggaagagaccucaucauccacuucaucaccuacagaugcgaugaucagaugcccccugcuguccugaagaaccuugcagaagcuguuaggggcuacuaccacugcuacagcccaaagauggagcacuacaccagccgggacauggaugagcuccuggcagaaauucagaaggcccagagccuccucagccacgugcaagcccugcagcacagcagccccugugaggcgcucaccugcaccauggaggagauuuccacagagauuacaaaugggccacucauaagccucuugccuaaacccccaaagcaugacgcuccucucaccauugaguuuccaaacuuggacaagacuucugcagaguggcuuaaggucaauggucugaaagccaagaaauuaagucuauaucagguccuggcacccaaugcauucucuccuguggaggaauuuguaccuauucuccagaaaacaguaucaucgaccauccaugagaaggcaaugauacaauuugaauggcacgacgggacagugaagaacauucauguggacccacccuuccucuauaaguaccagcaacagcucagcagagcuaugcggauguaugagaggcggauugaguggcucucccuggccagcagaagaaucuggggcacagucugugaaaaaagggugguuguacugcucgauaucucugcgaccaauuccauguacauuauucauauccagcacucccugcggcugcugcuggaggagcaguuauccaacaaggacuguuucaaccucaucgcguuuggaagcacaauugaaagcuggaggccugagaugguucccgugagucacaacaauuuacaaagugccuggcggugggcccugaaccugcggugucggggcagcaggaacguucucagcgcccugcggaaggcuguggaaguagacuucaaggacaaagacaaacaccaaucgcagggaaucuaccucuucacugggggcauccccgaccaggacauggacuggaccaggcacagagaaggcccuggagaaacauggccaggcugggcugcccagagccccacagcuucaaggcccucagcugcuggccccuccuaccuucucuuccccaccagccuacacucagugccuacauggcugaggccuguggcggcugcgaccuccagcugaacgugugucucuucuacgugggcgagccaaagauggacaccacacccccugcccgcuaugccagucacacugacacagccgccgccuacaaggaggucacccgggcugcagguggccgcuuccacugguuuggagacacaggcauuuaugagagcgaugacaucaacuccaucaugucugagauggaaaaggcucucaacuacucccaaaagugugccuuccucauggccucccugaagaaccauucaggaaaaguacugggaaguucagcccucccgaaagaaaaaccaaagacacuucagcuaagaagucagcccaagaagcucugcccucccaggcccaccgucccccugggggccagaaugagcauuaaagaugacccugacagagagaagagccccccgcugaaaucucugaaauggcguccacucaguagcagaguuggcaucucaccagcugcggcccagccaacgaaagaagggaugauggaacugaggaggaagaccaagucaagggaagcagagacaucucuuuuacuguucuacacagagaaagggaaugacgugggcucaguguacaagaaguacccucaaggaaggggcuugagaaggacuagcucuucuauugacuuacccagaaaggauacaguuugcucaagccaagaguggguggcaaaauaugggcucaaaaaauugaagcuggagauuuccagaugcaugggucccaacugcacucaucaaaagucaggacagaggucagcauccgccaaacacugcagcaucuuccccagcguugagauccauggaguggugagacacauccaguggacgcccagggagauggagguguacaucaggcacuuggagaagguguuaaggcgcuauguccagaggcugcaguggcugcuguccgguccaguccucugcaguaggaccugguauagacaguccauggacaggggcgucaugaugacugcugcuucagggagccgccgacuguuuggcaccguuuuggagagcaaaguaugcauauugcuggacacgucaggguccaugggccccuaccugcagcaggugaagacagagcugguuuugcugauuugggaacagcugcggaagugcugugacaguuuuaaccugcucagcuuugcagagagcuuucagucauggcaggacacgcugguggagaccacagaugcagcgugucaugaggcuaugcaaugggugacccaccugcaagcucagggcagcaccuccaucuugcaagcauugcugaaagcuuucaguuuccaugaucuggaaggauuguaccuccugaccgacggaaagccagacacaagcugcagccuuguccuaaaugaaguccaaaaacucagggagaaaagagaugugaaagugcacaccauuuccuugaacugcucagacagagcggcgguugaguuccugagaaagcuggcuuccuucaccggcggacgcuaucacugcccugugggugaggacacacucuccaaaauucacagccugcugaccaaaggcuucaucaaugaaaaggaucccacauugccaccauuugaaggagaugauuuaaggauccuggcccaggagaucaccaaggccagaagcuuccucuggcaggcccaauccuucagaucccaacuccagaagaaaaaugaugcagaaccaaaggucacucuuuccuagagaaguguucucagaaaagucauccugcaaaggaccacucacugagcaaaucucagccccgagggcaggaugggaugaaaugcugugaccugcaggaaacaugauuccugguaccaggacucucuggaagcugaggaaggaaagacuuugucuuuugugugaggggccauucccgggucuuaaucuaacucuccagcccugucccgcagcgcacucuacucuccagccacuagauugucccucucugggaagcccuaaaccaacccccugccuaaaugguggugcuucuugcaaaccaacccccugccugaacggugcuucuugcccccucugccuggagacuccugcucauccaucaaggcacagcucaaaugacaucagcucccugggaccuaucuagagcgaggggccuccagucuuucucuugcagcauccugaccacgcagaccucucgcacucagcacucuaugucacgccaccuugcucgcugaucuaacucuucuccuugauggugagcuccuucgggaugagacuggugucccaggaucugcagguccccagaagcugccacauaggagacacauggugaacagugagcaggcggcugagcugugagagccuagcucuggaaagcagcugaugggguggucuccacccugguucauaagaggcuaaugcagagucacagucagcccauccugggggaagaagaaacaagugagccucagcaccacccuccaucccugcccaaccaaacugaagugaaggcugcucaucuggguucauuuucuaaaauuaaaaacaauuaauuuuauucuacuaauaggaucaacaugacuuuaacuguuugaagugaucauuggcgugugugugugugcauaaauuuuuagugacauaaaacuuuauuaaaagacucauaccauaauaaagaauuucaauaagaaaaaga

SEQ ID NO: 874 - RNA, 215 nt, Homo Sapiens
uauccuaaacaugugcuuguuaccuuaugcaacaacauggcugaucugacuccaccauuaaguccuaguuccggguaggaagaaagccaagagcaaaaggugucaccuacgugcuagcaaagucuguccaaaaaccugcugggaggagauuuuacagaaaacccacagaacaacuagagagaguguccccagucacaauuggagucuuauguaag

SEQ ID NO: 875 - RNA, 326 nt, Homo Sapiens
ugugacucccagggcuacguggguucaaaaacaauuuaauacaaaaacacaagcagguuccccuccucuccuuugccuuuggucuggcucuccccaucgcuggguucagugccugacugaauggaaaacccgucgucuugcagccacuaaccugugagcgccggguaccuggagaccaggccccucugcugggggcccccaggagcggugccccaucauuuugcagcccacugacucccagccuggugugaaaacugaggcccggagaggugaugugauuugccuaaagucaugcaacuaguggcagagccaggccuagacgccag

SEQ ID NO: 876 - RNA, 11151 nt, Homo Sapiens
ggcggcggcggcggcggcggcggcagcgggucgguguagaaaauggcgcuggugcagcggcucgggccucuccccgcggcgcugcggagggcuugaggcucgcgagccuccuucgccgcgccccacuugcucgugcacuuuacacacaugagagaauuggaagcuaaagcuaccaaagacguagaaagaaaucuuagcagggauuuagugcaagaagaagaacaguugauggaagaaaagaaaaagaaaaaagacgacaagaaaaagaaggaagcugcucaaaagaaggccacugaacaaaaaaucaaagugccagaacagauaaagcccaguguaagccagccucagccugccaacucuaauaacggcacuuccacagcaaccagcacuaauaauaaugccaagcgagcuacagccaacaaucagcagccacagcagcagcagcaacagcagcagccgcagcagcagcagccacagcagcagccacagccgcagccgcagcagcagcagccacagcagcagccacaggccuugccucgguauccucgugaaguaccuccacgauuucgccaccaggaacacaaacagcuucuaaagaggggucagcauuuuccuguuauagcagcaaaccuuggaucugcuguuaagguguuaaacagccagucagaaagcagugcuuuaacaaaucaacagccacaaaauaacggagaggugcagaacagcaaaaaccagucagugaauaaguagcagauccuggacucacaucaagaucugucugacuccaaagauaugcuuguaaccaccaugcugugcuuuggcaacauacaggaugugauugguaaugaggaagaggacacaaauauauaaaccacaguacuucaggaucccauuaugaaaauucccagcggggaccugugucuucuacaagugauucuagcacaaacuguaagaaugcuguuguaagugacuugucggaaaaagaagcauggcccucagccccuggcagugauccggaguuggcuucagaauguauggaugcugauucugccuccaguucugaaucagagagaaacaucacuaucauggcuucagggaacacagguggugaaaaagauggccuucggaauagcacuggacuugguucccaaaacaaguuuguaguugguagcagcagcaauaaugugggccauggaaguaguacugggccaugggguuuuucccauggagccauaauaagcacaugucaggucucuguggaugcuccugaaagcaaaucugaaaguagcaacaauagaaugaaugcuuggggcacuguaaguucuucaucaaauggaggguuaaauccaagcacuuugaauucagcuagcaaccauggugccuggccaguauuagagaacaauggacuugcccuaaaagggccuguagggagugguaguucuggcauuaauauucagugcaguacuauaggccagaugccuaacaaucagaguauuaacucuaaagugaguggugguucuacccaugguaccuggggaagccuucaggaaacuugugaaucugaaguaagugguacacagaagguuucauucaguggucaaccucaaaauauuaccacugaaaugacuggaccaaauaacacuacuaacuuuaugaccucuaguuuaccaaacuccgguucagugcagaauaaugagcugccuaguaguaacacaggggccuggcgugugagcacaaugaaucauccucagaugcaggcuccaucagguaugaauggcacuucccuuucucaccuuagcaauggagagucaaaaaguggaggcucuuaugguacuacauggggugccuaugguucuaauuacucuggagacaaauguucaggcccuaauggccaagcuaauggugacacugugaaugcaacucuaaugcagccuggcguaaaugguccuaugggcacuaacuuucaaguuaacacaaacaaaggagguggugugugggaaucuggugcagcaaacucccagaguacaucauggggaaguggaaauggcgcaaauucuggaggaagucgaagaggauggggaaccccugcacaaaacacuggcacuaauuuacccagcguugaguggaacaaacugccuagcaaucagcauuccaaugauagugcaaauggcaaugguaagacguuuacaaauggauggaaaucuacugaggaagaggaucaggguucugccacaucucagacaaaugagcaaagcagugugugggccaaaacaggagguacaguggagagcgaugguaguacagaaagcacuggacgccuugaggaaaaaggaacuggggaaagucagaguagagacagaagaaaaauugaucagcacacauuacuccaaagcauuguaaacagaacugacuuagauccacguguccuguccaacucugguuggggacagacuccuauuaagcagaauacugccugggauacagaaacaucaccuagaggggaacgaaagacugacaaugggacagaggccuggggaagcucugcaacacagacuuuuaacucaggggcauguauagauaagacuagcccuaaugguaaugauaccucaucuguaucaggguggggcgaucccaaaccugcucugagguggggagauuccaaaggcucaaacugccagggggggugggaagaugauucugcugcuacaggaauggucaagagcaaucagugggggaauugcaaagaggagaaggcugcauggaaugacucgcaaaagaauaaacagggauggggugauggacaaaaaucaagccaaggguggucuguuucugccagugauaacuggggagaaacuucaaggaauaaccauuggggugaggccaauaagaaauccagcucaggagguagugacagugacagguccguuuccgguuggaacgaacuugguaaaacuaguucuuucacuuggggaaacaacauaaauccaaauaauucaucaggaugggaugaaucuucuaaaccuacuccuucccagggauggggagacccuccaaagucuaaucagucucuagguuggggagauucgucaaagccagucagcucuccagacuggaacaagcaacaagacauuguuggaucuuggggaaucccaccagcuacaggcaaaccuccugguacaggcuggcuggggggaccuauaccagccccagcaaaagaagaagaacccacaggcugggaggaaccauccccagaaucuauacgucgcaaaauggagauugaugauggaacuucagcuuggggagauccaagcaaauacaacuacaaaaaugugaacauguggaacaaaaacgucccaaauggcaacagccguucagaccagcaagcacagguacaucagcugcuaacgccugcaagugccaucucaaacaaagaggcaagcaguggcucuggcuggggugagcccuggggggagccuucuacuccagccacaacuguggauaaugguacuucagcaugggguaagcccauagacaguggucccagcuggggggaacccauugcugcggcauccagcacauccacguggggcuccagcucuguugguccacaagcauuaagcaaaucugggccaaaaucuaugcaagauggcugguguggugaugauaugccauugccuggaaaucgccccacuggcugggaagaggaagaggauguggagauuggaauguggaauaguaauucaucucaagagcuuaacucaucuuuaaauuggccaccauauacaaagaaaaugucaucgaagggucugaguggcaaaaaaaggagaagggaaaggggaaugaugaaagguggaaacaaacaagaagaagcguggauaaauccauuuguuaaacaguuuucaaacaucaguuuuucgagagacucaccagaggaaaauguacaaagcaauaagauggaccuuucuggagagguuaucagccagccaccuucuguuuacuagucuauuucaaguuaauuauuucaguaaaauaacaguaucuccuaauugcgacuucauuugugaggaaugcaaaauuuaugaaauggaaguguauuuuucacauacccuugucuuggcugaagucauuucaguuuggaaagugaguguuuugcuuuuguuguaaauuuaucugaaaccaauuggguugucuuccuguuugauaacagucuccugccuuuauuaggaauguuacaagacaaacgaauggagauagauaaacauagccuaaauauuggugauuacaaucgaacggucgggaaaggcccugguucucggccucagauuuccaaagagucuuccauggagcgcaauccuuauuuugauaaguuuuaccucugacuugauaaaccaguauacuucauagcguaauuuucacacuaauauuuuaaaaccuuuuauauaauauaaaguguuacaauccacuaccaaaucuuauuacuggauuuugaaguucacugucuuuuuaugucucaauuuaucauagagguugcauuuauauuuuucuucuuaaucccaugaaauauguuuggcucuuuuugugugcucuagaauuaacacuaauccgaucucuucuguuuucuaccuguuuccuguugaugcuggaaugucaugugacuucucuucuguuccugcaaugauuucucccuuccacuuguuugcuuggcugguguugcacaucuuucugucuguccaaucaggauggcauuguagcagaugaaucccaaaacaugcaguuuauguccagucaaagcaugaagcuucccccuucaaauagugcacuaccuaaccaggcccuuggcuccauagcagggcuggguaugcaaaacuugaauucuguuagacagguaaguccagauguguauuuuaggcucucaguugaaugauuuguauuaguaauaagaucucucuuacauguaguuacuguguuuaaaucauaguacagugugguaaugagauguuugucccuaaagaaucccacuguuacuuguugcuguuuguuuuuauagaauggcaaucccaguauguuugguguuggaaacacagcagcacaaccccggggcaugcagcagccuccagcacaaccucuuaguucaucucagccuaaucuccgugcucaagugccuccuccauuacucuccccucagguaaauaagcuuuccuuacauucuccuguuuaccugcaaaaaggaucuugcaugauuuuguauuugaauaaaauggcuaacuaagcauuaucauauuuauuggcaucuuugagauucagcuaguuuugaauuaacuauuaaaaaagguuguaguaaggaaaagucaaggauaauuuaaauccaaaauuuaccauuuucuucuuuaaaacauucuugagaguaggacaaaagcaaaguaaaauugacuaguuuaagaugcaccucugucaucuuuuacuuaacccacgaaaaaguguaagugaguggucaguuaguaagacagagacaaagacuauaacccccaaugaauaguccacaaauuuaacugcucuauugacaacugaaaacacacaguacguguaguuagugugaguuauuuuaucaagaucauuaacuuaccauugugauccuaagguuccaguuucauugcugaaguaugcaccaaacaacgguggccugaauccacucuuuggcccucaacagguagccaugcugaaccagcuaucccagcuaaaccagcuuucucagaucucccaguuacagcgauuguuagcgcagcagcaaagggcgcagagucagagaagcgugccuucugggaaccggccgcagcaagaccagcagggucgaccucuuagugugcagcagcaaaugaugcaacaaucucgucaacuugauccaaaccuguuggugaagcagcagacuccaccaucucagcagcagccacuccaucagccagccaugaagucuuuccuugacaaugucaugccccacacuacaccugagcugcaaaaagggccaucaccaauaaaugcuuucagcaacuucccuauaggcuugaacucaaacuugaauguaaauauggauaugaacaguauuaaagagccacagucaagacuaaggaaguggacgacaguggacagcauuucugugaacacaucuuuggaucaaaacuccagcaaacauggugcuauuucaagugguuucaggcuggaagagucuccauuuguucccuaugacuuuaugaacagcaguacuucaccagccaguccuccagguucaauaggagauggcuggccacgugccaaaucgccuaacggcucuagcaguguuaauuggccaccagguaaaauuuuuucuaacacuuucuuucaugagacuguguuuccauuaagguuuuguuacaucuggacuuacuacugauguagcccagaucggcgugcuuagacugacgugugcggaugagaaggaaugcagaagugauugaggaaaaguuaagcaugaagucuugggcaagugagugugucagccuguuaccuaugccuuuaugcucaagcagcagagguagaagugagccccauugaccagcaugaagaauuauauuaaaaacuuuaggcugggcgcaguggcacaugccaguaaucccagcacuuugggaggccgaggcgggcggaucacgaggucaggagaucgagaccaugcuggcuaacacggugaaaccccgucucuacuaaaacuacaaaaaauuagccaggcgugguggcgggcgccuguagucccagcuacaggaggcugaggcaggagaauggcgugaacccgggaggcagagcuugcagugagccgaaauugcgccacugcacuccagccugggcgacagagcaagacaacaacaacaaaaacuuuaauucgcuguuucucguaaguugugucagggaguaacuugcaguauuuucauucauacauaggaguuaccagaagugcuucuauggccugcuuucuccuaccugaguugcaguagcuuugugauuugucuuaaagcuuaaagcacuuuuaaauguuacuguuuaaaaauaaacaugaaucuggcggguacgguggcucaugccuguaauccuagcacuuugggaggcugaggugggcagguaacgaggucccaggagauggagaccguccuagcuaacacggugaaaccccaucucuacuaaaaaugcaaaaagaaauuagccggguauggcggugugugcccguagucccagcuacucgggaggcugaggcaggagaguggcgugaacacaggaggcggagcucgcagugagccaagaucaugccacugcacuccagccugggcaacagagcgagacucugucucaaaaaaaaaaaaaaaaaaaaauuucguccuggugagccauggaaagguuauccaaacauugacccugaaacugacccuuacgucacuccuggcagugucauaaacaaucuuucaauuaauacugugcgggaaguugaccaccucagggacaggaacagugggucauccucauccuugaacaccacgcugccuucaacuagugccuggucauccauucgugccuccaacuacaacguuccccucagcaguacagcacaaagcacuucagccagaaauagugauuccaaauugacauggucuccugguucaguuacaaacaccucucuggcucaugagcuguggaaggucccuuugccaccuaaaaacaucacugcuccgucccgcccaccuccgggacugacuggucagaagccacccuugucuacgugggauaauucuccccuucguauagguggaggauggggaaauucugacgccagauauaccccagaugagaagaucucaaaaagaugcagccuuuuguggcucacugcccuccucuguggugaacugggagccauucugagcucacugucgccagaggcagagcccccugccauaggaguuaaugccuggccauggcuagggcgagcugaaauucugggccuagggagaaagccucccauguagaagugcaaggaagugaaggaagucaagaggccaggugaucugcuaaguaacuguaguugggcucuuucaguccuggaaaacugacuuguccuuuuuuuccuuguuuagguuccagcuggggugagagcagcucagggagaauaacaaauuggcuuguucuaaaaaaccuuacaccucagaucgauggcucaacucugcgcacucugugcaugcagcacggcccgcugaucacauuccaccugaaccucccucacggaaaugcucugguccgcuacaguucaaaagaagagguagugaaggcacaaaagucucugcacauguguguacuggggaacacuacuauucuugcugaguuugccagugaagaggagaucagucguuucuuugcacaaagccagucucugaccccuucucccggcuggcagucucucggguccagccagagccggcugggcucccucgacuguucccacucauucuccagccggaccgaucucaaucacuggaauggugcugggcugucgggaacuaacuguggagaccuucacggcacuucacucugggggaccccgcauuauuccacaagccuguggggucccccaagcagcagcgacccccgaggaauuagcagcccaucucccauuaacgcuuuucuuucuguugaccaccuggguggggguggagaguccauguaacaguguagaugcagacucaccgaccgggaccucagacgcgagggaaaggagcacuaaguggggcucgccgccugcagccaggggccgccugugggaacagcuauucucugcacauuuuccacuuuguuuuccccaaaacauaucaguuugaauacuugaaucaugcaggccaauauuauaaugugaaaagguaucuacucuauuuacacucccaaauagcgccauacaugcuaaaccguagagaaugagcucgcuugugucuauucaucauguuuagccuuuggauucuuuuuuuuuuuuuccuucuauuccuccccaacccccccccccgccccuuuuuuucucucuugcaaaaccauuuuuugggcugauaacguaugagcuuuucccuuugcacugaaugauguucucuccgucucaucggcaguauggggggcagcugucccagugucaauguuuacucaaggguguucuuaggaggcgugcgcucucuacuaugccuugauguugccuaccuuauugugguaucguggaguuuaaaagaucaaguuaggaugcugacuuaggauuauuaaugaaaguguugcaccaguuuuuucauguuguaaaacuaaagaauuucgcucugcaguuugaaaaacuguggccacagcugugacuugcagcccaccugccacccaggacgggcccugcacuuugaauaggcuuuccauuuuguuuuggagguucucacuuugaaccuucuuguuuacagauuuuuuuguuuguuuuuugagaaaaaaaaauguuuacucuuccaucauuuaaaaaaaauguaaaagacaaaaaaaaaauggaggaugauuuaaaagaugcuuucuaucucugggaaaaaggagcagcauuuggccauguucuuuuguuuuucuauuccugucccaaaucaaagagcaugguucucaggaaaaccaguuccccaguuuaaaaaaaaaaaaaaaaauuccuuguaguuucuuagaggaaaaaaagaaaaaccccaacuuuuagcacugauacuacauauugcucuguuaaagaauuuucucugccaaaaaaaaagaaaaaacaaaaaaacgcuuaaagcuggaguuugacauucugcuuucagaugcugucuuuuuauuagugagugaugaugguuugcuaauaaucaauagguaauaauuuuuuguaaucccaucaaguggcuccauauguuucugcucucucgugacuguguuaauguuuaacuguuguaccuuaaagccgaaaucaguaacuaugcauacuguaaccaagguauugggcuuacagaguuguuuguuguauaaagaaaauuuuaaauguuguugcaaacuaacgaguuacaccauuuuaaacuuucuuuccuccccccuuuuuuugcccacaaaugguauuauaaugcuugcuuagucaaagaagagagacuaaacaaggguaaaaauuuuaacaguacagaauuugccaucauaucauugccuugauucuaacuguuuguguccuaagaugcaaaagaagucaguggcuuuuaacuguuuacaaauagaaugugauuguaaaauguacaguuugguuguguuugaauuaugaaauuucuucagauauaauaaaccaugacuuuuuggcugcucaacauuaauugucuccuuuuugugaauuuauuuguaggcucuuuuuuauaaugaaaguuucaaaguugcuauguaugaggguucucauagagcaaccgauuaaaaaucuaagcaaauauuugaacauuuuaucugaacucaucacaauuucacccugaaauaaugugagaacaaugggaaacuguagcuugcuccuucccacccucucugagcaucuuugggaucuuguugcucaaaacucuucugugacuucaucuuccccaccauuugugcccaucucaagccucagcaagaaaccauguggaacaugaagcuuaaugacuugacaguguacuaguguuaaacucucauaccucuguuacaaagcgagaaacgccacacccggacuggccuuuucuucccccuucacggcccucgcuucucccugcaggagcucgggggcgaaaccuguguauggauuucaguguaugacuucagaucaugcuccaacuugccaggugugagcuaauguugucggacaccuuacuauaagcaaauguuauucagugcguucaauguauauugacuuccauacugguuuuuccaaaaaccaaagguagcuuugaaaaaccaugucuggaaauguuuggagcguuaagcugauugaccuucugaccuuggggcuuugaguaguauauaauucauaacugcguuaauuguauuguuaaaguguuugggaguuuuuugcgcuuguuauguggaaauaaaguguuugauuuaaaauuuuuuaaa

SEQ ID NO: 877 - RNA, 2725 nt, Homo Sapiens
augggucaccccagcccuggcaucugcccagagcccgagaaggaaggaacaaugauccuccagcuaccucacagggcuggcacagugugccaaaucauucacccgucaccacaaccgaaugagcuaaggauucucauuauauauaguuuauggagagggaagugcagacauaaagaggugaauuaucuuacccagaucacacagcugauaagugguggaggcagaauagaaucuaaacaguguagaaucuaaacagaauagaaucuaaacaugcauugauuugacaaguguuuauugagcaccugccaugaacaaggccuugugugauuaaauaggguuauaauuaguaauauaaaaaugagaaaucacuaaugcuuuuuagacuuaacauuuucuuuuuuguagguuucaggcacagaacuguauauccaauaauagugaaauggaucccacuaauuaugacagaaaugaugauacauuuaaaugacuuggauguuuuauagguaugaucucaugaaaccuugagagaaacugaaugacgaaugaaacuauuguuccuguuucacacagaagaaaacugagguuaaaagggguaaaguaauuuugcauggcaugaaguagaaauucaaaguacaggaauuugaacuugguucuguccuuuucugaagccccuaugcucuugaccacuauagacucaaacaucaccuuguuuuuccacucauucaacaaacuuuuuuucuuaauugucuaauagguuggcacucaucaugagccccuguucucauucugcaaauggugaagcucucuauuguccugaccccacaguuccugucccaugaccagggccagcucaccaaggagcugcagcagcauguaaagucagugacaugcccaugcgaguaccugaggaagagaccgaagaagguuuggcagauagcagaaccuuuuugucucccucucauugcuccuaagccucacgcucccuugucccgcguguccuguugcuucccugaucuucuccgugaccuguagcuaaaccuuccaccagcgcuugagaacuuaauuugaaccggauccuuucccagaccccuuucuucuucuccuccuccuccuccaccuccuccagggcgcccugaaaggaccaggacaugcggcugcgcuuuuggcuccucauuuggcuccugcugggauuuaucagccaucagcccaccccuguuaucaauagucuggcugucuaucgucaucgugagacugacuuugguguaggaguucgagaccacccuggccaacauggcaaaaccccaucuccacaaaaauuggauaauuugauaauuaucauuauuggguuucugagauguuacacauuuaacauucucuucugcacaaguugccuuugugugucuuuccugaagacuaucuucuggucucgaaauggacaugauggauccauggauguacagcagagagccuggagguccaaccgcaguagacagaaagggcugagguccauuuguaugcacacaaagaaaagaguuucuuccuuucgaggaaauaaaauuggccugaaagacgucauuacucuacggaggcauguggaaacaaaaguuagagcuaaaauccguaagaggaaggugacaacgaaaaucaaccgucaugacaaaaucaauggaaagaggaagaccgccagaaaacagaaaauguuucaacgugcgcaagaguugcggcggcgggcagaggacuaccacaaaugcaaaauccccccuucugcaagaaagccucuuugcaacuggguaaguuuguuuguuuuccuugcuuuugaacauagucugccaggucaggacauggauacauuuuucucccuacagcucugugcucaagcccugcagagggagauggcagagaggaaggcugccuacaggcaucacagucccaucccuguugguaaccguguugugcaaaaacaccuucauccccacccaguggggccccugaucuaaauucaaagugucagagguuccauauuuguaauagcaaaugggcccugacuguaaauuagugaagagugaaugugucagaauggcggcagcggagcaucgucauucuucaggauugcccuacuggcucuaccucacagcugaaacuuuaaaaaacaggaugggccgccagccaccuccuccaacucaacaacauucuauaacugauaacucccugagccucaagacaccuccugagugucugcucacuccccuuccacccucaguggaugauaauaucaaggaguguccucuugcuccucuuccacccucuccucuuccacccucaguggaugauaaucugaaggaaugucucuuugucccgcuuccacccucuccucuuccacccucaguggaugauaaucugaaggaaugucucuuugucccgcuuccacccucuccucuuccacccucaguggaugauaaucucaagacuccucccuuagcuacucaggaggccgagguggaaaaaccacccaaacccaagagguggaggguggaugagguggaacaaucgcccaagcccaagaggcagagggaggccgaggcacaacaauuacccaaacccaagaggcggagguugaguaagcugagaacacgccauugcacucaagccugggcaauaagaauaaauccguaggucgaaaaaaagaaaaaaaucaaaaaacaaaacaaaacccacgcuccaaaaa

SEQ ID NO: 878 - RNA, 524 nt, Homo Sapiens
ugacacuugacuccuugccuacaucuauagcuuggcacagagagauucacgcacccucaagagugugggugagacauauacagccuguuagaccugaaggcagauggcucuucuuaaggccaauaaggaucucauuuccgcaggauugaaggaguucagcguucugcugaaucagcaggucuucaaugauccucucgucucugaagaagacauggugacugugguggaggacuggaugaacuucuacaucaacuauuacaggcagcaggugacaggggagccccaagagcgagacaaggcucugcaggagcuucggcaagagcugaacacucuggccaacccuuuccuggccaaguacagggacuuccugaagucucaugagcucccgagucacccaccgcccuccuccuagcucagggacccagccccuccucucugagaaacucugaccuucauguccuuaggcugugcuccugccacucuacccugacaccucaauaaagaccagugcugguuuuguugga

SEQ ID NO: 879 - RNA, 444 nt, Homo Sapiens
auggaguuugugcugagcuggguuuuccuuguugcuauauuaaaagguguccagugugagguucagcuggugcagucugggggaggcuugguacagccuggggggucccugagacucuccugugcaggcucuggauucaccuucaguagcuaugcuaugcacuggguucgccaggcuccaggaaaaggucuggaguggguaucagcuauugguacuggugguggcacauacuaugcagacuccgugaagggccgauucaccaucuccagagacaaugccaagaacuccuuguaucuucaaaugaacagccugagagccgaggacauggcuguguauuacugugcaagagacacagugaggggaagucagugugagcccagacacaaaccucucugcagaaugcuugggggaaaucagcugcggggggcacacaggacccacuga

SEQ ID NO: 880 - RNA, 4617 nt, Homo Sapiens
cgcgcccccgggccccugacacacaggagauucuucaggcucacuuucaagugcuucguggacugcuucugacugcgccgccugugacccgcaccccgccgcucucccgccgccccgucccccggcccggccgccccccggcccccggccggcccgcgcccucggggcccuccccggugccgccggugccccgcgccugaccgcagccccccgcagggugccgcgaccccagcccggccgugaggcccgcaggggccauggcgaagaagagcgccgagaacggcaucuguagcguguccggcgaccagaagaagggcccccucaucgcgcccgggcccgacggggcccgggccaagggcgacggccccgcgggccuggggacacccggcggcggccuggccgugccgccgcgcgcgauagaccuggacgcgccagauggacuucaucaugucgugugugggcuucaccgugggccugggcaacguguggcgcuuccccuaccugugcuacaagaauggcggagaaguccgggcagcgguuggccccugggcacgcggggucggggccgccccugguccaccgcugcugcucgguggcugggccguccgccuccaccccucucgcagucaugugccuggcagggugaggggcgggggccggcgaugcccgcgaggcugccccccagacuccugggcuggaaggagcgauuggccgccgaggugggaaagcaggccugcgccuuggggucuccucgaaguguguuccuuauucccugcauccugauagcccuggucggaggaauccccauuuucuucuuggagaucucgcugggccaguucaugaaggccggcagcaucaaugucuggaacaucugucccuuguucaaaggugagcagcccuuggccagccucagggacugcccccuuuucccagcuggcucccacuugagaaaucuuuuccuguccugagcaccaggccuggggccacgugauggcaucccagucucgaggggggagccuggaggagauguucaggccgcacagugaacuuggggaagcagggacuagagggggcauaggcagcuccacaaggcaaggacaggccaggcauagccgggcuggggaugggaccugcccagcacacuuggcucucuagguagguccuacuauuacuguccccaaggacgcuggggcacagacagguggagcgacguacugagguugcccacuacgggggcaacugucuccaacacuaccucaggcuacuagaaacucccccccuccccaccaccaccaccaccagcugcugaggacuggagcuacuggguggccagguggaggcuuggaccuccuggaaccgccaugguggcagugggacccacagaaggggccagguguguaaggcuggagacucaacagcacuuggucagauggggacaggaggagaggggcucgcucugccuugggucuagggggcggcuggaggagaggagagaggcuggggagucagcccaguguuggggcucacacaagggggaguccaggggagucaggagcaccacaaacaaggcuccagaaggacagacggugggagcacugccagccuggguggggagauaaagggguggcaggggagguggccaggaaagaaucuacauggcaaggacuucccggccccaggccugggcuaugccuccauggugaucgucuucuacugcaacaccuacuacaucauggugcuggccuggggcuucuauuaccuggucaaguccuuuaccaccacgcugcccugggccacauguggccacaccuggaacacucccgacuguguggagaucuuccaccaugaagacugugccagugccagccuggccaaccucacuugugaccagcuugcugaccgccaguccccugucaucgaguucugggagaacaaagucuugaggcugucugggggacuggaggugccaggggcccucaacugggaggugacccuuugucugcuggccugcugggugcuggucuacuucugugucugaaagggggucaaauccaugggaaagguaccacuagaggcaugcaggggggaggguggcucagcccugggagcuggaugucugugccaggcacacccguggcaacgggaggugaccagacagagucuagcccuaaggaagggggagguacugaaagccaagcaacacuccccacccugcaaauccagggcccagcagccuuugcuccuguggggagaggccccagcaggcacugucccuucccugugcccaucacccccaccggugcccuccugccagucucugacucuugugacagucugcuggaccuggucuggccaucuguuaccugccuaucuugccuuggggacacagagcagagucuggccacaucccuugggggcuccuggucaggcuggggagucaccugaacaaagaagacaauguccagagcugugggacauggccagcucccugggggacaagguccccagagcagcaugugggaagagggggcagacaguguggcagccgcaucuugccugccucugccuggcccaguuccacucuucaccugcucagccccgaccucucuccagaagaggaggggggcccggcccugauccaauaucccgcucccugccugggccucccaugcgugcacugcccacacacucacacagcucucacuccccacaugcuccaugccuccuguccccacugaggagagcucccagaggcucgcccgcuccccacugacaugcaucccugcagacaaacgaggcgcccagagagcuuccccacugcacuugccagggcugccggggcccagccuugccccuagcuuccucuggcgggagcuauggcucggaggagaauggggaccucugaacauaccugcccgcaagggggaccggaggugcucggagugggcuugugagggagguggugccgcaguccccgcugagcagccuggccccccagaucguguacuucacugcuacauuccccuacgugguccuggucgugcugcuugugcuuggagugcugcugccuggcgcccuggacagcaucauuuacuaucucaagccugacuggucaaagcugggguccccucaggugagguggagguggggaggcugcagcaggguguugugggggagcccugcaggccccucaugccugcacucuccagcccuccucuagguauggauagauguggggacccagauuuucuuuucuuaugccauuggccugggggcccucacagcccugggcagcuacaaccgcuucaacaacaacugcuacaaggacgccaucauccuggcugucaucaacagugggaccagcuucuuugcuggcuucguggucuucuccauccugggcuucauggcugcagagcagggcaugcacaucuccaagguggcagagucagggccgggccuggccuucaucgccuacccacaggcugucacacugaugccaguggccccacucugggcugcccuguucuucuucaugcuguugcugcuuggucucgacacacaguuuguagguguggagggcuucaucaccggccuccucaaccuccucccagccuccuacuacuucuguuuccaaagggagaucucuguggcccucuguugugcccuccgcuuugucauugaucucuccauggugacugauggugggauguaugucuuccagcuguuugacuacuacucagccagcggcaccacccugcucuggcaggccuuuugggagugcguggugguggccuggguguauggagcugaccgcuucacggacgacauugccuguaugaucggguaccgaccuugccccuggaugaaauggugcugguccuucuucaccccgcugguuugcaugggcaucuucaucuucaacguuguguacuacgagccgcuggucuacaacaacaccaacguguacccgugguggggugaggccaugggcugggccuucgugcuguccuccaugcugugcaugccacugcaccuccugggcugccuccucagggccaagggcaccauggcugagugcuggaagcaccugacccagcccaucuggggccuccaccacuuggaguaccgagcucaggaugcagaugucaggggccugaccacccugaccccaguguccgagagcagcaaggucgucgugguggagagugucaugggacagcucagcucacaucaccagcucaccucuggucuguggggcaagaggcugcaauauuccauccugggugucugggcugcuaaccuggccugcucaggcuucccacccugugcccugggcugggcacagccccaggaagggaccccggacacggcucccacauccaggcucaaggcggaugcacuuccugcaccuccagucuucuguguagcggcuuuaacccacguaugucugucacguccagucccgagacggcugagugaccccaagaaaggcuucccugacacccggacagaggcuggagggcuggggcugcgugaggguggugggccugcggggacauucuuacugugcuaaaaagccacugcaaacauagcaauaaaaaccugucauuuuccaaa

SEQ ID NO: 881 - RNA, 152 nt, Homo Sapiens
gacuuuuagcgguggaucacugggcuucugugucgaugaagaacgcagcuagcugugagaacuaaugugaauugcaggacagauugaucaucgacacuucgaacgcaauugcagcccggguuccucccagggcuuugccugucugagcgucg

SEQ ID NO: 882 - RNA, 1695 nt, Homo Sapiens
ugguccuggcagcccccgggcgccauagcagccugagggugcuccagcccggaagcuaagcaggguugauccuggcugggacuuggaugagggaccacuuggggagaucggggcuggaggcuuuuggcuucccgcucccuucccacuuuucccugcuuguuacaacauuucccgauucugugacccccccgccacccgcuucccacaugacugcauucuugcuccagcccaggaccuccuuuuggggcuccauuuggccagccccugggcaccauagcaaacucagggugccccagccgggaagguaagcagggucggucuuggcugggacuuggaugggggaccaccuggggagaccaagugcuggaggcuggcccaggaccucccaguggguuuccgucccagcagcccgggcgccacagcagucugacagcgccccaucccagaagcucaccugcaccccugcuguggaagaaaaccuaccuauagggguacucccuggcagcccaugaagccauaguagccugaaagugcucaagcccagaaaacaauaguuacuucugugagaugaauggaaacuauguuccaaugggauccaaaaugucccuucaaaaauucuacaaaaagacugcuuccaaucugcuuaaucagaacaaagguuuaacuccaugagaugcauccaaacauugcaaagcauuuucacauauagcuuuuuucuaguuuuuaucacgggauauucauuuuuucacuauagccccaauuagcuccaaaauguccauucauagauuuuacaaaaacaguguuucuaacaugcugaaugaaaacaaagguuuaacucugugauaugaauccacacauuggaaaguguuuucacagauaguuuguuucuagguuuuaucauggaauauucaguuuuucacuauagguuucaauuagcuccaaaacauccauucguagaugcuacaaaaagaguguuuccaaccugcugaaucaaaacaaagguuuaauucugagauaaauccacacaucacaaagcgguuucacagauaccuuguuucuaguuucuaucguggaauguuugguuuucuuacuaugggccucaaugggcucugaaaguucccuuagauauuacaaaaagauuguuuacaaccugcugaaucaaagcaauguuuuaacucugugagagaaauccaaaugucacaaaacauuguuagagguagcuugcuucuaguuuucaucacuagauaaucaguuucuuaauauaggccucaaugagcucagaaaugucccuuuguagauucuacaagaagacaguuuccaaccugcuuaaucagaacaaagguuuaccucuaugagaugaauccacacauugcagagaauuuuaacagauagcuuguuucuggaguuuacugcagaauauuugguuuuccacuauaggcuucaaugagcucaaaaaucgcccuucguagauucacaagaagaguguuuccaaccugcugaaucaaaacaaaguuuuaacucugcgagaugaaucaacauaucacaaaguauuuucaaggauaucuucuuucuagguuucauuaugagauauucccuuuuuaacuauguguuucaaugggcuucagaauguccccuuguaguuuguucaaaaagaguguuuccaaccuucugaauaaaaagaaaaguuuaacucug

SEQ ID NO: 883 - RNA, 111 nt, Homo Sapiens
gcccucggugcaauagcagccuaagggcacuugagcuuggaagcuaagcaggguugggccugucuggggcuuggaugugggaccgccuggggagaccgggcucuggaggcu

SEQ ID NO: 884 - RNA, 451 nt, Homo Sapiens
gccagcugucgggcacugacucucugggcuacauucucccguggguucucuuuaacccgcuugguuucaccgcaggggaaugcugaagagacacaaguguuuuuguuuucucucuuaaaaaauacagaaacuguaaucuguuuuacaucugggucugacugcagacaagcaagagcgggcggaauggagugaugggcaauccagcugcaagaagaggugcauaccccucuguagacagcacaucugugcaggugucuaacagccgccucauggaaggagucauggaagacguuaggccccuccaguugggaucaagcaacugaugcaagcuuuggaccaaaugaaacauuucaagaacucagauuguaaaaucacaaucagcuggaggaauucggaucugcaucuggcccagaagaacauuuuugaggaucuuuugaaaguaucacuaaga

SEQ ID NO: 885 - RNA, 457 nt, Homo Sapiens
agagggugccucagaagaggagaucagacuuagcaagauggugaugaaauucugggccaacuuugcucgcaauggaaaccccaauggggaagggcugccccacuggccagaguacaaccagaaggaaggguaucugcagauuggugccaacacccaggcggcccagaagcugaaggacaaagaaguagcuuucuggaccaaccucuuugccaagaaggcaguggagaagccaccccagacagaacacauagagcugugaaugaagauccagccggccuugggagccuggaggagcaaagacuggggucuuuugcgaaagggauugcagguucagaaggcaucuuaccauggcuggggaauugucuggugguggggggcaggggacagaggccaugaaggagcaaguuuuguauuugugaccucagcuuugggaauaaaggaucuuuugaaggccaaa

SEQ ID NO: 886 - RNA, 396 nt, Homo Sapiens
accaagccuuccacgugcgccuuauagccucucaacuucuugcuugggaucuccaaccucaccgcggcucgaaauggaccccaacugcuccugcgccacugguggcuccugcaccugcacuggcuccugcaaaugcaaagagugcaaaugcaccuccugcaagaagagcugcugcuccugcugccccaugagcugugccaagugugcccagggcugcaucugcaaaggggcaucagagaagugcagcugcugugccugauguccggacagcccugcucgaagauauagaaagagugaccugcacaaacuuggaauuuuuuuuccauacaacccugacccauuuacuguauuuuuuuuaaugaaauaugugaaugauaauaaaaguugcugacuuaa

SEQ ID NO: 887 - RNA, 2929 nt, Homo Sapiens
uaugucccuuugcagacaccugggcugagacauacaggacagagcauggaucgccuacagacugcacuccugguuguccucguccuccuugcuguggcgcuucaagcaacugaggcaggccccuacggcgccaacauggaagacagcgucugcugccgugauuacguccguuaccgucugccccugcgcguggugaaacacuucuacuggaccucagacuccugcccgaggccuggcgugguguugcuaaccuucagggauaaggagaucugugccgaucccagagugcccugggugaagaugauucucaauaagcugagccaaugaagagccuacucugaugaccguggccuuggcuccuccaggaaggcucaggagcccuaccucccugccauuauagcugcuccccgccagaagccugugccaacucucugcauucccugaucuccaucccuguggcugucacccuuggucaccuccgugcugucacugccaucuccccccugaccccucuaacccauccucugccucccucccugcagucagaggguccuguucccaucagcgauuccccugcuuaaacccuuccaugacuccccacugcccuaagcugaggucagucucccaagccuggcauguggcccucuggaucuggguuccaucucugucuccagccugcccacuucccuucaugaauguuggguucuagcucccuguucuccaaacccauacuacacaucccacuucugggucuuugccugggauguugcugacacccagaaagucccaccaccugcacauguguagccccaccagcccuccaaggcauugcucgcccaagcagcugguaauuccauuucauguauuagauguccccuggcccucuguccccucuuaauaacccuagucacagucuccgcagauucuugggauuuggggguuuucucccccaccucuccacuaguuggaccaagguuucuagcuaaguuacucuagucuccaagccucuagcauagagcacugcagacaggcccuggcucagaaucagagcccagaaaguggcugcagacaaaaucaauaaaacuaaugucccuccccucucccugccaaaaggcaguuacauaucaauacagagacucaaggucacuagaaaugggccagcugggucaaugugaagccccaaauuugcccagauucaccuuucuucccccacucccuuuuuuuuuuuuuuuuugagauggaguuucgcucuugucacccacgcuggagugcaaugguguggucuuggcuuauugaagccucugccuccuggguucaagugauucucuugccucagccuccugaguagcugggauuacagguuccugcuaccacgcccagcuaauuuuuguauuuuuaguagagacgaggcuucaccauguuggccaggcuggucucgaacuccuguccucagguaauccgcccaccucagccucccaaagugcugggauuacaggcgugagccacagugccuggccucuucccucuccccaccccccccccaacuuuuuuuuuuuuuuauggcagggucucacucugucgcccaggcuggagugcaguggcgugaucucggcucacuacaaccucgaccuccuggguucaagcgauucucccaccccagccucccaaguagcugggauuacaggugugugccacuacggcuggcuaauuuuuguauuuuuaguagagacagguuucaccauauuggccaggcuggucuugaacuccugaccucaagugauccaccuuccuugugcucccaaagugcugagauuacaggcgugagcuaucacacccagccucccccuuuuuuuccuaauaggagacuccuguaccuuucuucguuuuaccuaugugucgugucugcuuacauuuccuucuccccucaggcuuuuuuugggugguccuccaaccuccaauacccaggccuggccucuucagaguaccccccauuccacuuucccugccuccuuccuuaaauagcugacaaucaaauucaugcuauggugugaaagacuaccuuugacuugguauuauaagcuggaguuauauauguauuugaaaacagaguaaauacuuaagaggccaaauagaugaauggaagaauuuuaggaacugugagagggggacaagguggagcuuuccuggcccugggaggaagcuggcugugguagcguagcgcucucucucucugucuguggcaggaggcaaagaguaggguguaauugagugaaggaauccuggguagagaccauucucaggugguugggccaggcuaaagacugggauuugggucuaucuaugccuuucuggcugauuuuuguagagacgggguuuugccauguuacccaggcuggucucaaacuccugggcucaagcgauccuccuggcucagccucccaaagugcugggauuacaggcgugagucacugcgccuggcuuccucuuccucuugagaaauauucuuuucauacagcaaguaugggacagcagugucccagguaaaggacauaaauguuacaagugucugguccuuucugagggaggcuggugccgcucugcaggguauuugaaccuguggaauuggaggaggccauuucacucccugaacccagccugacaaaucacagugagaauguucaccuuauaggcuugcuguggggcucagguugaaaguguggggagugacacugccuaggcauccagcucagugucauccagggccugugucccucccgaacccagggucaaccugccuaccacaggcacuagaaggacgaaucugccuacugcccaugaacggggcccucaagcguccugggaucuccuucucccuccuguccuguccuugccccucaggacugcuggaaaauaaauccuuuaaaauagu

SEQ ID NO: 888 - RNA, 4496 nt, Homo Sapiens
aggccucccucgccagcgggguguggcuccccuccaaagacggucggcugacaggcuccacagagcuccacucacgcucagcccuggacggacaggcaguccaacggaacagaaacaucccucagcccacaggcacgaucuguuccuccugggaagaugcagaggcucaugaugcuccucgccacaucgggcgccugccugggccugcuggcaguggcagcaguggcagcagcaggugcuaacccugcccaacgggacacccacagccugcugcccacccaccggcgccaaaagagagauuggauuuggaaccagaugcacauugaugaagagaaaaacaccucacuuccccaucauguaggcaagaucaagucaagcgugagucgcaagaaugccaaguaccugcucaaaggagaauaugugggcaaggucuuccgggucgaugcagagacaggagacguguucgccauugagaggcuggaccgggagaauaucucagaguaccaccucacugcugucauuguggacaaggacacuggcgaaaaccuggagacuccuuccagcuucaccaucaaaguucaugacgugaacgacaacuggccuguguucacgcaucgguuguucaaugcguccgugccugagucgucggcuguggggaccucagucaucucugugacagcaguggaugcagacgaccccacugugggagaccacgccucugucauguaccaaauccugaaggggaaagaguauuuugccaucgauaauucuggacguauuaucacaauaacgaaaagcuuggaccgagagaagcaggccagguaugagaucgugguggaagcgcgagaugcccagggccuccggggggacucgggcacggccaccgugcuggucacucugcaagacaucaaugacaacuuccccuucuucacccagaccaaguacacauuugucgugccugaagacacccgugugggcaccucugugggcucucuguuuguugaggacccagaugagccccagaaccggaugaccaaguacagcaucuugcggggcgacuaccaggacgcuuucaccauugagacaaaccccgcccacaacgagggcaucaucaagcccaugaagccucuggauuaugaauacauccagcaauacagcuucaucgucgaggccacagaccccaccaucgaccuccgauacaugagcccucccgcgggaaacagagcccaggucauuaucaacaucacagauguggacgagccccccauuuuccagcagccuuucuaccacuuccagcugaaggaaaaccagaagaagccucugauuggcacagugcuggccauggacccugaugcggcuaggcauagcauuggauaauguguagacucaagccuuucuucagaucaggaaacuuuucuuuucuuuuuuuuuuuuuuuuuuuuuguuauuucuucuguucuguuuguucugggauuuuccucauuaauagcaacuauuauuccuauauacacaaaacauauauauuuaucuuuccauagauuuuuccugauuucugaaagaacuuuuuaaguuuuuuauuucacaaaguuaauuucuuuguaauuacuucuuaucucuuccagcucuuuuuguauuccuuccuggcucuugcccaaugaucuuuucauuaaucacuaaaacaagucccagcuauggugugaugucaccuguucagcucugaaagugcaucugauggucucagauacuccauccgcaggaccagugacaagggccaguucuuccgagucacaaaaaagggggacauuuacaaugagaaagaacuggacagagaagucuaccccugguauaaccugacuguggaggccaaagaacuggauuccacuggaacccccacaggaaaagaauccauugugcaaguccacauugaaguuuuggaugagaaugacaaugccccggaguuugccaagcccuaccagcccaaagugugugagaacgcuguccauggccagcugguccugcagaucuccgcaauagacaaggacauaacaccacgaaacgugaaguucaaauucaucuugaauacugagaacaacuuuacccucacggauaaucacgauaacacggccaacaucacagucaaguaugggcaguuugaccgggagcauaccaagguccacuuccuacccguggucaucucagacaaugggaugccaagucgcacgggcaccagcacgcugaccguggccgugugcaagugcaacgagcagggcgaguucaccuucugcgaggauauggccgcccaggugggcgugagcauccaggcagugguagccaucuuacucugcauccucaccaucacagugaucacccugcucaucuuccugcggcggcggcuccggaagcaggcccgcgcgcacggcaagagcgugccggagauccacgagcagcuggucaccuacgacgaggagggcggcggcgagauggacaccaccagcuacgaugugucggugcucaacucggugcgccgcggcggggccaagcccccgcggcccgcgcuggacgcccggccuucccucuaugcgcaggugcagaagccaccgaggcacgcgccuggggcacacggagggcccggggagauggcagccaugaucgaggugaagaaggacgaggcggaccacgacggcgacggcccccccuacgacacgcugcacaucuacggcuacgagggcuccgaguccauagccgagucccucagcucccugggcaccgacucauccgacucugacguggauuacgacuuccuuaacgacuggggacccagguuuaagaugcuggcugagcuguacggcucggacccccgggaggagcugcuguauuaggcggccgaggucacucugggccuggggacccaaacccccugcagcccaggccagucagacgccaggcaccacagccuccaaaaauggcagugacuccccagcccagcaccccuuccucgugggucccagagaccucaucagccuugggauagcaaacuccagguuccugaaauauccaggaauauaugucagugaugacuauucucaaaugcuggcaaauccaggcugguguucugucugggcucagacauccacauaacccugucacccacagaccgccgucuaacucaaagacuuccucuggcuccccaaggcugcaaagcaaaacagacuguguuuaacugcugcagggucuuuuucuagggucccugaacgcccugguaaggcuggugagguccuggugccuaucugccuggaggcaaaggccuggacagcuugacuuguggggcaggauucucugcagcccauucccaagggagacugaccaucaugcccucucucgggagcccuagcccugcuccaacuccauacuccacuccaagugccccaccacuccccaaccccucuccaggccugucaagagggaggaaggggccccauggcagcuccugaccuuggguccugaagugaccucacuggccugccaugccaguaacugugcuguacugagcacugaaccacauucagggaaauggcuuauuaaacuuugaagcaacugugaauucauucuggaggggcaguggagaucaggagugacagaucacagggugagggccaccuccacacccacccccucuggagaaggccuggaagagcugagaccuugcuuugagacuccucagcaccccuccaguuuugccugagaaggggcagauguucccggagcagaagacgucuccccuucucugccucaccuggucgccaauccaugcucucuuucuuuucucugucuacuccuuaucccuugguuuagaggaacccaagauguggccuuuagcaaaacuggacaauguccaaacccacucaugacugcaugacggagccgagccaugugucuuuacaccucgcuguugucacaucucagggaacugacccucaggcacaccuugcagaaggcaaggcccugcccugcccaaccucuguggucacccaugcaucuuccacuggaacguuucacugcaaacacaccuuggagaaguggcaucagucaacagagaggggcagggaaggagacaccaagcucacccuucgucauggaccgagguucccacucugggcaaagccccucacacugcaagggauuguagauaacacugacuuguuuguuuuaaccaauaacuagcuucuuauaaugauuuuuuuacuaaugauacuuacaaguuucuagcucucacagacauauagaauaaggguuuuugcauaauaagcagguuguuauuuagguuaacaauauuaauucagguuuuuuaguuggaaaaacaauuccuguaaccuucuauuuucuauaauuguaguaauugcucuacagauaaugucuauauauuggccaaacuggugcaugacaaguacuguauuuuuuuauaccuaaauaaagaaaaaucuuuagccugggcaaca

SEQ ID NO: 889 - RNA, 1151 nt, Homo Sapiens
ggcgcgggaguuggcauucggugguccuggcaguuagcugagcacgcccucugagccgcucgguggacaccaggcacucuaguaggccuggccuacccagaaacagcaggagagagaagaaacaggccagcugugagaagccaaggacaccgagucagucauggcaccuaaggcggcaaagggggccaagccagagccagcaccagcuccaccuccacccggggccaaacccgaggaagacaagaaggacgguaaggagccaucggacaaaccucaaaaggcggugcaggaccauaaggagccaucggacaaaccucaaaaggcggugcagcccaagcacgaagugggcacgaggagggggugucgccgcuaccggugggaauuaaaagacagcaauaaagaguucuggcucuuggggcacgcugagaucaagauucggaguuugggcugccuaauagcugcaaugauacuguuguccucacucaccgugcaccccaucuugaggcuuaucaucaccauggagauauccuucuucagcuucuucaucuuacuguacagcuuugccauucauagauacauacccuucauccuguggcccauuucuauuccuuuggaggaagcuagccagggugcaguguuuguugauggggacccuggcuuuggcugaggcugacuaaccucuccaccuucaggaccucuucaacgaccugauugcuugugcguuccuugugggagccguggucuuugcugugagaagucggcgauccaugaaucuccacuacuuacuugcugugauccuuauuggugcggcuggaguuuuugcuuuuaucgaugugugucuucaaagaaaccacuucagaggcaagaaggccaaaaagcauaugcugguuccuccuccaggaaaggaaaaaggaccccagcagggcaagggaccagaacccgccaagccaccagaaccuggcaagccaccagggccagcaaagggaaagaaaugacuuggaggaggcuccuggugucugaaacggcaguguauuuuacagcaauauguuuccacucucuuccuugucuucuuucuggaaugguuuucuuuuccauuuucauuaccaccuuugcuuggaaaagaauggauuaauggauucuaaaagccuaaa

SEQ ID NO: 890 - RNA, 7032 nt, Homo Sapiens
aauugagccaaccagggcuggcgggagggcgcuuccuucuggagcuggguccugacuagggaccgccugggugaggugaggaccugguggccgcaguuguggcacugugcgcaggcgcugaacugaccggacggagcgggcggcuguggccucgccagcugguuuaaaaauauccuuuuuugcugaaggaacacauuugcugguauaguuucagaaugucaaguacuguguccuacuggaucuuaaauucuacaaggaacagcauugccacauugcaaggggguagacgcuuauacuccagguaugucucaaauaggaauaaauuaaaauggaggcucuuuucccgggugccacccacccuaaacaguuccccaugugguggcuuuacucugugcaaagccuacagacacacaucaacagaggaagaugauuuucacuugcaacucagcccugagcagauaaaugaagugcuucgagcuggcgagacaacccacaagauucuugaccuugaaagcagagucccaaauucaguguugcgguuugagagcaaccagcuggcugccaauuccccaguggaggaccggcgagguguagccuccugccugcaaaccaauggacugauguuuggcaucuucgauggacaugguggucaugcaugugcccaagcagugagcgagaggcucuucuacuauguggcagugucccugaugucccaccagacccuggagcacauggagggagcuauggaaagcaugaaacccuugcugcccauccugcauuggcucaagcacccaggggacaguaucuacaaggaugucacaucugugcaucuugaccaccuccgugucuauuggcaggaacugcuugauuugcacauggaaaugggacuaagcauugaagaagcauuaauguacuccuuccagagacuggauucugacaucucgcuggaaauccaggccccccuggaagaugaggugacaaggaaccugucacuccagguugcuuucucuggggcaacagcuugcauggcccauguugauggaauucacuugcacguggcaaaugcuggugacugccgagccauccuugguguccaagaggacaauggcauguggucuugucugccccuuacacgugaccacaaugccuggaaccaggccgagcugucccggcuaaagagggagcacccugagucagaggacaggacgaucaucauggaggacaggcuacugggcguccucauccccugcagggccuuuggggauguucagcugaaguggaguaaagaguugcagcgcagcauucuggagaggggcuucaauaccgaggcccucaacauuuaccaguucacacccccacacuacuacacuccacccuaccugacugcugagccugaggucacauaccacaggcugaggccccaggauaaguuccuugugcuggccucagauggccugugggacaugcugagcaaugaggacgugguaaggcuggugguggggcaccuggcugaggcagauuggcacaagacagaccuggcccagagacccgccaacuuggggcucaugcagagccugcugcugcagaggaaagccagcgggcuccacgaggcugaccaaaaugcagccacgcggcugaucagacaugccaucgggaacaaugaguauggggagauggaggcagagcggcuggcggcgaugcugacauugccagaggacuuggcgaggauguacagggaugauaucacugucacugugguguauuuuaacucagaaucaaucggugcauauuacaagggggguuaagaaucucccauccuauugucaagguuaacauaaaugcucuucuaaaauguuucacuuacuccuaaacuagcuauccaaaccuuacuauuaaaagcgcaggcagauuuaauuugcuaaauagacuaacaggaggaaaaaaacaaacagccuagcuuuaaaaaacagugaaauagcagugauuucaugucccuguauguucugauuaagucuuauaugcagagaggacagagcauaaagucuauagaauuggcuugggcuuguguagccccagucauuugauaaagauguuguuaaacugugucagccugagccuucaaaggguaaauuuaaucaugauucugagaauaaagaacuucaggagcuucuuaggucuugccacaaaaaucugcaaauuugauaauucuccugaauucacaaucauggacuuguagacuaugaagagauauuuuauuuguuugucuuuuauuuaaauuacuaaggucuagguuuacaaagcauacuacaggacccuuuucuaugcaauauccuaacuuuuuuuuuugugauuaugcuugugagaaauuuuguaauacuacauucuaguucuguuuucguuuauuuuaaaacugaauccuuaaacuugcaaacacgccuacuguaagcaugcuuggaaugacuuguuuugguuuucagcugauaggaucuaugccucuggaccagcugaacuuacuggugcagcuuuuugugcccucuacugagucccauuccagaaacuuugagccaugcuaggagguaacuagucuaugccuuaacuccugaccuuuccugcauuaguaaaauuuccuccugggcugagccuuuggggguugauucacagcauuuaagcuuucugauuauaccucucaaacauucuucugucaauuccacacaauccuucuaccucugcuaugcugaaccccucauucacccugcaccugccaacugcaaaauauugucugaaagaaucuuucacauguuccugcuuccuauggcugcaggaaaggagaaaaugugauugcaugugguaguuguggugauagacguuuagacaggacagguuaauuuagcggauuguggacuuaagauucaaccucuaucuggagaggugaaaacacaaaggcuuaaggacaacaguuucuaaccaaguuucucugaauccuuuccugagagguggugggcaggagggaggagugagacuuaucagaugggacgcuugccccaagacugugggauaaaccaccauugcuaguccucaggaauuagaccauauuuaguauaggaguuggggcaaaaauaaaaguguaauuuguaaugguuucugugggcuguagacucuuuguauuuacuuggaaauucaguuauguggauccauuuuggagaugaauuucaucucaugaguugcuguggcauuuaaacaacaggaaaugugucccuaaauggaaacaaauauaaucccacaaaaccaacaauuuuauuugccucuacuacgucaggcagaauucuucaauuaaguugaacuacauuuguugaucccuuuucucaucuuaccccuuuaugccaccuacugaaaagaaaaacaaauagcuagguuugguuuccuguuuuuugucuaugucccagcugacauucagucaaauguugggauacuucuaauuuggugguguuucuuuguacauuuuucagugcaacuguuuagucauguguuuucaucuaagaaauuaucuuuugaauauuuaagccuugauccuuuuauucugaaaccauuaauauuccuucuuggcugggugcaguaguuuacgccuguaaucccagcacugugggaggccgaggcggauggaucaccugaggucgggaauucgagaccagccugaccaacauggagaaacuccaucucuacuaaaaauacaaaauuagccaggugugguggugcaugccuguaaucccagcuacucgggaggcugaggcaggaaaaucacuugaacccgggaggcggagguugcggugagccaagaucgcaccauugcacuccagccugggcaacaagagugaaacucugucucaaaaaaaaaaaaaaaaaauccaucuuaucucuuaguccguccuuccuuccuuccuuccuuccuuccuuccuuccuuccuuccuuccuuccuuccuuccuuccuuccucucucucucuuucuuucuuucuuuccuucuugacagggucucccuguagccaggcuggagugcaauggcaugaucuuggcucacugcaaccucugcagcccaggcucaaacgauccuccugccucagccucccgaguagcugggacuaugcaccaccaugccuggcuaauuuuuuuaauuuuuuguagagacaggguuuugccauguugcccaggcuggucucaaacuccuagacucaagcaaucugcccaccucggccucccaaggugcugggaugauaggcaugagccaccgcacccagccuaucuccuagaucuugaaucaaaaauaaaauguaaaucacuuccauucugcuagcaugaggguuuguugcuaaaauugaggauucuaucugacguuuacuuuuuguuguuuuuugagacaaggucuugcuuugucgcccaugcuggagugcaguggcaucauuauaacucacugucaaacuccuggacuccaauguucccuccccuuuuagccucccaaguagcugggucuacaggcaugaaccaucaggcccagauaauuaaaaaaacuuuuuuuggugaaaacaugaucuugcuauguugcucaggcugguugucuggcauuuucuuuguccuuuauucuuuauacuagcuaaacccuggaguauccuugaagccuuuacuggcauacagaguaccugaaucuuacuuuggagccuagcaugggucauaaauauaucugauucauuaaccugugagacagcugagagaacacagacuccuuaccuguaucuccaggcauaucugguuuuucucugccuaauagauuuuccugcuuucuaguuaguaauauugagaaagaagaaaggcuuauuuaucauuugcuuuuuuuccacugugaaucaucuguucuuuccaugaacauucuggggagcaccuccugauuaaacuccugucucccugaccacuauccugcugucauuggacuucuugaagcacaugggcuacugccccaggacacugggauuugagaggaguuuagugguaauugucaggucuuucaaagcauuuauuauuccuuuuauacggagauuucaguauugagacuuaaaaugaacugaaaaaugagauugaacauuuaauauuuuggauguaacuuuugaagaaaguaugcuuuggugcuuaaaauuguauaugauuuuagguaagaaacuuugauaauauuggcauaauuuagauuuauuuucuuucuuuuuuuugagacagucucacucagucgcccaggcugaagugcagugacacagucucagcucacugcaacgucugccucccagauugaagugacucucgugccucugccacagaguagcugggauuacaggcaugcaccaccacacaccgcuaauuuuuuguauuuuuaguagagacagaguuucaccauguuggccaggcugcgaacuccugagcucaagugauccucccaccucagcuucccaaagugcuagcauuacaggcaugagccaccacaccucaccagauuuuuaaaaaauauauaacugcaucucucuugauucuggggcuugguaaaaauggauagauaagauaguauucuaaauucaaauucguggcuaggcacaguggcccacaccuguaaucccagcacuuugggauuccaagacagaagacucacuugaguacaguaugagaccagccugggcaacauagaucuugccucuacaaaaaaaaaaaaaaauagccagguguggcacaugccuguagucucagcugcuuggaaggcugaaaugagaggaucucuugagcccaggaggucuaggccagagugagcugugaucgugccauugcacuccagacugagugacagagugagacugugucuaaaaaaaaaguuugaauuaaaaaaaaaaaaaaaaaagucggcugugcacgguggcucaugccugugaucccagcacuuucggaggccaaaguggguggauuaccugaggucaggaguuugagaccagccugaccaacaugguaaaacuccaucucuacuaaaaauacaaaaauuagccuggaauaguggcgcaugccuguaaucccagcuacuugugaggcugaggcaggagaaucccuugaacccagaaggcagagguugcagugagcugagauugugccauugcacuccagccugggcaacaugagcgaaacuccaucucaaaaaaacaaaaacaaaaaacaaacucaaauuagcaugauagaucaggcuacuuagauucagcuuucugagauguuauuuguuaacauuaaggcuaauuuauuauaaugaaaauguaaacuuugagguauguuaauauauaaacaucuuuuuccuuuggccuaaaaggucuuuaguauucagcacacuggguaaaguucaguuuagacacaaucaaauuggcaucuuuuaaacauaagugaaauauagagagcuugaacuugaguuacuuaaagaagauacaguauaauuaauuauacagaacaaaacaaagauguguuuagagugacucuggccugacucuuguccaucagccccuaguagccuaucuucagccuuugggaagucuuaacuucccagguuaaacuagaauauucuggaacugagcuguccaaauuucaucuuaaaguggaucauuugacucugaaacacgauucucauggcagaaaaagcccugguguuuccuuggagcuggggauaaaggccagugagccagccugugaugagagcugccccuggcacuaucugaguggaaagcucauugggacagccaugcagcuaucagagccgacugaagcccugucccuuaccccucaggcaccugaugcuuaacuugccuccugggaaauaaugaucuagcauuuacuuggaacaaugauuaaucauguucuuuaauaauugcugacauuuguauuuuaagcuguauaccaauguucguauuugacauugauuuucuaaccauuagagauauuuaauuaaaacuuggaaaugaaagaaacaaaa

SEQ ID NO: 891 - RNA, 529 nt, Homo Sapiens
guuuuauugcucugcaggucuccacccuggcaggaagcucuugccaccggcuacagucuggauccagccuggccaguuccaccuuucccaccuacaacaccuggcaagaccaagacacagcccuuccacaaauacaugaguacaugagcacgugggguggacaagccauccaaucaguccucacugacucugagcugggacaccugccuucugcccuuaaacaucagaacuccagggucucucgccuuuugacucugggauuuguaccagcagccccccaguguucucaggccuucagccugggacugaaagucuuggauugggcaaugcuaccagcuuccugguucuccagcuuguagauggcuuauccuaggacuucucagccuccauaaucccaugagucaauuucccuaauaaguccccucucaucucucucuguauauauccuauuuguucuguucuugggagaacccugacuaauacacuguguaacaucaggccaaucccuuuacuucucugugagucucug

SEQ ID NO: 892 - RNA, 77 nt, Homo Sapiens
uauaggcaugugccaccacaccuggcuuaaaugugucauuuaaaaauucaggccaggcacaguggcucaugccugua

SEQ ID NO: 893 - RNA, 94 nt, Homo Sapiens
cagccugaaaugaugacucuuuaaaaaauuucaugucucuucucugacauuuuucucuggacacaguuuuugccuuaugaaucugaucaggcug

SEQ ID NO: 894 - RNA, 3324 nt, Homo Sapiens
cgcccuucccccaccaccagcggcgagugggugacagagcccccgucuccgcgcgucuucgccgcccugcgccgugacccgcuguggcacugggccacgaguggaggcugcgccccuccagguacgagaggggcuuccaguucugccuucauaguucucugccuuugcccaaaacugcagaaaaugaacaaaucccagggaucaguuucauucacggaugugacuguggacuuuacccaggaggaaugggaacaacuggaccccucucagaggauccuauacauggaugugaugcuggagaauuauagcaacuuacuuucaguggguaaggacgguuuucagaaguguggaaggcugaugaccagauggagagagaccacagaaacccagacgagcaggcgaggcaauuuuuaauucuuaagaaccaaaccccaauugaggaaagaggcgaucucuuuggaaaagcacuuaaucugaacacagacuuuguuucuuuaagacaaguaccuuauaaauaugacuuauaugaaaaaacuuugaaauauaauucagacuugcuuaauaguaauagaagcuaugcaggaaagcagacugaugaguguaaugaauuuggaaaagcacuucucuaccugaagcaagagaaaacccacaguggaguagaauauucugaauacaauaaaaguggaaaagcccucagccauaaagcagccauuuuuaaacaucagaaaauaaaaaacuugguucaaccuuucauuuguacuuacugugacaaggcuuucuccuuuaagucacuccucauuagucauaagagaauacauacuggagaaaagccauaugaaugcaauguauguaagaaaaccuucucccauaaggccaaccucaucaaacaucagagaauucacacuggggagaaaccuuucgaguguccggaauguggaaaagcuuucacccaccagucaaaccucauuguacaccagagagcacauauggagaagaagcccuaugagugcagugaauguggaaagacauuugcccaaaaguuugaacucaccacacaccagagaauucauacaggagagcgacccuaugaguguaacgaaugugcaaaaaccuucuuuaagaagucaaaccuuaucauacaucagaagauucacacgggggagaaacgcuaugagugcagugaauguggaaaauccuuuauccagaacucacagcucaucauacacaugagaacucauacaggagagaaacccuaugaauguacugagugcggcaaaacuuucagccagaggucaacucuuagauuacacuugcgaauccacacaggagagaaaccauaugaguguuccgaaugugggaaggccuuuagcaggaagucccgacucaguguccaucagagaguucacaucggggagaaacccugaaacuccagccaggucuuacuguggaaaacuccugccagaacucuucaagcgggugaaaaaccucaugacaguauugagggaacaugggaauucauacugagaugcaaucucucaacucaaaaauguauuaaaaauaggaucccaugagaacauuauacuggaaguuacaugugauacccagcuaaagaauacauaucagaauauauccaguuguaaauagccauacccaguuguacuacaaugagcuuuuuaaaaucuugaaugaauugaguauucuagacagcagcauaagaaauauacaaacaguauccuaugaauuuagugguuuuauguggauaugccacaaaacacaagugguaugcuuuagaucugcacaugugaauuuagcauaaucacugggaauuugaaauucuuguccucugugauaauuaggacauaacaagauuuuccauacuaaacaucacauguguuuuucaguaucucugcaauccaguaugcauuccaaaugaaauguguaacauuuaaaguagcauggaaccuacgucuuucccuacugcuugcuggcauauaucaguugguaugaacauuguucuugagcugccucuuaggaaacagaagacaguguugaaguuuucccugcuucugguuugcugaagauuuucuagaagcacuauuuacacaaauaugcaaaugugaaauaaccgaucuauaacgugaaggaggcagacaugagcuguacuacucaguaugcaccacagaauaagaguuugccguguaaagacaauauccccauucgucaugcucuuauuuucccgugggauauuugcauacaaaugcaugucuguuaccaaaauauuguguaacacagacagaaaccaccuguuuuugucuuuccuuguuucccuuaauauuucaugaauugucuagcaaaaaugguaggaugcuucuguaguucacaaauguuacauuucagagacuuuagaggaaaaauuauuuuaaauaacugucaacuguuucauugcuuuuuaaauuuuucacgugcauaacccccuuuagaaguaaauuuuuacacuauuuuguuguuuaaaggaggcauuucuacuuccuugaguuuugcuguugccaaccuaaaacauuucccuuuggaacaugaguuauaaguuauuacuuuuccuuuacauguuuacacuuuuauaaaaaucagauuuuucaguggucucuccagauauuaacaagaauuguuguguaacucaaagauuugcuuuuauagacuugauuucaaauucuuaaguucagccuuucccuaucaaucacaaaucauguauuggaaauuauaaauggcaaccaaaaacuggcuuuuaaaaaauauuuuuggauaucauugaugugcugucacacuauauauugagugacuuucugaacaaauuuauccagaacauccauagcccaauaagcuuuugucuaaguugucaucuuacuuacucacaaaggaggggaaaacguuauuuucauagcugcuuuuagaaauguaaauuguaacagccuccuuggacaacauugugagucuguuuuaacauuaauauacucuuacaaccuaggaaucuccugggaaucuaucccuaaggaauaaaaagcgccagcacuuaagauuauauguuuacuaauguauauuguauuuuuugguaaggaccaaaaaaacaaacaaaaaaaagaccaucaguaagggaauggaugaauaaauugugguaaaaacauaccauggcugaaugguauuuccuugaaaagaaugugugggaacaaacuccaaacuucucuaggucaaaugaggaaagcaagaggggagagagagaguguauguguguguguagcaguuuuuauaaaauaaagauaaacccuuaua

SEQ ID NO: 895 - RNA, 3816 nt, Homo Sapiens
cgcaacuuccgggacagaggcuguggcuggaaggagcugggcauccggccugaggcgcagcggucgcguuaguucggcccaauggcggcaccgcugcuucacacgcguuugccgggagaugcggccgcuucguccucugcaguuaagaagcugggcgcgucgaggacuggacagaaaugagcucauuccuccuaacuggguaauagacauggguggggccuggaaaagauuucaaauaugcgugcauuagagaaugacuuuuucaauucucccccaagaaaaacuguucgguuugguggaacugugacagaagucuugcugaaguacaaaaagggugaaacaaaugacuuugaguuguugaagaaccagcuguuagauccagacauaaaggaugaccagaucaucaacuggcugcuagaauuccguucuucuaucauguacuugacaaaagacuuugagcaacuuaucaguauuauauuaagauugccuugguugaauagaagucaaacaguaguggaagaguauuuggcuuuucuugguaaucuuguaucagcacagacuguuuuccucagaccgugucucagcaugauugcuucccauuuugugccuccccgagugaucauuaaggaaggcgauguagauguuucagauucugaugaugaagaugauaaucuuccugcaaauuuugacacaugucacagagccuugcaaauaauagcaagauauguaccaucgacaccgugguuucucaugccaauacugguggaaaaauuuccauuuguucgaaaaucagagagaacacuggaauguuacguucauaacuuacuaaggauuaguguauauuuuccaaccuugaggcaugaaauucuggagcuuauuauugaaaaacuacucaaguuggaugugaaugcaucccggcaggguauugaagaugcugaagaaacagcaacucaaacuuguggugggacagauuccacggaaggauuguuuaauauggaugaagaugaagaaacugaacaugaaacaaaggcugguccugaacggcucgaccagauggugcauccuguagccgagcgccuggacauccugaugucuuugguuuuguccuacaugaaggaugucugcuauguagaugguaagguugauaacggcaaaacaaaggaucuauaucgcgaccugauaaacaucuuugacaaacuccuguugcccacccaugccuccugccauguacaguuuuucauguuuuaccucuguaguuucaaauugggauucgcagaggcauuuuuggaacaucucuggaaaaaauugcaggacccaaguaauccugccaucaucaggcaggcugcuggaaauuauauuggaagcuuuuuggcaagagcuaaauuuauuccucuuauuacuguaaaaucaugccuagaucuuuugguuaacuggcugcacauauaccuuaauaaccaggauucgggaacaaaggcauucugcgauguugcucuccauggaccauuuuacucagccugccaagcuguguucuacaccuuuguuuuuagacacaagcagcuuuugagcggaaaccugaaagaagguuugcaguaucuucagagucugaauuuugagcggauagugaugagccagcuaaauccccugaagauuugccugcccucagugguuaacuuuuuugcugcaaucacaaauaaguaccagcucgucuucugcuacaccaucauugagaggaacaaucgccagaugcugccagucauuaggaguaccgcuggaggagacucagugcagaucugcacaaacccgcuggacaccuucuuccccuuugaucccugugugcugaagaggucaaagaaauucauugauccuauuuaucaggugugggaagacaugagugcugaagagcuacaggaguucaagaaacccaugaaaaaggacauaguggaagaugaagaugaugacuuucugaaaggcgaagugccccagaaugauaccgugauugggaucacaccaagcuccuuugacacgcauuuccgaaguccuucaaguagugugggcuccccacccguguuguacaugcaacccaguccccucugacggcagaaauuugugacugagaugugacauuugggauuccccaucacuugucaugcccucagcacccagcuugugccauugggcauugauggcauugaacuagagcgagugccugccucggcuguggcacuuccagguucgacugaaucaagcaucugaagacuggguuuuuuuguuguuguuguuccccuuacagacaaaaugaagacuaucaugugcaaucuuuuacagugggguugaugauacauuuggaaggauuugcuuguuuaauauguacauuuuuuguguuaacagcuuuuugacacaauuacuggguaauuucuaauauaggcagcagacuguuuuacggguugcuguuuuaacauggguuuuugucagauccauggucuuaggacuugacugaugagcuuucagugaagaauccucuaagauaaaacuucuauuuaaagacuuuaacuagaaaguguuuauuuuggcuacauuguucaccuucugcuguauugguauuugucuguugggauuucaagggaguguagagaagacagaaggaaagcugagagcuggcccgacauggucugggacacagaguuggagcuggcacugaagaucuccagggacuucagagaccaauaaaagcccauagggaagagagagaggauauagggaaacagaaucagauguguaauauacuuggcacagcgaaaaaauggauuuaaaagacaaaaauggagguccagguagauguaauucacacagacugaaagugaguucgggcuuguguaaaacacaugagauuggauuugaccccuuggcucucaaguguccccuuagaucuagaacugcuccuugguggccauuagaucgagucaguuuugaucugcaucacuuaguuauugggaauuucuuuguuggaaacaggaaaauuuuuuuagauuauuugguguacgguuuugcucacaacaauagguggaaguugcuagugcagucuuggucugauggcugugugcaucgcacauucggcuuggugaaauccuucucuaaagccucuuuuuguauuuuuauaacuaaacagaggaagucuucagaagaccucgcuuuaaaacaaauuugugcaaacacugcuagagucauuuugaagcucaagcauuuucacuuuguuucuuacauguguacuuuuuuguuuacuugugaaaauggccaucuuuaagcauauuuauuuucugccacuuuauuuaaaggcaagcaauauuuucuugaucauaaauauuuuguaaugaaauacuuccucuuuuccagggcuuuguaugcacuuguauaauuacauugauggcaauguagaguuugaauuucagucuguaaauacuuuuuuggaaaauagaaauuuuuauugcuuuaaaguuuuggauaugggugguuuucuuuuccggguuugguggaaaguaauuugagaacuuuaagguugucuuuuuaacugcuggcaaaauguugauuuuuuaauauuagauaaaacgaguaaacgaaauuccccagaaauuaguaguaaguggggucuuuguggguugggaaguaguuuuaauguagaaagacauuuacauauaagucuguuuaauuucaaaggaguuugugaaaaaaaauccauggugaaaaugaaacaaugacaugguuaaucuggaacuuacguucuuauaccaauaaaagguaccucaauacauguucuuucaa

SEQ ID NO: 896 - RNA, 1076 nt, Homo Sapiens
auggcugcagccaacaacggcaacaagcccagaguccggaggaguaucugcuuugcggcaggccacgauacagagggcucccauagccacgucugcuuugaugagaggcuucaugacucgguggucauggccacccaggacagcgacagcagcuuucuggucaagguuggcuuccugaagauccugcgcagguaugagauuaccuucacucuucccccgcccagugagcaagcacguccgugaggcaccuguucccagccucugcaugucaagcuccucagcguuguuccugucccugaagguuacagugucaagugcgaguacucagcgcacaaagaggguguccucaaagccgcgaugcugccagccugcgaagguggcgccggcgccugugugagcguggcagugcaggcuggcgccaggggccgacaccacggcaugcccaccugcuggacggugucaagggcucgggcgccgcgcuggaauaagacucgcagcacagccacuggcacggcuuugacugaggccggaggcccugcccgccccgagcccucagccuuaaaccccgccugguccccgugacacgcugcgugaugguggcuuccucggcccucuccggggugggcgugggguggaguggcccuggccagccucccaccucugccuucauuccugccaccaccgugccucucccguccuccucuuccacuuccuccucuccgugugccucaggcuccugccagaagacauugguugagcccacaaggagacugucuggggaagggauggggagggccugggguggguucuccccacugcccaccccaacccacaggagcuccagcuagggucugggggaggauggagcuugcucugugacgucguggccccaucacugcugcugcugccuggcgucagccaccucuccugcuccucucucuucuccucugcuguccacaaugaguaggagggaggugcaguccccaccucucaccccucaggucuguguuacuugguuuuuaagugacugauugggauagaacccuaaagaaauaaaacuuccaguggauacgaaa

SEQ ID NO: 897 - RNA, 961 nt, Homo Sapiens
cggagaggagcggagcggcgcggcaggccgggcggguugcggcaguagcggaggaggccgcagcugcgagucccaggagcggaggcgacgcgggcggcggcugggggccggguggccggggucccgggccccgcggcggcagcgguaggaugaucaagcuguucucgcugaagcagcagaagaaggaggaguagucggcgggaggcaccaagcgcagcagcaagaaggcgucggcggcgcagcugcggauccagaaggacauaaacgagcugaaccugcccaagacgugugauaucagcuucucagauccagacgaccuccucaacuucaaguuggucaucuguccugaugagggcuucuacaagagugggaaguuuguguucaguuuuaaggugggccaggguuacccgcaugauccccccaaggugaagugugagacaauggucuaucaccccaacauugaaaucgagggcaacgucugccucaacauccucagagagaacuggaagccaguccuuacgauaaacuccauaauuuauggccugcaguaucucuacuuggagcccaaccccgaggacccacugaacaagaaggccgcagagguccugcagaacaaccggcagcuguuggagcagaacgugcagccauccaugcgggauggcuacauaggcuccaccuacuucgagcgcugccugaaauaggguuggcgcauacccacccccgccacggccgcaagcccuggcauccccugcaaauauuuauugggggccaucgguagggguuuggggggcggccggugggggaauccccugccuuggccuugccuccccuuccugccacgugccccuaguuauuuuuuauuaacaccaugugauuaaggucagcgcugccucccccgacccacucagcgaugggaaaugaauuggcuguucuagccccccugcugggugcuuguucagcc

SEQ ID NO: 898 - RNA, 1344 nt, Homo Sapiens
gcaguuagugaaacaaagaugaagacaucagucuucucccagagagugaagaacaggagugugaagaggaugguucagagacagagacugguggccaggaggaccuagaagauuuacaggaggaagaggaagugucagauauggguggugacaauccugaagugggcaagaaagcuagaaacucaagcaaauuugagcugaggaaaagcccaguuuucagugaugaggauucugaccuugacuuugauaucagcaaauuggaacagcagagcaaggugcaaaacacaggacauggaaaaccaagagaaaaguccauaauagacgagaaauucuuccaacucucugaaauggaggcuuauuuagaaaacagagaaaaagaagaggaacgaaaagaugauaaugaugaugagucagguaaaaguuccagaaaugugaacaacaaagauuuuuuugauccaguugaaagugaugaagacauagcaagugaucaugaugaugagcuggguucaaacaagaugaugaaauugcugaagaagaagcagaagaaggaagcauuucugaaaugugaguauuuugaaacauccuuuacuuugugagcuggaauugcccaaucaguguuuguauuugugguuuucacauauguuuguuuuaagaaguuagauacucuccuaucagaucuucucaagauagccagaggaaagucacuggauuuaaacggacauuagagaucauuuaaugaagaaaaauauuacugacaguagcaaucaaaccuuucuuaccaggaacuuugauuugguuuugugcccccaaaauccuguuauuuuugugagauaagagguuuguauuauagauugaugaauaauuuauuuucuauauauuggacccuuuuuguuucuuacauagcauuucacuuaaaugauagcuucucuuccuuaauaccugaaugauuuuggaaguucuaaguaucugguugcauuaggcauauaaaagaggaacuuuguuaagggaaaauauguuuccuuuuguuuuucuaauggaaaacaauauauuucuuuuuauaagaguuuugguaguguagggaugaaggugaucaccuggaagaaagagaagacaguaaacaauguaaagaaagcuugaaaagagugacuuuugcuuugccggaugaugaggcaacugaagaugcagguguuuuaaauguaaagaaaaauucugaugaaguuaaucuucuuuugaaaaaagacaggaaaagguaauuaggaauuuaaggaauuuuuaauaugcuucgcaugauuguggaacucacagacuacuaacaaaucuucccuauuuucuuucuuuuuuuuu

SEQ ID NO: 899 - RNA, 416 nt, Homo Sapiens
uucacauacaucuuaagcuccucaaggccagaaaugaggcuucauucacgucgaauuaaugaaacaugauuguccagauguccauccaggaauaaacuccacugcauggagccccauggugagacggacugcaggcuugcagccccacaccuaugcaccggcaacgugcccccaggaacacaggaccaacuccaaauuugggaaugaagauaauguucaggggaacacaggaccaacuccaaauuugggaaugaagauaauguucagcagcuacauuuucaccccaucccgggcuccauguuccugcugcacacacaucaagaaugcugcuaauuucagcgucugccuuccagacccagacgucaaaacaacuaccuuucaucucagcaaacuacuauguugugagcagcccaaug

SEQ ID NO: 900 - RNA, 405 nt, Homo Sapiens
acuccgccuuccacgugcacccacugccucuucccuucucgcuugggaacucuagucucgccucggguugcaauggaccccaacugcuccugugccgcugcaggugucuccugcaccugcgccagcuccugcaagugcaaagagugcaaaugcaccuccugcaagaagagcugcugcuccugcugcccugugggcugugccaagugugcccagggcugcaucugcaaaggggcaucggagaagugcagcugcugcgccugaugucgggacagcccugcucccaaguacaaauagagugacccguaaaauccaggauuuuuuguuuuuugcuacaaucuugaccccuuugcuacauuccuuuuuuucugugaaauaugugaauaauaauuaaacacuuagacuuga

SEQ ID NO: 901 - RNA, 135 nt, Homo Sapiens
agcacuauauuuaaaccuguggaugggaauauuccccauucuugguuacgcuguagugcaaaagaauuccuggcucucuguugcacagcugacuugugccauucugcuguugcuguauagaguuaaggaacaugg

SEQ ID NO: 902 - RNA, 1060 nt, Homo Sapiens
gggugauugaaccaagccuucaccgcaccgaguuugcccuacugcagucacccacaccgcggcucgcuuacgguuggagaaaucaaggcccuaccggggccaccucucuguugugggcguggacgaggcuggggugagccugccggagcugcaguugccagcgacauguucaagguaauucagaaggguccguggggccagccagccggagcuuguucaccuucagagucugugcagcaccgaaaaaggacucaccucccaaaacuuccgugaagguugacgagcuuucgcgagggcaaaucgcaguguguggaggagucaaggaaccagcuugaagaaagcuucucacagcuccgacacuuauugcgagccauacacaagcuggugucaggacacguacucccaaaguaagcccaagaugcaaaguuugguucaguggggguuagacagcuaugacuaucuccaaaaugcaccuccuggauuuuuuccgagacuugguguuauugguuuugcuggccuuauuggacuccuuuugacuagagguucaaaaaugaagaagcuaguguaucugccugguuucaugagauuagcugccucccuguauuauccacaacaaaccaucguguuugcccaggucaguggggagagauuauaugacuggaguuuaagauuuguggaaggagaacuuucaaaagccaggaaaugugaagaauucaccuggaacuaaguagaaaacuccaugaucugcccaucuuaacuuauuuaaguuaccuauauuaaguuaccuacaacuuaaucaguuauagguacacauuggaaacuccacagaguaaaucaguauuucuacagaaaaaugucagagaagucaguauugaauguauuaaauuggcuuucuucuucaggaaauacuagaucagaccucuguuaucuugggugguaccauccuacacgcaaacuaaucugaaauccuuucaccuagggauaauguacaaaccuuagaacuccucguuuucauguugcuauuuauuuacauaauuaaaacccaaauuaaaaaaaaaaa

SEQ ID NO: 903 - RNA, 75 nt, Homo Sapiens
uggagugggggggcaggaggggcucagggagaaagugcauacagccccuggcccucucugcccuuccguccccug

SEQ ID NO: 904 - RNA, 1999 nt, Homo Sapiens
aaaccagacagaccgaauuaacucuucugagucgcagcuuagaauauuugaccugccuaggagcugggcacaagccggcagcuaaccgccacgugggccuggguaggaggugagaucaggaagaucccugggccccuacuaguucccugccuggccuccucccccacucgugugggggucuacggagccagcgcuggggguggaagggcgaggaguccucgacgcugcagcggcgguuccggcccaugggggcgcucuccugcuugggggcggaaaagccguggcgcccccuugcguggcgcgucggucucagagucgcgugacuucaacccccucuucgggaggcugggucgucaugauccggaccccauugucggccucugcccaucgccugcuccucccaggcucccgcggccgacccccgcgcaacaugcagcccacgggccgcgaggguucccgcgcgcucagccggcgguaucugcggcgucugcugcuccugcuacugcugcugcugcugcggcagcccguaacccgcgcggagaccacgccgggcgcccccagagcccucuccacgcugggcucccccagccucuucaccacgccggguguccccagcgcccucacuaccccaggccucacuacgccaggcacccccaaaacccuggaccuucggggucgcgcgcaggcccugaugcggaguuucccacucguggacggccacaaugaccugccccagguccugagacagcguuacaagaaugugcuucaggauguuaaccugcgaaauuucagccauggucagaccagccuggacaggcuuagagacggccucgugggugcccaguucuggucagccuccgucucaugccagucccaggaccagacugccgugcgccucgcccuggagcagauugaccucauucaccgcaugugugccuccuacucugaacucgagcuugugaccucagcugaaggucugaacagcucucaaaagcuggccugccucauuggcguggaggguggucacucacuggacagcagccucucugugcugcgcaguuucuaugugcugggggugcgcuaccugacacuuaccuucaccugcaguacaccaugggcagagaguuccaccaaguucagacaccacauguacaccaacgucagcggauugacaagcuuuggugagaaaguaguagaggaguugaaccgccugggcaugaugauagauuuguccuaugcaucggacaccuugauaagaaggguccuggaagugucucaggcuccugugaucuucucccacucagcugccagagcugugugugacaauuuguugaauguucccgaugauauccugcagcuucugaagaagaacgguggcaucgugauggugacacuguccaugggggugcugcagugcaaccugcuugcuaacguguccacuguggcagaucacuuugaccacaucagggcagucauuggaucugaguucaucgggauugguggaaauuaugacgggacuggccgguucccucaggggcuggaggauguguccacauacccaguccugauagaggaguugcugagucguagcuggagcgaggaagagcuucaagguguccuucguggaaaccugcugcgggucuucagacaaguggaaaaggugagagaggagagcagggcgcagagccccguggaggcugaguuuccauaugggcaacugagcacauccugccacucccaccucgugccucagaauggacaccaggcuacucaucuggaggugaccaagcagccaaccaaucggguccccuggagguccucaaaugccuccccauaccuuguuccaggccuuguggcugcugccaccaucccaaccuucacccaguggcucugcugacacagucgguccccgcagaggucacuguggcaaagccucacaaagcccccucuccuaguucauucacaagcauaugcugagaauaaacauguuacacaugga

SEQ ID NO: 905 - RNA, 11240 nt, Homo Sapiens
aagcgcccgcgagccgccggccgggagggauccggguccugaagagaaauaugaaacgcaaugggagcagaaauuguuugaauaggagaaguagguuugguucucgagaaagagacuggcuaagagaagauguaaagagaggcuguguuuaccuuuauggagcagacacuaccacugccacuacaaccaccaccaccuccucuuccucuuccuccuccuccucuuccucugacuuacaucucguccuuugcacuguagagacaccagcaucagaaauaugugcuggagagggaagagaaagucuuuauuuacagcuucauggagaccuggucaggagacuggaaccuacugaacgaccucuucagaucguuuaugauuacuuauccaggcugggauuugaugauccugugcgcauacaggaggaggcuacaaauccugaccucggcuguaugauucgauuuuauggugaaaaaccaugccacauggaucguuuggaucgaauccuauugucuggcaucuauaauguacgcaagggaaagacccagcugcauaagugggcugagcgccuaguuguccucugugguaccugccuuaucguuuccucagugaaggauugucaaacuggaaagaugcacauuuugccucugguugguggaaagauagaagaagugaagcgacggcaauacucccuugcuuucagcucagcaggagcccaagcucagaccuaucaugucagcuucgagacuuuggccgaguaccagcgauggcaacggcaagcauccaagguggugucccagcgaaucaguaccguggaucucucguguuacagccucgaggagguuccugagcaucucuucuauagucaagauauuaccuaccucaacuugcgacacaacuucaugcaguuagaaagacccggaggccucgauacacucuacaaauuuucucaacugaagggccugaacuugucccauaauaaacuuggguuguuuccuauauuguuaugcgagaucucuacccugacugagcucaaccuuuccuguaauggauuucaugaccuaccaagucaaauuggcaaucugcuaaaucuucaaacccucugucuugauggcaacuuucugacuacuuuaccugaagaauugggaaaucuacaacagcuuuccuccuugggaauuuccuucaacaacuuuagucaaauuccugagguuuaugagaaacucacuauguuagauagagugguuauggcaggaaauugccuggaaguccugaacuuaggggugcugaauaggaugaaccauaucaagcauguggauuuaagguaagguuauucuuuaccacaccuuccuuuaaauugacucugguggaccuuuaugucuucuguuuaugaagauuuguuuaaaacauuaggguuuuuaaaauuuuguuguuguuuugagacaaggucucacuuugucacccaagcuggcauacaguggcacgaucucggcccacugcagucuugaccucccguucucaggcgauucucccaccucagccucccgaguaguugggacuucaggugcgcaccacgaggccuggcuaauuuuuuucuacuuuuaguagagaugagguuucaccauguugugcaggcaggucucgaacuccuggacucgagcaguccacccaccucagccucccaaagugcugggauuacagccaccgcaccuggcccauaacuuuagguuuuuugaauaguguagaaauauauguuuucaaagguauaguaagacuuuauuuaucacucaguagcagagagauuaaggaucagguaguuguaccaugugauagagacuaucaaauugccuuugacaaagauuguucucacuuacccucccaucaguguauauuuuuuauuuuaaaaauuuuuuauagagauggggucuugcuguguugcccaggcuggucuugaacucccuggcucaaguaauccuccugccuuggccuccuaaaguguugggauuacaggugugagccagugugcccgaccccuccaccauuuuaugagaauucccauuuucucauaucuuugucaguauuggauuuuagcauuucuuuuuauuuaucaucagucuaguagguugaaaaaaguauuucauuguuuuaaucaacguuuauuuacauagcagugagguugaacaucuuuuuauauguauauuaguaguuuguagauuuccauaaaugaccauuuuucuguugagucauuggguuucuucuugauacccauuguauuacaauuaaaauguuaaggguuucauuacuaagaacuuuuuaugagaguuuuauuuucuagucauaauauuuuccuaaaggaagcugguaaaaagacaccuacuggauguucuguuauuuacaguaagccauugauguagcuuguaaagacaguaagagaguuuuuuuuuuuuuuuaaaccacacuggagacuuaagagagagauuuauagaaauacaggaaagugagaauagaccugcauaaauuaaaucauacaccuguguagaaaaaacccagaggucauuuucuauaauuugccuuugaacucuuccauauauauauauauauauauauauauauauauauauauaugugcagauuauuuccuugucuguuaauuaauuuuauguuugaaccuuagcucuagagauagagcaggcauagcaacaggaagaaguauggcuccauccuuauacucuggacaugguacuguugugacugcuuugcuacucacugacucaaaagguuguguucaucuuccuguuccuuuguccuacuuagugcccaccugacauuauuagguauuuggauauaaguguuuaacuguucguagauauggccucuuuuuuccuucucuuuauuaauuuguauacguauuugccaauuuggauugucuaacuuagcuguaccuugaguuauucaucaacuaauuauuuauauaguaccuugcaaaaugaggcgaguagugaaauucuuaaguuguuuaggaaacagagaaagggggccgggcacgguggcucaugccuguaaucccagcacuuugggaggccgaggcaggcagaucaucugagguuaggaguucaagccuggccaacauggugaaaccccagcucuacuaaaaauacaaaaaauuagccuggcauggugggggugauucuaaucccagcaacuugggaggcugaagcaggagaaucgcuuuaaccugggaggcagagguugcagugaaccgagaucacgccauugcacuccagccugcgcaacacagugaaacuccaucucaaaaaaaaaaaguaaacagagaaagggaucauaccuguccuauuuuuuauuuuuauucugguaagcacauuuaauagacucuuauuuaugauuauuuucuuguuucugcguauuaaggaugaaccauuugaaaaccaugguuauugaaaaucuggagggaaauaaacacaucacccacguggaucugcgggacaaccgacugacugacuuggaucuuagcuccuuaugcagcuuggaacagcugcacugugggcggaaucagcugagggagcuaacacucaguggcuuuucccuucggacccucuaugccaguuccaacaggcugacagcagugaacgucuauccaguacccagccugcucacuuucuuggaucucucccgaaaccugcuagagugugucccugacugggccugugaagcaaagaagauagaaguauuagaugugagcuauaaucuucucacagagguucccgugagaauucugaguagcuugagucuuagaaaacugaugcugggacacaaucaugugcaaaaccuuccaacacugguagagcacaucccccucgaggugcuggaucuucagcauaaugcacucacgaggcugccagacacccucuucuccaaggccuuaaaucucagauacuugaaugcaucugcaaauagucuggagucuuuaccauccgccugcacuggagaggagaguuugaguaugcugcagcugcuuuaucugaccaacaaucuccugacggaucagugcauaccuguccugguagggcaccugcaccugcgaaucuugcaccuugcaaacaaucaguuacagaccuuuccugcaagcaaacuaaauaaauuggagcaauuggaggaacugaaccuaaguggcaacaagcuuaaaaccauucccacaaccauagcaaacuguaaaaggcugcacacccuuguugcacacuccaacaacaucagcauuuucccagaaauacugcaguugccucagauccaguuuguagaccuaaguugcaacgacuugacagaaauccugauuccagaggcuuugccugcuacauuacaagaccuugaccugacuggaaauacaaaucugguucuggaacacaagacacuggacauauuuagccauaucacaacccugaaaauugaucagaaaccuuugccaaccacagauucuacaguuacgucaaccuucuggagccauggacuggcugagauggcagggcagagaaauaagcugugugucucagcacuugcuauggauagcuuugcagagggggugggagcuguguauggcauguuugauggagaccgaaaugaggagcucccgcgccugcugcaguguacgauggcagaugugcuuuuagaagagguacagcagucaacuaaugacacaguuuucauggcuaacaccuucuugguaucucacaggaaauuaggaauggcuggccagaaguugggcuccuccgcucuccugugcuacauccgcccugacacugccgauccagcaaguagcuuuagcuugacuguagccaauguuggcacgugccaagcaguccugugccgaggugggaagccagugccccucucuaaagucuucagccuggagcaggacccagaggaggcucaaagggugaaggaccaaaaagccaucaucacagaggacaacaaagugaaugggguaaccugcuguacccggaugcugggcuguacauaccucuacccuuggauccuccccaagccccacauaucuuccacuccgcugaccauucaagaugaguugcugauucugggaaacaaagcauugugggaacacuuguccuacacagaagcugucaaugcuguacgucacguacaagacccauuagcagcugcuaagaagcugugcacauuagcgcagagcuauggcugucaggacaauguaggggcgaugguaguuuauuugaauauuggugaggaaggcugcacuugugaaaugaaugggcucacccucccagguccugugggauuugcuucaaccaccacuaucaaggaugccccuaagccagccacuccauccucuagcagugggauugccucugaguucagcagugagauguccaccucagaggugagcagugaagugggguccacugcuucugaugagcauaaugcugggggccuggacacugccuugcuuccgaggccagagcggcgcugcagccuccacccaacacccaccucugggcuguuucagcgccagccuucuucugcuaccuucuccaguaaccagucugacaacggccuggacagugaugaugaccagcccguugagggggucauaaccaauggcagcaagguagagguggaaguagacauccacugcugcagggggagggaucuggagaacucacccccucucauagagaguucuccuacccuguguucugaggaacaugcuagagggucguguuuugggauccgaagacagaacagugugaauaguggcaugcuccugccaaugagcaaggacaggauggaguuacagaagucucccuccaccuccugccucuaugggaagaaacucuccaauggcucuauugugccccuagaggacagccugaaccucauugaaguggccacagaagugcccaagaggaaaacuggcuauuuugcugcccccacucagauggaaccagaggaccaguuuguugugccucaugaccuggaagaagaagugaaggaacaaaugaaacagcaccaggacagccggcucgagccugagccccaugaagaggaucggaccgagcccccggaggaguucgacacagcacuaugacugccccacugggcacagugugggaggaggcugugcaggguugggguagggacuugcuagaggcauucugccucuacauuucuuuuuguuuguucguuuuuuuuuuguuuguuuguuuugagacggagucuugcucagucgcucaggcuggagugcaaugguggggucucgggucacugcagccucugucccuggguucaagccauucuccugucucagccucccgaguagcugggauuacaggcaccugccauuaugcccggcuaaguuuuauuuuuuuuuuuuagagacgggguuucaccauguuggccaggcugguguugaacucuugaccucaggugauccacccuccucugccucccaaagugcugugauuacaggccucagccaccaugcccagcccugcgucuacauuucuaaaccauagcugugugggguugaacucggagccaaaaagugugagagccaucaggggcuggcucuggauaaacugguagccacuaucaguguuaaguuucacauuuaaccugcauuggaauucccagggguacugggaagaaagcagcuguucuguaucaguccuaccaccugccauuaacccuuucucuccuaggaucauuuugagaauuugccugccugggcaggaaagggacuauuucuguggaggaaaaaagugaagauugauucucuuuacuaguugcugcugauggaucucugugacagagaaaucaccuuaucucagacuaauggggugugaugugacuagucacauggcuuuucauucuucucuacgagaauacagccuaucaaaaugaugucuguuggaaauguagaaccaaucaaacagauaauuuauguauguaauguaaugagagcacuuuucauugacugugaacuuuuuauuuuugaaucugcacucgagccaaucuucuuagaggcagcccggcaccuucauccauaggcagagagagaacuggguguuggagacuuauucgaggguauaggaagggcccugugaaguugauuuaacuuuuggaugucagacugugaaagcuccugagaaacuugggguaauaggaucuucuuuuggggaugaaaauggggaaggcgugaggaccuagacuacuucucccuagaucagaaaaagagaauuaccccuugacaaauaugauaccugcuagguauuucccagggaaauuuagggauuggcgucuuucccuagcauguggaggaauuggcagacagcuuccuaagggcggggagcgggggcccaaggcugacacugcuugcauccacgugaccuuaaguuauggcagaugacucugaaacggacugaggccaaugagaacagauggauggagcacucagguuagacuuguuccuucuccuaugcuggaggagagggaugguucucuagaauguuggaggugaguugagagcucgccucuugaauguugaacaguguacucuucugaaaacugcauauucacuuuaugugguuucagaauacugggcucaauacuaacauaagaaagacacuucauugagaaauucuuaagcuuacagaaaaccuauacucuuugcacauuccacauaacccuagcaaaaugcaguuucuucauacuucugucacuuuuuccauuggaagauuugcuuaggaaaauuaauuccuauuuauucccacaaaauguuggcauugcuugauuuuacccaauggggaaugugcuuugaauuuuuggaacacuuuuacaauuaaaaauaaaguagggccauuuuuaauuuguuucaucagaaacuauguuaaagagaggguuaaauauaaauauauuuucguguguauuuuugggaagauuuuuguucaaagcaauagucaaaaucagaugaccuguccauaauaauuaugugucuucaucuucucagaggccccaugcucauaugcacgugucauugggauacacucuugggggauuugguacacucuaauggaugucuaauguucaaccccucgagaaucugaacuugaguccccagauugucaaacuacuggucagcuauugagaauuuuagaacucaggucuuugauuugaaguagggaacauaguggcucacacagaguuuaggugcuguuagaaagaugggaacaagaguguuuugccaccuuauuuuuauaugggaaauuuuuuuuaaugaagaaaaaaugaaaaugaaauaacaggaugauagugaugagugauguaaaacaucuuacuuagauggcagaaccuucggguuguagaauagugaugucuaaaaauuaaaguuauuuugggaauacaccacuuuaauaguauagucuuauaaaaauuauucauuauggugaacccuucuugucugcuauucguuucccaaccuacuuauuggaaccaccucaaaacccaguucugaaaugaccuuaccaaaaguaaauguauuuauuuuuuagucagcagaacucuguaauuccaaauguuguucugugugguagaauuuuuuuucaggaaccauuagguuguauugaaaaucuuuguuauaggcgauaccaaaacugauuauucuuuuuugcagucugcuuuaauucauguccuucugcaguugcucuguauuaaaacaggguaaaaaggccauagcccauuaugaaaaauauaauacaaaacucuuugaccuaugagguaacuuacagacauuguguuuucuaaacaggcugucagugaaagcccguaucugucuccaggugaauguaauuuacuuccgaguacuuuacccagaggauguguuccccaggugggcagaguacaguugaucucuagcacagacagagauucuggccucugcauauucucaggucucuguguguaccucccauugaguagagaagcuuaagauaauuucugagagaagaacacugcugauugugggagcaguuuaggaguccauggaagaaagaaaaauacaugugucuuggcagccaugguguauuuuuguccaaauggauuggaaggauauuugaauauuugaauguugguaugacauaaagcugcagugcacuauagagucaagucauugaauuaccacuccugauacagggcuuuauuguacuacugugaaguguaugugugcaauacauuggugaguucauuuacugguguacggaagagccagcaggagcagcguggucauugcugggugcuauuacaguugcuuguagugagugcuguuuuccaggagauggagccaguuggguguggcagaucuacugaauaucaaaugaugcucuucuucccauguagaccuucagcaaaagccgguacuuggaagccacaggcucaccuucucuaucuauccaauaauuauuaaugaagagaccuccauaagggagcagcuggcuguuaucgauaaauguaccaauuauuaaauaauuagucuccaagccauucagugaugucuucagcaucacuauaggacugucuagugucacuuuuuacuuccuucuggguggaggcuuuccgacucccaaucaugaaggcaaguuaaucuuuccaguuagugacuuuugccccauaguugggguaagcacuuccuagauugagaaaaagcagcuacagucaauccugcucuguuugccucauuuggugaucagucagucacacauaaguuccuuguauucuaaauuucaugcacuucucccagaugcuauaggguuuucucucacuguugccaguggaugucauccagacagugggcucauaucuuacgguuuugugcaaucauugucguauuguagucuuaagacucauuauaguguauuuuugauauuuuugaaauguguuaaauuuuuuaauucaauaauaugagccagagcauguugcagcaaaucuauuguuuguaaaaauaacaauaacaauaauaaauaaaauaaaguggaaaauuggguucuuaaccaaaagcaccugcaggauuuuccuggggaagauaagugagaacaaacacaugaaaccacauucccugacacugcaaagcuaugaguuaagguuccggaagaucucaaagaguuccagaccacagauauuccggugcaucacuguaacuuccgggcuguucucggcugccuuuguagcgcuucuguucucgguagcuacgcagggccagcaccacgcuggcgccguacaugaucacgagaagacaagcaaagguggcugcugcuccgucggugccugccagcuggcaguccauccaggugagacccuugcgggcauagagccucucucuuguuuugcaagugucggugcuauugaucugcagagccacguggagguaaacaccaaugccugugcaguagcccacugccgcuaggaggcugaaggcggccuccgugaggagccacuucccugacaacauuguucgacucuuggcuccuuggaguaaaacacccauggugaggacccccagacccagagaaacagccacgccaccguauaucaggggcgagcggaggaucguguacugcugguccagcugccgaaccugcucuagcucagugcccucgaacgauguuuucagaucaguuccuacaagaggagccacauuuuguuaaguggccuucgacuucauuguauggauggauuugucuauucaaccaggaccuuacugauagauauuuggacugaaaggaacccacaaauggcacgaggcagaggaagccaacaggccaacagacugaagaucuucuuguccgaggucagcuuuuauuuguuacugacagaggccccaaauccuucuuagguguccuucugggagagggucuccugccauucccgugguguucagggaugagcaugaagagaaauacaaaugaaccgagagcaggaccaccagguucaaguccccgcuuuuuacugccuugucaucuuggccaagccauucaguccuucuaagccucagacaauaugacaaaugaagcuaagucugccaaucuucacccacagggauguggggaggcucaaaugaaagcaaccgugugauacugugggaaguuaacaacaacaacaaaaaagcaaguaugugaaaauacucuaaaaauaaaauaauguacaaaugg

SEQ ID NO: 906 - RNA, 508 nt, Homo Sapiens
gcaaugaccaucaggggaagagauuaggggugccaccuuagaguuugccacacggucuuccuaagaaaaccaagaucuagaauuucuaguagaauuuucuuuuguucgucuaagaaucaauugauucuuaauucuaagcuugaaguguaacugcauuuuuauggguaaaaagaucaaccgugugaaccaagcugaguaucuucaccagccccugaguugcugcacugugaacuggguauacagacugcuaaugcuuuguuaggaguucuuucaacauggaaacuacuugauacaucagcuuugaagcaaugcggcauacgcaugcucuagaaagguaaaaugcuaaggucuguccugcugaagaguccaguggccacaccaguuucacauuacacagaacacagcuucuucacaaccucugaccaucuccauccucugaagugguccacuggaucuaaugucccaacaugcugugcuauuuguaacaugcugagggcucugccccacu

SEQ ID NO: 907 - RNA, 1566 nt, Homo Sapiens
cccgcggcaccgccuccgcgccuccauccagccggcucccuccggccgcgaacugccccuccccgccccgccucccggcgcggguggccgaggcguagcgcugcgacccccgcaccccugcgaacauggcgcugcgaguggugcggagcgugcgggcccugcucugcacccugcgcgcggucccgucacccgccgcgcccugcccgccgaggcccuggcagcugggggugggcgccguccguacgcugcgcacuggacccgcucugcucucggugcguaaauucacagagaaacacgaauggguaacaacagaaaauggcauuggaacagugggaaucagcaauuuugcacaggaagcguugggagauguuguuuauuguagucucccugaaguugggacaaaauugaacaaacaagaugaguuuggugcuuuggaaagugugaaagcugcuagugaacucuauucuccuuuaucaggagaaguaacugaaauuaaugaagcucuugcagaaaauccaggacuuguaaacaaaucuuguuaugaagaugguuggcugaucaagaugacacugaguaacccuucagaacuagaugaacuuaugagugaagaagcauaugagaaauacauaaaaucuauugaggagugaaaauggaacuccuaaauaaacuaguaugaaauaacgcaagccagcagaguugucuuaaauuagugguggauagaagacuuagaauagaaacuuuuaguauuaccgauggggaaaaaaaaacuacuguuaacacugcuaaugaaagaaaaugcccuuuaacuuucuaaugauuauagauaaauauaauaugcgucuuuuucacaauauccuaugauuuuuagacuaggcucuaguguucagaauucaugaaauuauccaugguaaaaacuaguuauaaaaauuacauaauucaaagauaacauuguuauucuuaagccuuauauaauauuguaacuugcauguauccauaccuggauuugggaugaaauacuuaaugaucuuuccauuggaaauaacuggaagugaagagguuuuguugcuuguacagugucagaugaggaacaccacuaucuuaauuuugcgauacacugcauuugcuggugcuauuuuuauacagugaagcaacagcuuugcagcaaaauaauaaaauacuucuucguuaaucauguuuguuuugauguuaauauuucauuuaguaacucugcuaguauuugugaaagugcuaacuuuaacuuacggaaaguuacuuuuuaaaaggaaauuuaagccagaacaaugcaaagcuccaagaaaauguuuucuuuagucacaaaucugguuuuucuuaagccaagaucugucaccuuuaacauaauaaaaaauaaaucaccaacuuugauuuucuaucaugcgaggucugaagaaagaagaggaaagacagaggaagguggaaguuuugaucaguauagcacaugguguuuuuaaguuguuaaaccacguucagguuuccacuuaagucaugggaauaaaaguggacaaggacugaagcuuuaugagcuca

SEQ ID NO: 908 - RNA, 1195 nt, Homo Sapiens
cucaggagaguuccagggaagaaccccacccccacuccaaccaugucacaauggcuggagcucugaggggcccaggcucccugagccaggaggagaggagaaaguccaaggaaagauggcuggcagucaccccuacuugaacccgccugacuccacacacccaucgccgcccuccgcuccacccagccuccgcuggcaccagugcugccagcccucugaugccaccaauggccugcugguggcccugcugggugggggccugccugcuggcuucgugggcccccuuucucauauggcuuaccaggcuuccaaccugcccucgcuggagcugcucaucugucgaugccucuuccaccucccuauugcccugcuacuuaaacugcguggcgacccccuucugggaccuccugacauccgaggccgggccuacuucuaugcccugcucaacguccucagcauuggaugugccuacagugcgguucagguggugcccgcuggcaacgcugccacuguucgcaaagguucuuccaccgucugcuccgccguccucacccucugccuugagagccagggucucaguggcuacgacugguguggacuguugggcagcauccuaggacuaaucaucauugugggaccuggacucuggacacuacaggaggggaucacgggugucuacaccgcccugggcuaugggcaggcuuucgugggaggacuggcgcugucccuggggcuucuggucuaucguucucugcacuuucccuccugccucccaacaguggccuuccuaucuggcuugguggggcugcugggcucugugccaggccucuuugugcugcagccccccguguugcccagugaucucccgaguuggaguugugugggggcaguggggauccucgccuuggucuccuucacaugugugagcuaugcggucaccaaggcccacccugcccuggugugcgcuguccugcauuccgagguggugguggcccuuauacugcaguauuauaugcuccaugagacuguggcaccuucugacaucgugggggcagggguugugcugggcagcauugccaucaucacagccuggaaccucagcugugagagggaagggaagguggaggagugagauagaacuugggagcccggggguugggagggacagggauaaauagaggcaaagacugaagac

SEQ ID NO: 909 - RNA, 2856 nt, Homo Sapiens
uggcuacaugcucuccccgugauggggccggagcugggcuggggacacccccgcggcggcgacgucugcuccucugauuccuucaacgaggacaacacugccuucgccaagcagguucgcucugagaggcccuucuucuccuccaacccagaacuggacaaucugaugauccaggcaauccaagugcugcgguuccaccugcuagagcuggagaagggaaagaugcccaucgaccuggucaucgaggaucgggauggcggcugcagggaggacuucgaggacuacccagccuccugccccagccucccagaccagaauaauauauggauucgagaccaugaggauagcgggucuguacauuuggggaccccagguccauccagcggggggcuggccucccagaguggggacaacuccagugaccaaggagucgggcuggacaccagcguggccucucccaguucugguggagaagaugaggacuuggaccaggagccacggcgaaacaagaagagggggaucuuccccaagguggccaccaacaucaugcgagccugguuguuccagcaccucucacacccguaccccucggaggagcagaagaaacagcuggcgcaggacacggggcuuaccauccugcaagucaacaacugguucauuaaugcccggagacgcaucgugcaaccuaugaucgaucaauccaaccgcacagggcagggugcagccuucagcccagagggccagcccaucgggggcuauaccgagacagagccacacguggccuuccgggcuccagcaucaguggggaugaguuugaacucggaaggagaauggcauuaucuauagaggcugaugcgggagagacccagccuccggcugugacccccagccucacaccuggcucugguucccgccugguccucuggcuucaggaucccaccuccaaaggccucuccgcucaacgccuaccucccuagggcccugcugggacaugggggccugagugcccacccaaggggcucucaaggacaccggcaaggccuccaggcucugagccccgcuucugccuucaccucugccugggacccgagcugggcuccugggccuugguccccagaagauggcagcuagggccucgccgcgaggacagagaagggacaggguggcugggcagucagggaaggagggucgcccggauccgacauuuuggagagauucuuucacccuccugucccccccaccucccuucucuaauuucuucuuuuuuuaaugauaaagucuuaaaacacagaaaaaaaaaagacuucagagaauuagguagaugaagcacuuuauacaguauauaucuucagcuuaaauuuguuuugaguauuuuuuuuauuuuuaaguaggcaaagauuuaaaauuuuuuauuuuuaguaaauguuugaagcaaacuaaaaagacgugggcaauauuuaccaaaacaaaacagaacccaaaaaauuguacaucuugaucuuagcaaauauccuuauuguagagacacuuaauaaagagaugguauuuuaauaucugcaguucugagguaggguguaacuuaguucuacauugugauuuaggaauuuuuaaaccuuucuucuucaggggagaagugacccaggccucgaguuuagugcuaaagccacuaguguacuuaugcugucaccuaaccaccacaugcgacauggaggcagaggcuaaauauaggggcuuucuuaagaaagugagaggaaauuagcaagcauuauuaguguuugacuacugcuaucaagugaauucaaaggaaacagguuuuuaugccauauuuaaguuacagaaaccaggcaugcuuagaauaguuucuaaggugacagagugagacuccaucucaaaaaaaaaaaaaaaaaaaagaauaguuucuagagguuauuggagaauagaaagcuaagaaaacuugguauacauuuacaauugaaauauaauuacacuuuuuacucucagaauauuauucagauuagacuuccuguuuaucuuuuauauucuugcauugauauaaugccugauccuucaaaguucuuucacauauuauaugaucuucuuuaugaaaaaaaguagaugcuuuauucugauauauucaguuucccacuuuaggcaaaaguggauuaauagaaugaugaauucaaaguagaugaggaaaaucaggcacagagaaguaaagguagguacagacccaaauucacacaagauaaugacaucaccagcguuuaaguugaucaucaaaggcugggcuggauuugucuugcuguaugugucaggaaauuuauaccuauuacauuuuccauuuucucaaaauaagucacaugauuguaauguuuagcugcaacuuuucuccuaauaaauagugucaugaagaauguuauagugcgaaguuuguacauuucagggucaguuauacaaugugaacucuuuaucuacgggaaugagaauggaggaucauugaaggccaugauauaaacaaauuugcauguugaagccuguauaaaacaugguacagugagugaaugcccccauccccaagaacacuuuauacauauuaaauggauauaugauuacugugcaaaaauucauucuggaaaugaacauauauuugagcacuaauauguaauguacaucuucugcccuaaggagaaaauaaaucauaaaacuuguuuuacauucaaaauuacuuucccgagcaugucuuagaguaaucuacguguugauguauguaaauuguauuuuagguaggcaaagaaacaagucugguuauuuauguaaaaacuagucuaauaaagugaguggcuuuaucacuuugaa

SEQ ID NO: 910 - RNA, 111 nt, Homo Sapiens
cuggagguaucaucagugaagucugugaaacagcaaagauggcugccugccacuuccucuggaagcuccagcccagcagcguacugacuuauugcuggcucgaaagugcau

SEQ ID NO: 911 - RNA, 58 nt, Homo Sapiens
guaaauauaaauguaggugcauaauauagacuuuuucugaaugguuuauaaguugcag

SEQ ID NO: 912 - RNA, 9271 nt, Homo Sapiens
ucucacugugguuuugauuugcauuucucuaaugauuagugaguuugagcauuuuuuucguagccuucuuggccacauguuaugucuucuuuugaaaaguaucuguucauguccuuugcccacuuuugaugggguuguuuguuuuuuuucuuguaaauuuaaguuccuggcagaugcuggauauuagaccuuugucagauggcuagguugcaaauauuuucucccuuucugugagcuguucacucuguugauaguuucuuuugccguaaagaagcucuuuaguuuaauuaggucccauuugccaauuuuuguuuuucuugcaauuacuuuuggcaucuuugucaugaagaucauuuccagguccuacguccgcaaugguauuuccuagguuaucguccaagguuuuaauauguuuucauuuuagauuuaaguuuuuaauccugccuuugccucccaaagugcugggauuacaagcgugagcuaccacacccagcgaggaagccaaguuuaacgugugugcuccacuccuccaaccuggccaaagggcagucaucaucacuggccacuacugaccacagccuuuagaaacuccccuugaacgugcugggcugaccuuccucugaucacaggcaaggcaaaggaaaacgacaggcccuugccuucccgguccucaagggucagcuguaagaugaugucauaaagccggaucagguccuggggccggggggaagcacuugcugucauccucuggcugcugcugcagcagagcccucugcagaccuuuggccaugcucucauuacacuugauugccauugacagcuugauguaagucaggugaacaaauagaagcugagggugaaggaccuacagcugucaccuuuaucucuucucaacacugccaacuguccccuuggaucucccagacagacaacaagggacaucucugguuucucggugcccccuagaaaccucgggucauuucaaggcauuaugcaaaugagaagcuuuccuucucuucaccucaucuccugaucugcacaaaagugacuguaggacccaguguuuauaacagcauuugacagccucgugacucucacauagggaaaaagucucgccugaaaacccaugcuaagcugcaugucuugagcugugccaauuuguauuccaggcagccuaagguucccaucgugaguuucaggaagggaaauucauggaggaaguucaccucuggaagggugaggagcaauaaauagggugggugauggacauaugugacguuugccacagagaggcagucaguaugggccuugugguccgggcucugcuuugggacacaaauauaaacugugugaagucuuaugguagcauucauaacccugaugcuucacccaccuucccauacauuagagggacaaacagaaggaucccagcucuaugguucuugauuguuugucagguagcagccaggcauggagagggaaaaauucuuucuuuucugcugcacucuagauccuuccuucucuccuccuucauucuacaccacccccaacacauaucccugcaccccgcccauucuuugcucucuccuuucuuacacuuaacuccuucuugcuccacagccuaacaugcugauuaacaggaccccaaagguuuggguggguauuaggggccuucucaacaaaagcagcacacucuugagcuuguucuuccuuuuguugccaucucagauaaaaaggccccaugagggaggagacagauaaguauagacuugguauucugauaacucuguguuacaugggaucagauguaaaugaguuguacccugugauguuucaugcucugcuguguugucuucucauggugagcuuuucugugcccuuauuucauccagcucugguuucuguguuucauguuauuucuccuagccucuguaaacucugcagcauacgaauaaugcucuggcuuucugauuaaagauaaauggcuuacuaucaucaccccuggcuugagggccagcucacauguaaucccuuauaggauuccaaaguuguuaaauaaaugcaguucuuuuugucauuuugaagcauucaaaaauuuuucaagaaaagcuaugaucauauaaauagaaauuuuauccagaauguuacaauguaacauuugugaauaaauguguaggugcuguauuugcucagacucuaguuuggguuguguuuucuuuucccuuuuuuuuuuuuuuuuuuugagacagggucucucucugucaucugggcugcagugcaguggcguaaucacagcucacugcaaccucuacucccaggcucaagcaauccuccugaguagcugggacuagagacaugcgccacaacgcccagcuaauuuuuagguuuuucuuucacauagacagggucucuguuggccaggcugguuucgaacuccuggacucaagcaauuccccccaccucagcauccuaaagugcugggauuacaggccugagccaccauacccagccaguuauauuuucuuuuuccuuauauagaguaaaauaagggugagugaccgagagguugaugcauagcuagaucaccaguuuaaaugccuucccacacaccccuuuccuccuguucccuccaccuacagguuguagaugagcaugagaguguggagcagagucggcgagcgcaagucgagcccaucaaccuggacagcugucuccgugcuuucaccggugaggaagagcuaggggaagaugagauguacuacuguuccaaguguaagacccacugcuuagcaacaaagaagcuggaucucuggaggcuuccacccuuccugcacguggcugugccacgcugcugaguugagugugugcacaagcacaccagugcacuggggccuguguagaggccuuuaggaaaccauauuuuugaagucuuuaaaaaauaaugaagaguaaauguucuguuauauauucccaaacauucacauguauuugacuuguuuuuuccauguaaauuuuguaucuucagaacgcuuuaaugcaauguuuucuaccuuuacuucuccagauuauucaccuuaagugauuucaguuuguaaaugaucaguggauaaaaucacagaaaauugucaaauuuccucgggaaaguuuugaccugagugcuuuuuugguaccacgagacccggcucucugccagcaucaaccacucacaccccagggggaugagcucuccaagcccaggauucuggcaagagaggugaagaaaguggaugugcagaguuuggcuggggaauaggacaugcuccugagcaaaagcccauccucacucagcgcuaacaucagcagcagcccaaaagagauggugcuucgccauguuucccaggcugggcucgaacuccugcacccaagugaaccuccugcuucggccuccuaaacugcugggauuacagguucuccuucuucaucaagaaaaaguggaaccagcugucccuccagcaaaaacagcagcccuaauagcagcccacggacuuuggggaggagcaaagggaggcucuggcugccccagauuggcagcaaaaauaaacugucaaguaguaagaagaacuuggaugccagcaaagagaauggggcugggcagaucugugagcuggcugacgccuugagccgagggcauaugcggggggugggcagccaaccagagcuggucacuccucaggaccaugagguagcuuuggccaauggauuccuuuaugagcaugaagcauauggcaauggcuauagcaauggucagcuuggaaaccacagugaagaagacagcacugaugaccaaagagaagacacucauauuaagccuauuuauaugcaauuucaguaagugguuuauuguaugguuuucggagaguggucuguguuuuguucacuugucuucauguauucaucagcaaguauuuuucagguccugcuuauuuccuagcauugagcuuagugauagagaaaguuaacauagaaaucugggccugcccaggugugguggcucacaccuguaaucccagcacuuuagaaggcugaggcagaaggaucgcuugagcccaggaguuugagaccagccugggccccaucucuacaaauaauuuuaaaauggagcgagguaugguggcauugccuguggucccagcuacuuggaaggcugaggcagaaggaucaccugagcccaggaggccaagucuuuagagaguugugaucacucgacugcaccccagccugggugauagagcaagccccugucucaaaauaauaauaauaauaguaauuacauuauaaaaugauuguuuauccacacaagacuuggagcuuaugacuuuuguauuuugcuuuuugcuuauuuugguuuuagagaaaguuagaggguucuaaaauauuuucucaccuacugaucauuuacaugaucacuguucuccugcucagauccuagugcuauacccuggccauaguacaguuaacuacuaacauacauccacucucuuaucucuuacagugccauucaggaauucugagugggggccauuacgucacuuaugccaaaaacccaaacugcaagugguacugcuacaauggcagcaucugugagguaaacauucucaaucuuugaaugaaaguuagaaacaaucaacagaacuggggaacauuuuuugaaauaauggacuaucucuugaauaggaaauagauauuucuguuagaaucaauauauagaugcugucaguauuaaagaaacaaaagugauaugcagaauagggaaugaaaacaugaguagcgaggaaaaauaaagaguuaguugaccgggcgcaguggcucaugccuguaaucccagcacuuugggaggcugaggcaggcuuaggagguggaucacuugaugucaggaguucaagaccagacuggccaacauggugaaaccccaucucugcuaaaaauacaaaaauuaguugggcauguuggcacaugccuguaaucccagcuacucaggaggcugaggcaggagaauggcuugaaccugggagguggagguugcagugagccaagacugcaccgcugcacuccagccugggcaacagagcaagacucugucucaaaaaaaaaaaaaaaaaagaacgucacccugaugaaauugacaccaacucugccuacauucuuuucuaugagcagcagaggauagacuacgcacaauuucugccaaagauugauggcaaaaagauggcagacacaagcaguauggaugaagacuuugagucugauuacaaaaaguacuguguguuacagcaaagcuaccacucuggcugcuagacagcuugguggggagggagaugacuccuuguagcugauacuuggcaaagaugucacugagaggcaagcuaaauguaguuauuuuauccuguuagaauacaaauucuaauuaaaauaguuaacuuuaagaguaguaguaauuuuauuuugaagucucaugcaaguugucugauagagaacuuucaggcagaucccaccauuagccuguaaacaaaagguuuggcaccagccaccugggaccaaauaagaauucaauugugcuuguccagauaugaacaaauauguagugaguauagaguuuaucaauaaucauaacaaauauuaaagauuuccuuggagucaaaguaaaaaacaaaaaauuauaauguugucuagggaugacaugauaugcuaccuccuuuuuccugaaguuuuauuccauucuguugacaagauggagaaagcaagaucaugaaggugugcaaaugauucuuacggcaugggcgaggauuuuucaauuuauuuuuuaaaguuuccauacccuuucuuugucuuucuugcuuuuuguuuuugccuuuguguuuauguuugagauacaaccagucauugguggcaggggcauagaguggucagucugaaagggaggcucucuuaagagcuaugugccuuccacccagagggagacccaguagaaagaaaaacauccugggaaauccagcuaccauggcccucccaguggaggcaucuuacauuuaggauacuucaaguauccucagaaauguauucugcacccccggccccgcccaugcugagggaaggggagcaguugccaauauuugcaccaucuucacaugcacauguugcaacaagagcuucugggaagguaagcagcaucggagcuagaucacguuucacaauuagugguuguucuuuuccguguuuauuuugcacuuuaaaaaagagagaacgcaugcaaaugaacuugcuuguguguauuugauggcucuaagggcuauaaauuacaaacaaaacacaucccagacauuaggaguucauaaguauauuuaaugaaauuggugguuuuaggaagucaacuuuaguuuugcuuuguuugcauguccacuaauuuuuuuauuuugauauuagucuuuuuuaaaaaauuuuacaguagucauugaaaguuauguuucuuuguuuacuucauuuuuuccucuaauuauucaagacuggcacaaaaguauaaauauuauuuauuucagguagaauuuuuuucguguaguuuuuuaauauauacuugaaggaaauguuucaccuuauuuuuggucuuuguuuauucauuuagacccugcaaguugauucucauuaauugucagauuccacuacacuuucuuccucauagguaguaauuaccaguguaacuaagcauuuguguucugauaucugaggccaguaacuauuaaugucuaguucucagagcauuuggaaagguuaucuuaaauggcuaccuaaauugaaauccuuuucagaaaaaauauaauugcaaauagguaggaguggccuaaauuaucuaauguaauaaagucagacaaaaugcauacuuuauaguuucaagauuuucaguacauaaaaucuguccuuuccuaccuggacaugucccauuaaaaagugggagauuuuaaauaauuucuuuacagauguuuuauuuaagcagguagcacaaucuacuaauguuguuugaucuguguuuguuauacugguuguaauuaauuuuuuuaauucaugaacuagcggaaaauuuauuaaauuaacuauuaaccacauucaccuuguaaaugacuguauaaaacuuguugacaaugcacugacuuuagaaagauguuaaugugcauaaauagaguguaaauaaaauaguguugauguacugaaauaugaacuguauaaaaaguauugguaauuguauaugggguguaccuauuuaucuguaacuauuauccaaacaaauuaaauacuguggaugccucuauguacuguuuuuccucauacaaguaaacacagaaugucaaauucuucagcaggggaugcuucaucucugagguuggaaacucuguagagcaggauucccuaacuccugggcuacagaccagcaccguccauggccuguuaggaaccgggcugcacagcagcagcaaagggcuaugccaugaggccgggaauuuguguccggauggcucacuaauguaucuguggugccuagaccagcgccugggacaugaaucuuugucgagugcauggaccagcagugcuuuagauauuaugcuauugcguuaucagaauccauuucuuccacaccucugaagccagaauaaugcacguggagagguuuuaaagcuguggaaaagcagagcccuagaagaaaacagcccaggcugagacucuggggacaacaggagacagaagaauacuugaugauuucauagugggaggcauggagaauuaacguagucaagagcugcgaggcaauaagaggagacucuugggcagcccucaaauagauuauuauuccuccuccucucuccaccuuaccccaggaauaccuguuagcauccugcagaaccaauguuuuguguaauccgugguggggaaagcugcuugggaagauuagaaaugcucaacaccaggcccucugcucggcuccuggcacaugcaucguggacaccaggaagcgugagccccuguugcauuucuuccuaaugucaguccucagaguacagcaaguggaaguucaccaacagccccacguuccuggagcugcuggaggaguucccaucccugcaggugucugcuggcuuccugcucucccugcuccccauucugaagcccagguuuuacuccaucagcuccucccaggaucacacgcccacagcgauccaccugacuguggccgugcucauguaccacacucgagcuucucagggcucagggucugcccucugagccccaacuucaacaccucccaugggaacccuccaaagaaugaaccaggaauggaaaccauagagcccacggcaccccggcaccugagacccaaugagaaucaacacugccucuccagccaacaugcaaggcugcagccuggacccagugccagcaucccaaaugcaggcccuccauuuggggaguggauggaguaggagagaagggcugcaaggacccagauaggcagacagagggacagagagggaaccaaagauccuacuugcaaguuguccccagaggcaaagguaucguccacuggggacauggggaccuggaggcagcacaaggacagcuuugcucuggucgugggagcccucuugcuucccacacccucaacuuacuccccauugcugucugucauugauccccagguggggcaagugagggaccugagucagcauguggcuggcugcugggagagggagaacccgcugagucacggcuccuccccuggagccuccaugagccaucuaggcaggugugcacugcccacuggugcagggcuguggguaccugcaccugucugucaacacugauucuuucucauacaacaggcacuugccaacacucugcccagccagacccuaucagaccacagugaggggauggagugggcccgcauaggugccuccaccugagucuaggcaccccaggcuugugucugcugggacacaccuagcagggaggcugagagcaccggcuucggagccaggcaggucauaguguaaagcuggauucuuccacuuauuuggggaaaguugcuuccccucucugaaccuguuuccucacuguaaauucagauucauccuuuauugagcaccuacuaugugccaggcauuggguugagugcuggggauaaaguaaugagcaagcccuuaucuugaugaacaguuacggaauaaaauagaccugcaaaaauaaa

SEQ ID NO: 913 - RNA, 6541 nt, Homo Sapiens
gcaguggcugcuuggcuuggcaguggucgcuuggcuuggcguggcagugaucgcuuggcuuggcauuucuggcuuagcgguccuccuuucgcagauuggaaaccgcgggcuauccugcugggagguuguggccgaggcaguagcucgcuacugauggucuccugggguggagaaaagcggggaggggcugaggggucuccgaagccggcagucuacgccacgaggaaaaccgguagcgucaggagccaggaggaccagugguacuugggcuacccgggggaccagugguccucgggcuucuccuacagcugguggaaaaacagcgucggcagcgagagcaagcacggugagggcgccuuagaccagccccagcacgauguccgccuggaagaucuuggcgagcuccacagagcugcccggucgggcgacgucccugggguggagcacgucuugguuccuggagacacuggcguggacaagagggauaggaagaagagcauucagcaacuaguuccugaauauaaggaaaaacagacaccugaaagucuuccucaaaauaacaauccagauuggcauccuacuaauuugacccuuagugaugagacuugucagagauccaagaaucugaaaguugaugauaaauguccaucuguaucaccaucaaugccugaaaaucagucagcaaccaaagaacugggacagaugaacuuaacagaacgagaaaagauggacacugggguuguacuucucucagggaaugauacucuccaugaccugugccaaucacagcuaccagaaaacaaagagagcaaagaagguaacaaagaagcauagagaauucaguccuagagugccucugcuuggcugcauagagcuauaguucugacuuaaaaaaacuuuuucugguaaaaugugcuuuguguuuacucaccuuuugcacugaacagaauaccuuuuggcaggauauuuguguucuuccuuuaaccaaagcaacaucuagauaacagagaauuaggggaaagcaggauuuucuuuaggaaguaggauuauauuuagaauauagggacuaaguauguuuagggacuaacauaggauuauauuuaggauaacuuaguagagaccuaaagauugcugacucaaacacaaugugguuucuuugcuuuauuuuuacagcucugaauucacagcuguuaguuauaacuauaugcacuauaauuuaaaagacaccuucccacaccugcaaucucagcacuuuaggaggccgagguggguggaucacgaggucaguaguucgagaccagccuggccaauauggugaaaccccaucucuacuaaaaauacaaaaaaaacuagccaggcaugguggugaaugccuguagucccagcuacucaggaggcugaagcaggagaaucgcuggaacccagaagguggagguugcagugagccgagauugcgccacugcacuccaacccgggcaauagaggaagacuccgucucaaaaaacaaaaacaaaaacaaaaaaacaccuuccaaaagcaaauauuaagugacuuccuaucguuucuaugacuuuauguauuauagaauugacuuuccaagucaguaauuaaugagacuuauugagaauuugcugcauaguaucuccuuggcuguguccacaugagcuaccaccuugcguuaauaaauguguucgcuagggauguugguuuuggcauugacaguguucuaucaccaaugcaaauaagaccagggaccacucuugagaacauuaauguccaagcaucuuaaaguuauacguaaggcuuucauaaugugauucugcucagcucuccaucuuuagcccuuucccccgugugccccuucucuggccuuacugaacugcugguccuguccugcugacccauccuucgacugcaggcaaacacauacacucuuucaggccucuuucugccuuuuguugcugccugucaugcucucacucuuuccuguccccuaccccuucuaauuaggcuagccucacucuuuaagccucagcucgggcaggaucucuagaaaagucaucucugacaugcuuucuuuucacucuuuaaauccuagugccuagcacauagcaagacucaauacauaauugcugaguaaaauagauaaugacucuuuguacaaagaugauuuucaagauuguucccuacagucaaggagcagagggaauagacauguaaagcaauaauugacaauucgggugguggagaugcaguagaaaaaucaguaaaguucuagggcagcccuaaggaaggagauaccuagauaccuguuuaccuggggaaagaugaggaugagggucaacuucaccuagcagucuguuuuuuauuuuauguauuuuauuuauuuauuuuuagcagucuguuuuaaaagaugaaaauauuaauacauuugucagaauaauacagggaaccauuucggauguuaggaagagguuguacaccaauaaagguguccacagucauuuuggaaaucauuaauaagguacuauuaugaaauggagaacaguaugcagcauugccugauaauauugcuacugcauuccaaaauuuuguuuuguuugugauggcuuuguucauugauguuggguggaugaaucugugagugaaucuucaacaugauuguauuucuuuaaccugguggcaucuagugucucccagaaagugguuuguugaaguuuuggagaauuagaauuauuucuuaaagaaguaaguauuccacuaaagaucaagcuucauuuaaacucucaauuuaugaaauaaaaugaaauguaauuuaaaauccagaacaagacuuggagcugacaucagaggaagagcaagaaagacuuaaaggaugcgaaaauaagcagccacaaaaaacgucucaagaaccagaaauggcuaaggauugugauagagaggauauaccuauauauccaguacuuccucaugugcaaaaaucugaggaaaugcggauugaacaaggcaaauuagaguggaaaaaccaauuaaaacucgucauaaaugaguuaaagcagagguuuggugaaauuuaugaaaaauacaaaauuccggcuuguccugaggaagagccacuacuugauaacucuacaagaggaacagaugugaaggauauucccuuuaauuugacaaauaacauaccugguugugaggaagaagaugcaucugaaauaucugucucagugguauucgagacauuuccugaacaaaaagaacccagucucaaaaauaucauccauucauacuaccauccguacucugggucccaggaacauguuugccagucaucuucuaagcuucauuuacaugaaaauaaauuagacugcgacaaugauaacaaaccaggcauuggacauauuuuuaguacagauaagaacuuucauaaugaugcaagcacuaagaaagcaaggaacccagaagugguuacgguugaaaugaaagaagaccaagaguuugauuugcaaaugacaaaaaauaugaaccaaaauagugacaguggcaguacaaauaacuauaaaagccugaaaccuaaauuagaaaaucugaguucuuuaccaccagauucugacagaacaucagaaguauaucuacaugaagaauuacagcaagacaugcaaaaguuuaagaaugaggucaacacauuagaagaagaguuccuggcuuugaagaaagaaaauguucaacuucauaaagagguugaagaagaaauggagaagcacagaaguaauagcacagaauuaucaggaacccuaacugaugguacuacuguuggcaaugaugaugauggacuaaaucagcagauuccuaggaaggaaaauggagagcaugacaggccugcagauaaaacaucuaaugaaaagaacgaggucaaaaaccaaauauauccugaggcugacuuugcugacucaauggagccaucugaaauagccucggaggauugugaauugucucacucuguuuaugagaauuuuauguugcugauugaacaacuuagaauggaguauaaagauucugcuagccuaccaagaauccaagaaagacacauuuuguuugugugaacacuuacugaaacuuaagaauaaucacugugaccaacuuacaguaaaacuuaaacaaauggaaaauauggucaguguacuacaaaaugagcuaucugaaacaaaaaagacaaaauuacaguuagaacuucaaaaaauugaaugggagaaagagcuguacgauuugagacuugccuuaaaacaagaaaaugaggagaaaagaaaugccgauauguuguauaauaaagauagugaacaguuaagaauaaaagaagaggagugugggaaagugguugaaacaaagcaacaacuuaaauggaaucugagaagacuuguuaaggaauugaggacaguaagaaauaacuuggaucugguugugcaggagagaaacgaugcccagaagcaacuuucugaagaacaggaugccagaauauuacaagaucagauucugacgaguaaacaaaaggaacuagaaauggcucagaagaaaaggaauccugagauuucucauaggcaucagaaagaaaaggaucucuuucaugaaaauugcauguugcaggaagaaauugccuugcugagacuggaaauagauacaauaaaaaaucagaacaagcaaaaggaaaagaaauauuuugaggacauugagguugugaaagaaaagaaugauaaccuucaaaaaauuauaaaacgaaaugaggaaacauuaacagaaacaauacuccaguacaguggacagcugaacaaucugacagcugagaacaaaaugcucaauucugaacuggagaaugggaaagagaaccaagaaagacuagaaauagaaauggaaucauaccguuguagacuggcugcugcuguacaugacugugaucaaagucagacagcaagagaccuaaaacuugauuuccagagaacaagacaagaguggguucguuuacaugacaaaaugaagguugauaugucuggccuacaagcuaagaaugagauucuuucugaaaaacuuucuaaugcugaaaguaaaauuaacagccuacaaauucagcuccauaacacaagagaugcucuuggaagagagaguuugauuuuggaacgugugcaaagagaccucagccaaacacagugucagaagaaagaaacugaacaaauguaccaaagcaaacugaagaaauacauugccaagcaggaaucuguagaggagagauuaucucaacuacaaagugaaaauauguugcuucgacagcaacuggaugauguucacaagaaagcuaacagucaagaaaagacaaucaguacuauccaagaccaguuucauucugcugccaaaaaucuucaagcugagagugaaaagcagauucuuucacuacaagagaagaacaaggagcugauggaugaauauaaucauuuaaaagaaagaauggaucaaugugagaaagagaaagcaggaagaaaaauugaccuuacagaagcacaggaaacuguaccuucacgaugucuacaucuggaugcagagaaugaaguucuucaacuucaacagacauuauucucuaugaaagcaauacaaaagcaaugugaaacacuacagaagaauaagaagcagcugaaacaagaaguaguaaaccucaaaaguuauauggaaagaaauauguuagaacguggugaagcugaauggcauaaacuguugauugaagaaagagcaaggaaggagauagaagaaaaauuaaacgaagccauucucaccuugcagaaacaagcagcaguaucucaugaacaguuagcacaguuaagggaggauaauacuacuucaauaaaaacucagauggaacucacagucauagaucuggaaucugaaaucuccagaauaaaaacuucgcaagccgacuuuaauaaaaccaaauuggaaagauauaaggaacucuaccuagaagaagugaaaguuagagaauccuugucaaaugaacucaguagaacuaaugagaugauagcagaggucaguacacaacuuacuguggagaaagagcagaccagauccagaucucuauucacugcuuaugcuacaaggccaguccuagagucaccuugcguuggaaaucuuaaugauagugaaggucucaacagaaaacauauuccaagaaaaaagaggucugcucuuaaggacauggagagcuacuuguugaagaugcagcagaaguugcaaaaugaccuaacugcagaaguagcaggauccagccaaacuggacugcacagaauuccacagugcucguccuucuccuccagcucuuugcacuugcuucuuugcucuaucugccaaccuuuuuuucucauccuucagcugcuacuaaauaugaaccuggauccuauauagcuucuccucuaggauuuacacacaaggaaaaucugaaucaagauccaguuuuggaaguagcaaaagaauaugcacagauuuuaagaagaaaauacauacucug

SEQ ID NO: 914 - RNA, 74 nt, Homo Sapiens
gggugcaaaugaugcauauguuagcgaccaaagccugaucuuugcugauuagucauaauuaacugacugcaccc

SEQ ID NO: 915 - RNA, 2434 nt, Homo Sapiens
acuggccgaggggggcgggcggcuggaggagggggugacggggccccggcucagcaccucggagagcucccuccccggccuuguuuugcucuggcaucgccgccgggggagggagcgagggggccgggcaccgggcgcaaaggcagggggauggccauggaaggguugaggggccccgucggacagagggcccagccgugauccagcgacggguuuggggcuccgggaggggugggggggcagcgggcggcggcagcaguggccgcacaucuggauggaagcgagcuuuguccagaccaccauggcucuggggcuguccuccaagaaagcguccucucgcaacguggcuguggagcguaagaaccugaucaccgugugcagguucucugugaaaacgcugcuggagaaguacacagcggagcccaucgaugacucaucggaggaguuugucaauuuugcagccauuuuagagcagauccucagccaccgcuucaaagccugugccccagcagguccagugagcugguucagcucagacgggcagcggggcuuuugggacuauauccggcuggccugcagcaaagugcccaacaacugugugagcagcaucgagaacauggagaacaucagcacagcccgggccaagggccgggcauggauccggguggcacugauggagaagcgcaugucagaauacaucaccacggcucugcgugacacccggaccaccagacgguucuaugacucuggagccaucaugcugcgggaugaagccaccauccucaccggaaugcugaucggacugagcgccaucgacuucagcuucugucuaaagggggaaguccuggacgggaagacccccguggucaucgauuacacgcccuaccuaaaguucacgcagagcuacgacuaccugacggacgaggaggagcggcacagcgccgagagcagcacgagcgaggacaacucgcccgagcacccguaccucccgcucgucaccgaugaggacagcugguacagcaaguggcacaagauggagcagaaguuccgcaucgucuacgcgcagaagggcuaccuggaggagcuggugcgucugcgcgagucgcagcugaaggaccuggaggcggagaaccggcggcuucagcugcagcuggaggaggcggcggcgcagaaccagcgcgagaaacgggagcuggaaggcgugauccuggagcugcaggagcagcugacaggucugauccccagugaccacgccccucuggcccaggguuccaaggagcucacuacaccccuggucaaucaauggcccucacugggaacgcuuaauggggccgagggcgccagcaacuccaagcucuaccggagacacagcuucaugagcacggagccgcugucagcugaagccagucugagcucggacucccagcgccugggagagggcacgcgggacgaggagcccuggggucccaucggaagcucagagccaaauuaguggcucccuucgagcgaaugcccaggacuucaacgcaugcacuuuguguugaccucaucccuggcuucaccuugguuuuucccauccuaguucucccuaugccugaauauccugucuuuucuuuuuuauaagcaaccacacuguauuggaugacccuagaucuucuuugagacaaggcaggcuguggccauguagccccaucacacuguguuugugauugucugugugucugucucccccaccagacugugagcuccaugagggcagggaccgugucuuguccguucucuguauccccagugcuuggaacagagcgagugcucacuguguauuuaauaaauggacaaagagagaggaugacccucaggaaggaccccacgcccuccaugcugggccucugcggcucccuggccuccauucccagcugcaagucccuggcgagcuucaaauccaacgagugccuggugagcgacagucccgagggcagcccagcacugagccccagcugaggaacagcaugggcagugccagccccaccugccaggggccauggacaccugccaccuuucuucaacaagagucccccaauccaggcuacccuuccagagaacgcuacccacccagccaggguucucucggggaagaucucgucugcucaccuuagcuuucugccuuggcagcacgggcugcggaagaaagcacgcugggccaggaggcaggggugcccaagccacagggagccccuggggaagccugcuccauucuucuggugaccuuggcgcuccuucacucaucuccccugcccccucaggaacugguggcccagcuuccacacccccaccucccagucucuagccucuccaucugucuguguauggccuggagucacuccuuccucagcccccagggcaagagagcucaaauaaaaaccagaggacugag

SEQ ID NO: 916 - RNA, 7430 nt, Homo Sapiens
gaaaacuauaaugccuuucaaauauggcuuauugcuuggaucucaauaucucccacguaucuuggguggaauauuuugccgaagaucuuucugucaaucauuuacaaucaugugcugcaaaaugaaguuugggucaacaguagaccacauauaugauggugguucuguaagcguauaauggagcuaucccuauauagguauaccauuuuuaucuuuuuuuuuuuuuuuuuuuuuuuuuugagauggagucucgcucuguuguccaggcuggagugcagugguaugaucccagcucauugcaaccuccaccucccagguucaagugauucuccuaccucagccuccugaguagcugggauuauagacacgcgucaccacacucagcuaauuuuuguauuuuuaguagagaugggguuucaucauguuggccaggcuggucuugaacuccugagcucaagugauccacccaccuuggcgucccaaagugcugggauuacaggcaugagccacugugcccaggccccauuuuuaucuuuuacacaguauuuuaacuauauauuuuccauguuuacauacacaaauaccugccauucugugacaguugccuuuaguauucaguacaguaacauacaguacagguuuguagccuaggaguccuaagccauaccguguacccuagguaugguggcuacaccaccuagguuuguguaaguauacgcuaugauauuagcacaauggugaaaucaccuagugacacauuucucaagcuccucacguggcaagcaaugcaugacugcauaugaaagcucuuaaauagagauuguuucuaaauuaaucucaaaacagucauuauuuacuauuuauggaauuuuuuuuaaaaaaaggagcaaaaguaucauuucagugggaacuuaacuuggggcuacaguguuuuauuuaacuuuuaccccaaaguugcaaaguguuuugaaauuuuucccuguaaaauaauuauuuuaauucaauuuaaauaaaacccaccaaggagacuucaagcuuuaagaagucuagcuuccugugaaaugugagaggaagucagcacucauuucagaaaucugauuauaacgauagcuccaucccuaaaugaggugaaucuuggacucucuuccauuuuauuuuauuuuauuuuuuugagauggaguuucucucuuguugcccaggcugaagugcaauguugcgaucucggcucacugcaaccucugccucccagguucaagugauucuccugcuuuggccuccugaguagcugggauugcaggucaguugcucucccuggaaggaagaguguucucggauuucaccuuaaaggaggaaggcugccagaacugaacuagcacuucugaauauccugaggcgagguccggugacuuccuugggaagcucugccgcgcccccaccccacccuaccccacccuaccccaccacagcaggcgcuggaguccugggaccaccagggucugaggcccaaauccuuccucacuaaggggaggagagggguguuccggcagggcaggaugggaaggcgugcuugggcgggauugugacauaagagugcccuggugacauggagcagaucugugacauaaauaaaggugucauaaagacagggcggggcucacgcuuagaaggggcacgagcgucucggagcugccagaaugucuucugcucagugcccggcacuagugugugucaugucccggcugcguuucuggggcccauggccccuccuuauguggcaacuauuguggcuacuagucaaggaggcucagccucuggagugggucaaggacccgcuccagcucaccucuaauccccuggggccgccugaguccuggucuucccacuccucccauuucccacgggaaucuccccaugcgccuacucucccagcagacccgugggacuuugaucaccuggggcccucugcuuccucagagaugccagccccaccccaggaaucgacugaaaauuugguuccauuccuggacaccugggauucagcuggagagcagccccuggagccagagcaguucuuggcuucacagcaggauuuaaaggacaagcugaguccacaggaaaggcucccuguuucgcccaagaagcugaagaaagauccagcucagcguuggagccuugcugagauuauuggaauuacacgccaauuauccacaccucagagucagaaacagacuuugcagaaugaauauuccaguacagauacaccguaucccgguagccugccuccagaacuccgggugaagucagaugagccuccagggcccucugagcaaguuggaccuucucaauuccaucuagagcccgaaacucaaaauccagagacccuugaagacauccaguccucuucacuccagcaagaagccccagcacagcuuccacagcuccuugaggaagaaccuucuucaaugcagcaggaggccccagcucugccuccagaguccucuauggagagucuaacucuaccgaaucaugaggugucaguucaaccuccaggugaggaucaagcuuauuaucacuugcccaacauuacaguuaaaccugcagauguggagguuaccauaacuucagagccuaccaaugagacagaaucuucccaagcccagcaggagaccccaauucaguuuccagaggagguggaaccuucugcaacccaacaggaggccccaauugagccuccaguuccuccuauggagcaugaacuuuccaucagugagcagcagcagccaguucagccuucugagucuccuagggaggucgaaucuucuccgacccagcaggagaccccaggucagccuccagaacaucaugaagucacaguuucaccuccaggucaccaucaaacucaucauuuagcuucacccagugucucugugaagccuccagacgugcagcucaccauagcagcagagccuagugcagaggugggaacuucucuaguccaccaggaggcuacaacucggcucucagggucagguaaugauguagaaccucccgccauccagcacgggggcccaccucugcuuccagagucaucagaagaagcuggaccuuuagcaguucaacaggagacuucauuucaaucuccggaaccuauuaauaaugagaaccccucuccaacccagcaggaggcugcagcugagcauccacagaccgcugaggagggugagucuucccuaacccaucaggaggccccagcucagacuccagaguucccuaauguaguuguagcucaaccuccagagcauucacaccugacucaagccacaguucaaccuuuggaucugggguuuaccaucacuccagaauccaagacagagguugaacuuucuccaaccaugaaggagaccccaacucagccuccuaagaaaguuguaccccaacuucgaguauaucaagggguaacaaauccaacaccaggucaggaucaagcucagcauccagugucacccagcguuacaguucaacuuuuggaccugggacuuaccaucacuccagaaccuacuacggagguuggacauucuacacccccgaagaggacuauaguuucuccaaagcauccugaggugacacuuccacauccagaccagguucagacucagcauucacaccugacucgagccacaguucaaccuuuggaccugggguuuaccaucacuccaaaauccaugacagagguugaaccuucuacagcccugaugacuacagcuccuccuccaggacacccugaggugacacuuccaccuucagacaagggucaggcucagcauucacaccugacucaagccaccguucaaccucuggaccuggagcuuaccauaacuacaaaaccuacuacagagguuaaaccaucuccaaccacggaggagaccucaacucagccuccagaccugggacuugccaucauuccagaacccacuacagagacuggacauucuacagcccuggagaagacuacagcuccucguccagaccggguucagacucugcaucgaagccugacugaagucacagguccaccuacugaacuagaaccugcucaggauucacuggugcagucugaaaguuacacccaaaauaaggcuuuaacugcaccagaggaacacaaggccuccacaagcaccaacauaugugagcucuguaccugcggagaugagauguugucauguauugaucucaacccagagcagaggcuccgccaagugccugugccagagcccaacacccacaauggcaccuucaccaucuuaaauuuccaaggaaacuauauuucuuacauugauggaaauguauggaaagcauacaguuggacugagaaacuaauucucagagaaaauaacuugacugaauuacacaaggauucauuugaaggccugcuaucccuccaguauuuagauuuauccugcaauaaaauacagucuauugaaagacauacauuugaaccacuaccauuuuugaaguuuauaaaucuuaguugcaauguaauuacagaacucagcuuuggaacauuucaggccuggcacggaaugcaguuuuuacauaaguuaauucucaaucacaauccucugacaacuguugaagauccguaucucuuuaaauugccagcauuaaaauaucuagacaugggaacaacgcuagucccacuuacaacacuuaagaacauucucaugaugacuguugaacuggaaaaacuuuuuucaauaucacucuucguggauucuucuuuauauuaaauaugugguaacuuauuguuguuauucuuuugaaugcucaaauuguccagauuugaccaaugcagucuuuguuauuuuuuaacuccgcaauccagguuaaacuauuuuuaaugcccagaguaauuuauaauauuucccacucccaacaggaauugagaaagggacuccagaaguugggggcuuauucagacuucuuaaaagucuaccuucuuccucuguacuuucagcccaaagugagacuuuugaauugggaagagauacuucugaaacuacuaaucacugucacccaauucuaaucccaaccaucuuuauucuaggcauaccauacucacugccaugcuuacccuucaguugggcacuuuuguccuccuuccuauuggucuucugguuccuacccaacuguccaguccauaggcuucaaugacaccuuuuucccacaccugugguagcguuggcugccuccuuuaccuacucaaguaaccgcuuuaccgcuaauuuauugcucucuguuuucaucuauaggaucuuaccuagccauauggccugcugccucugccaauuuaaaaacagcauugaggcugucugcaagacagucaagcugcauugcaacagugcaugucugacaaacaccacacauuguccugaagaagcaucgguagggaauccagaaggagcguucaugaagguguuacaagcccggaagaacuacacaagcacugagcugauuguugagccagaggagcccucagacagcaguggcaucaacuugucaggcuuugggagugagcagcuagacaccaaugacgagagugauuuuaucaguacacuaaguuacaucuugccuuauuucucagcgguaaaccuagaugugaaaucacuguuacuaccguucauuaaacugccaaccacaggaaacagccuggcaaagauucaaacuguaggccaaaaccggcagagagugaagagaguccucaugggcccaaggagcauccagaaaaggcacuucaaagagguaggaaggcagagcaucaggagggaacagggugcccaggcaucuguggagaacgcugccgaagaaaaaaggcucacgaguccagccccaagggagguggaacagccccacacacagcaggggccugagaaguuagcgggaaacgccgucuacaccaagccuucguucacccaagagcauaaggcagcagucucugugcugaaacccuucuccaagggcacgccuucuaccuccagcccugcaaaagcccuaccacaggugagagacagaucgaaagacuuaacccacgcuauuuccauuuuagaaagugcaaaggcuagaguuacaaauacgaagacgucuaaaccaaucguacaugccagaaaaaaauaccgcuuucacaaaacucgcucccacgugacccacagaacaaccaaagucaaaaagaguccaaaggucagaaagaaaaguuaucugaguagacugaugcucgcaaacaggcuuccauucucugcagcgaagagccucauaaauuccccuucacaaggggcuuuuucauccuuaggagaccugaguccucaagaaaacccuuuucuggaaguaucugcucuuucagaacauuuuauagagaagaauaauacaaaacacacaacugcaagaaaugccuuugaagaaaaugauuuuauggaaaacacuaacaugccagaaggaaccaucucugaaaacacaaacuacaaucauccuccugaggcagauuccgcugggacugcauucaacuuagggccaacuguuaaacaaacugagacaaaaugggaauacaacaacgugggcacugaccugucccccgagcccaaaagcuucaauuacccauugcucucguccccaggugaucaguuugaaauucagcuaacccagcagcuacagucccuuauccccaacaacaaugugagaaggcucauugcucauguuauccggaccuugaagauggacugcucuggggcccaugugcaagugaccugugccaagcucaucuccaggacaggccaccugaugaagcuucucagugggcagcaggaaguaaaggcauccaagauagaaugggauacggaccaauggaagauugagaacuacauuaaugagagcacagaagcccagagugaacagaaagagaagucgcuugagcucaaaaaagaaguuccaggauauggcuauacugacaaacucaucuuggcauuaauuguuacuggaauacuaacgauuuugauuauacuuuucugccucauugugauauguugucaccgaaggucauuacaagaagaugaagaaggauucucaaggggcauuuucagauuucugccauggaggggaugcucuucgcgaagggagagucaggauggacuuuccucauuuggacagccgcucugguuuaaagaucuguacaaaccucucagugccacaagaauaaauaaucaugcauggaagcugcacaagaagucaucuaaugaggacaagauccucaacagggacccuggggacagcgaagccccaacggaggaggaggagagugaagcccugccauaggaggagaacacagcccaccucaggccuccugcaaaaauacauagaauaaacaacaacaguuacuaaaugaa

SEQ ID NO: 917 - RNA, 1030 nt, Homo Sapiens
cucucuggcugcuccggcauauuugagaaggucuguuucccugguccuucuggguuuccaccaauuggcaagaagggaucagccuguccuagagaucucaucucccagacgccacgucucucgguuucuucuuagaucacuccucugccaaagaucccaacaagacaacauggcucccaagaagccugagccuaagaaggaggcagccaagccagcuccagcuccagcuccagccccugcaccagccccugccccagcuccugaggcucccaaggaaccugccuuugaccccaagaguguaaagguaauaggguguccaugccccagaucgcagucccauggggcagugauagacuucacugccgaccagauugaagaguucaaagaggccuuuucauuguuugaccggaccccgacuggagagaugaagaucaccuacggccagugcggggauguacugcgggcccugggccagaacccuaccaaugccgaggugcugcgugugcugggcaagcccaagccugaagagaugaaugucaagaugcuggacuuugagacguucuugcccauccugcagcacauuucccgcaacaaggagcagggcaccuaugaggacuucguggagggccugcgugucuuugacaaggagagcaauggcacggucaugggugcugagcuucggcacguccuugccacccugguaauuaagagcgcaccaccucccaaacccaccgcaggagagaagaugacugaggcugaaguggagcagcuguuagcugggcaagaggaugccaauggcugcaucaauuaugaagccuuugucaagcacaucaugucagggugaagcagagucuuccaggugccuggcccuuggcuuuagccauaccagggugaguuaaagagaggccccggcugggugagcugagauggaguccucgacuuaucaccacaccacugccccaaggaccuuacaggcccucccuguuaauaaacagcucuaacacggccaggcugggcucugggauucuga

SEQ ID NO: 918 - RNA, 4899 nt, Homo Sapiens
cgccgcgggaggcggacgagaugcgagcgcggccgcggccccggccgcucugggcgacugugcuggcgcugggggcgcuggcgggcguuggcguaggagggcccaacaucuguaccacgcgaggugugagcuccugccagcagugccuggcugugagccccaugugugccuggugcucugaugaggcccugccucugggcucaccucgcugugaccugaaggagaaucugcugaaggauaacugugccccagaauccaucgaguucccagugagugaggcccgaguacuagaggacaggccccucagcgacaagggcucuggagacagcucccaggucacucaagucaguccccagaggauugcacuccggcuccggccagaugauucgaagaauuucuccauccaagugcggcagguggaggauuacccuguggacaucuacuacuugauggaccugucuuacuccaugaaggaugaucuguggagcauccagaaccuggguaccaagcuggccacccagaugcgaaagcucaccaguaaccugcggauuggcuucggggcauuuguggacaagccugugucaccauacauguauaucuccccaccagaggcccucgaaaaccccugcuaugauaugaagaccaccugcuugcccauguuuggcuacaaacacgugcugacgcuaacugaccaggugacccgcuucaaugaggaagugaagaagcagagugugucacggaaccgagaugccccagaggguggcuuugaugccaucaugcaggcuacagucugugaugaaaagauuggcuggaggaaugaugcaucccacuugcugguguuuaccacugaugccaagacucauauagcauuggacggaaggcuggcaggcauuguccagccuaaugacgggcagugucauguugguagugacaaucauuacucugccuccacuaccauggauuaucccucuuuggggcugaugacugagaagcuaucccagaaaaacaucaauuugaucuuugcagugacugaaaauguagucaaucucuaucagaacuauagugagcucaucccagggaccacaguugggguucuguccauggauuccagcaauguccuccagcucauuguugaugcuuaugggaaaauccguucuaaaguagagcuggaagugcgugaccucccugaagaguugucucuauccuucaaugccaccugccucaacaaugaggucaucccuggccucaagucuuguaugggacucaagauuggagacacggugaggugagcuucagcauugaggccaaggugcgaggcuguccccaggagaaggagaaguccuuuaccauaaagcccgugggcuucaaggacagccugaucguccaggucaccuuugauugugacugugccugccaggcccaagcugaaccuaauagccaucgcugcaacaauggcaaugggaccuuugagugugggguaugccguugugggccuggcuggcugggaucccagugugagugcucagaggaggacuaucgcccuucccagcaggacgaaugcagcccccgggagggucagcccgucugcagccagcggggcgagugccucuguggucaaugugucugccacagcagugacuuuggcaagaucacgggcaaguacugcgagugugacgacuucuccuguguccgcuacaagggggagaugugcucaggccauggccagugcagcuguggggacugccugugugacuccgacuggaccggcuacuacugcaacuguaccacgcguacugacaccugcauguccagcaaugggcugcugugcagcggccgcggcaagugugaauguggcagcugugucuguauccagccgggcuccuauggggacaccugugagaagugccccaccugcccagaugccugcaccuuuaagaaagaauguguggaguguaagaaguuugaccggggagcccuacaugacgaaaauaccugcaaccguuacugccgugacgagauugagucagugaaagagcuuaaggacacuggcaaggaugcagugaauuguaccuauaagaaugaggaugacugugucgucagauuccaguacuaugaagauucuaguggaaaguccauccuguaugugguagaagagccagagugucccaagggcccugacauccuggugguccugcucucagugaugggggccauucugcucauuggccuugccgcccugcucaucuggaaacuccucaucaccauccacgaccgaaaagaauucgcuaaauuugaggaagaacgcgccagagcaaaaugggacacagccaacaacccacuguauaaagaggccacgucuaccuucaccaauaucacguaccggggcacuuaaugauaagcagucauccucagaucauuaucagccugugccacgauugcaggagucccugccaucauguuuacagaggacaguauuuguggggagggauuuggggcucagagugggguagguugggagaaugucaguauguggaagugugggucuguguguguguaugugggggucuguguguuuauguguguguguugugugugggaguguguaauuuaaaauugugauguguccugauaagcugagcuccuuagccuuugucccagaaugccuccugcagggauucuuccugcuuagcuugagggugacuauggagcugagcagguguucuucauuaccucagugagaagccagcuuuccucaucaggccauugucccugaagagaagggcagggcugaggccucucauuccagaggaagggacaccaagccuuggcucuacccugaguucauaaauuuaugguucucaggccugacucucagcagcuaugguaggaacugcugggcuuggcagcccgggucaucuguaccucugccuccuuuccccucccucaggccgaaggaggagucagggagagcugaacuauuagagcugccugugccuuuugccauccccucaacccagcuaugguucucucgcaagggaaguccuugcaagcuaauucuuugaccuguugggagugaggaugucugggccacucaggggucauucauggccugggggauguaccagcaucucccaguucauaaucacaacccuucagauuugccuuauuggcagcucuacucuggagguuuguuuagaagaagugugucacccuuaggccagcaccaucucuuuaccuccuaauuccacacccucacugcuguagacauuugcuaugagcuggggaugucucucaugaccaaaugcuuuuccucaaagggagagagugcuauuguagagccagaggucuggcccuaugcuuccggccuccugucccucauccauagcaccuccacauaccuggcccugugccuuggugugcuguauccauccauggggcugauuguauuuaccuucuaccucuuggcugccuugugaaggaauuauucccaugaguuggcugggaauaagugccaggauggaaugaugggucaguuguaucagcacguguggccuguucuucuauggguuggacaaccucauuuuaacucagucuuuaaucugagaggccacagugcaauuuuauuuuauuuuucucaugaugagguuuucuuaacuuaaaagaacauguauauaaacaugcuugcauuauauuuguaaauuuaugugauggcaaagaaggagagcauaggaaaccacacagacuugggcaggguacagacacucccacuuggcaucauucacagcaagucacuggccaguggcuggaucugugaggggcucucucaugauagaaggcuauggggauagauguguggacacauuggaccuuuccugaggaagagggacuguucuuuugucccagaaaagcaguggcuccauugguguugacauacauccaacauuaaaagccacccccaaaugcccaagaaaaaaagaaagacuuaucaacauuuguuccaugagcagaaaacuggagcucuggccucaguguuacagcuaaauaaucuuuaauuaaggcaagucacuuucuucuucuuaaagcuguuuucuaguuugagaaaugaugggauuuuagcagccagucuugaaggucucuuucaguaucaacauucuaagaugcugggacuuacugugucaucaaaugugcgguuaagauucucugggauauugauacuguuuguguuuuuaguugggagaucugagagaccuggcuuuggcaagagcagaugucauuccauaucaccuuucucaaugaaagucucauucuauccucucuccaaacccguuuuccaacauuuguuaauaguuacgucucuccugauguagcacuuaagcuucauuuaguuauuauuucuuucuucacuuugcacacauuugcauccacauauuagggaagaggaauccauaaguagcugaaauaucuauucuguauuauuguguuaacauugagaauaagccuuggaauuagauauggggcaaugacugagcccugucucacccauggauuacuccuuacuguagggaauggcaguaugguagagggauaaauagggggcggggagggauagucauggauccaagaaguccuuagaaauaguggcagggaacagguguggaagcucaugccuguaauuauaaccuucagcuacuaagacaggugugguggcucacgccugugauuauaaucuucaguuacuaagacagaguccaugagaguguuaaugggacauuuucuuuagauaagauguuuuauaugaagaaacuguaucaaagggggaagaaaauguauuuaacaggugaaucaaaucaggaaucuugucugagcuacuggaaugaaguucacaggucuugaagacca

SEQ ID NO: 919 - RNA, 924 nt, Homo Sapiens
auggaaacagggaaccucacguggguaucagacuuugucuuccuggggcucucgcagacucgggagcuccagcguuuccuguuucuaauguuccuguuugucuacaucaccacuguuaugggaaacauccuuaucaucaucacagugaccucugauucccagcuccacacacccauguacuuucugcuccgaaaccuggcuguccuagaccucuguuucucuucagucacugcucccaaaaugcuaguggaccuccucucugagaagaaaaccaucucuuaccagggcugcaugggucagaucuucuucuuccacuuuuugggaggugccauggucuucuuccucucagugauggccuuugaccgccucauugccaucucccggccccuccgcuaugucaccgucaugaacacucagcucuggguggggcuggugguagccaccugggugggaggcuuuguccacucuauuguccagcuggcucugaugcucccacugcccuucuguggccccaacauuuuggauaacuucuacugugauguuccccaaguacugagacuugccugcacugacaccucacugcuggaguuccucaagaucuccaacagugggcugcuggaugucgucugguucuuccuccuccugauguccuacuuauucauccuggugaugcugaggucacauccaggggaggcaagaaggaaggcagcuuccaccugcaccacccacaucaucgugguuuccaugaucuucguuccaagcauuuaccucuaugcccggcccuucacuccauucccuauggacaagcuuguguccaucggccacacagucaugacccccaugcucaaccccaugaucuauacccugaggaaccaggacaugcaggcagcagugagaagauuagggagacaccggcugguuuga

SEQ ID NO: 920 - RNA, 2994 nt, Homo Sapiens
cagggcaugcaguuuuugccuuccggaacuagaucaggaucaugcauuuaagcuagaaaauggaaagaggaguugcuucacccacagucagugcuauugcaucaaccaaucccugccauucugcaguuuccugguguaucugcccggagucacacagucuuuccugcuaagccucagcgucuccuccaagccacaucaaaaucuuuccuucugggccuuucccagaagugaauucuugcuggaagguauaaaagaccagcuccuccaagcagagcaacucccuggcugccgugaaaagacaaggcacugggcagugaugaggguccuucuccaucucccagcccuccuggcuucccucaucuugcuucaggcugcagcaucuaccacaagagcgcagacuaccagaaccucugccaucuccgauacugugagucaggccaagguccaagucaacaaggccuuccuggacucccgaaccaggcugaagaccgccaugagcucugagacucccaccagccgacagcucucagaauaccucaagcaugccaaaggccggacgcgcacagccauccgcaauggacaggugugggaggagucuuuaaagagacugaggcagaaggcauccuugaccaaugucacagaucccagccuggacuugacuucacugucucuggaggugggcuguggugcuccugcucccguggugagaugcgacccgugcagcccuuaccgcaccauuacgggagacugcaauaacaggaggaagccugcgcugggcgccgccaacagggcucuggcgcgcuggcugcccgcggaguacgaggacgggcucucccugcccuucggcuggacgccggggaagacgcgcaacggcuucccucucccgcuggcccgggagguaucuaacaagauuguuggcuaucugaaugaggaggguguucuggaccaaaacaggucccugcucuucaugcaguggggucagauuguggaucaugaccuggacuuugccccugacaccgagcuggggaguagcgaguacuccaaagcccagugugaugaguacuguauccagggagacaacugcuuccccaucaugugcuuuccuguccaguucccacccaaugaccccaaggcggggacucaagggaaaugcaugccuuucuuccgagcuggguucgucugccccacuccacccuacaagucccuggcccgagagcagaucaacgcucugaccuccuuccuggaugccagcuuuguguacagcuccgagccaagccuggccagccgccuccgcaaccucagcagcccccugggccucauggcugucaaccaggaggucucagaccauggacuacccuaccugcccuaugacagcaagaagccaagccccugugaguucaucaacaccacugcccgugugcccugcuuccuggcaggagauucucgagccucagagcauauucugcuggccacaucccacacccucuuucuccgcgagcauaaccggcuggccagagaacuaaagagacucaacccucagugggauggagagaagcucuaccaggaagcccggaaaauccugggagccuucgugcagauuaucaccuuuagggacuaccuacccauuuugcuaggugaccacaugcagaaguggauacccccauaucaaggcuacagugaaucuguggaucccagaauuuccaaugucuucaccuucgccuuccgcuuuggccacuuggagguccccucuaguauguuccgccuggaugagaauuaucagccaugggggccagaaccagaacucccccuccacacccucuucuucaacacuuggaggauggucaaagaugguggaauugauccucuggugcggggccugcuggccaagaaauccaagcugaugaaacagaauaaaaugaugacuggagagcugcgcaacaagcuuuuccagccaacucacaggauccauggcuuugaccuggcugccaucaacacacagcguugccgggaccaugggcaaccuggguacaauuccuggagagccuucugugaccucucacagccgcagacacuagaggaguugaacacagugcugaagagcaagaugcuggccaagaaguuacugggucucuacgggaccccugacaacaucgacaucuggauaggggccauugcugagccgcugguggaaaggggucggguggggccucuccuggccugccucuugggcaagcaguuccagcagauccgugauggagacagguucuggugggaaaacccuggggucuucacgaacgagcagaaggacucucuacagaaaauguccuucucacgccuugucugugacaacacccgcaucaccaaggucccacgggacccauucugggccaacagcuaccccuaugacuucguggauugcucagccaucgacaagcuggaccugucacccugggccucagugaagaauuaggggcccgcgcugcacaggaaaguucccuuugguccacagggccauuucaagcaaguucaaugaccuggucccuuagagcuccauaucccagucccagcccuucuuugcagcugggccucucuauaccccuggaugaacagcuugcucaggccccaggguggcugccucggcccucccagcucuuacacucagcuccaguggcuucuccuuucugucaagacuuagccccgcugagaugcccuucugcuccagcuugcuggauguuaccuguccucuucccuccacaagucuuggcccuuaaccuuuaucuuucuuccuguccucucaccuagauuguaagcucccugggccaggacuucagccugccuccgaggguccccuguggcaccuagcauggugcacagcacauuagaagugcucaaaaacaucugaugacugacuaaagaugcuaggcgugacaccguucccuccaaaagcagaccucggaaucacugccaaauaaguaacuagacguuuacaggcca

SEQ ID NO: 921 - RNA, 2474 nt, Homo Sapiens
agaucugacucugcagccaucccucaccacuccugcuuggacaucgccaggcucagcuagagaaggcagaaaaaguuccuccaacuccuuccccaggcaccuaugcaggcuccacacuccugccugaacagcuaugauuuuaaaagccaucgagucaugaagagaagugugccagugugugcuggacucaguuuccccugugcaccauuuuccccagucagcccugcaccuuccaagaacuaugacccgaaggcacacccuagucagcucaggccccacauuccugcaaaaauaaggcuccagggcucccucaucgcagcauggguucugcaggaagccccagugccaaguggcuuucaaaacuagccucagcuagcaacguggcggcuauuucagcgaccgacaaaagcagcucccccagccucccuugguguuuguggucccuuuuguuccagccaggcaccaugaggaaaaugcagcaaccguuuggaaacaaaggcucgggcaggcucucuccagucugaaaagcccacuuucacuugaguuucagguaauuugcugugcagccugaauucguuagacaaauuaggcucacuuggacuucagguggcucaauuaccugggugauuugcauguuuaugagugaaggggacugcacaguagcagaaagcaaauuugaaauccugacuuugggggcccuggagccccuuugcugcaccuuuacuuucccuaccagaaaggaggaaggacagaguagcuccccagcaagcagaucagcggaugucacauaaccacagggcagucaucagggagcacgaccccuccccagggccacgcaggccuuaguuucuccuucuggaucugccagcaaaacaaagguaacugccuaagaacagcuuccaaagauggaagaagaaagugagaaaaucuauauuauugaucguucauaccuaaggaaaagaggcaagaggauucccauagcccagcugggaggugccagaaacuuuuaaaggugcuuuauaaaguauccuaaaucuacucuacaacccuaaaagugaaauauuuucacucaaagaagcugagauuucaagguugaauaucuugcaugcacagcuaguuacugagagguuaagaauugccaaaaaagaccugugccuucccucugauauucccuggguuuaguucuucucuccuccuucugccaagagaccacugagaagugccuccgaagagcuaagggcugccccaggugguuaugugggagcuggagaauuucccaaaaagcuucgugaagagcuugaaaccccagaagagaucccuuggggaugggaguugcuccaggacagaagaagcagugagucaaggcuugaggaucuggagacuaagcaacucucaagagaaaguucugcugggaccccucccuuggucuucccuuucugcccccucugaugcccccuucauccaucccugccugccuucuggucugucccugcagcgugagugccagacagaggccuguucugauguccugacaugcuacaauuaugcagauuuacacagcaagcauaagaccuucuccgcauguauggcuuccccauucccaagcagaccaugaacuuccuaaggaaagugaccgaauuccgcacuucucaacccucgcggaggggcagggagaugguaaccaugucacaaccaguuccucccagaggauucaacaucacugcucaucuccucagaccaaucaagaggauuggucauugggaagucauccugagcugugaccacucucuggaacccagaacuuccugcuucacauggacuggaugaaugucuaggggcacagcuguuuccagacaccugguuugucuucagaaucucaaaucuuaaaggcuuucugguccaaccauccaaugcauggugaggccccuucuggauugccccugccugcagcauccuggugugugccuacauauuuccagggacagccaggaagauuccaugcaauuauguguucccuguuccaggggagcccacagcuugaucaggggacagacuguaucuuccaucaacucaagaacuaagacucaaauuaaaaaaaugcaaggcugggggccaggaugaagaaauaaagagagggugaaaucauucugggaaguuuccuugaaaggggugagucauaaagaggggguugggugcaggugaggaggaggaagauuacagacugcagggaugagcaaauaccauuucccaggauuuccugaaguuuuucuccccucccaaagcccaaaucugccucuuucuggggcccagcgaggacccuggaagacagagauccuagaaaaagcagagggaaaagaagaggaagagaacauggagaaaccgccagggaacagaacucuugguccaggaggcgcaaaccacaagugcaauuagucaaaaaaaaacccugaaauuaaaaaaugauuccaagcuga

SEQ ID NO: 922 - RNA, 5119 nt, Homo Sapiens
cacagccccagcagaaggcccucaccucacaaggaacaugaggcgccuugccgggcgcgcaggccacucccaggucacucaggauuccaaguucucccccaagacgccuucagaugcugagcggcacaagggccuccccagggacugguugcaaagccuccugcucagcuugagagggccaccagcuccccacuguuuacuguuguuccugagagaggccagagggagggaccagccagggaguggccagagggacagaagggguggccuuccugagggcagggugggugccccagaccugagagcgcugcaggacuccccuccacaggcucagguggagccuccccaggguccuccuggccaggaaggcagagagccgacuucuuucuucagcucccaacccaggcccagcccacggcgugggagucggggagagggagaggaggaggaaggaggaggagagagggagcuugucuugucccugagcagcgcucucagggcagaggugaggcaccgggacaugaaguuggaggacaaguucccaagcagggcuuccucgggcucccccucgcgacgguaauuugacacuuggaucuccaggacgaccaacaacaaaaaagccaggcagagacagcagcuggcugucagcagaggagcugggcugaggcgcccaggggagcagcggcgcccacgaaggaaguacgaggacagcacguggaggcuccgcgcuggggcacugcugcucagcccccaacaccugagcucccagggcacuccuuggccuggcuuuaaauagcccgcugggaagaccaccuggggaccggcuggaaugcgccuccuccucuuuagagaacaggaccccucagcucccccaccugcgccaugaagguucagucgcggguuuacgcuccaaaugacaagauaucaacugcaaaacaaagggggucccgggguuccucuccagcucucugggggcagaacagccacguccaacgguccuacuucugcucacugugugacaggauaccgugaguaccccugggucagacccuggggcugggugaggcuggccaugccuggcuggcaaauucagcuuccagucagcccccuagggaagcccugggcgcaaagcuaugacacuguccacagccgcagccugcugcugcugggaacugacacuuuuccccgcuggaggccgggguccacccggcaugagucugcagcucucccacuuugcagccccuggaggaggcuggccagagcuucucagcaacaaaccccacuuuuccugcaccaguaaauucagccucaguccaaccuuccuccucccuguucuggugagcacagccccaggucucucgcucacaaggaaaagugcccccugcaaucucucccugggucucuggguguggcacaagcgaaaaagcucucccugcccgcucccucuuugaaggagugucucugcugggcuacauuaggccgugugggcacagugccagucaggcugaaaacgccagaccaaguguagacagagagggaggggagaaaggcagcccagcuccugaaccacgcgcaaacugucccguaagggacacugucggcauugucgucccucuaagaaugagggaaccuggaaagcuggggcgugaggauggcacggaggucccggaaccaagaggggaccacuguccuugugcaagccugcuccaccuggccagagagaaugucccauucagucugaccagaggguucaguccuacacucaggcuggcuagacucacaagaccuguaccuguggugacaaggacuccagguagucucaaagagccugguguggccccggccugguggugauaugcugauaaaagcagcuucagauccacaaaugugggcuggggcuggccgagcacagccagcuggcuuccagggggcucucgggcccuggcuccuguacugagcccacugcacgggcaguacccucagcggggcugcuccuggcuaucuugcuggucuaagcuggagacaggccuccauggagagacagcguggggcaccagugggggugcuggcuggggcccuguccugcuguguaaccucagagaaguugcuugcucucucgggucucagcuuccccacguauagaaggaaggaggcgggagcggaugaucuauagcauucuaggacccuaugccucucaguacauuugaaaacugagauccucaccuccacagaaacgcacucacuccaggugaggugugagaagcuggguggaucuaacucagggaacccacggcuuuugacaagaacucaucuaauuuuccacggagccaucuucugccugcuacccucaucaucacuuaaaaaaacagcuccccaggccgggcgcaguggcucacaccuguaaucccaacacuuugggaggccgagggcggaucaccugaugucaggaguucgagaccagucuggcuaacauggugaaauccuguuucuacuaaaaauacaaaaauuagccgggcaugguggcgcacacucgugaucccagcuacucgggaggcugaggcaggagaaucacuugaaucugggaggcagagguugcagugagcugagaucaugccauugcacucuagcuugggcaacaagagagaaacuccaucucaaagaaaaccaaaaccaacaacaaaaacauagcuccccaccuccagcuugccuaccuuccuucagggcacacaccgcagacacccuaggacagacacccaaaagguguugggggugcuagugacggugcacgggggugacagcccccaaagccagugagacccgucccgggggggcauucucgugugccgggcaccccccuauggcugucuacaaugugcugcuagauggucaguccucccaauagccucaaaacacgggcaucucauuccauaucagagacaugaagcaaccuguucaugucacaaaaggaagaaguggagguggcauucaaggaggagcagcugaaaacacuagagcaggccccuggcagagaaggaaauccagaagguacaugccggcugccaucuugcuccugaagggcuacgaggcagaagagggggcaaggucuaagugaccacaagugggacuaacugggggccagcagggaguccgaccuucugcagugggugggcugccucagcaggcggagguuccucaccauccugggugcucaugcaaagaccacauggccucaaggauggccgcaggccaauugcaggguggagggccccguucgaugaccuucacggugguucuaaaccagcucugccaaggcagcggcaccgggagugacuggccucacugacguagccaucucagcgagaaccggcugagaccugggacaaggcaacgauaauuacagccaaaggucuggcaccagccccuggccaccuguccccaccaccaccccuggauuagagcaacugccuuggugaacuggaucaggcuggguugggacaagguugucucuggcuccucucuaaagaggcaccagcucccucaugcccacaggagaggcagaaggggaaagccuucuggaguggcaccuugggccucuugggcacccugagacaggaagaggcucuccuggggcaggggugggaguggagaggacuuuccuggucaggcuagagaaacagaugacgccagcaggggaggggcuggcuugagcaaccugggccuccugacccccucccaacagacaggacagaaacccuggcaaaaccuggagggacacggugcggccucccccucuggcagaacaggcaugaguguagaaacugggcuggugggagagguuggggggccugggggacaggggggcaguuuucaccucugacugacccuggccagaagccccaugaaccugcucucgggagaaccugcuccuucuguccccacauugauggaaggcaagaguaccagcuuggcauccuaucccagucuccccaccccgagggagcugugccagucccaagcacccaggcaaaacccaguagugguaccucaagacaagggaauggaacagcgaagccagaaaccaccaccagccgccgccuuggccggcagcccccgaagcaagcccuuggucucacuguccucaccggcuuccuccacccugagcugugucagcuggguggggacugagggccaccacuagguggaagucaccaggggugcaaugugugagaccugacaaacuuguucugcgggcugcggaugggugcgaggguggaaucucggugcugcgacgaguguggggccagccguggaggcuccagguguucucucugccccagcagagcccggcaggagccccaacaggaagccagcgcggcauggcugccaccgacuucgugcaggagaugcgcgccgugggcgagaggcugcugcucaagcugcagagacugccccaggcugagcccguggagaucguggccuucucagucaucauccuuuucacagcuacuguucugcuguugcugcugauagccugcagcugcugcugcacucacugcugcugcccugagcggagaggcaggaagguccaggugcagccgacaccaccaugacggacgggcgauggcugaggagaagcuggagaggagauggccaaugccaugacacaggccaucagccuggcccugcagcccuuaccccucaagaccaggcuccccuggccccagcucuggcccagcccagguaccuggacacugacaacuugagcccuaccaaggaaacaagggcugguauaggugcaaaccucucaucugccaguggacacugggugcuggggagucagcuguuucaaagacugggucaacugccugggcuucuucgccuaccugcacuuuuuaacaaaacaaggaaguagggguccccauaccuugauggagaacaguccccaccugugggcaauuggcccuuggggcucugcugauacaugccaaagaggagcaaggcaaucagaggggcuuugugcaauagcuucugcauccgagcucccgccagagcgugagcaugucaguauucuaguccaguauuugccaguuuccaaguaaaagcuuuuguguuacguguu

SEQ ID NO: 923 - RNA, 3851 nt, Homo Sapiens
gggagcugugggggccagacgaacccgagcgcucccaccgagcugccugccauggggcuggggcugcugcucccgcugcugcugcucuggacucgggggacucagggguccgagcuggaccccaaagggcagcacgucuguguggccagcagccccucugcugagcugcagugcugcgcaggcuggaggcagaaggaucaagaaugcaccauccccaucugugaggggccggacgccugccagaaagacgaggugugugugaagccgggccucugucgaugcaagccuggauucuuuggggcccacugcagcucccgcugcccgggccaguacuggggccccgacugccgugagagcugccccugccacccgcacggccagugcgagccagccacgggcgcgugccagugccaggccgaccgcuggggagcccgcugcgaguucccgugcgccugcggcccccacgggcgcugcgaccccgcgaccggcgugugccacugcgaacccggcugguggucguccacgugccgccgcccgugccagugcaacaccgcggcggcgcgcugcgagcaggccacgggcgccugcgugugcaagccgggcuggugggggcgccgcugcagcuuccgcugcaacugccacggcuccccgugcgagcaggacuccggccgcugcgccugccggccgggcugguggggucccgaaugccagcagcagugcgagugugugcggggccgcugcagcgccgccuccggcgagugcaccugcccgcccggcuuccgcggagcgcgcugcgagcugcccugcccggcaggcagccacggggugcagugcgcacacagcuguggccgcugcaaacacaaugagccgugcucuccagacacaggcagcugugaguccugcgagccgggcuggaacgggacccagugccagcagcccugccugccuggcaccuuuggcgagagcugcgaacagcagugcccucacugccgacauggggaggccugugagccagauacuggccacugucagcgcugugacccuggcuggcuggggcccaggugagggcaccauucuguucagggugggguacaccuucccccaggacccucagcucagcggcucucuccgagagcaccacccuccccgacacacagguucaugcggccccaggggccucccuccuguugaagacugggggagagcaguggguucugggggggccugggcaggaucccagcucccuccccucugaggcuuccugcccuccucgcccucuggggacuuguagucugucaccugcuggauuuggccccaaguucaaggcccuauuugcaccugagcuucacugcugaggaguggccaguuggguccuugaguccaggagcguggggcggagggguggggccccacagugggggccaggccugccuuggucuccccuuccccgagucuugccucaccccaggugugaagaccccugccccacugguaccuuuggggaagacuguggcucuaccugccccaccuguguucagggguccugugauacugugacaggggacugugucugcagugccggcuacugggggcccagcugcaacgccuccugcccagccgguuuccauggaaacaacugcucaguuccuugugaaugcccagagggacucugccacccugucucuggguccugccagccaggcucuggcagucgggacacugcccucaucgcgggcagccuugugccucugcugcugcucuuccugggccuugccugcugugccugcugcugcugggccccccgaucagaccucaaggacaggccagcgagagauggagcuaccguguccaggaugaagcugcaggucugggggacacugaccagcuugggcuccacgcugcccugccguucccucagcucccacaagcuacccugggugacagucucacaucacgacccggagguccccuucaaccacagcuucaucgagccgcccucugccggcugggccacugaugacuccuucucauccgauccugagucuggagaggcagaugagguuccugccuacugugugccaccccaagaagggauggucccuguggcccaggcagggucgucagaggccagccuggcugcaggugcuuucccgcccccugaggacgccuccacgccauucgccaucccgcgcaccuccagccuagcucgggccaagcggccaucggucuccuucgcggaagguaccaaguuugcaccacagagucgccgaagcucaggggagcucuccagcccgcuccgaaagcccaagaggcucucccggggggcgcagucggguccugagggccgggaagccgaagaguccacaggcccagaggaagcagaagcccccgaguccuuuccggcggcugccagucccggggauucagccacuggccaccggcggcccccacuugguggccggacaguggcugagcacguggaagccauugagggcagcguccaggagagcucgggcccugugaccacgaucuacaugcuggcagggaagccccgcggauccgaaggcccuguccgcucugucuuccgccauuuugguagcuuccagaaaggccaggcggaagccaaggucaagagggccaucccuaagccuccgcgccaggcccugaaucggaaaaagggcagcccuggccuugccucuggcucugucggccagagccccaacucagccccaaaagcugggcuuccuggggccacagggccuauggcagucagaccagaggaagcgguccgggggcugggggcuggcaccgagaguucaaggagagcccaggagccagucucuggcuguggcuccccagaacaggauccccagaagcaggcugaagaggaaaggcaggaggaaccugaguaugagaauguuguacccaucuccaggccaccagaacccugaugaccuugaauuuggggaguggggagaguggauggacuagacugugcugugugcuggaaaaugaucccggggccaggacagacaaaccagagccucugcgccuccacagggaaaaggcaaggcuuccaggccaguuggcccaggccccuggcagugcucccggaggggcccaggaaggccugggcagagacccuguaggauggggucaggaaggguugccugcagggacuuuugcucugcuguccuggacccugugugccucauaagggcuauucuuucuuucacgugcaaaacauuuuucugaaauagcaaacaaccuacauguuugcugauaaaagauuggcuaaacaaauuuuuuuuuuuuuuuuugagacagaaucucccucugucccccaggcuggagugcaguggugcgaucucggcucacugcaagcucugccucccggguucacgcccuucuccugccucagccucccgaguagcugggacuacaggugcccuccaccacgcuuggcuaauuuuuuuguauauuuaauagagacaggguuucaccauguuagccaggauggucucgaucuccugaccucgugauccaccugccucggccucccaaagugcugggaugacaggcaugagccaccacgccuggucuaugaacuuuuuaaaaaggauguauguguauaaaaacagauucaagggaaaggcacuaaaugguuuuuuccucuggaagaugagauuguaggugauauuuauuuucuucugaaacuuuuguauaguuugcaaauuuucuacagugaacauucuuuuuuacuuuuguuacuagauugaauuugauaaaguauaauaaaaagcaaugaucuuuguuaaaaaaauaaaaaguacuaacauuacagacaugua

SEQ ID NO: 924 - RNA, 4586 nt, Homo Sapiens
cugaccuggaagcggcuggggccggagcacacguguuucguguuucggugaguguggcggagauggagagccgggaucccgcccagccgaugucgccuggagaagcgacgcagaguggcgcccggccugccgaccgcuauggccuauugaagcacagucgcgaguucuuggacuucuucugggacauugcgaagccugagcaggagacgcgacuugcggccacggagaagcugcuggaguaucugcguggcaggccgaagggguccgagaugaaauaugcccugaagcgucuaaucacgggacucggggucgggcgagaaacagcccggcccugcuacaguuuggcccuggcacagcuguuacagucuuuugaagaccuccccuugugcagcauccugcagcagauacaagaaaaauaugaccugcaucaggugaagaaggcaaugcugagaccugcucucuuugcaaaccuguuuggagugcucgcccucuuucagucaggucggcuggugaaggaccaggaggcacugaugaagucggugaagcugcugcaggcccuggcccaguaccaaaaccacuugcaggagcagccccggaaggcccugguggacauccucuccgaggucucgaaggccacauugcaggagauccugccggagguccucaaagccgacuugaauauaauacucagcuccccugaacagcuagagcucuuccuccuggcccagcagaaggugcccuccaagcucaagaagcuggugggauccgugaaccuauucucagaugagaauguccccaggcuggugaaugugcugaagauggccgccuccucugugaagaaggaccgcaagcugcccgccauugcucuggaccugcuccgccuggcacucaaggaagacaaguucccacgguucuggaaggaggugguggaacaagggcugcugaagaugcaguucuggccagccagcuaccuguguuuccgccugcugggcgcggcccugccccugcugaccaaggagcagcugcaccuggugaugcagggagacgugauccgccauuacggggagcacgugugcacugcuaagcucccaaagcaguucaaguuugccccagagauggacgauuacgugggcaccuuccuagaggggugccaggaugacccugagcggcagcuggccgugcuaguggccuucucaucugucaccaaccaaggccucccugucacgccuacuuucuggcgggucgugcgguuccugagcccuccggcccugcagggcuauguggccuggcugcgggccauguuucuccagccagaccuggacuccuugguugacuucagcaccaacaaccagaagaaagcccaggauucaucgcuccacaugccugagcgagcuguguuccggcugaggaaauggaucaucuuucgauuggugagcauuguggacagccugcaccuggagauggaggaggccuugacugagcagguggccagguuuuguuuguuccacucguucuuugucacaaagaagcccacaucccagaucccugagacaaagcacccguucuccuucccuuuggaaaaccaggcccgagaggcugucagcagugccuucuucagcccaggagagguccgaagucuguugcagacccucagcacgcaguucaagcaggcaccgggccagacccagggugggcagcccuggaccuaccaccuggugcaguucgcagaccuccuguugaaucacagccacaacgugaccaccgugacacccuucacugcgcagcagcgccaggccugggaccggaugcugcagacucugaaggagcuggaggcccacuccgcagaggccagggcugcugccuuccagcaccuucugcuccucgugggcauccaccuccucaaguccccugcagagagcugugaccugcugggugacauccagaccugcaucaggaaaagucugggagagaagccccgccggagccgcaccaagaccaucgacccccaggaacccccguggguagaggugcugguggagaucuugcuggcccuguuggcccagcccagccaccucaugcgccagguggcccggagcguguuuggccacaucugcucccaccugaccccgcgugcccugcagcuaauucuggaugugcugaaccccgagaccagugaggaugagaaugaccgugugguggugacggacgauucugaugagcggcggcugaagggugcagaggacaagagcgaggaaggugaggacaacagaagcucagagagugaagaggagagcgagggggaggagagcgaggaggaggagcgcgacggggacguggaucagggcuuccgggaacagcugaugaccgugcugcaggcugggaaggcgcuggguggagaggacagugagaacgaggaggagcugggggaugaggccaugauggcccuggaccagagccucgccagccucuuugccgagcagaagcugcguauccaggcccggcgagacgagaagaacaagcugcagaaggagaaggcucugcggcgcgacuuccagauccgggugcuggaccugguggaggugcuagugaccaagcagcccgagaaugcccugguccuggagcugcuggagccgcugcugagcaucauccggcgcagccugcgcagcagcagcuccaaacaggagcaggaccuucugcacaagacggcgcgcaucuucacgcaccaccugugccgugcccggcgcuacugccacgacuugggugagcgcgcaggggcccugcacgcccagguggagcgguuggugcagcaggcuggccgccagcccgacucccccaccgcccucuaccacuucaacgccucucucuaccugcuccgggucuugaagggcaacacugcugagggcugcgugcaugagacacaggagaagcagaaagcuggcacugaccccagccacaugcccacgggcccgcaggcugccagcugcuuggacuugaaccuggugacccggguguacucgacagcacugagcuccuuccugaccaagcgcaacagcccccucacaguucccauguuccucagccucuucucccggcacccggugcucugucagagccugcuccccauccugguccagcauaucacgggcccggugcggccccgucaucaggccugccugcugcuccagaagacccuguccaugcgggaggugaggucgugcuuugaggaccccgaguggaagcagcugaugggccagguccuagcaaaggucaccgagaacuugcgcgugcugggggaggcgcagaccaaggcgcagcaucagcaggcacuguccucccuggagcugcucaacguucucuucaggaccugcaaacaugagaagcugaccuuggaccugacggugcuccugggugugcugcaggggcaacagcagagccuacagcagggggcacacuccaccggcuccagccgccugcacgaccucuacuggcaggccaugaaaacccugggaguccagcgccccaaguuggagaagaaggaugccaaggagauccccagugccacccagagccccaucaguaagaagcggaagaaaaagggauucuugccagagacgaagaagcgcaagaaacgcaagucagaggauggcacgccagcggaggauggcacaccugcagccaccggcgggagccagccccccagcaugggcaggaagaagaggaacaggacaaaggcuaaggucccagcccaggcaaacgggacgccaaccaccaagaguccagccccuggcgcccccacccggagccccagcaccccugccaaauccccaaaacugcagaagaaaaaccagaagccgucccaggugaauggagcucccgggucccccacggaaccugcaggccaaaagcagcaucagaaggcucuucccaaaaagggggucuugggcaaaucaccacuguccgcgcuggcacggaaaaaggcaaggcugucuuuggucaucaggagucccagccugcuucagaguggggccaagaagaaagcacaggugaggaaggcagggaagcccugagcacagguacgggccccccucagccccugccuccaucugccugagacgccuauuuuuuuuuuuuuuuuuuaaaccaugauuuuaauacgcaagcuguuucuaaggcgcugccacuggggaggguggcuguugccgccugcccgggcauccugcucuggcaagcacagccugagccauuccugcaggggucccagggugcagagaccuccccacccccgguucugggcugggacccuggcuccagggccauguccagggcucugguguuugccuggguuggugcagguugaugugcuggcugcaggcaggugugaccaucucucgugccugccaccucuuugcccccaggcuuuuuugcugugagggagccaccagggggugauuuaaauagguuuauuucuucauuuacaagaggaauauauuuggcuucucucuuaagacucugagauucacaaucagcagcucuaaaaaauaaaggagcaguuuggcuuccggaaggaagaggaggcaacacucgga

SEQ ID NO: 925 - RNA, 2767 nt, Homo Sapiens
uucugcaggcaacagggaggcagcggcuuuuaugcucaaaaggaaugagucccaguggcuggcacagagaagaaggagcgaaacaucuuugagcaagaugggucucuaccgcauccgcguguccacuggggccucgcucuaugccgguuccaacaaccaggugcagcuguggcuggucggccagcacggggaggcggcgcucgggaagcgacuguggcccgcacggggcaaggagacagaacucaagguggaaguaccggaguaucuggggccgcugcuguuugugaaacugcgcaaacggcaccuccuuaaggacgacgccugguucugcaacuggaucucugugcagggccccggagccggggacgaggucagguucccuuguuaccgcuggguggagggcaacggcguccugagccugccugaaggcaccggccgcacugugggcgaggacccucagggccuguuccagaaacaccgggaagaagagcuggaagagagaaggaaguuguaccgguggggaaacuggaaggacggguuaauucugaauauggcuggggccaaacuauaugaccucccuguggaugagcgauuucuggaagacaagagaguugacuuugagguuucgcuggccaaggggcuggccgaccucgcuaucaaagacucucuaaauguucugacuugcuggaaggaucuagaugacuucaaccggauuuucugguguggucagagcaagcuggcugagcgcgugcgggacuccuggaaggaagaugccuuauuuggguaccaguuucuuaauggcgccaaccccguggugcugaggcgcucugcucaccuuccugcucgccuaguguucccuccaggcauggaggaacugcaggcccagcuggagaaggagcuggagggaggcacacuguucgaagcugacuucucccugcuggaugggaucaaggccaacgucauucucuguagccagcagcaccuggcugccccucuagucaugcugaaauugcagccugaugggaaacucuugcccauggucauccagcuccagcugccccgcacaggauccccaccaccuccccuuuucuugccuacggaucccccaauggccuggcuucuggccaaaugcugggugcgcagcucugacuuccagcuccaugagcugcagucucaucuucugaggggacacuugauggcugaggucauuguuguggccaccaugaggugccugccgucgauacauccuaucuucaagcuuauaauuccccaccugcgauacacccuggaaauuaacguccgggccaggacugggcuggucucugacaugggaauuuucgaccagauaaugagcacuggugggggaggccacgugcagcugcucaagcaagcuggagccuuccuaaccuacagcuccuucugucccccugaugacuuggccgaccgggggcuccugggagugaagucuuccuucuaugcccaagaugcgcugcggcucugggaaaucaucuaucgguauguggaaggaaucgugagucuccacuauaagacagacguggcugugaaagacgacccagagcugcagaccuggugucgagagaucacugaaaucgggcugcaaggggcccaggaccgaggguuuccugucucuuuacaggcucgggaccagguuugccacuuugucaccauguguaucuucaccugcaccggccaacacgccucugugcaccugggccagcuggacugguacucuugggugccuaaugcacccugcacgaugcggcugcccccgccaaccaccaaggaugcaacgcuggagacagugauggcgacacugcccaacuuccaccaggcuucucuccagauguccaucacuuggcagcugggcagacgccagcccguuaugguggcugugggccagcaugaggaggaguauuuuucgggcccugagccuaaggcugugcugaagaaguucagggaggagcuggcugcccuggauaaggaaauugagauccggaaugcaaagcuggacaugcccuacgaguaccugcggcccagcgugguggaaaacaguguggccaucuaagcgucgccacccuuugguuauuucagcccccaucacccaagccacaagcugaccccuucgugguuauagcccugcccucccaagucccacccucuucccaugucccacccucccuagaggggcaccuuuucauggucucugcacccagugaacacauuuuacucuagaggcaucaccugggaccuuacuccucuuuccuuccuuccuccuuuccuaucuuccuuccucucucucuuccucuuucuucauucagaucuauauggcaaauagccacaauuauauaaaucauuucaagacuagaauagggggauauaauacauauuacuccacaccuuuuaugaaucaaauaugauuuuuuuguuguuguuaagacagagucucacuuugacacccaggcuggagugcaguggugccaucaccacggcucacugcagccucagcguccugggcucaaaugauccucccaccucagccuccugaguagcugggacuacaggcucaugccaucaugcccagcuaauauuuuuuuauuuucguggagacggggccucacuauguugccuaggcuggaaauaggauuuugaacccaaauugaguuuaacaauaauaaaaaguuguuuuacgcuaaagauggaaaagaacuaggacugaacuauuuuaaauaaaauauuggcaaaagaa

SEQ ID NO: 926 - RNA, 4878 nt, Homo Sapiens
agucccggggagcgcaccggaaguucucgccuggcccaggcgcgggguccaagaugguggcgcuaggagccgcgacccagugauagcggccguggaggggcccccgaccgagcgggagguuggggguagccuggagauucugaagacaggaauaagaugaaggaauggaaaucaaagauggaaauuucugaagaaaagaagucagcaagggcugcauccgaaaaacuccaaagacaaaucacccaggaaugugaguuaguugaaaccaguaauucugaggacagauuauugaagcacuggguaagcccuuuaaaggaugcaaugagacaucucccuucccaagagagcgguaucagggaaaugcauauuaucccccagaaagccauugugggagagauuggccauggauguaaugaaggagaaaaaauacuuucugcaggagaaagcucccauagauaugagguuaguggccaaaacuucaaacagaagucaggauuaacugaacaucagaaaauucauaauauaaauaagaccuaugaauguaaggaaugugaaaaaaccuucaacaggaguucaaaccugaucauacaucagagaauucauacaggaaauaagccauauguguguaaugaaugugggaaagacucuaaucaaaguucaaaucuuauuauacaucagagaauucauacaggaaagaaaccuuauauaugucaugaauguggaaaagacuucaaucagagcuccaaucuggugagacauaagcaaauucacaguggugggaaucccuaugagugcaaagagugugggaaggcuuuuaagggaagcucaaaccuuguccugcaccagagaauccacaguagggggaagccauauuuaugcaauaaaugugggaaggcuuucagucaaagcacagaucuuauuauacaucacagaauucacacuggagagaaacccuaugaauguuaugacuguggacagauguucagucaaaguucacaccuugucccacaucagagaauucacacuggagagaaaccccucaaauguaaugaaugugaaaaagccuucaggcagcauucucaccuuacugaacaccagagacuccacaguggagagaaacccuaugaaugucacagaugugggaagaccuucagugggcgcacagcuuuucuuaaacaucagagauugcaugcuggagagaaaauugaagaaugugagaaaaccuucagcaaggaugaggagcuuagggaagagcagagaauucaccaggaagagaaagcuuauugguguaaucagugugguaggaauuuccagggcaccucagaccucaucagacaucagguaacucauacaggagagaaaccauaugaauguaaagaaugugggaaaacuuucaaucagagcucagaccuucugagacaucauagaauucacaguggagaaaaaccuuguguauguagcaaaugugggaaaucuuuuaggggcagcucagaucuuauuagacaccaucguguucauacuggagagaaacccuaugaauguagugaaugugggaaagccuuuagccagaggucacaccuuguuacacaccagaaaauccauacuggagagaagcccuaucagugcacugaaugugggaaagccuucaggcggcguucacuccuuauucaacaucggagaauucauaguggugagaaacccuaugaauguaaggaaugugggaagcucuucauuuggcgcacagcuuuccucaaacaucagagccugcauacuggagagaaacuugaaugugagaaaaccuucagccaggaugaggagcuuaggggagagcagaaaauucaccaggaagcgaaagcuuauugguguaaucagugugguagggcuuuccagggcagcucagaccucaucagacaucagguaacucauacaagagagaaaccauaugaaugcaaagaaugugggaaaacuuucaaucagagcucagaccuucugagacaucauagaauucacaguggagaaaaaccuuauguaugcaacaaaugugggaaaucuuuuagggguagcucagaucuuauuaaacaccaucguauucauacuggagagaaacccuaugaauguagugaaugugggaaagccuucagccagaggucacaccuugcuacacaccagaaaauccauacuggagagaaacccuaucagugcagugaaugugggaaugccuucaggcggcguucccuccuuauucaacaucggagacuucauaguggugagaaacccuaugaauguaaggaaugugggaaacucuucauguggcacacggcuuuccucaaacaucagagacugcaugcuggagagaaacuugaagaaugugagaaaaccuucagcaaggaugaggagcuuagaaaagagcagagaacucaccaggaaaagaaaguuuauugguguaaucaguguaguaggaccuuccagggcagcucagaucucaucagacaucagguaacucauacaagagagaaaccauaugaauguaaagaaugugggaaaacucaaucagagcucagaccuucugagacaucauagaauucacaguggagaaaaaccuuacguaugcaauaaauguggggaaucuuuuaggagcagcucagaucuuauuaaacaccaucguguucauacuggagagaaaccucaugaauguagugaaugugggaaagucuuuagccagaggucccaccuugucacacaccagaaaauccacacuggagagaagcccuaucagugcacugaaugugaaaaagccuucaggcggcguucacuccuuauucaacgucggagaauucauaguggugagaaacccuaugaauguaaggaaugugggaaacucuucauguggcacacagcuuuccucaaacaucagagacugcaugcuggagagaaacuugaagaacgugagaaaaccuucagcaaggaugaggagcuuaggggagagcagaaaauucaccaagaagagaaagcuuauugguguaaucagugugguagggcuuuccagggcagcucagaccucaucggacaucagguaacucauacaggagagaaaccauaugaauguaaagaaugugggaaaacuuucaaucagagcucagaccuucugagacaucauagaauucacaguggagaaaaaccuuauguaugcaacaaaugugggaaaucuuuuaggggcagcucagaucuuauuagacaccaucguguucauacuggagagaaacccuaugaaugcccugaauguuggaaggccuucagucagaacucacaccuugucagucaucaaagaauucauaccagagagaaacccuuugaauguagcaacugugguaaggccuucaguggguggacagcuuuucuuaagcaccagaaacuucacauuggaaaggaauuugaagacuguaagagucuacaaacaggaccuauucuaauagguagcagaaaccuaaugaaugcaguaaaacuaggaaaagucugauggagaccacaucuuauugcacuacaaaugaguuuuauuagaaaaaaaccaugggaaggugggaaagcagagaaaauaccuacuggauuuuucaaacguaaguauaaucaaguggaaaagccaaaagcucuuggacauaaucaccuuuuuuuuuucugucucagaacugacacuagaauauggucccaacgauacaauuuuuuaaauuauuuauuuuuuaacauacaaagagaugaggucucacuauguugcccaggcuggacuugaacucuugggcucaagcacuccucccuccucagccucccaaaggguugggauuaccggcaugagccacugcaccagccccaggggucuaauuacuugagaauguuuuaagggaugucuaucauuauuaaaaucauuauaaaucacuuuggcaacaaccccaaaacuaaauuauucauggaaagagccauuucaaucuugacuuccuagucgagugacaaguuuaaaugugggaaaaaacccugugaaaguaaugaguguaggccaggugcgguggcucguaccuguaauccagcacuuugggaagccaaggugggcagaucacgaggucacgaguugaucaugaggaguuacuaugcccagccaacauacuaaaaccccgucucuacuaaaaauaacaaaaauuagccaggcaugguggggcacgccuguagucccagguacuugcgaggcuagggcaggagaaucacuugaaccugggagguggagguugcggugagccaagaucaugccacugcacuccagccugggcaacaagugcgaaacuccaucucaaaaaaaaaaaaaagucuaacucuucugcuugucuuuacaaugcuguacagugagagcuaauguuuauaaggauaaacaggauacuuacagggauuugaagguaauuuaauucagugguuuccaacuuuuuaaucaccaaggccuucuuuuuacuccccuauguccugugucuuaaaagauuauguuuaccaaacugcauuuauuaaagaauuauauuuugcuacauaaaggcauguacaacacaaaucaugcuucugacuggcaccauguaggcagaccuagguacuaaaauuccagcccaaagcaaauaauuuaccauuuucauuagucuuuuuauuccuuuugugggcaaacauaucgucuauguuaggcuuuuugaaauauuaacuaugacuuguaaacuccagauuaaaaacuaaccaauucaucuuugauggagcuugaaucaaacuaaggguauuggacuuuugaaagauugaaauuuuuguuacaguauggaauguuuuuaacugaauguugaaauaaaaguuauuuaagaauua

SEQ ID NO: 927 - RNA, 1583 nt, Homo Sapiens
gagccggggggaggggccggggcgguggcggcuguggccgguacuggacccggcgggaugagcgagguggaggcggcagcgggggcuacagcgguccccgcggcgacggugcccgcgacggcggcaggggugguagcgguggugguaccggugcccgcaggggagccgcagaaaggcggcggggcgggcggcgggggcggagccgccucgggccccgcugcugggacccccucggcgccgggcucccgcaccccuggcaauccggcgacggcggucucgggaacccccgcccccccggcccggagucaggcggacaagccggugcuggcaauccaaguccugggcacugucaaaugguucaacguccggaaugguuacggauucaucaacaggaaugacaccaaggaagaugucuuuguucaccagacagcuauuaaaagaaacaaccccaggaaguuucugcgcagcguuggagauggggagacuguggaauuugaugucguggaaggagagaagggcgcagaagccacuaauguaacugggccugggggaguacccgugaagggcagccguuaugcccccaaccgacguaagucccgccgauucaucccccggccucccucaguugccccaccacccaugguggcagagauccccucggcggggacaggaccuggcaguaaaggggagcgggcugaagacucugggcaacggccccgacgauggugccccccacccuucuucuaccgacggcgguuugugcgaggcccccggccucccaaccagcagcagccuauagagggcacugacaggguagaacccaaagagacagccccauuggaggggcaccaacagcagggagaugagcgaguccccccgcccagauuccggcccagguaccgaaggccuuuccgccccaggccacgccagcagccuaccacagaagguggggauggugagaccaagcccagccaaggucccgcugaugguucccggccugagccccagcgcccacgaaaccgccccuacuuccagcggagacggcagcaggccccuggcccccagcaggccccuggcccccggcagcccgcagccccugagaccucagccccugucaacaguggggaccccaccaccaccauccuggagugauuccaacucaacucagaggacacccagagcugccaucugguaucugccaguuuuuccaaaugaccuguacccuacccaguacccugcucccccuuucccauaauucaugacaucaaaacaccagcuuuucaccuuuuccuugagacucaggaggaccaaagcagcagccuuuugcuuuuucuuuuuucuucccuccccuuaucaaggguugaaggaagggagccauccuuacuguucagagacagcaacucccucccguaacucaggcugagaaggaaccagccagcucuuaccuccuccugguugcuuuucuugcccccaccccaaguuuauuuuuguuuucccccggcccccuaccucugaagccauuuuaugaucugucaugugccaccugagccuccaguaaaaacaaaaacaggcuuuccuguggu

SEQ ID NO: 928 - RNA, 1636 nt, Homo Sapiens
cuacacuacuuggggccccucuucuuuccagcccuucuccugugugccugccuccugccgccgccaccaugaccaccuccauccgccaguucaccuccuccagcuccaucaagggcuccucuggccuggggggcggcucgucccgcaccuccugccagcugucuggcggccugggugccggcuccugcaggccgggaucugcugguggccugggcagcgcccucggggguagcagcuacuccagcugcuacagcuuuggcucuggcgguggcuauggcagcagcagcuuugagggcguugaugggcugcuggucggaggugagaaggccaccaugcagaaccucaaugaccgccuggccuccuaccuggacaaggugcgugcccuggaggaggccgacacugagcuggagguaaagauccgugacugguaccagaggcaggccccggggcccgcccgugacuacagccaguacuacaggauaaucgaggagcugcagaacaagauccucacagccaccguggacaaugccaacauccugcuacauauugacaaugcccaucuggcugcugcugacuuccgcaccaaaguccuggcaaaaugaaggcaggugagcagccaggaccuggaccugcaauuccaagcagccugggcugaagucccugauucccauggcagguuugagacagagcaggcccugugccugaguguggaggccgacaucaauggcccgugcagggugcuggaugagcugacccuggccagagccgaccuggagaugcacauugagaaccucaaggaggagcuggccuaccugaagaagaaccacgaggagaugaacgccccgcgaggccaggugggcggugagaucaauguggagaugggcgcugccccagguguggaccugagccgcauccugaaugagaugcgugagcaguaugagaagauggcagagaagaaccgcaaggaugccgaggauugguucuucagcaagacagaggagcugaaccgcgagguggcuaccaacagugagcugguccagagcggcaagagcgagauuucggagcuccggugcaccaugcaggccuuggagaucgagcugcagucccagcucagcaugaaagcaucccuggagggcaaccuggcggagacagagaaccgcuacugcaugcagcugucccagauccaggggcugaucggcaguguggaggagcggcuggcccagcuucucugcgagauggagcagcagaaccaggaguacaagauccuccuggacaugaagaugcggcuggagcuggagaucaccaccuaccaccgccugcuggagggcgaggaugcccacgagggccuccuggccccuacccacuuuaaauugccugcuucuccugcagcggugaccaccugucaggugccuaccauuguggaagagguccaggaugguaaggucaucuccucccgcgagcagguccgccagaccacccgcugagcacucagcuuuccuggccggccccccaggaggcagggaggcagcggucccaucugccccgcggucuccggccucuccacccucagcccccugcuucagucccuuccccaugcuucccugcgugaugacaauaaagcucguugacucagcua

SEQ ID NO: 929 - RNA, 217 nt, Homo Sapiens
aagacuauacuuucagggaucauuucuauaguguguuacuagagaaguuucucugaacguguagagcaccgaaaaccacgaggaagagagguagcguuuucuccugaacgugaagccggcuuucuggcguugcuuggcugcaacugccgucagccauugaugaucguucuucucuccguauuggggagugagagggagagaacgcggucugaguggu

SEQ ID NO: 930 - RNA, 86 nt, Homo Sapiens
uggggcccuggcugggauaucaucauauacuguaaguuugcgaugagacacuacaguauagaugauguacuaguccgggcaccccc

SEQ ID NO: 931 - RNA, 804 nt, Homo Sapiens
cuggagaaagacugaauucuuacucuucaaagaaaaauaucaaaagaggaggaugauguucaagcuaucaccgauuggccugcucuucauguuuguuaacauuccggggacaaacuucaacaucaacaaccucaaauucuauggcaguauccaauccugcgucaagccugaaucccgggaccagaccuaaucccaggaagagcaccaaucccagaaugaaccccaauccugggauaagcccagaucucaaaaugaccucgagucccaagaugacuccaaauuccaagacaagucugaauagagcagugaccccaaagagccacaacuaugaauaugaauacugugacaaaugguagcaccaauccugggacaagcccaaaucucaaaaugaccucaaaucccuagaugacuccaaauuccaagacaagucugaauacagcagugaccccaaagauagccacaacuaugaauaugaacacugugacaaaugguagcaccauacucaauccaauggacaacauuuauuuucuauguaauauuuuugcuguuuuguguauacuugcacucaggcugaagugaacuucaacugccugcauucuuaucucaguuucuuauuauugcugaaugacaagcaugcuaggaaaauaucauuuauuucaauuuacuauuuaagaaauuaucaucuugauuuuuuuuugcaaauuauaauuguguacguuuaaauauuaacuuaauaugauguuuuccuuccauaugaaagaaguaugcacuaccuuauuaaaugcugaaacaagcaaaauacca

SEQ ID NO: 932 - RNA, 927 nt, Homo Sapiens
acacugaaucggaaaugugaagcccaagggucagaggaaugcagccuuuaaagaguacagauuccaaauagacaaagcaaaauggagcuuccucaacaccuccaagucugauguugguggaggggaagcaaaagagagaaccgacgcaggggucgccaggccucucccgggagccaucaggccaccuccagugcaccgagucccugccuggcccaccuugccaggggaagccugcugaggcacaaagcauacgaagcuuuugguugacaaaaacggaaaccaggagucuccauggaguacuccucagggacugcagcuggaaagucaagacaaagaugugugcuggagaauaguaaaaaaugcauacaaauucuccaagcaccaggagagugccucuuucuuuagcagccuggaaucaucuaugccuggaaacaucaaugucuucuggccagacaaaggccaaggagugaaaggcgcuaugcccagcaagaaaaacuuacaaguggugaaagugccugugcagggagggggucaggggcugggucagaauguccaaaccucagcaucguuacaggagguucaaagugccuuuuccucugacucagaagcaccugguauuaaagaauuccaugcugcagaggcuaugcuccacgcaagagcuagaacagcauuuuaggguggaaacuaaauggaauggaggcgcaaaugcuguugaggagacaguugcccugggccagguccuagccucaccuuccagcugcaagaaguugcuugagcuuucuacgcuucugcacccucaucuauaaagugaacagaaugacagugccccauaaugacagcuuugauaaggauuaaaugaaauuaaguauguaaaauguuuaauacagugccuaguaaauucuuaauaaauaaauggaugacagugaa

SEQ ID NO: 933 - RNA, 1123 nt, Homo Sapiens
uguuaguugggcagggcugaaguguauguggugaggaagaagaggcuccuacuguagacagccuuguucuacagauccucccagaaaucucugggccagguggaacccagggucagagagggaugggagagaguuaauuuuccaugauaaauaaaaaucuauaaaauaauaaacaagagaaaagagauuggaaacagccagguuggagcagugagugaguaaggaaaccuggcugcccucuccagauuccccaggcucucagagaagaucagcagaaagucugcaagacccuaagaaccaucagcccucagcugcaccuccuccccuccaaggaugacaaaggcgcuacucaucuauuuggucagcagcuuucuugcccuaaaucaggccagccucaucagucgcugugacuuggcccaggugcugcagcuggaggacuuggauggguuugaggguuacucccugagugacuggcugugccuggcuuuuguggaaagcaaguucaacauaucaaagauaaaugaaaaugcagauggaagcuuugacuauggccucuuccagaucaacagccacuacuggugcaacgauuauaagaguuacucggaaaaccuuugccacguagacugucaagaucugcugaaucccaaccuucuugcaggcauccacugcgcaaaaaggauuguguccggagcacgggggaugaacaacuggugaggaggacacggugggacucagcgggcagagccccacgaaggaggacgugacagagaaaagggguagaauggagguugcacuguucaggccggccacucuucuacuggcugacaggaugccgccugagaugaaacagggugcgggugcaccguggagucauuccaagacuccuguccucacucagggauucuucauuucuucuuccuacugccuccacuucauguuauuuucuucccuucccauuuacaacuaaaacugaccagagccccaggaauaaaugguuuucuuggcuuccuccuuacucccaucuggacccaguccccugguuccugucuguuauuuguaaacugaggaccacaauaaagaaaucuuuauauuuaucgaaauauuaaagcacucgcucugcaaa

SEQ ID NO: 934 - RNA, 2185 nt, Homo Sapiens
cacuuccuccccagacagggguagugcgaggccgggcacagccuuccugugugguuuuaccgcccagagagcgucauggaccuggggaaaccaaugaaaagcgugcuggugguggcucuccuugucauuuuccagguaugccugugucaagaugaggucacggacgauuacaucggagacaacaccacaguggacuacacuuuguucgagucuuugugcuccaagaaggacgugcggaacuuuaaagccugguuccucccuaucauguacuccaucauuuguuucgugggccuacugggcaaugggcuggucguguugaccuauaucuauuucaagaggcucaagaccaugaccgauaccuaccugcucaaccuggcgguggcagacauccucuuccuccugacccuucccuucugggccuacagcgcggccaaguccugggucuucgguguccacuuuugcaagcucaucuuugccaucuacaagaugagcuucuucaguggcaugcuccuacuucuuugcaucagcauugaccgcuacguggccaucguccaggcugucucagcucaccgccaccgugcccgcguccuucucaucagcaagcuguccugugugggcaucuggauacuagccacagugcucuccaucccagagcuccuguacagugaccuccagaggagcagcagugagcaagcgaugcgaugcucucucaucacagagcauguggaggccuuuaucaccauccagguggcccagauggugaucggcuuucuggucccccugcuggccaugagcuucuguuaccuugucaucauccgcacccugcuccaggcacgcaacuuugagcgcaacaaggccaucaaggugaucaucgcuguggucguggucuucauagucuuccagcugcccuacaauggggugguccuggcccagacgguggccaacuucaacaucaccaguagcaccugugagcucaguaagcaacucaacaucgccuacgacgucaccuacagccuggccugcguccgcugcugcgucaacccuuucuuguacgccuucaucggcgucaaguuccgcaacgaucucuucaagcucuucaaggaccugggcugccucagccaggagcagcuccggcaguggucuuccugucggcacauccggcgcuccuccaugaguguggaggccgagaccaccaccaccuucuccccauaggcgacucuucugccuggacuagagggaccucucccagggucccugggguggggauagggagcagaugcaaugacucaggacauccccccgccaaaagcugcucagggaaaagcagcucuccccucagagugcaagccccugcuccagaagauagcuucaccccaaucccagcuaccucaaccaaugccaaaaaaagacagggcugauaagcuaacaccagacagacaacacugggaaacagaggcuauuguccccuaaaccaaaaacugaaagugaaaguccagaaacuguucccaccugcuggagugaaggggccaaggagggugagugcaaggggcgugggaguggccugaagaguccucugaaugaaccuucuggccucccacagacucaaaugcucagaccagcucuuccgaaaaccaggccuuaucuccaagaccagagauaguggggagacuucuuggcuuggugaggaaaagcggacaucagcuggucaaacaaacucucugaaccccucccuccaucguuuucuucacuguccuccaagccagcgggaauggcagcugccacgccgcccuaaaagcacacucauccccucacuugccgcgucgcccucccaggcucucaacaggggagagugugguguuuccugcaggccaggccagcugccuccgcgugaucaaagccacacucugggcuccagaguggggaugacaugcacucagcucuuggcuccacugggaugggaggagaggacaagggaaaugucaggggcggggagggugacaguggccgcccaaggcccacgagcuuguucuuuguucuuugucacagggacugaaaaccucuccucauguucugcuuucgauucguuaagagagcaacauuuuacccacacacagauaaaguuuucccuugaggaaacaacagcuuuaaaagaaaaagaaaaaaaaagucuuugguaaauggcaaa

SEQ ID NO: 935 - RNA, 1193 nt, Homo Sapiens
cagaaacuccuccaagcaaccuaacucuuaacccaacuucugacaccaugaccugcugccagaccagcuucuguggauaucccagcuucuccaucagugggaccuguggcuccagcugcugccagccaagcugcugugagaccagcugcugccagccacgcagcugccagacuagcuucugcggauuucccagcuucucaaccagugggaccugcagcuccaguugcugccagccaagcugcugugagaccagcugcugccagccaagcugcugugagaccagcugcugccagccaagcugcugccagaucagcuccugcggaacuggcuguggcauuggugguggcaucagcuauggccaggagggcagcaguggagcugugagcacccguaucagguggugccgcccagacagucguguggagggcaccuaccuaccccccugcuguguggugagcugcacgcccccauccugcugccaacugcaccaugcccaggccuccugcugccgcccguccuacuguggacaguccugcugccgcccagucugcugcugugagcccacuugcugaaagccaguuugcuuauuuucaauugccuaggucacagugucucugaacuguucaucccuugaccaccucuggaccacuaacaaguucucagacuuugcauugcuugugauggagacuacuaaguauaugagcucacaauucuaucugauuccauucuacaaugaauaccuugacccuucacuggggacacagaaaugcuacaaagccaccugcugaucaucaauuugcuugggauauacuauuucugauauuucugcaggauuaaaaauuacugacauguuguggaauuuauccaugagaacuauccacaagucuaauguuuccaugcuuuauaaucuauuuuaucuuguuuaccuaaaauuuuuugcaacaucaaagacaccaaauuauagccaagugacauuccucaagucaccagagagaauggaagcucaucacccaacauucagcuucuaagaaguaggcuggacuuuccacauuuuaacaucugauccaucccuugguuuuuggaucauaaugaucuugccugcuggauauuucaguuauaucugugauacaaugucuucugucauuucuuaauaaauauuauauacuaggcaaagaaaaaaaaaaaaaaaaaaa

SEQ ID NO: 936 - RNA, 853 nt, Homo Sapiens
cuccucucaacagcccaacccacaccagccucagacaccaccaugaccggcuccugcugcggcuccaccuuguccucccugagcuacgggggaggcugcugccagcccugcugcugccgcgaccccugcugcugccgccccgugaccugccagaccaccgugugccgccccgugaccugcgugccccgcugcacgcgccccaucugcgagcccugccgccgcccggugugcugcgaccccugcucccugcaggaaggcugcugccgccccaucaccugcugccccucgucgugcacggcuguggugugcaggcccugcugcugggccaccaccugcugccagccugugucugugcagucccccugcugccggccucccugcggccagccgaccccuugcagcaccaccugcaggaccuccuccugcugagaccccaccucuccucucaacgcacgaaacauucccaggugcacagaagcuugugcagacucuucuaccccuucuggaucagaugagagacuccaccuuugcagccuagcugauccucaagcacgaauucaacaauaacauccuaucuauuuccccacauaauuaugcagcuaauccuggcccucucugacaaucuugagaaaaauuccagcuuucaucauucgaauuccuggcuugaaaaaaaaaacgaguaaauaaaaaucaaagcuccucuugaauagaacucugucccacugacucaucacccuuuuuucuacuguuucaagguucucagaugagauuuuuuucuuccaggauaauacuauuuguaugcuguauuuuugcacuguaaaaaaaaauaaaauuauauuucuggggaagcaaa

SEQ ID NO: 937 - RNA, 2354 nt, Homo Sapiens
gaaagcauagcuggagggcccgccugaaucacaggugacgggccugagaccagaggcacgcacacgcacggcacucagcacgaggauuuggagaaaugagaucgcuacgcccacuugguggccuauaaaggaagcgggcgaaccccggcagcccuacacaacuuggggccccucuccucuccagcccuucuccugugugccugccuccugccgccgccaccaugaccaccuccauccgccaguucaccuccuccagcuccaucaagggcuccuccggccuggggggcggcucgucccgcaccuccugccggcugucuggcggccugggugccggcuccugcaggcugggaucugcuggcggccugggcagcacccucggggguagcagcuacuccagcugcuacagcuuuggcucuggugguggcuauggcagcagcuuuggggguguugaugggcugcuggcuggaggugagaaggccaccaugcagaaccucaaugaccgccuggccuccuaccuggacaaggugcgugcccuggaggaggccaacacugagcuggaggugaagauccgugacugguaccagaggcaggccccggggcccgcccgugacuacagccaguacuacaggacaauugaggagcugcagaacaagauccucacagccaccguggacaaugccaacauccugcuacagauugacaaugcccgucuggcugcugaugacuuccgcaccaagugaguccuagcuguggccuugggcagccugggccagcuggcggaggaucucaggguaccccuccugaccccaggauguuugagacagagcaggcccugcgccugaguguggaggccgacaucaauggccugcgcagggugcuggaugagcugacccuggccagagccgaccuggagaugcagauugagaaccucaaggaggagcuggccuaccugaagaagaaccacgaggaggugagguggcuggggcagaaggucaaagaugcugaggaguggguggcagagcccuggggcugggcaauggcugaggccgugggagagagcagagcaggugcaccgggauuagucaccuuagagggcuucccugucugcagagcccugauccuugggguccagugugcagggcagacuccucuuuguaccacacugcuucucuguacacaaggaaccucccaggggccugcagaggcucccucuaccuacccugccucccucaugagggugggggauaaguaaggaaaucuugucccauuucaaacucucaaagcugaacaucuacauagaagcuuggaaauuagaggggaacuuuugggggcauaggccuaauaauuagauuuuauuuuggagaguccuuggucuaaugggggagauagagucugaugguggaggcaauacugagcagaugaauaaaaaucauuuagagggucagauagagcagagggagaacaaaggagggguccuugugggaagugggguccccuugugggggaaggcuugggagugagaggucaggauggguccagaugcgcacauccacauccccuuuuuccauaggagaugaacgcccugcgaggccagguggguggugagaucaauguggagauggacgcugccccaggcguggaccugagccgcauccucaacgagaugcgugaccaguaugagaagauggcagagaagaaccgcaaggaugccgaggauugguucuucagcaagacagaggaacugaaccgcgagguggccaccaacagugagcuggugcagaguggcaagagugagaucucggagcuccggcgcaccaugcaggccuuggagauagagcugcagucccagcucagcaugaaagcaucccuggagggcaaccuggcggagacagagaaccgcuacugcgugcagcugucccagauccaggggcugauuggcagcguggaggagcagcuggcccagcuucgcugcgagauggagcagcagaaccaggaauacaaaauccugcuggaugugaagacgcggcuggagcaggagauugccaccuaccgccgccugcuggagggagaggaugcccaccugacucaguacaagaaagaaccggugaccacccgucaggugcguaccauuguggaagagguccaggauggcaaggucaucuccucccgcgagcagguccaccagaccacccgcugaggacucagcuaccccggccggccacccaggaggcagggaggcagccgccccaucugccccacagucuccggccucuccagccucagcccccugcuucagucccuuccccaugcuuccuugccugaugacaauaaagcuuguugacucagcuaugaaa

SEQ ID NO: 938 - RNA, 3567 nt, Homo Sapiens
auuccugccugggagguuguggaagaaggaagauggccagagcuuuguguccacugcaagcccucuggcuucuggagugggugcugcugcucuugggaccuugugcugccccuccagccugggccuugaaccuggacccagugcagcucaccuucuaugcaggccccaauggcagccaguuuggauuuucacuggacuuccacaaggacagccaugggagaguggccaucguggugggcgccccgcggacccugggccccagccaggaggagacgggcggcguguuccugugccccuggagggccgagggcggccagugccccucgcugcucuuugaccuccgugaugagacccgaaauguaggcucccaaacuuuacaaaccuucaaggcccgccaaggacugggggcgucggucgucagcuggagcgacgucauuguggccugcgcccccuggcagcacuggaacguccuagaaaagacugaggaggcugagaagacgcccguagguagcugcuuuuuggcucagccagagagcggccgccgcgccgaguacucccccugucgcgggaacacccugagccgcauuuacguggaaaaugauuuuagcugggacaagcguuacugugaagcgggcuucagcuccguggucacucaggccggagagcuggugcuuggggcuccuggcggcuauuauuucuuaggucuccuggcccaggcuccaguugcggauauuuucucgaguuaccgcccaggcauccuuuuguggcacguguccucccagagccucuccuuugacuccagcaacccagaguacuucgacggcuacuggggguacucgguggccgugggcgaguucgacggggaucucaacacuacagaauaugucgucggugcccccacuuggagcuggacccugggagcgguggaaauuuuggauuccuacuaccagaggcugcaucggcugcgcggagagcagauggcgucguauuuugggcauucaguggcugucacugacgucaacggggaugggaggcaugaucugcuggugggcgcuccacuguauauggagagccgggcagaccgaaaacuggccgaaguggggcguguguauuuguuccugcagccgcgaggcccccacgcgcugggugcccccagccuccugcugacuggcacacagcucuaugggcgauucggcucugccaucgcaccccugggcgaccucgaccgggauggcuacaaugacauugcaguggcugcccccuacgggggucccaguggccggggccaagugcugguguuccugggucagagugaggggcugaggucacgucccucccagguccuggacagccccuuccccacaggcucugccuuuggcuucucccuucgaggugccguagacaucgaugacaacggauacccaggugcccuggacugccuccagcuagaaaugcccaagaaaggcccuuggacauucgcuggaagugccaagagacacggccaggggcucaugccuggccuggugucccacuauggacugccagaggggcugggugaaaccuccagugggggaggugguguggggaaccccugggaagaugagaugaggaucccaugcccuaaucgccaauucugacccauuccucgaugucuauagaccugaucgugggagcuuacggggccaaccagguggcuguguacagagcucagccaguggugaaggccucuguccagcuacuggugcaagauucacugaauccugcugugaagagcuguguccuaccucagaccaagacacccgugagcugcuucaacauccagauguguguuggagccacugggcacaacauuccucagaagcuaucccuaaaugccgagcugcagcuggaccggcagaagccccgccagggccggcgggugcugcugcugggcucucaacaggcaggcaccacccugaaccuggaucugggcggaaagcacagccccaucugccacaccaccauggccuuccuucgagaugaggcagacuuccgggacaagcugagccccauugugcucagccucaaugugucccuaccgcccacggaggcuggaauggccccugcugucgugcugcauggagacacccaugugcaggagcagacacgaaucguccuggacuguggggaagaugacguaugugugccccagcuucagcucacugccagcgugacgggcuccccgcuccuaguuggggcagauaauguccuggagcugcagauggacgcagccaacgagggcgagggggccuaugaagcagagcuggccgugcaccugccccagggcgcccacuacaugcgggcccuaagcaaugucgagggcuuugagagacucaucuguaaucagaagaaggagaaugagaccaggguggugcugugugagcugggcaaccccaugaagaagaacgcccagauaggaaucgcgauguuggugagcguggggaaucuggaagaggcuggggagucuguguccuuccagcugcagauacggagcaagaacagccagaauccaaacagcaagauugugcugcuggacgugccgguccgggcagaggcccaaguggagcugcgagggaacuccuuuccagccucccuggugguggcagcagaagaaggugagagggagcagaacagcuuggacagcuggggacccaaaguggagcacaccuaugagcuccacaacaauggcccugggacugugaauggucuucaccucagcauccaccuuccgggacagucccagcccuccgaccugcucuacauccuggauauacagccccaggggggccuucagugcuucccacagccuccugucaacccucucaagguggacugggggcugcccauccccagccccucccccauucacccggcccaucacaagcgggaucgcagacagaucuuccugccagagcccgagcagcccucgaggcuucaggauccaguucucguaagcugcgacucggcgcccuguacuguggugcagugugaccugcaggagauggcgcgcgggcagcgggccauggucacggugcuggccuuccuguggcugcccagccucuaccagaggccucuggaucaguuugugcugcagucgcacgcaugguucaacguguccucccuccccuaugcggugcccccgcucagccugccccgaggggaagcucagguguggacacagcugcuccgggccuuggaggagagggccauuccaaucuggugggugcuggugggugugcuggguggccugcugcugcucaccauccugguccuggccauguggaaggucggcuucuucaagcggaaccggccaccccuggaagaagaugaugaagagggggagugauggugcagccuacacuauucuagcaggaggguugggcgugcuaccugcaccgccccuucuccaacaaguugccuccaagcuuuggguuggagcuguuccauuggguccucuuggugucguuucccucccaacagagcugggcuacccccccuccugcugccuaauaaagagacugagcccug

SEQ ID NO: 939 - RNA, 85 nt, Homo Sapiens
uccuccccggagccaggaugcagcucaagccacagcaggguguuuagcgcucuucaguggcuccagauuguggcgcuggugcagg

SEQ ID NO: 940 - RNA, 2723 nt, Homo Sapiens
gggcggggcgcaggagccccggggcggaggagccggggaggcgggaggcgggaggcgggagguguuggggccguugaagcggccucccucccgcccccagccgcccggucuggccccagcccugucccgacccccggccuggcccacuccgacccuacccggccgaaggguuccgcuggacacgcaggcggccuccggagcagcccaagcccaugagggccgcgcgcccggccgccggugcugacgagacggagcuccuggcccccgaggaggagcagaggaucaaugcgguucaagaaucgauuccagcgguucaugaaccaucgagcuccagccaauggccgcuacaagccaacuugcuaugaacaugcugcuaacuguuacacacacgcauuccucauuguuccggccaucgugggcagugcccuccuccaucggcugucugaugacugcugggaaaagauaacagcauggauuuauggaaugggacucugugcccucuucaucguuucuacaguauuucacauuguaucauggaaaaagagccacuuaaggacaguggagcauuguuuucacaugugugauagaaugguuaucuauuucuucauugcugcuucuuaugcuccaugguuaaaucuucgugaacuuggaccccuggcaucucauaugcguugguuuaucuggcucauggcagcuggaggaaccauuuauguauuucucuaccaugaaaaauauaaggugguugaacucuuuuucuaucucacaaugggauucucuccagccuugguggugacaucaaugaacaacaccgauggacuucaggaacuugccugugggggcuuaauuuauugcuugggaguuguguucuucaagagugauggcaucauuccauuugcccacgccaucuggcaccuguuuguggccacggcagcugcagugcauuacuacgccauuuggaaauaccuuuaccgaaguccuacggacuuuaugcggcauuuaugaccaaucuguacuaauucuccaaaccaguauuauuucaauuauggcacuugggaguggggugagagcuaaacauugcacagggaaagaaaaaaaauaacugcacugacuuuauaucuuuugaauauaauuacugugaaaguauaaaggcuguguucuggaauuuucugccucacagcaaauaaauaagguagugaauuaauuauucauuccauuccacuaucaugaaggacucugaauagacuuggccaacugauguuuacaaaccagacuuuuauauuuuaauuuuacagauuuuacuacaugauuuuucuaaauuacuaugucagguuguaaaagucagugcaauaacaaaccuuccuuuuuaagaagaaaauuguuucuauuacuuucccauucacuagguaaagaaucauggacagaacuuacacuacuuuuuaccauguuucaucuuggcauaacaugguucuuuuuuaaauagaaacuuuaguuuuuuguaaauuuuuaaaaaaauauuucauugauaugcaucucugcagguccucauucauguuguaaauuuuugcagcaagcagucaacauuccacaaacgaacaaacauuauaccucuucugauaguuuuauuaagcauggagaaauugccaauuuuuaaaaacugcaguuuuccaaacuuuucugccaaccucuuacucugaauucagugcugcuuugggacauauacuugaccuagcuugguuuaccagugauggaaaaguauuuugauaucauuaacuuuuucaaaagauccaacuuuuucucuaugccuuugccacauucucuucagggucucuuuccacaguggauaaauguuuuuucuguauuaugacaguauuguugugauggccaucugcuggaaacuccugaagagcauuauguauuacagugagcaguuguauugccuguuuggugcccaaugguuaagucauugucacuuagcuuuauauugucaguuugauauuuauuuuaaauuguggaacuagaugcauaaauucacauuucugccuuuccuuugcaucuucucauauauuguguuuuuuuuuuuuuuuccuagaaaaaauauuuaaagcauuguuugacagguagaaacucauguaucuguaguccaugaguuauauccuggcucaguggagugauauuuauguauuauuuuuacuuuucucucagugucuuauauuaagauuaacauguuguuaauaguugcuuuguugauuaaucucucuuguugguguuuuaauaaaugaaauaggcuugccuuuagaucgggugcugauauugccuguuuccuaguaaugggcugaucaaaugaucaguggaauucuugguuugaugauaaccuuauuaauugaaauuuuuuacugauguggcuuuaaaagagguuuauuuuguauauguuuagaacucucugauuuugaugaauuauaugggaaugagaaacagaagaagugguauuugcuggcgaguuaaauaggcaagguacccagugauaacaccaaccaaaccacuccuaucugcaugauucugaacaucuggaugccuguuguuuuacuguguauauuuuauuuuuaauauauuaacuuuguggauucauuuaaggucuacucaaaaguaacacugucaaaaccacuaauauguauguaaaaauugugcuguauacuacaauaaaguuguuacuuggauuuguucca

SEQ ID NO: 941 - RNA, 87 nt, Homo Sapiens
gacagugcagucacccauaaaguagaaagcacuacuaacagcacuggaggguguaguguuuccuacuuuauggaugaguguacugug

SEQ ID NO: 942 - RNA, 4946 nt, Homo Sapiens
aucaguccgcauuccccgcacccacccacgucuucccgggagucguaucccgagcauggagguuacugagaccguuauuucuucauggccugccuagcuuaagcaguagcuggaaaagaugucucgggcuguucgucuuccaguccccuguccuguucaacuugguaccuuaagaaaugacucccuggaagcucagcuucaugaguaugucaaacaagggaacuaugugaaagugaagaaaauucuuaagaaaggaauuuauguugaugcaguuaacuccuugggccaaacagcacuuuuuguugcggcguuauugggccuuaggaaauucguugauguucugguggauuauggaucagauccaaaucaccgcugcuuugaugggagcaccccuguccaugcagcagcauuuucgggcaaucaguggauccuuagcaaacugcuggaugcaggaggugaccugcgacuccacgaugagaggggucaaaacccgaagacuugggcuuugacagcaggaaaggagcguagcacccagauaguggaguucaugcagcgcugugccucacacaugcaggccaucauccagggcuucucuuacgaccuccugaagaagauagacuccccgcagcggcuugucuacagcccguccuggugugggggccucgugcagggaaacccuaauggcucuccuaaccgacugcuuaaagcuggagucauuucugcucaaaauaucuacagcuuugguuuugggaaggcuaugccuugguuucaguuuuaucuuacuggggcgacacagauggccuaucuaggaucucuuccggucauuggagaaaaggaagugauucaagcugaugaugagcccaccuucucuuucuucagcggccccuacauggucaugaccaaccuaguguggaaugggagcagggucacagugaaagagcugaaucuccccacccacccacacugcagcaggcugcggcuggccgacuuguuaauugccgagcaggaacacagcagcaagcugcggcaccccuacuugcuacaguugauggcugugugucucucccaggaccuagagaaaacccgccuuguguacgagcgcaucacuaucggcacauuguucaguguccuucaugaacgacggucccaguucccagugcugcacauggaggugauugugcaccugcugcuccagauaucugaugcccugagauaccugcauuuccagggguuuauccaccgcucccucagcuccuaugcuguccauaucaucuccccaggugaagcgaggcugaccaaccuggaguacauguuggaaagcgaggacagagguguacagagggaccugacucgagugccccuuccuacgcagcuauacaacugggccgcaccagaagugaucuuacagaaggcagccacagugaaaucagacaucuacagcuuuucuaugaucaugcaggagauuuuaacagaugacauacccuggaagggcuuagauggcucaguuguuaaaaaagccguagucucggggaauuauuuagaagcugaugucaggcuuccgaaaccuuacuaugauauuguuaagucaggcauccacgucaagcagaaagaccgaacuaugaaccuucaagauauccgguauauucugaagaaugacuuaaaggauuuuacuggagcccagagaacucaaccaaccgagagccccagagugcagagauacggacuccaucccgaugucaaugucuaucuaggacugacuucagaacaccccagagagacaccugacauggaaaucauagaacuaaaggaaaugggcagucaaccucauucaccaaggguucacucuuuauucacugaggggacacuagauccucaggccccagauccaugucugauggccagggagacucagaaucaagaugcuccuugcccugcuccauuuauggcagaagaggccagcagccccagcacaggucagccaagccucugcaguuucgaaaucaacgagaucuacucaggcugcuugauuuuggaagaugacauagaagagccuccaggagcugcuucaucuuuggaggcagacggaccuaaccagguagaugaacugaaauccauggaagaagagcuggauaagauggagagagaggcguguuguuuuggcagugaggaugagagcucuucaaaagcugagacagaguacucuuuugaugacugggacuggcaaaacgguucacucaguucacucagccuuccugagucaaccagagaagccaagagcaauuugaacaacauguccacgacugaggaguaucucaucaguaagugugugcuggaucuaaagauuaugcagacaauaaugcacgagaaugaugauaggcugaggaauaucgagcagauauuagaugaagucgagaugaaacagaaggaacaggaagagcgcaugucuuuaugggccacuucaagagaguuuacaaaugccuacaaguuaccucuggccgugggcccuccaucuuuaaacuauauuccuccuguccuacagcuuucagggggucagaagccagacaccaguggcaacuacccaacccuaccaagauuuccaagaaugcugccgacucuuugugacccuggaaaacagaacacagaugaacaauuucagugcacucaaggagccaaggacaguuuggaaacaagcaggauccaaaauaccaguagccagggaagaccuagagaguccacugcccaagccaaagccacacaguuuaauagugcacucuucacucugucaagccaccggcagggaccuucugcaucacccagcugucacugggacucuaccaggaugaguguggaaccuguuucuucugaaaucuauaaugcagaguccagaaauaaagaugauggaaagguacacuuaaaauggaaaauggaggugaaagaaauggcaaagaaagcagcuacuggacagcucacaguaccuccuuggcauccucagaguagucugacuuuagagagcgaggcugaaaaugagcccgacgcccugcugcagccccccauuaggagcccagaaaacacggauuggcagcgaguuauugaguaucauagggaaaaugaugagcccagaggaaauggcaaguuugacaagacgggcaacaaugacugugacagugaccagcauggcagacagcccaggcuuggaagcuucaccaguaucaggcacccaucucccagacaaaaggagcaaccagagcauagugaagccuuccaagcaaguucugacacauugguggcuguagagaaaucuuacagucaucaguccaugcaaucaacuuguucaccagagucuucugaggauauaacagaugaauuuuuaacuccagacggugaauauuuuuacuccucgacugcucaagaaaacuuagcucuagagaccucgagucccauagaagaggacuuugaaggaauacaaggugcauuugcccaaccucaagucucuggugaggaaaaguuccaaaugagaaaaauucuuggaaagaaugcugagauuuugcccaggucucaauuucaaccuguacgaaguacugaagaugaacaagaagagacaucaaaggagucaccaaaggaacugaaagagaaagacauaucauugacggauauucaagaccugucuaguaucuccuaugaaccagacagcucuuuuaaggaagcuucaugcaaaacacccaaaauaaaccaugcaccuaccagugucagcacuccacucagcccaggguccguuucuucagcugccagucaguauaaagacugccuugaaaguaucacauuucagguuaagacagaguuugccucuugcuggaacagucaagaauuuauucaaacuuugucugaugacuuuauaaguguccgagagagagcaaagaaacuggauucucuccuuacuuccucugaaacucccccuucaagacugacuggucuuaaaagauugucuucauuuauuggggcuggaucccccagccuuguuaaggcaugugacucaucaccaccccaugccacccagagaaggagccugccuaaaguagaagccuucucacagcaucacauugaugagcugccaccaccaucucaggagcuacuugaugacauugagcucuugaaacagcagcagggcucauccacgguguugcaugagaacacagcaagugauggaggaggcacugcaaaugaucaaaggcacuuagaagaacaagaaacugacaguaaaaaagaagauaguaguaugcuuuuguccaaagaaacugaagaucuuggagaggacacagagagagcucacucuacucuggaugaggaccuggaaagauggcugcagccaccugaggagagcguggagcuacaagaccuucccaagggcucugaaagggagacaaauaucaaagaucaaaaaguuggugaagagaaaagaaaaagggaagauagcauuacaccagaaagaaggaaaucagaggguguucuagggacuucugaagaagaugaacuaaaauccuguuuuuggaagcgacuagguugguccgaaucauccaggauaaucgugcuggaucagagugacuugucagacugauuggaauuggaucauagacggacuccuggccugaguuugaguguccugguuguaagcuccuuucuucucuuucugcuucaguugcugucagggcagcaguuccaguucuguaagucucacuuuguucagcugccacaauagacaucaucguuuggcccucucuguuagcagcacauucaaccauuuguuuucagucagauuucugaaaagugagagguaguuuugauaguaaaaauuuuugguugugccuagaauggcuuugguuuuguugauguuaauuuucaaaaacuuuaacucuuguuauauaauaaaauguuuaauuuuaauaacagau

SEQ ID NO: 943 - RNA, 115 nt, Homo Sapiens
ucuguuuaucaccagauccuagaacccuaucaauauugucucugcuguguaaauaguucugaguagugcaauauugcuuauaggguuuugguguuuggaaagaacaaugggcagg

SEQ ID NO: 944 - RNA, 86 nt, Homo Sapiens
acugcuaacgaaugcucugacuuuauugcacuacuguacuuuacagcuagcagugcaauaguauugucaaagcaucugaaagcagg

SEQ ID NO: 945 - RNA, 2271 nt, Homo Sapiens
aguguucuacagcaguuacacacaggcagugguaucugugagcagcucuguggacucaaagguuuucucccugagaggcaugacccaggccagcugauucaucagaaucaggauggacgugguagaggucgcggguaguuggugggcacaagagcgagaggacaucauuaugaaauacgaaaagggacaccgagcugggcugccagaggacaaggggccuaagccuuuuggaagcuacaacaacaacaucgaucacuuugggaugcagcaugagacggagcugccuccucugacugcgcgggaggugaagcaaauucggcgggagaucagccgaaagagcaagugggugaaaaugcugggagaaugggacaccuacaaaaacagcagaaagcucauagaucgagcguaccagggaauucccaugaacauccggggcccgauguggucaguccuccugaacauugaggaaaucaaguugaaaaaccccggaagauaccagaucaugaaggagaagggcaagaggucaucugaacacauccagcagauggaccuggacguaagcgggacauuaaggaggcauauauucuucagggaucgauacggaaccaaaagccagggucacccaggagggaugacacagcugccaagagcucuccuggcccagggagcagccggcaccaugaaccgagcaccucccugguuccaaacccugggccagacuggaacaugcagcgggaacuacuuuacauccuccuggcguaugaggaguauaacccggaggugggcuacugcagggaccugagccacaucgccgccuuguuccuccuuuaucuuccugaggaggaugcauucugggcacuggugcagcugcuggccagugagaggcacucccugcagggauuucacagcccaaauggcgggaccguccaggggcuccaagaccaacaggagcaugugguagccacgucacuacccaagaccauguggcauuaggacaagaaagaucuaugugggcaguguucguccuuaggcugccucauccggauauugauugaugggaucucucucgggcucacccugcgccucugggacguguaucugguagaaggcgaacaggcguucaugccgauaacaaaaucgccuuuaagguucagcagaguaacuccccuggccugauauccacccugucccuagagcgccucacgaagacguccagguguggcccgugggcacguuuuuggaaccgguucguugaugccugggccagggaugaugacacugugcucaagcaucuuagggccucuaugaagaaacuaacaagaaagcagggggaccugccacccccagccaaacccgagcaagggucgucggcauccaggccugugccggcuucacggggcgggaagacccucugcaagggggacaggcaggccccuccaggcccaccagcccgguucccauggcccauuuggucagcuuccccgccacgggcaccucguucuuccacacccuguccugguggggcuguccgggaagacaccuacccugugggcacucagggugugcccagcccggcccuggcucagggaggaccucaggguuccuggagauuccugcaguggaacuccaugccccgccucccaacggaccuggacguaggggacccuugguuccgccguuaugauuucagacagagcugcuggguccgugccauaucccaggaggaccagccggccaccugcuggcaggcugaacacccugcggagcgggugagaucggcuuucacugcacugagccacaacgugggcauggacuucccggcccugcagugcacccagcacugauuccgaccagggcacccccuucagagcuagggacgaacagcagugugcucccaccucaggaccuugccucugcggccuccacuuggaaaguucucaguucccuccaggcuucuagaagcaucugggccagggcucauggcuggauaauuucccuaggcuuaacaacccaagcaagcuucgccuccucguuuuauuuuuuguuaaacuuaugagaauguauuaagaaagagugcagcucgagagacauucagagauggagcacaccagaccccagaucacaaagccaaccaugcccagccccucccaacacccccagccccacgaccaucguucugaauucugacgacaccgugagccugccuuuguacuuuaaacucauggaaggauaaccaccuucacguuuugaaauaaauguuuccuguugaaa

SEQ ID NO: 946 - RNA, 3945 nt, Homo Sapiens
aacgugauggcgucaggggccggggcgcugcuuccuguugucaguggccgagagaccgcaucgucggcucggaggcugaggggcugccgcagccgggagccccccucgccucgcuccucgcuccgcuuggugucaugugauucucugagggagcagcugcgugaguggagaugcuuucagugguggagaauggacuggacccccaggcugccaucccggucaucaagaagaagcuggugggauccgugaaagccuugcaaaagcaguacgugucccuggacaugguggucacuagugaagacggagaugccaacaccaugugcagcgcccuggaggccguauuuauccauggccugcacaccaagcacauccgagcugaggccggaggaaaaaggaagaaaagugcccaccagaagccucugccccagccugucuucuggccccuccugaaagcugucacccccaaacacaucaucucagaguuggagcaccugacguuugucaacauggaugugggccgcugccgggcauggcugcggcuggcccugaacaauggccugauggagugcuaccugaagcugcugcugcaggagcaggcccgcuugcugggcuuugcccgcuuucugagcuggacccucucucuaccucuggugcagaacuacagcggaaggaaucucuggauuccauuucccauucuucaggcucugaagacaucgaaguccaucacucgggccauaagauacggaggaaccagaagccgacugccuccucccucagccuggacacggccaguucaucccagcuguccugcagccuaaacucugauagcugcuuacuccaagagaauggcuccaagaguccagaccauugcgaggagcccauguccuaugacucagaccugggcacagcaaaugcugaggacucagaccagucucugcaagauauaaagauuuucagcugggcgcaguggcucacgccuguaaucccagcacuuugggaggccgaggcaggcggaucacaaagucaagagaucgagaccuuucuggcuaacacggugaaaccucaucucuacuaaaaauacaaaaaauuagccgggcgugguggcgggcgccugaagucccagcuacucaggaggcugaggcaggagaaugguguggacccgggaggcggagcuugcagugagcugagauugugccacuacacuccagccugggugacagagugagacucugucccaaaaaaaaaaacaagauuuuuaaaaugucuuccuuauuuauuacuuucucuccuacaaaggcaguauauacacacuguucuauaucuuguuuuggagaagaucuuuucauaucagagcuucuucauucuuuuauuuuuauuuuuuauagagacgggggucucacuguguugcccaggcuggucuugaacuccugggcucaagagaucuuccugccucaggcucccaaauugcuggggauuacaggcgugagccacugcgcucagccucauucuuuuuuuuucuauugcauauuguucuaguguaucaauguaccuuaguuuacuuaaucagcccaguauuuaaugggugcuggggccuguguuuucauaaauaaccuuguguauguggucuuuuaguucugcguagcuaucucuguuccauaaacucccagaaaaacaagagcuggaucucagaggaugacuucuaccggccuucccgggagcaaccccugaagagugcuucagaccacccaauagcuucuuacagggggacuccagagucaaggccuggucuccacaggcauuuuucucaagaaccaagaaaaaacugcucccugggggcguuagaccaagcguguguaccuuccccaggaagaaggcaagcccaggcagccccaucccaggggcauaagaguuuccaggugguacaccggaggcagaugggacuguccaacccauuccagggucucaugaagcugggcaccguggagcggcagggggcaaugggcaucuggaaggagcucuucugcgagcucuccccacuggaguuccgccucuaccugagcaacgaggagcacaccuguguggagaacugcucccugcuucgcugugagucuguggggccagcccacagugacgggcgcuuugagcuggucuucucuggcaagaagcuggcccugcgcgccuccucccaggacgaagcugaggacuggcuggaccuggugcgggaggcccugcagaagguccggccucagcaggaggaugagugggugaacgugcaguacucagaccagccugaggaaccccccgaggcgccccagggcugccucucucccucagaccugcucucggagcccgcggcccuccagggcacacagucugacuggucguccgcccagguuccagagcuagaugccaucaaggagucccugcuguacuuguacauggacaggaccuggaugcccuauauauuuucucugcccuuggaggcucugaaauguuuccgcaucaggaacaaugagaagaugcugagugacagccacggcguggagaccauccgggacauccugccagacaccagccuugggggcccauccuucuucaaaaucaucacggccaaggcuguccugaagcugcaggccggaaacgccgaggaagccgcccuguggagggaucugguccgcaaaguccuggcauccuacuuggagacagccgaggaggcggugacccugggcgggagccuggaugaaaacugucaggaggugcugaaauuugccacccgggagaauggcuuccugcugcaguaccugguggccauccccauggagaaaggccuugacucccaaggcugcuucugcgcaggcugcucccggcagaucggcuucuccuuuguacgacccaagcucugugccuucucuggccucuauuacugugacaucugccaccaagacgaugccucagugauuccggccaggaucauccacaacugggaccucaccaagcgcccgaucugcaggcaggcccugaaguuucugacgcagauccgggcccagccccucaucaaccugcagauggugaacgcgucucuguacgagcauguggagcggaugcaccucauugggaggagccgggagcagcugaagcuccugggggauuaccugggccugugccggaguggcgcccugaaggagcucagcaagaggcucaaccaccggaauuaucucuuggagucuccgcauagguuccguguugcugaccuccggcagaucgcagaugagguauaugaaggauuccucaaggcccugauugaauuugccucccagcaugucuaccacugcgaccugugcacccagcgcagcuucaucugccagaucugccagcaccacgacaucaucuuccccucugaguuugacaccacaaucaggugugccaagugcaagaccgucuuccaccagagcugccaggcuguggugaagaagggcugcccccgcugugcucgcugacgcaaguaccagcaacagaacguuuucgccugaugccccucugcugaucccacucugaaggccgggggugaguguggcucagccaucccagcuggguuuccuaucagcccaggauacucaccgugucacagcuguguccccuugucaggaagaccucagaugugaccagagcacuggccuccuacagaaagcccaggaaguccccaugauguccccuggcccuccccccaccccucugcugcaggaggcguggccaccaccagaugcucccugucuggggcaggcagggccguuuacucaccaggcccuggcucaccagcgucccggcgccuccguuagggcuggccaaacacuguggaaaggggacuuggggaacauuuucaauuccacauuccugauuaaaaggucugguuuuuuaagguggguuuuucccauucauauuucaaca

SEQ ID NO: 947 - RNA, 8170 nt, Homo Sapiens
uaguaguacuaacaacguuuuauaggagcacaauuaauuuuacuuaggauaaguguuguuauuauuguuuuuauuguuguucuguuaguuacucaaaacuucauucuaauugugcccugaguuuguuaaaauaccauacuguauuuuuguguaacauguaaauaggcauuaauuuuugagaaauagaaauguuuauccuuaauguauuuuuaauuugcuaacauugauuuuuuauuuucuuuccugaaauagcuuauuuccuaaaaugaaagaauuuauucucagaugaauaauuuuuauaucagcuauucuuaucagagcaauaaacaaauaccaaugaugcgcucagccaacaauucauuacacucucugaagaguaacuggacaaggagaaaaacauagggaaaaaaccaacagaauuuguuggcauguucuacacacagaccauggcuuuucagaagccaagcugaaucaaaacaguuuuaaaagaggcaaccauuuguagaggaguccuugaaggauucuucauuguuuucuuggacaaaaagagaccaguggauccaagugcuucaaauacuucucucuuauuuucuuaacucuauugcucugcaauauuuacuuuacccuguuaaugaacaggacaaaaugguuaaaaaagagauaagcgugcgucaacaaauucaggcucuucuguacaagaauuuucuuaaaaaauggagaauaaaaagagaguuuauuggaauggacaauaacauuguuucuagggcuauauuugugcaucuuuucggaacacuucagagcuacccguuuuccugaacaaccuccuaaaguccugggaagcguggaucaguuuaaugacucuggccugguaguggcauauacaccagucaguaacauaacacaaaggauaaugaauaagauggccuuggcuuccuuuaugaaagagaaaaucagugauguuagcacuguccucauaaaaguuucaccgccugacucuauauugggaaggaugaggaguuuugaaaggaagaacagucauugggacaccagaugaagagaccauggauauagaacuuccaaaaaaauaccaugaaauggugggaguuauauuuagugauacuuucucauaucgccugaaguuuaauuggggauauagaaucccaguuauaaaggagcacucugaauacacagaacacuguugggccaugcauggugaaauuuuuuguuacuuggcaaaguacuggcuaaaaggguuuguagcuuuucaagcugcaauuaaugcugcaauuauagaagucacaacaaaucauucuguaauggaggaguugacaucaguuauuggaauaaauaugaagauaccaccuuucauuucuaagggagaaauuaugaaugaaugguuucauuuuacuugcuuaguuucuuucucuucuuuuauauacuuugcaucauuaaauguugcaagggaaagaggaaaauuuaagaaacugaugacagugaugggucuccgagagucagcauucuggcucuccuggggauugacauacauuugcuucaucuucauuauguccauuuuuauggcucuggucauaacaucaaucccaauuguauuucauacuggcuucauggugauauucacacucuauagcuuauauggccuuucuuugauagcauuggcuuuccucaugaguguuuuaauaaggaaaccuaugcucgcugguuuggcuggauuucucuucacuguauuuuggggaugucugggauucacuguguuauauagacaacuuccuuuaucuuugggauggguauuaagucuucuuagcccuuuugccuucacugcuggaauggcccagaggcaguaaaaugugagguuaugaauaacgagugaagccagauggcauggauaagggucucaucucuguugccuaccagcuggugacacuggauuacacaccuggauaauuacuuaagugguguuauuuuuccugaucccucuggggauucauacaaaaugauagccacuuuuuucauuuuggcauuugauacucuuuucuauuugauauucacauuauauuuugagcgaguuuuaccugauaaagauggccauggggauucuccauuauuuuuccuuaaguccucauuuugguccaaacaucaaaauacucaucaugaaaucuuugagaaugaaauaaauccugagcauuccucugaugauucuuuugaaccggugucuccagaauuccauggaaaagaagccauaagaaucagaaauguuauaaaagaauauaauggaaagacuggaaaaguagaagcauugcaaggaagugaggagcgucucugccccgccgcccaucgucugagauguggggagcgccucugccccgccgcccaucaucugggaugugaggagcgccccugcccggccgcgaccccgucugggaacugaggagugucucugcccgaccgccacccugucugggagaugaggagcgucucugcccggccgccccgucugagaagugaggagccccucugcccggcagccaccccgucugggaagcauauuuuuugacauauaugaaggacagaucacugcaauacuugggcauaauggagcugguaaaucaacacugcuaaacauucuuaguggauugucuguuucuacagaaggaucagccacuauuuauaauacucaacucucugaaauaacugacauggaagaaauuagaaagaauauuggauuuuguccacaguucaauuuucaauuugacuuccucacugugagagaaaaccucaggguauuugcuaaaauaaaagggauucagccaaaggaaguggaacaagagguaaaaagaauuauaauggaauuagacaugcaaagcauucaagacauuauugcuaaaaaauuaaguggugggcagaagagaaaacuaacacuagggauugccaucuuaggagauccucagguuuugcugcuagaugaaccaacugcuggauuggaucccuuuucaagacaccgaguguggagccuccugaaggagcauaaaguagaccgacuuauccucuucaguacccaauucauggaugaggcugacaucuuggcugauaggaaaguauuucugucuaaugggaaguugaaaugugcaggaucaucuuuguuucugaagcgaaagugggguauuggauaucauuuaaguuuacacaggaaugaaaugugugacacagaaaaaaucacaucccuuauuaagcagcacauuccugaugccaaguuaacaacagaaagugaagaaaaacuuguauauaguuugccuuuggaaaaaacgaacaaauuuccagaucuuuacagugaccuugauaaguguucugaccagggcauaaggaauuaugcuguuucagugacaucucugaaugaaguauucuugaaccuagaaggaaaaucagcaauugaugaaccagauuuugacauugggaaacaagagaaaauacaugugacaagaaauacuggagaugagucugaaauggaacagguucuuuguucucuuccugaaacaagaaaggcugucaguagugcagcucucuggagacgacaaaucuaugcaguggcaacacuucgcuucuuaaaguuaaggcgugaaaggagagcucuuuuguguuuguuacuaguacuuggaauugcuuuuauccccaucauucuagagaagauaauguauaaaguaacucgugaaacucauuguugggaguuuucacccaguauguauuuccuuucucuggaacaaaucccgaagacgccucuuaccagccuguuaaucguuaauaauacaggaucaaauauugaagaccucgugcauucacugaagugucaggauauaguuuuggaaauagaugacuuuagaaacagaaauggcucagaugaucccuccuacaauggagccaucauagugucuggugaccagaaggauuacagauuuucuguugcguguaauaccaagaaauugaauuguuuuccuguucuuaugggaauuguuagcaaugcccuuaugggaauuuuuaacuucacggagcuuauucaaauggagagcacuucauuuucucguuguauauaaaucuagacaaaauuaauguucggaaggcuugucaaggaagcaauuuggauauuaaauugucuccuguggauccagggaagacuuggagucuuggaauauauccccuguggaaacgggagacuaccguauauacauauaaaauugagauuuugaauuucuuuuauaucaugcuguuccugggaauggaaccugccacuaagguuaacaaaacauguuugcuugucucuuugcuucuuaaaucaggaugacauagugcuggaucuugguuuuauagauggguccauauuuuuguuguugaucacaaacugcguuucuccuuuuaucggcaugagcagcaucagcgauuauaaaaaaaauguucaaucccaguuauggauuucaggccucuggccuucagcauacugguguggacaggcucugguggacauuccauuauacuucuugauucucuuuucaauacauuuaauuuacuacuucauauuucugggauuccagcuuucaugggaacucauguuuguuuuggugguaugcauaauugguugugcaguuucucuuauauuccucacauaugugcuuucauucaucuuucgcaaguggagaaaaaauaauggcuuuuggucuuuuggcuuuuuuauuaucuuaauauguguauccacaauuaugguaucaacucaauaugaaaaacucaacuuaauuuugugcaugauuuucauaccuuccuucacuuugcugggguaugucauguuauugauccagcucgacuuuaugagaaacuuggacagucuggacaauagaauaaaugaagucaauaaaaccauucuuuuaacaaccuuaauaccauaccuucagaguguuauuuuccuuuuugucauaaggugucuggaaaugaaguauggaaaugaaauaaugaauaaagacccaguuuucagaaucucuccacggaguagagaaacucaucccaauccggaagagcccgaagaagaagaugaagauguucaagcugaaagaguccaagcagcaaaugcacucacugcuccaaacuuggaggaggaaccagucauaacugcaagcuguuuacacaaggaauauuaugagacaaagaaaaguugcuuuucaacaagaaagaagaaaauagccaucagaaauguuuccuuuuguguuaaaaaaggugaaguuuugggauuacuaggacacaauggagcugguaaaaguacuuccauuaaaaugauaacugggugcacaaagccaacugcaggaguggugguguuacaaggcagcagagcaucaguaaggcaacagcaugacaacagccucaaguucuugggguacugcccucaggagaacucacuguggcccaagcuuacaaugaaagagcacuuggaguuguaugcagcugugaaaggacugggcaaagaagaugcugcucucaguauuucacgguacagagagaagucucacaauuuguagcaggaggaaggggaaaauaugucauuucuucauuauauauuaaaaggaaauuauaaacaaugucuuuaaauuuucaugcaaauaaaaugauucaaauaccugaauaagaaccaaaucauaagauuuagcauuuaugaaaacguuaaggaagcuuaaauuuacuaucuagaauaauagugcuuagaguuuccuacaguuguuuuagauagguccauuugccauauacuucauguauaaucacacuguuuuuugucagauugguggaagcucuuaagcuccaggaacaacuuaaggcuccugugaaaacucuaucagagggaauaaagagaaagguaugggccaggcucgggguuucccugugcacccauggcugggugccgacgggcuguuccuugcauugcagcugugcuuugugcugagcauccuggggaacccaucaguggugcuucuagaugagccguucaccgggauggaccccgaggggcagcagcaaauguggcagauacuucaggcuaccguuaaaaacaaggagaggggcacccucuugaccacccauuacaugucagaggcugaggcugugugugaccguauggccaugauggugucaggaacgcuaagguguauugguuccauucaacaucugaaaaacaaguuugguagagauuauuuacuagaaauaaaaaugaaagaaccuacccagguggaagcucuccacacagagauuuugaagcuuuucccacaggcugcuuggcaggaaaguauuuuaauuuuuauaggagagauugaaaauuaaaucucaaucucuccuaugagagaggggaaagguaauguaaacauucuagaaagguugcuuuuugagaguaaguaagaaauauagcacaauaacaaagugcaggcugagugggaaagauucuuaaucagagcuauuucucagaauuuaucuuuaacauaaaauuagaggcaaccagauuuuuguuguuauaacuuuuuuuaugauugaaucuguaauuucacacugauucaugcuauaucaaaucagacacuuauuuaaagaacacauugaaaaauuauuuuacuuugccuauuaauuccucccccguauuaucacacugaaacuuaguaauaaaucucacucuucuuccugacagauauuccucuuuaauggcguauaaguuaccuguggaggauguccacccucuaucucgggccuuuuucaaguuagaggcgaugaaacagaccuucaaccuggaggaauacagccucucucaggcuaccuuggagcagguauucuuagaacucuguaaagagcaggagcugggaaauguugaugauaaaauugauacaacaguugaauggaaacuucucccacaggaagacccuuaaaaugaagaaccuccuaacauucaauuuuagguccuacuacauuguuaguuuccauaauucuacaagaauguuuccuuuuacuucaguuaacaaaagaaaacauuuaauaaacauucaauaaugauuacaguuuucauuuuuaaaaauuuaggaugaaggaaacaaggaaauauagggaaaaguaguagacaaaauuaacaaaaucagacauguuauucauccccaacaugggucuauuuugugcuuaaaaauaauuuaaaaaucauacaauauuagguugguuaucgguuauuaucaauaaagcuaacacugagaacauuuuacaaauaaaaauaugagguuuuuagccugaacuucaaauguaucagcuauuuuuaaacauuauuuacucggauucuaauuuaaugugacauugacuauaagaaggucugauaaacugaugaaauggcacagcauaacauuuaauuauaaugacauucugauuauaaaauaaaugcaugugaauuuuaguacauauugaaguuauauggaagaagauagccauaaucuguaagaaaguaccgcaguuaauauuuucuuuagccaacuuauauucaauguauuuuuuauggauccuuuuucaaagguaguaucaguaggcauagucauuuucuguaucuuuucaccucacaguucaugaacauuucccaugucauuauagcacuuuuguguuauauaauugcugcauuaauguuauagcuguauugauguaauaccagaguuguuacguucggguuauaugcaaguuuauuucuuagaaauaaaacuuugauggacuuuuaagcagugugaggccucacuggaugcagauauuggcaccacgcuucuuguacaaccugugguuucagaaucccaacugaaaaagucagccuaaaaguguccugugaaacaccugggaagauaggacgucaggcaagcaacaacuucaaugcaaaaugugucuuguuccaaaagugacaggaggaccacugccacagaaaccacccuaaagucagaagcagcgguaagaagauaggccugauggaagcagagcugacaugcaguugcugacuuucacaugcuuccaacaagcagauuuugcagcagagcaauaugaaacauugauuggaugaauacagaagcaaaugaaucagaaaauuuagcaggauuguguuagauugggcaaaaaaaaaaaaaaacaa

SEQ ID NO: 948 - RNA, 966 nt, Homo Sapiens
agagaacuagaggcugcagcggcagcaguuggagcaucucacugcggggcucgggaaggaggaaaggagugagcauguccugcuccugcaugucccugcuuaagcucaggacuggcccuuccaggccaaggaccccagcauagaccccaggacagggccccaaggaucccuggcucaugagagcggcuugcugggcugccccaagagagccugaaggaaacacauuguugagcugagcugacgucgcuguuucuuccagacugcucucuaaagugggcaggguagcgaccggccggcuccgauggugacgucccacugccaaggggugggaguggggagagucuccacagagcuucggagaagcugcuaagauggaaaaguggaaacuuggcagacagauccagccucccuggccacuggcccaugcucguggcuccuggauggcgcugccacguucugagcagcuugggacagguggagaucaggacuggcagcugcaaggacacaccaggugaauagguuucuuuaugguccucacaccugcagaaaaccaggaggagccacagaaacuaaagagaauuuccaaaaggagucuauggugaagucucugaggaugcaaagaagacaaggagaaugaaaauccaaugaaagccugauuguauuuguugaccuuaaggaaagugauuuuaugguacagccucucuggaagggaggguguguucgcucacagaaugcaaauacccuuugacccccuaaucuuucuucuaggaguuucuccuacagauaaacuuagaagggugcucaaauaaguaaguucaaggauauccucugaagcauugccguaguauaaaaaaagcacagauacccucaaaggacaucauuaggggccugguaaaauaaauuccacacaguggaacaccguguagcucuuuagagaauaaacagcucucuauaugugaucuggaa

SEQ ID NO: 949 - RNA, 1283 nt, Homo Sapiens
cugagcucugagcgccugcggucuccugugugcugcucucugugggguccuguagacccagagaggcucagcugcacucgcccggcugggagagcuggguguggggaacauggccgggccuccgaggcuccugcugcugccccugcuucuggcgcuggcucgcggccugccuggggcccuggcugcccaagaggugcagcagucuccccacugcacgacuguccccgugggagccuccgucaacaucaccugcuccaccagcgggggccugcgugggaucuaccugaggcagcucgggccacagccccaagacaucauuuacuacgaggacgggguggugcccacuacggacagacgguuccggggccgcaucgacuucucagggucccaggacaaccugacuaucaccaugcaccgccugcagcugucggacacuggcaccuacaccugccaggccaucacggaggucaaugucuacggcuccggcacccugguccuggugacagaggaacagucccaaggauggcacagaugcucggacgccccaccaagggccucugcccucccugccccaccgacaggcuccgcccucccugacccgcagacagccucugcccucccugacccgccagcagccucugcccucccugcggcccuggcggugaucuccuuccuccucgggcugggccuggggguggcgugugugcuggcgaggacacagauaaagaaacugugcucguggcgggauaagaauucggcggcaugugugguguacgaggacaugucgcacagccgcugcaacacgcuguccucccccaaccaguaccagugacccagugggccccugcacgucccgccugugguccccccagcaccuucccugccccaccaugccccccacccugccacaccccucacccugcuguccucccacggcugcagcagaguuugaagggcccagccgugcccagcuccaagcagacacacaggcaguggccaggccccacggugcuucucaguggacaaugaugccuccuccgggaagccuucccugcccagcccacgccgccaccgggaggaagccugacuguccuuuggcugcaucucccgaccauggccaaggagggcuuuucugugggaugggccugggcacgcggcccucuccugucagugccggcccacccaccagcaggcccccaacccccaggcagcccggcagaggacgggaggagaccagucccccacccagccguaccagaaauaaaggcuucugugcuuccuuu

SEQ ID NO: 950 - RNA, 62 nt, Homo Sapiens
aaguguuacagcucuuuuagaauuugucuagcaggcuuuccgguuuuugcuggaaagacucc

SEQ ID NO: 951 - RNA, 1319 nt, Homo Sapiens
cauagggagacccugucucuuaaaaaaaaaaaaaaaaaaggacugagugagccgagcccaguccucugaugcacugugucauucauccccuuucuuaggcuguguugguucuaggcuagcugcugucuuucuuugguaggcugcuaaccucuuuggauugugaauuuaaaacauguuuuacaguaaauuugcugccaagacaagagguguauuucuccagcaaugaauuccucauuucaccugcauuucuuggaucucaaccugaaugccacagagggcaaccuuucaggacccaaugucaaaaacaagucuucaccaugugaagacaugggcauugcuguggagguguuucucacucugggugucaucagccucuuggagaacaucuuggucauaggggccauagugaagaacaaaaaccugcacucccccauguacuucuucgugugcagccuggcaguggcggacaugcuggugagcauguccagugccugggagaccaucaccaucuaccuacucaacaacaagcaccuagugauagcagacgccuuugugcgccacauugacaauguguuugacuccaugaucugcauuuccgugguggcauccaugugcagcuuacuggccauugcaguggauagguacgucaccaucuucuacgcccugcgcuaccaccacaucaugacggcgaggcgcucaggggccaucaucgccggcaucugggcuuucugcacgggcugcggcauugucuucauccuguacucagaauccaccuacgucauccugugccucaucuccauguucuucgcuaugcuguuccuccuggugucucuguacauacacauguuccuccuggcgcggacucacgucaagcggaucgcggcucugcccggggccagcucugcgcggcagaggaccagcaugcagggcgcggucaccgucaccaugcugcugggcguguuuaccgugugcugggccccguucuuccuucaucucacuuuaaugcuuucuugcccucagaaccucuacugcucucgcuucaugucucacuucaauauguaccucauacucaucauguguaauuccgugauggacccucucauauaugccuuccgcagccaagagaugcggaagaccuuuaaggagauuauuugcugccgugguuucaggaucgccugcagcuuucccagaagggauuaagcacaaagugcuccucucuguggcucuguucuccuuuguuugcucaccuaugacaaagcgacagccaagggguaggcgggagugcuagcaucccauuuuucucuuuaccagcucagaca

SEQ ID NO: 952 - RNA, 3707 nt, Homo Sapiens
gcggugcaggcgcgcgcccaacggcuuugcgaggcucacucggucugagaggucggaggcugcgagugucgcugcugaaggcugugguggacugggcuggaucgcggauuuuggauuagauaauagauuugggaucgcggauuggggguuggaucgcggauuugggguuggaucggggauuugggguuggauaggggauuuggggcugggucggcgggggcguggggggaggugaaaagguaacagggagcugcccccucucaagagccgguaguugggagucugagaagucaccaccaugaaguuguucggcuucaggagccgcaggggccagacgguccugggcuccauagaccaccucuacacggguuccggguaccgaauccgguacucggaacugcagaagauccacaaggcagcugucaagggcgacgcugcggagauggagcgcugucuggcgcgcaggagcggagaccuugacgcccuggacaagcagcacagaacugcucuacauuuggccugugccaguggccaugugaaaguggucacucuccugguuaacagaaaaugccagauugauaucuaugacaaagaaaauagaacgccuuugauacaggcuguccauugccaggaagaggcuugugccguuauucugcuggaacauggugccaauccaaaccuuaaggauaucuacggcaacacugcucuccauuaugcuguguauagugagagcaccucacuggcagaaaaacugcuuuuccauggugaaaauauugaagcacuggacaaggacaguaauaccccacuuuuauucgcuauaauuugcaagaaagagaaaaugguggaauuuuuauugaaaaacaaagcaaguacacaugccguugauaggcugagaugaacagcccucaugcuugcugugcacuaugacucacuggguauugucaacauccuucuuaagcaaaguauuaaugucuuuacucaagacauguguggacgagaugcagaagauuacgcuauuucuugccguuugacaaaaauucaacaacaaauuuuggagcauaaaaagaugauacuuaaaaaugacaaaccagauguuggaaguucugaugaaucugcagucagcauuuuccaugaacuguguguggauucauugucugcauuggaugacgaacucuugaguguugcugcuaagcaguguguccccgagaaagugucagagccuuuacguggaccuucccauggaaaaggaaacagaauagucaauggaaaaggagaagggccuccugcaaaacauccuuccuugaagccuagcacugaaauggaagauccugcugugaaaggagcaguacaaaaaagaauguacagacauugagagcagaacaagccuuaccaguggcuucagaggaagaacagcaaaggcgugaaagaagugaaaagaagcaaccacaggucauagaaggaaauaauacauacaaaagugaaaaaauacaacuaucagaaaauauaugucauaguacauuuucugcugcugcugacagauuaacccaacaaagaaagauugggaaaacauauccucagcaauuucccaagaaacugaaggaagagcaugauagaugcaccuuaaaacaagaaaaugaagaaaaaacaaauguuaauaugcugcacaaaaaaaaucgagaagaauuagaaaggaaagagaaacaauauaagaaagaaguugaagcaaaacaacuugaaccaacuguucaaucacuagagaugaaaccaaagacugcaagaaauacuccaaaucaggauuuucauaaucaugaagaagugaaagaucugauggaugaaaauugcauuuugaagacagauauugcuauacucagacaggaaauaugcacaaugaaaaaugacaaccuggaaaaagaaaauaaauaucuuaaggacauuaaaauugcuaaagaaacaaaugcugcccuugaaaaguguauaaaacucaaugaggaaaugauaacaaaaacagcauucugguaucaacaagagcuuaaugaucucaaagcugagaauacaaggcucaauucugaacuguugaaggaaaaagaaagcaagaaaaaacuggaagcugaaauugaaucuuaucagucuagacuggcugcugcuauauaaguaaacacagugaaaaugugaaaacagaaagaaaccuaaaacuugcuuuagagagaacacaagauauuucugagcaaguaaaaaugaguucugauauuuccgaaauagaagauaagaauuaguuucuuacugaacaacuuucuaaaaugcaaauuaaauucaauaccuuaaaagauaauuccguaagacaagagauacucucagaaaaaagucauuggcuuuagaaacuguacaaaacgaccuaagccaaacacagcagcaaauaaaggaaaugaaagagauguaucaaagugcagaagcuaaagucaguaaauccacuggaaaguggaacuguguggaagagaggauaugucaacuccaacgugaaaauccguggcuugaacagcaacuaguugauguucaucagaaagaggaucauaaagagauaguaauuaauauccaaagaggcuuuauugagaguagaaagaaagaccucaugcuagaagagaaaaauaagaagcuaaugaaugaauaugaucauuuaaaagaaagucucuuucaauaugagagacagaaagcagaaacaguaguaaguaucaaggaagauaaauauuuucaaacuucuagaaagaaaguuuaaacauuugguucuggauacauguugaaccuaguugaauauaaaaaucaguagauaaaaaguguguuuacuauacuguauaauuccauuuacaugaagcauccagaaaagagaaagguauagguacaaaaaguagaauaauguuugugaagggcuggggcuggaagcugguagugacugcuaaugggcgugagggaucuugcagugauggaaaugcucuaaaguuggauuguagagauggcugcacagcucagaaaauguacuaaaaaucuuuuaacuuuauguuaaaacagauacauucuauaguauguaaauuauauuucaacaaagcuuuuugguuuaaaaaaaaaggaaaaauguguucacuacaucagcuuagaaacauaacuuguuuccauagaggugagagaugauuuacuuugagagaagacauugugucaccuaugacauuuuauuaggcacagagucauauuuuaagguagauaguccuguagugcugaaauaauaauuuuaaugucuuuauauugccacauguuaagaccauggugaagguauaaauggaaauguuuacaccugaaaugaguauuuucaaauuaaaauuuaauuaagugauuugcuucaacacuuaauucuagauuucccagaugaacugaaguguauugcuguaucuuguaauaucuugcuuuaaguaguuuuuuauauauuuuaguugguauagcuuuauuauuauucauauuaauuuaacuuaaaucugaaaaugucagucucaaauuacauauuuuaaugaccacguaauguuuuaaaggcaccuacuuguuauaaaauuauaauuuaggguaaaugugguaaauuuuagcaaaacuauauuugauuuagucuucccacucguauucauaauuuacuuugaauauuuuuauuaauaauuagcucauaauuuuua

SEQ ID NO: 953 - RNA, 5100 nt, Homo Sapiens
caagagcuuggcgauacagaaauuucugcugguguuggggcgggugcgggaacugaagacgggcgagugcgagccgggggcgggugcuggggaaggguaagcgggaagcgagggcgagggguaggggcuggggaagggcgagcgggaggcgcgggcucucucuagcagggggcugcagccaugaagaggcucuuagcugccgcuggcaagggcgugcggggcccggagcccccgaaccccuucagcgaacgggucuacacugagaaggacuacgggaccaucuacuucggggaucuagggaagauccauacagcugccucccggggccaaguccagaagcuggagaagaugacaguagggaagaagcccgucaaccugaacaaaagagauaugaagaagaggacugcucuacacugggccugugucaauggccaugcagaaguaguaacauuucugguagacagaaagugccagcuuaauguccuugauggcgaagggaggacaccucugaugaaggcucuacaaugcgagagggaggcuugugcaaauauucucauagaugcuggugcugaucuaaauuauguagauguguauggcaacacggcucuccauuaugccguuuauagugagaauuuguuaaugguggcaacacugcuguccuauggugcagucaucgaggugcaaaacaaggcuagccucacaccccuuuuacuggccauacagaaaagaagcaagcaaacuguggaauuuuuacuaacaaaaaaugcaaaugcaaacgcauuuaaugagucuaaaugcacagcccucaugcuugccauaugugaaggcucaucagagauagucggcaugcuucuucagcaaaauguugacgucuuugcugaagacauacauggaauaacugcagaacguuaugcugcugcuuguggaguuaauuacauucaucaacaacuuuuggaacauauacgaaaauuaccuaaaaauccucaaaauaccaauccagaaggaacaucuacaggaacaccugaugaggcugcacccuuggcggaaagaacaccugacacggcugaaagcuugcuggaaaaaacaccugacgaggcugcacgcuugguggagggaacgucugccaaaauucaaugucuggggaaagcaacaucuggaaaguuugaacagucaacagaagaaacaccuaggaaaauuuugaggccuacaaaagaaacaucugagaaauuuucauggccagcaaaagaaagaucuaggaagaucacaugggaggaaaaagaaacaucuguaaagacugaaugcguggcaggaguaacaccuaauaaaacugaaguuuuggaaaaaggaacaucuaauaugauugcauguccuacaaaagaaacaucuacaaaagcaaguacaaauguggaugugaguucuguagagccuauauucagucuuuuuggcacacggacuauugaaaauucacaguguacaaaaguugaggaagacuuuaaucuugcuaccaagauuaucucuaagagugcugcacagaauuauacguguuuaccugaugcuacauaucaaaaagauaucaaaacaauaaaucacaaaauagaagaucagauguucccaucagaauccaaacgagaggaagaugaagaauauucuugggauucugggagucucuuugagaguucugcaaagacucaaguguguauaccugagucuauguaucagaaaguaauggagauaaauagagaaguagaagagcuuccugagaagccaucugccuucaagccugccguugaaaugcaaaagacuguuccaaauaaagccuuugaauugaagaaugaacaaacauugagagcagcucagauguucccaucagaauccaaacaaaaggacgaugaagaaaauucuugggauucugagagucccugugagacgguuucacagaaggauguguauuuacccaaagcuacacaucaaaaagaauucgauaccuuaaguggaaaauuagaagagucuccuguuaaagauggucuucugaagccuaccuguggaaggaaaguuucucuuccaaauaaagccuuagaauuaaaggacagagaaacauucaaagcagagucuccugauaaagauggucuucugaagccuaccuguggaaggaaaguuucucuuccaaauaaagccuuagaauuaaaggacagagaaacacucaaagcagagucuccugauaaugauggucuucugaagccuaccuguggaaggaaaguuucucuuccaaauaaagcuuuagaauugaaggacagagaaacauucaaagcagcucagauguucccaucagaauccaaacaaaaggaugaugaagaaaauucuugggauuuugagaaugccugggacuugaauccuuguaaaaguuuccuugagacucucuuacagaaugauguguguuuacccaaggcuacacaucaaaaagaauucgauaccuuaaguggaaaauuagaaguauauuucugucccauuggcauguuaacaaauacaaaaacccaaaagaccccaaaaccuaguguaaucccuuuucaauccaagcaugauuuucuuuuagagucuccugauaaagauggucuucugaagccuaccuguggaaggaaaguuucucuuccaaauaaagccuuagaauuaaaggacagagaaacacucaaagcagagucuccugauaaagauggucuucugaagccuaccuguguaaggaaaguuucucuuccaaauaaagccuuagaauuaaaggacagagaaacauuaaaagcagcucagauguucccaucagaauccaaacaaaaggaugaugaagaaaauucuugggauuuugagaguuuccuugaggcucucuuacagaaugauggguguuuacccaaggcuacacaucaaaaagaauucgauaccuuaaguggaaaauuagaagagucuccugauaaagauggucuucugaagccuaccuguggaaugaaaauuucucuuccaaauaaagccuuagaauugaaggacagagaaacauucaaagcagaggaugugaguucuguagaguccacauucagucuuuuuggcaaaccgacuacugaaaauucacagucuacaaaaguugaggaagacuuuaaucuuacuaccaaggagggagcaacaaagacaguaacuggacaacaggaacgugauauuggcauuauugaacgagcuccacaagaucaaacaaauaagaugcccacaucagaauuaggaagaaaagaagauacaaaaucaacuucagauucugagauuaucucugugagugauacacagaauuaugaguguuuaccugaggcuacauaucaaaaagaaauaaagacaacaaauggcaaaauagaagagucuccugaaaagccuucucacuuugagccugccacugaaaugcaaaacucuguuccaaauaaaggcuuagaauggaagaauaaacaaacauugagagcagauucaacuacccuaucaaaaaucuuggaugcacuuccuucuugugaaagaggaagggaacuuaaaaaagauaacugugaacaaauuacagcaaaaauggaacaaacgaaaaauaaguuuuguguacuacaaaaggaacugucagaagcgaaagaaauaaaaucacaguuagagaaccaaaaagcuaaaugggaacaagagcucugcagugugagauugacuuuaaaucaagaagaagagaagagaagaaaugucgauauauuaaaagaaaaaauuagacccgaagagcaacuuaggaaaaaguuagaagugaaacaacaacuugaacagacucucagaauacaagauauagaauugaaaaguguaacaaguaauuugaaucagguuucucacacucaugaaagugaaaaugaucucuuucaugaaaauugcauguugaaaaaggaaauugccaugcuaaaacuggaaguagccacacugaaacaucaacaccaggugaaggaaaauaaauacuuugaggacauuaagauuuuacaagaaaagaaugcugaacuucaaaugacccuaaaacugaaacagaaaacaguaacaaaaagggcaucucaguauagagagcagcuuaaaguucugacggcagagaacacgaugcugacuucuaaauugaaggaaaaacaagacaaagaaauacuggagacagaaauugaaucacaccauccuagacuggcuucugcuuuacaagaccaugaucaaagugucacaucaagaaaaaaccaagaacuugcuuuccacagugcaggagaugcuccuuugcaaggaauaaugaauguugaugugaguaauacaauauauaacaaugaggugcuccaucaaccacuuuaugaagcucaaaggaaauccaaaagcccaaaaauuaaucucaauuaugcaggagaugaucuaagagaaaaugcauugguuucagaacaugcacaaagagaccgaugugaaacacagugucaaaugaagaaagcugaacacauguaucaaaaugaacaagauaauguggacaaacacacugaacagcaggagucucuggagcagaaauuauuucaacuagaaagcaaaaauagguggcuucgacagcaauuaguuuaugcacauaagaaaguuaacaaaagcaagguaacaauuaauauucaguuuccugagaugaaaaugcaacgucaucuaaacgagaaaaaugaggagguauucaauuaugguaaccauuuaaaagaacguauagaucaauaugaaaaagagaaagcagaaagagaaguaaguaucaaaaaauauaaauacuuuucaaacuuccugaaagaaaguggccuuggcuaaaugcugaaucuaguugaauauauauauauauaaauagaugauaaauguacuuacuauaucagcuuagaaacaugccucauuuccaccaaaugaaagugaaagcuaagagacguuuuacuuugaguaaagguauugugucacugaugaaauuauaagaguuuaaguuaaagauuuuuaauagauuaacauuaaugacauuggcuuauacugcugaaauaaagguuuuaaugucucuuuguggccacauuuuuugacuac

SEQ ID NO: 954 - RNA, 3602 nt, Homo Sapiens
cgcgugacgucgcgcgggcucccgggcggggcggguccggccgccuccgagcccggccggcagcccccggccuuaaagcgcgggcuguccggaggggucggcuuucccaccgaggauuuggcacucuggugagggaaaagggcgaaagagaaaagcgagcagccguccuuucacagccucagaaagugcucgcuucccuucgggggcuuucgcgaaucccgaggcaaucucggaggcgcgcacgcggaaccggcgcgggcaccuggggagaaauggauggagaagggaccuggcuggaaagccuuugccccgcugcucugcuccgcccauaagaggaccccugaaaugucccgugcaguuuguucaaguccccugugugaugaaaugugccucucgccuuacccgugugagaauaccugugguguggcagcgaguauuuuggugagcaccugcaguguagugguuuauacuaaggaauacacacaaauuacaggccuuugagcccagaaugcaacuugggaggauugagaacaugcgggcuacagagagguauuugaccuguccaaagacgacuugauaccucuauaauguaacagaaaaggucagaaaauauuaagcaaguagaaguguggagcauauuaagcaagaugaacaucucgggaagcagcuguggaagcccuaacucugcagauacaucuagugacuuuaaggaccuuuggacaaaacuaaaagaaugucaugauagagaaguacaagguuuacaaguaaaaguaaccaagcuaaaacaggaacgaaucuuagaugcacaaagacuagaagaauucuucaccaaaaaucaacagcugagggaacagcagaaaguccuucaugaaaccauuaaaguuuuagaagaucgguuaagagcaggcuuaugugaucgcugugcaguaacugaagaacauaugcggaaaaaacagcaagaguuugaaaauauccggcagcagaaucuuaaacuuauuacagaacuuaugaaugaaaggaauacucuacaggaagaaaauaaaaagcuuucugaacaacuccagcagaaaauugagaaugaucaacagcaucaagcagcugagcuugaaugugaggaagacguuauuccagauucaccgauaacagccuucucauuuucuggcguuaaccggcuacgaagaaaggagaacccccauguccgauacauagaacaaacacauacuaaauuggagcacucugugugugcaaaugaaaugagaaaaguuuccaagucuucaacucauccacaacauaauccuaaugaaaaugaaauucuaguagcugacacuuaugaccaaagucaaucuccaauggccaaagcacauggaacaagcagcuauaccccugauaagucaucuuuuaauuuagcuacaguuguugcugaaacacuuggacuugguguucaagaagaaucugaaacucaaggucccaugagcccccuuggugaugagcucuaccacugucuggaaggaaaucacaagaaacagccuuuugaggaaucuacaagaaauacugaagauaguuuaagauuuucagauucuacuucaaagacuccuccucaagaagaauuaccuacucgagugucaucuccuguauuuggagcuaccucuaguaucaaaagugguuuagauuugaauacaaguuuguccccuucucuuuuacagccugggaaaaaaaaacaucugaaaacacucccuuuuagcaacacuuguauaucuagauuagaaaaaacuagaucaaaaucugaagauagugcccuuuucacacaucacagucuugggucugaagugaacaagaucauuauccagucaucuaauaaacagauacuuauaaauaaaaauauaagugaaucccuaggugaacagaauaggacugaguacgguaaagauucuaacacugauaaacauuuggagccccugaaaucauugggaggccgaacauccaaaaggaagaaaacugaggaagaaagugaacaugaaguaagcugcccccaagcuucuuuugauaaagaaaaugcuuucccuuuuccaauggauaaucaguuuuccaugaauggagacugugugauggauaaaccucuggaucugucugaucgauuuucagcuauucagcgucaagagaaaagccaaggaagugagacuucuaaaaacaaauuuaggcaagugacucuuuaugaggcuuugaagaccauuccaaagggcuuuuccucaagccguaaggccucagauggcaacugcacguugcccaaagauuccccaggggagcccuguucacaggaaugcaucauccuucagcccuugaauaaaugcucuccagacaauaaaccaucauuacaaauaaaagaagaaaaugcugucuuuaaaauuccucuacguccacgugaaaguuuggagacugagaauguuuuagaugacauaaagagugcugguucucaugagccaauaaaaauacaaaccaggucagaccauggaggaugugaacuugcaucaguucuucaguuaaauccauguagaacugguaaaauaaagucucuacaaaacaaccaagauguauccuuugaaaauauccaguggaguauagauccgggagcagaccuuucucaguauaaaauggauguuacuguaauagauacaaaggauggcagucagucaaaauuaggaggagagacaguggacauggacuguacauugguuagugaaaccguucucuuaaaaaugaagaagcaagagcagaagggagaaaaaaguucaaugcucuuuuacauagaugaagaaagaaaaaugaaugauagcuuggaagauauguuugaucggacaacacaugaagaguaugaauccuguuuggcagacaguuucucccaagcagcagaugaagaggaggaauugucuacugccacaaagaaacuacacacucauggugauaaacaagacaaagucaagcagaaagcguuuguggagccguauuuuaaaggugaugaaagagagacuagcuugcaaaauuuuccucauauugaggugguucggaaaaaagaggagagaagaaaacugcuugggcacacguguaaggaaugugaaauuuauuaugcagauaugccagcagaagaaagagaaaagaaauuggcuuccugcucaagacaccgauuccgcuacauuccacccaacacaccagagaauuuuugggaaguugguuuuccuuccacucagacuuguauggaaagagguuauauuaaggaagaucuugauccuuguccucguccaaaaagacgucagccuuacaacgcaauauuuucuccaaaaggcaaggagcagaagacauagacguugaaacagaaacagaaggaugaaggacaguuuuuuccuucuuaguuauuuauaguuaaaguugguacuaaacauugauuuuuuugaucuucuguaaauggauuuauaaaucaguuuucuauugaaaauguuugugauauuuugcuuuugcaccuuuaaaacaauaaggcgcuuucauuuugcacucuaacuuaagaguuuuuacuuuauguagugauaccuaauacaauuuugaaaauacaa

SEQ ID NO: 955 - RNA, 51 nt, Homo Sapiens
ucuguguaaaccuggcaauuuucacuuaauugcuuccauguuuauaaaaga

SEQ ID NO: 956 - RNA, 5276 nt, Homo Sapiens
acaaagggcccgcgcgcagccgccgccgccgccgccgcgcgaggagccaggaugguccugguccacgucggcuaucucgugcuuccaguguuuggcucugugcgaaacagaggugcccccuuucaaaggucucagcauccucacgcuaccuccugccgccacuuccaccugggccccccgcagccgcagcagcucgcucccgacuucccgcuggcccaccccgugcagucgcagccaggccucagcgcccacauggccccggcccaccagcacagcggcgcccugcaccagucgcugaccccgcugcccacccugcaguuccaggacgucacaggucccuccuuccuaccucaggcccugcaccagcaauaccuccugcagcagcagcuccuggaagcccagcaccgcaggcuggucucgcaccccaggcggagucaggagcguguaucuguccacccccaccgccuccaucccagcuucgacuucggccaacugcagacaccucagcccagguauuuggcugagggcacugacugggaucucaguguggaugcuggcuugaguccugcucaguuccaggugcggcccaucccucagcacuaucagcauuaccuagccacuccucgaaugcaccacuuucccagaaacuccuccuccacacagauggucguccaugaaauccgaaacuacccuuacccucagcuucacuuccuugcucuccagggacuaaaucccagcagacacaccuccgccguacgggagagcuaugaggagcugcugcagcucgaggacagguuggguaaugugacucggggagcuguacagaacaccauugagagguucaccuucccccacaaguauaagaagcgaagaccccaggauggcaagggcaagaaggaugagggggaggagucagacacagaugagaaaugcacaauuugucugucuaugcuggaagauggagaagaugugagacgccuacccuguaugcaucucuuucaccaacugugcguggaccaguggcucgccaugagcaagaaaugccccaucugccgaguggacauugagacacaacugggagccgacagcugagggaggaauuagccaguggacaccccauuuccuucaccagguccccccacggccauagcccuugcagccaaacuuugccuucugagccauuugacguagaggaaaagccugcaagcacauuuuguggaaagaggaguuggugguaucggugucgagggagaggaggggguuggggaggacccaccucuccagaauggcgacuguccccauccgccuggcugagcaggagagagggagcuggcggugcccagcgcaagggcgggaaggaggggcccaggcugcggagaacccaggugggauccugaaggcacuagcugacagacgggccccucaauccuguccucugaaggauuguauauauaccucucgaccacguaggaaccauguaggggucucuagcuauuucuguggauggcagccggagcauguuagcuuaagaaaaauguuguguguggugcucuagucaucuugugguggacaugucgcuauuaccgaauucgcaccaaauauuucucauugaguuucuuguuuuggugccugaccgaaccaacgacagccccaaucuucccgucuuuaugagagaaaaggaaaaaggaaucaaagguggaagaaaaaaaaagccaaauucuguuuacggugaaaaaggauuuuguuuuucacccaauuugggaggcgggagggggggguucucguuuuauuuuuguuuuuguuuuuaccuuggcuuuuguuuuucucauguuuacagugcacggaguguggaagggggucuaggagagggagagcuggaaaaggagcugauggggucuuauccuggccucugaggguucagcggaggugaggaaggcagcagagcuccagcaggugaagggagaguucaucuaggcggggcuccccaggcccagggcucaacuucauggccccagcuauauccccccaguuccacacuaaaccagggagggcucggcccucagcuacugguacccaauguguuccugggagccgagagacccauggucacuccaacuccuuccuuuaggcugugcucuugccugucacaaagaggcaacguagccacugccucccuaugcaaaaaauuaaccagaugaugcagauaagacagcauaggugauggcugcuuggucuuggccacagugcucucagccagcacuaagggcugaggucaauaccgcagaccuuggggaggaagcugagcaucccccgggaugucuccaguccugacacagucccucagagauggcccuggcucugaggucacaucagcuagguuugggaggccccucagcuugguuugggagugcccguguuccuggucucuggcugcuucucugacucuuugauaaccuugggcaagucccuuucuuucucugugccucaguuuccuucuccuuugaggggggagagagaacagugcagccccauuuccgguccugcuaccucaccuagauguugugaggauucauauucucuguccagcguguucuaugcucucuucugagaaccuuguggggugucgggaugggggugcugggagacacagaccugauacaguaugucuuucugcaccaccucacaauuuuccugaaccccaaagggagcagagagauaagaggacagaagaauggagaugggaaaauccaccaaauuccaacccaaacccaacuuucuuucucccuauguggaagacaccagauuagcuggaauucugccaccuuccuuugugccccaccccccacuguucccucauuugcacugcucuguaagccucccccucaccuccauucauaacccagucucaaugcccucguaucaauaagaccgggguaagggggacaggauacuugucacauauuugaagaaauuccauacagugaaggaaauuugagucuguauugcugcuacaaggguaaaaccaggaccaauggguaaaaguaacaggcgggcagauuuuggcuugaggaagagcuucuagcacgacugguucaugcgggaauagcugcucuggccaccugcaggcagaaagugggggaaguggcuccuggcaggagauuucucccagcacuaauauccugguguucuauaaaaucuuuauugagugccuaccggugcaggcgcugggagagacaauagcuuugaggagcucacaaucuagcugaggagacaagacacauccaaugcugcaaaaauggugaauaaccugauucaggguuagcagcaaugaguaucacagcguccaacucaguagcuccaguguaugaaaaugucuccagggcuaaaggcuggagaucucaccaguggggaaaguacaucugagucaggauuuugggggaaagcuaguuacugauagccacaggaaguugagacuucugccccauucucuccaauggcugggugaaaaccaagaauucaucggaagauggcuuuggccuggagguagcuaggguggucuaggaagcucacuccucucuuagucucagucuuucauucuuucugcugagacuggccugaaaggcuggcaagugggagggagucaguggggaggccaggauagaacuagagcuggugucccagguuccagucugggcucuucacugacaaagugggcaacacuagaaacuucccuuugucucucugggccuuaguuuccucaguuacaaccuaaggagguuggauuggaugcuugcuaauuuccuucugacacucacacucccuaacaucaacacaucuucaaggcggcagagcugugcgcccacccagcuauugaaaaggacuuucugugggcacacacucuguuucagacugggcugggggcacacgugcugggugagacagugggcccucguccccuccccccucccaauucucugccccaggcuaauauuagggacuggggaggggaccaccagaggggagagggaagcugcuuacuuuggggguagacccugaagccccuccuccuucccccacagauggggacaggaggugauggggugcucagaacccugcagcucccacuucuuuagccgggcagcuguuugggggacaagagagggccagggucugugcuucugcucccggcacuggucagggagucugggaagaguggagaagaggcagggucaggccucagcaucucacauccaccaccuccaggaggggagaccacugguaaguccuccuccugcucaacucaagggacucagacccuuucuugacugagacgcaugagugccuucuggggugagagcagccccaggguuuaaguugggcguccuagcagcugcagcagcugugccgccgcggguccaccgaggacgccaaucaaucaacccaacaccacaagcuugguugggugcaagcagagggugagcaggggcugccccuccaccuggccaggacccccuucggcacccaguugcccuuggccaccaccuguggcaggacucaagcuccucuucugcaaauguucccagccuccgugcaaguauucuuaacucuuuacgccuaaugaacaagcacaguuuuucaauggugaagaaaaaagcaccagacuuuuuuucuuuuuuuccuaaagaaauccccuaagccccccgccuguaggcgggacaaacacucccugcguggggcuguagcaacgucugucaggcccccuuguguuucaucuccugcgcgcguagagcaaaugcuagagcgauuucagcugauagaaaaacaaaaaugaaaaaaaaaacacaaaaaacaaaaaacauggcacguugcuaguuuacaggguuuugugaguuuaaaugccuuauauuuaacaaucauaauuuaugacuaacuuguagauaucguggguucuuauuuaauuauuuuuauaguuguuuugcauuuuuaauuauaauuuauuuauuuagaaaggauacuaauuuuuuuuauuacuccuauuaccucauuuuggcguuguuucugggaguggaaugcuuugcaugcauugguacgaugacaaacaacuacgaauacaaaaaaaaaauuuaaauaaaauucugcaaacuuuauuucguccgaacuaucagggugugugauugcaagcuguccuaccguggugcuggccucuuuggauacauuccauacgaaaugcaaaccuuugauucuguaugcugugaucuagugaaaaacuccaauau

SEQ ID NO: 957 - RNA, 421 nt, Homo Sapiens
agaggcuugggccgccgagcuggacccggaccgguuuuggguacuguacugggggcagggcagagaggugggcggcaguuggggugcggugauuguaguaggcuagggcgcuuucggguccccauugcagcccccggaugagcccgcaguauuuuccuuauaugaucaggucccauugcgggcggcgccgcuugcccggagccugagaggauuaugaaaacguggcgagcgaaauggggccaggggaccuggagcaggggcgugaggagaguaggcagcgggugaggcuggacgggagggaggucuagggaggccucugccgcgggcacugugaguccuggccgaugaugacgagaccacugcgcaaucugaguucugggaaccaggugauggaguauguucugagaacagacugaggccg

SEQ ID NO: 958 - RNA, 62 nt, Homo Sapiens
aaaacaacugguauuucucacagcuccuucuagauuuggacaaaggaaugauacaagagcag

SEQ ID NO: 959 - RNA, 660 nt, Homo Sapiens
gagggcuuccuucaaaaaccuuggccugcgauggccuggauugcaggaguccuaugauguuggcuagucgguguaauugucgggcuuuucccuuaauccauuuaugccugagguugcaauuuuuugaauuuuugcaauuagaccuuggcgaugaccuugagcaguaggauauaaauaacucccuuguguuuagcauuccaguaauggaacacuagccauaauaaaccguuccaaaaaugcguucuaauggcucucaagcaagguccacuugcagugaaauaaaccagagguuugaaucauggcuugauacgaaauuauuggaaagaauauggcgaugacauccacaaugccgguaagaagacgaaauuacaagcaggaugaaaaauuuguucaaugaaacacagcuauuaaguggcugaccuaauaaguguuauguauaagugacucauccauuguagcuucugggacucaacuuuaggaucaucgucauaugcagccuggagcuagccauauuugaagagcuaggaaggaggcacagugauugacaaucuccuuucuccucaacuagaaugucauuuccuuuuuuaaaacuaauuuaaaucccaucuacauucaauugcuugucuaaaauaaaacccaacuccucucuuaaagacuuua

SEQ ID NO: 960 - RNA, 6058 nt, Homo Sapiens
agucccccgguuucccuggagaccaggcggaagcggccggaaguagcgcugcgguuggcagcggcgggauggagaagcuggggguggagccggaggaggaaggcggcggcgacgacgacgaggaagacgccgaggccugggccauggaacuggcggacgugggggcggcagccagcucgcagggaguucaugaucaaguguugcccacaccaaaugcuucauccagagucauaguacauguggaucuggauugcuuuuaugcacaaguagaaaugaucucaaauccagagcuaaaagacaaaccuuuagggguucaacagaaauauuuggugguuaccugcaacuaugaagcuaggaaacuuggaguuaagaaacuuaugaaugucagagaugcaaaagaaaaguguccacaguugguauuaguuaauggagaagaccugacccgcuacagagaaaugucuuauaagguuacagaauuacuggaagaauuuaguccaguuguugagagacuuggauuugaugaaaauuuuguggaucuaacagaaaugguugagaagagacuacagcagcugcaaagugaugaacuuucugcggugacugugucgggucauguauacaauaaucagucuauaaaccugcuugacgucuugcacaucagacuacuuguuggaucucagauugcagcagagaugcgggaagccauguauaaucaguuggggcucacuggcugugcuggaguggcuucuaauaaacuguuggcaaaauuaguuucuggugucuuuaaaccaaaucaacaaacagucuuauuaccugaaaguugucaacaucuuauucauaguuugaaucacauaaaggaaauaccugguauuggcuauaaaacugccaaaugucuugaagcacuggguaucaauagugugcgugaucuccaaaccuuuucacccaaaauuuuagaaaaagaauuaggaauuucaguugcucagcguauccaaaagcucaguuuuggagaggauaacuccccugugauacucucaggaccaccucaguccuuuagugaagaagauucauuuaaaaaauguucaucugaaguugaagcuaaaaauaagauugaagaacuacuugcuagucuuuuaaacagaguaugccaagauggaaggaagccucauacagugagauuaauaauccgucgguauuccucugagaagcacuauggucgugagagucgucagugcccuauuccuucacauguaauucagaaauuagggacaggaaauuaugaugugaugaccccaaugguugauauacuuaugaaacuuuuucgaaauauggugaaugugaagaugccauuucaccuuacccuucuaagugugugcuucugcaaccuuaaagcacuaaauacugcuaagaaagggcuuauugauuauuauuuaaugccaucauuaucaacuacuucacgcucuggcaagcacaguuuuaaaaugaaagacacucauauggaagauuuucccaaagacaaagaaacaaaccgggauuuccuaccaaguggaagaauugaaaguacaagaacuagggagucuccacuagauaccacaaauuuuucuaaagaaaaagacauuaaugaauucccacucuguucacuuccugaagguguugaccaagaagucuucaagcagcuuccaguagauauucaagaagaaauccuuucuggaaaaucuagggaaaaauuucaagggaaaggaagugugaguuguccauuacaugccucuagaggaguauuaucuuucuuuucuaaaaaacaaaugcaagauauucccauaaauccuagagaucauuuauccaguagcaaacagguauccucuguaucuccuugugaaccgggaacaucaggcuuuaauagcaguaguucuucuuacaugucuagccaaaaggauuauucauauuauuuagauaauagauuaaaagaugaacgaauaagucaaggaccuaaagaaccucaaggauuccacuuuacaaauucaaacccugcugugucugcuuuucauucauuuccaaacuugcagagugagcaacuuuucuccagaaaccacacuacagauagccauaagcaaacaguagcaacagacucucaugaaggacuuacagaaaauagagagccagauucuguugaugagaaaauuacuuucccuucugacauugauccucaaguuuucuaugaacuaccagaagcaguacaaaaggaacugcuggcagaguggaagagagcaggaucagauuuccacauuggacauaaauaagcauauucagcaaaaaggucugaaaagcaagggaauaccauuauuuucggauuagcgguuuauuaagcucuucuauauuaaacacuaauagauauucaauaacggaguaaacuguuccagauaaagcaagaauaguugcaagaaguaaauucuggcacaaagcguaaaaauauaacagaagaaauaauguaaaauacuaucuuuuaugucuaaagccauuuuauauuacuuuucaauaaaaagaauaucauggucaacauagaauauuuuucaugaauugguggggagauguauauguuuauauauaaaaaauagccaaaucguugcaaugauaugguaaaggacacauuuuuuuuuuuuuuuuccugugaaauguggaauaucucaaauucagccucuuaggcugaauagcaaauccuacugccaacuaaccuauuaaaaauauagauaguuuugacuaaaguacuacauuacauuuaguauguugacuuuuaaaauaccaaagcaauuuauauucaauuaaugcuucuucauacaccaagaaucuaccacaauacacagcacacaaaggccguucaauaaacauugaaugaaugaaugguuuggcuagggccaggguggggaguuaaagugagaggaggguauauguuauagagaacagugguagaaggaacucuccgugcaaguaaauuaagggaaagauggacaccagaaaggcaaggugaugggccuauaagcauacuggauaauggaagaaguccauuucuuucuagcuaguuugaagggccuaaaagcacugagauguuuuuguaucuucccuacauuuggagaugauauuagguugucauaacaaccacaaauauagaccauuacuaaauugguggauguccucuuucucccauuguuauugccuuccucuuuugccugcuaaacuaaaaauuggauauaagauugagaauguauuauauaauuugcaagacauagaggauguuuauagaauauacuaaaguaucccucagcaccaauaugggaguauccuggucucaaguuuauaauuuuugcacauauaaucuaaagaagagacuuuaaaaauaaaguacacaaauaugaaccaaagaguagcuuaaaaauacuuucuucuaggucugaaauuuucuuuucuuucuuuuuuuguuuuggagacagagucucacucugucgcccaggguggaguacaguggcgcaaucccagcucacuacaaccuccgccucccagguucaagcaauucuccugccucagccuccugaguagcugggauuacacgcaugcccuaccacacccagcaaauuuuuguauuuuuaguagagaugacauuucaccauauuggccaggcuggucucgaacuccuggucucaggugauccuccaccuuggccucccaaagugcugggauuacaggugugagccauugcuccuggccccagcucugaaauuuuaacuuaguuuuggauuccuuggaauuugaaaauaugcuaacacgaaggauuguaaauagguaguuugagguuaucaggaacaguaacuugaagcaagaacaucagaaauuguucaccaugcaaauauuuaguacucugaaucaaggaacauaguauuuuuuacaugaguauuccaguaagguaauuaaacuuaugaaaaggguauauaacuuuuuguaaaucauuaaaacauuuuauaguccuuguaaugauuucaggaccuuggacagcuagaaggggcuuaagaaaaaauggcuaagaaaacaaaguaaaugguuuuggccagcuuaaaaagagaaagcaaaauaguuaaaaauacauuucauagauugagaauguacgggcuaugucacaguuacgcuacuuauuuugugguuuuaaguuagucucaacaucuuugggccucagaaucaacuuuuuuaugggaucuuuuuucucuguuuuuaagauuaucucuuuuuucuuuggugcuuugcagguuuacuguauuauuuggaagugcgaauuuauuuuuauucuuaguauauacuggcuucuuccuguaucuuuuaauucauguucuguaaaauucucaaccacuagcucuucaaauauuucuucucuauucuaggacuguauacaaaugauagacuuucuuacuguauccuucaugucucuuaauuucucauauuuuucauccucuuguuucucuuuacugcauuuuggguaauuucaucagcucuaucuuucuguuuacuaguucauuuuucaguagcaucucaccugcuauuuaaaacaaugaugguuuuaauuucaauaaauauauuuuucauuugauucuuuuuaacuucccguuuacucauuacagucccuuguaagucuguuucuaauuuuuaaaagucaaauauaugauauuuuugauaauuucaauauuuuaagucuuuauaagucuacauuuaagguuauuauugcauaucauugugacuuauuuccuugaguauguguuaaucugcgagaagacagagggccuaaauuguguauguuuuccuucaguaugauuugaguucguugcuucucugggugaggugguacaaacuccuuggcauacucuauucaccuuuguggauccugauugaaugccuugucuuaaguguaagcucccugacccuuacuacuagccgaagguuuugucucugcaggucaauuccaaacuaacaggcagaugcuguuagcuaucugccuccagggauaaaccccaucuuucaagcuugcuucuugcuugaugcuuucugcugcuuucuugcuuuuguuucagcucgaguuuguuguuguuuuuuuuuuuuccuguuucugucuugaauguagaggguauuuuuauuuuuauuuuuucuguuucucucuugaguguauaguguagaggggguuucugucuugaguguaggccuggagauuucccuuauaugguacaaaccagcaaugaauuaagaggucucuuuucuccaagaucuaguguuuuguacuaggagaacucuaaaaaguaucuauuccacuguagugccaaaguacaaauuuauuuggauuuauuuuuugccaucuuauuuuuuaauauauuucuuuuucuauguugugcuucuuucccaccuuuaucucuccuccuaucuuuugggaucaguuggguuuucuauuuaaucauauauuuucccuuuacugauuuggaaugugaauguuacaaguccuuuugauuauccuuaaacaucuaaaaaugcuacccucuuuccaaacaacacaaagguauugaaauaacauuaauucuaauuaaauuccacaaguucuuuauuaaaucuccaaauuggauauuauuaguauuuuauauagucaauguuuauuuuuuugaugggacauggugggggcuuaccuuuuuucuugugugucagauguuccuucuagguagaauucuuuauaccuucugaaauuauguccuuagagcuguagauuuagaacugacaucucuugagcuguucuaagauaauaucuuuuacuuuggagauacgcaguuuuuauuauaugucuagcuauagauuuaucauggauuuagguucauuaugaaucugcagauuugugucuuccaucaaaucuggauuguuuucaauauuaaaaaaacuucuauuuuaaaaucuguauauagaaagguacauaaacauaaaugaacauguuaaugaguaauuguaacaacuauguaacuguccaagucaagaaauaaaacauaucaaguaa

SEQ ID NO: 961 - RNA, 5801 nt, Homo Sapiens
ggcgggcgcucggcgacucguccccggggccccgcgcgggcccgggcagcaggggcgugaugucacggcagggagggggcgcgggagccgccgggccggcggggaggcgggggagguguuuuccagcuuuaaaaaggcaggaggcagagcgcggcccugcgucagagcgagacucagaggcuccgaacucgccggcggagucgccgcgccagaucccagcagcagggcgcgggcaccggggcgcgggcagggcucggagccaccgcgcagguccuagggccgcggccgggccccgccacgcgcgcacacgccccucgaugacuuuccuccggggcgcgcggcgcugagcccggggcgagggcugucuucccggagacccgaccccggcagcgcggggcggccgcuucuccugugccuccgcccgccgcuccacuccccgccgccgccgcgcggaugccaagcaccagcuuuccagucccuuccaaguuuccacuuggcccugcggcugcggucuucgggagaggagaaacuuuggggcccgcgccgcgcgccggcggcaccaugaagucagcggaggaaggccgggagaaccgaaccccuggcggccgcgaccccggcucccgccccggccccggcccgacccgccaugacggggcuggaggaccaggaguucgacuucgaguuccucuucgaguuuaaccagcgcgacgagggcgccgccgcggccgccccagaugaagagcggaacccuagaacacuauggcuaugcauccuccaacgucagccccgcccugccgcuccccacggcgcacuccacccugccggccccgugccacaaccuucagaccuccacaccgggcaucaucccgccggcggaucaccccucgggguacggagcagcuuuggacggugggcccgcgggcuacuuccucuccuccggccacaccaggccugauggggccccugcccuggagaguccucgcaucgagauaaccucgugcuugggccuguaccacaacaauaaccaguuuuuccacgauguggagguggaagacguccucccuagcuccaaacggucccccuccacggccacgcugagucugcccagccuggaggccuacagagaccccucgugccugagcccggccagcagccuguccucccggagcugcaacucagaggccuccuccuacgaguccaacuacucguacccguacgcguccccccagacgucgccauggcagucucccugcgugucucccaagaccacggaccccgaggagggcuuuccccgcgggcugggggccugcacacugcuggguuccccgcggcacucccccuccaccucgccccgcgccagcgucacugaggagagcuggcugggugcccgcuccuccagacccgcguccccuugcaacaagaggaaguacagccucaacggccggcagccgcccuacucaccccaccacucgcccacgccguccccgcacggcuccccgcgggucagcgugaccgacgacucgugguugggcaacaccacccaguacaccagcucggccaucguggccgccaucaacgcgcugaccaccgacagcagccuggaccugggagauggcgucccugucaagucccgcaagaccacccuggagcagccgcccucaguggcgcucaagguggagcccgucggggaggaccugggcagccccccgcccccggccgacuucgcgcccgaagacuacuccucuuuccagcacaucaggaagggcggcuucugcgaccaguaccuggcggugccgcagcaccccuaccagugggcgaagcccaagccccuguccccuacguccuacaugagcccgacccugcccgcccuggacuggcagcugccgucccacucaggcccguaugagcuucggauugaggugcagcccaagucccaccaccgagcccacuacgagacggagggcagccggggggccgugaaggcgucggccggaggacaccccaucgugcagcugcauggcuacuuggagaaugagccgcugaugcugcagcuuuucauugggacggcggacgaccgccugcugcgcccgcacgccuucuaccaggugcaccgcaucacagggaagaccguguccaccaccagccacgaggccauccucuccaacaccaaaguccuggagaucccacuccugccggagaacagcaugcgagccgucauugacugugccggaauccugaaacucagaaacuccgacauugaacuucggaaaggagagacggacaucgggaggaagaacacacggguacggcugguguuccgcguucacgucccgcaacccagcggccgcacgcugucccugcagguggccuccaaccccaucgaaugcucccagcgcucagcucaggagcugccucugguggagaagcagagcacggacagcuauccggucgugggcgggaagaagaugguccugucuggccacaacuuccugcaggacuccaaggucauuuucguggagaaagccccagauggccaccaugucugggagauggaagcgaaaacugaccgggaccugugcaagccgaauucucuggugguugagaucccgccauuucggaaucagaggauaaccagccccguucacgucaguuucuacgucugcaacgggaagagaaagcgaagccaguaccagcguuucaccuaccuucccgccaacgguaacgccaucuuucuaaccguaagccgugaacaugagcgcguggggugcuuuuucuaaagacgcagaaacgacgucgccguaaagcagcguggcguguugcacauuuaacugugugaugucccguuagugagaccgagccaucgaugcccugaaaaggaaaggaaaagggaagcuucggaugcauuuuccuugaucccuguuggggguggggggcggggguugcauacucagauagucacgguuauuuugcuucuugcgaauguauaacagccaaggggaaaacauggcucuucugcuccaaaaaacugaggggguccuggugugcauuugcacccuaaagcugcuuacggugaaaaggcaaauagguauagcuauuuugcaggcaccuuuaggaauaaacuuugcuuuuaagccuguaguccugauguggucuuuaaggauggugaaugagcuuugugcugggcggacguccccgagacacuucuccagggguaacuucaucuccugggaccacgggcauccaggcuggggcaccuucuccucaaccugccugccccucacccgccgugggaauggcuccuuuucacucauacuuccaauuauaaaaacagaacccacugaugauuaugagccugcuccaaccuguggaccggugagccagggguuaaguccucucccaagaccauacuacagccagcagcucgcgaugccacccgaccccagcuccugccucguggccggcuucccgcccuguccgcagagaagcacccugaugccagcggccccuggcgugagccccaagcuccacgaccuuucucccgcugccuacaccaagggcguugccagcccgggccacugucaccucggacucccgcagccggccggagaggcccccgccguccaggacgugcccaggccaguggccacgcaccccggcucgcccgggcagccacccccggcccugcugccacagcaggugagugcgccuccaagcaguagcugccccccuggucucgaacacucgcucugccccagcagccccucuccuccacucccgccugccacccaagagccgaccugccugcagcccugcagcccagcgugcccgcccgccacgggccgcccgcagcaccugccguccacgguccgcagggacgagucuccgacugccgggccacggcugcugccagaggugcaugaggacgguaguccuaauuuggccccuauuccuguaacggucaagcgagagccugaagaguuggaccaguuguaccuggaugacguaaaugaaauaauacgaaaugaccucuccagcacgagcacccacuccuaguugccacauuggagcacucaguucagcagggguaugcugacuucagcagacaaagacuuuugaauaaauaaacugaacucacaccugguaccacucagaaccuccaacugacugaaugccaggagcugaacauuaauaugugcaaagauuggcucuccaacaagaaggaaagcagggaggaagggagaccacugugucaccuggaggagaagucaucucaugacaacagaagggagguggccgggcugagcacgggagacccaccgugcaggggccuuucaugggaacggcccacacgcaguuugaccccacgcccagcccuucuggcaccccugggguucaauacuggaagugccuuauuuaaccagaccaucagggcaucauagaauugagcauugaauuugcuacuguaggaguauuuuuaggagcagaaacugcaaacacauuucauugugagguuuuacccucuguaugaaugaagagaacgcuggaaggcugcgagaggacucuaguaugagucuccaacauuuggaacguuuccugggcugucacguacacuccugcugccuuacacagugcauuuuagaaucuuccagucugucaucucagcucuuuuguaacaugcuucccuugucugcgcgguugaaaccguaggcuuguucauagucgcaugcucgcaucuuuguuuuuaaucuggcuucgaacauagcacaaguaacuugaauagcacaucaauagguuacuggacaaaagcagaaaaaccuguuacaggauagccugcauuugcauguguguacauaucuaggcaucuauuuauguauaaauaauaacagagccgacguguccucgcccaggagggcuucccugucagcaauaaccggcauccguuuuggaaccugcgucuggggcuccagucgcugcucuugcuggcguccaucgccgccucggacggccgugcauuuucucgucucacgcaguucgaggaggacccuagaaagccaggagcugugauugacaguagcuguagguuaccagacggcaacauuagaaagugauuguaaauaacaugcaaccuaaguguaauauauuuguucaguuauaagaugauuguuucacagaagccuuaccacucucugcuucaucuaagaaaaccaauaccaaaaacgccacuuuaaugcucagcccugcguuguguguuuucagaugaguuacuguuaacagguagguuuguguaggccuugcugggcacucuguacaauuaguugcuuauuacguaugauuacucacagcgaucuauuguuccauauaaccaaaaagcaugguuuauucauugaaacacgguugaccugaacucgugccuuaggaauuaaugcccccuuauggaaccugccugaauugcaccugcggguggaggcuccggcugugaagucacugaacagaacgucgcugauggagaaagggcucccgcagaaggaacggccuguaccgugcgcuccggcacaaucgcgucucuugugucucacucacggaaagaaacaaccugaaggccaucccgucggucugcacguaaccgugaagacguguggccgcgucccaccugcggcuggguacccugcacccggcacuguaggagucacgugcagccuuucucaggggacugucauugaaaaggaaacguuugaugucugugucagcugucuuuguaguuaggaaauagauccaauaaagccguauuuuuuugcuggaca

SEQ ID NO: 962 - RNA, 5534 nt, Homo Sapiens
gugcagucagggcuucugcugggcagggccggcuguuaaucucgccuggcggagcggacaccggggcguggugggggagaugggccuuauagguggcguccgcuggugagaaacaccuugcgcagguaaaaggguggcggcgagagggaguucccacccguggcuuucuuagagaaaugaagucuuaagucuuaaauagacaacaaggaggggccgaucggugucuuuuggacgcgucuggagccccucccuccgccaaaggaaaagccccuuggaugagaggcaggcgcuucagagaagcuaagaaaagcaccucuccgcgcgccccaccuccuccgccucgcgcuccuccugagcagcgggcccagacugcgcuccggccgcggcccucgccccgcggagcccuccuaccccggcccgacgcucggcccgcgaccugccccgagcccucuccauggaggcagcccgccccuccggcuccuggaacggagcccucugccggcugcuccugcugacccucgcggccucgggaacgugcggcucccugugccucgggaacgugcggcucccugugccucagcgccugcccaggccacggaaaggggaaccgcugggcggccgggacggagagcgaguguccuugggugaaaaagggaacugcucgccuuucugggaauuguuuacucugagagaagggcggggggaaguggcgggugggggaggggaucuugacccuuugcuccugaggacugucgaccggcgagcccuagaucuuaauauuugccagugaugccugcaaaaaugugacauuacauguucccuccaaacuagaugccgagaaacuuguugguagaguuaaccugaaagagugcuuuacagcugcaaaucuaauucauucaagugauccugacuuccaaauuuuggaggaugguucagucuauacaacaaauacuauucuauuguccucggagaagagaaguuuuaccauauuacuuuccaacacugagaaccaagaaaagaagaaaauauuugucuuuuuggagcaucaaacaaagaucucucuguugguucccuggcucugccuaguugcugagguccuaaagaaaagacauacuaaagaaaaaguucuaaggcgcgccaagagaagaugggcuccaauuccuuguucgaugcuagaaaacuccuuggguccuuuuccacuuuuccuucaacagguucaaucugacacggcccaaaacuauaccauauacuauuccauaagagguccuggaguugaccaagaaccucggaauuuauuuuauguggagagagacacuggaaacuuguauuguacucguccuguagaucgugagcaguaugaaucuuuugagauaauugccuuugcaacaacuccagauggguauacuccagaacuuccacugccccuaauaaucaaaauagaggaugaaaaugauaacuacccaauuuuuacagaagaaacuuauacuuuuacaauuuuugaaaauugcagaguggggcacuacugugggacaagugugugcuacugacaaagaugagccugacacgaugcacacacgccugaaguacuccaucauugggcaggugccaccaucacccacccuauuuucuaugcauccaacuacaggcgugaucaccacaacaucaucucagcuagacagagaguuaauugacaaguaccaguugaaaauaaaaguacaagacauggauggucaguauuuuggucuacagacaacuucaacuuguaucauuaacauugaugauguaaaugaccacuugccaacauuuacucguacuucuuaugugacaucaguggaagaaaauacaguugauguggaaaucuuacgaguuacuguugaggauaaggacuuagugaauacugcuaacuggagagcuaauuauaccauuuuaaagggcaaugaaaauggcaauuuuaaaauuguaacagaugccaaaaccaaugaaggaguucuuuguguaguuaagccuuugaauuaugaagaaaagcaacagaugaucuugcaaauugguguaguuaaugaagcuccauuuuccagagaggcuaguccaagaucagccaugagcacagcaacaguuacuguuaauguagaagaucaggaugagggcccugaguguaacccuccaauacagacuguucgcaugaaagaaaaugcagaagugggaacaacaagcaauggauauaaagcauaugacccagaaacaagaaguagcaguggcauaagguauaagaaauuaacugauccaacagggugggucaccauugaugaaaauacaggaucaaucaaaguuuucagaagccuggauagagaggcagagaccaucaaaaauggcauauauaauauuacaguccuugcaucagaccaaggagggagaacauguacggggacacugggcauuauacuucaagacgugaaugauaacagcccauucauaccuaaaaagacagugaucaucugcaaacccaccaugucaucugcggagauuguugcgguugauccugaugagccuauccauggcccacccuuugacuuuagucuggagaguucuacuucagaaguacagagaauguggagacugaaagcaauuaaugauacagcagcacgucuuuccuaucagaaugauccuccauuuggcucauauguaguaccuauaacagugagagauagacuuggcaugucuagugucacuucauuggauguuacacugugugacugcauuaccgaaaaugacugcacacaucguguagauccaaggauuggcgguggaggaguacaacuuggaaagugggccauccuugcaauauuguugggcauagcauugcucuuuugcauccuguuuacgcuggucuguggggcuucugggacgucuaaacaaccaaaaguaauuccugaugauuuagcccagcagaaccuaauuguaucaaacacagaagcuccuggagaugacaaaguguauucugcgaauggcuucacaacccaaacugugggcgcuucugcucagggaguuuguggcaccgugggaucaggaaucaaaaacggaggucaggagaccaucgaaauggugaaaggaggacaccagaccucggaauccugccggggggcuggccaccaucacacccuggacuccugcaggggaggacacacggagguggacaacugcagauacacuuacucggaguggcacaguuuuacucagccccgucuuggugaagaauccauuagaggacacacucugauuaaaaauuaaacaaugaaagaaaguguaucuguguaaucaagaugaaaaucacaagcaugcccaagacuauguccugacauauaacuaugaaggaagaggaucgguggcugggucuguagguuguugcagugaacgacaagaagaagaugggcuugaauuuuuggauaauuuggagcccaaauuuaggacacuagcagaagcaugcaugaagagaugaguguguucuaauaagucucugaaagccaguggcuuuaugacuuuuaaaaaaaauuacaaaccaagaauuuuuuaaagcagaagaugcuauuuguggggguuuuucucucauuauuuggauggaaucucuuuggucaaaugcacauuuacagagagacacuauaaacaaguacacaaauuuuucaauuuuuacauauuuuuaaauuacuuaucuucuauccaaggaggucuacagagaaauuaaagucugccuuauuuguuacauuuggguauaaugacaacagccaauuuauagugcaauaaaauguaauuaauucaaguccuuauuauagacuauuugaagcacaaccuaauggaaaauuguagagaccuugcuuuaacauuaucuccaguuaauuaaguguucauguggugcuuggaaacuguuguuuuccugaacaucuaaaguguguagacugcauucuugcuauuauuuuauucuuguaaugugaccuuuucacugugcaaagggagauuucuagccaggcauugacuauuacaauuucauuuugguggaguuuaguuuuagguuuuauuguauauaaaauccugcacugaaucugugucuccucuguuaccuacuuuugccagugaaauuuaaguuuuaaaauacuuucagaauguauuuuuacuacugcaaguuuuuggucuuuaaaaugucaaguagcaucucucucuuucucucugucucuuucuguuucucucuccaguuuuuuuuuuuuuuuuaauuuccauaugggcuaaagaauccaaauauuuuaaaaaucugucucucuuuucuucucucauaaagugaauuauuccuuuuuuuuguuuuauguaaguguauauauucuuaguuuuucuugaaaucauuguaauguuaacuuuguuguuucaaauaucuuggugauugcuucauuaucucuucaacaaaaaaaaccuuuaauuuugccauugaaacuguagaacuaugccaugcuuuuauuagaagcagugcucuguguuaacaacaagaaugguguaauuagaauugggauguggauauuuacuguaugacaacacauuuacaguucuguaaugcaaggaugcaguuuaaaaaugugaaguagugaugguuuuugaaauaagcuuuaaaauauagggaucuugaaggcucccugggguaacuauuuuauaacuuagauaaaauggcuagucauaucuguguguuuguaaaguuauuuuuuuaauauuuuaagauuacaauuuuaacaaauguagaaaugagccaaacuauuuaaauuuuaaaacaguaaaacaaaaugaaacuuaauagcucacaaaauuccaguccauguuucaugacuuauuuuagucaaugaauuuucuauuuauacuaaacauauggacauuuuaaauguguuucuaauauuuuugauuaucuauaaugugccugucuucaauucacaagauuggguuauaacaauuauuugccagauuaacacuagggaauuauuugauaaccagcuuaucuuaucaguaguuuuauugcugaucaggcaaaaauaguuuuccaaaguuauuuuuaauaaaguauauacaaaauucuuauauauuacuagucaugauaaaguaaauuaagcaguuuuuaaaacuuagugugaguuuguucaucacaggucugauaugaguuuaagggauuucgcacucccugaaucagagaaguaagaccccuuccuuagauuccuguuauacauuuuuuaaaauguagaguuuguuuuggagacauuuucagugcauuguuauugccauauuuauauaauaugacuauucuaaaggcugugaggccaugggguauugguuaaguugcuugcuuuugcuuuguccauuuucaucauuuuaaaaugggggauaauaacagaacuuguuuccuagggccauuguaagucacuugaauaaaaaauaguuuugaagcaugagagucauacagagcgguccaccuaaaaggcacuccugauaauaauaaaugauuuuaaacaagu

SEQ ID NO: 963 - RNA, 129 nt, Homo Sapiens
ugagcacuuucacagguccucccucaggcuguggggccaggauuugguagcuggugcugagagaaaaccuuuguuggcauccuugcccugggacugugccaguggcagcugucauucaaugggacaauu

SEQ ID NO: 964 - RNA, 1966 nt, Homo Sapiens
agcuuacggccgacaaaccacucuucucuaucaguaugcccuugaauagaugagguugugcaaaguccuuugcucuuaaauguauugcugucauugagaauauuuggagguuuucucuuggguuuguuuggauuuuuuuuuucagcuuuugucugaauuuugguuuuauuuuucuggggcagagaaaauggcuuuccuuaugaaaaguaugauaaguaaccagguaaagaauuuaggauuugguggugggucugaagaaaauaaagaagaaggaggugcaucugauccugcagcagcucaagggaugacuagagaggaguaugaggaguaucaaaagcaaaugauugaggagaagauggaaagagaugcugcauuuacacagaaaaaggcagaaagggcaugccucagaguucaucucagagaaaaauacaggcucccaaagagugaaauggaugagaaucaaauccagauggcuggagaugauguggauuuaccugaagaucuccggaaaaugguagaugaagaucaagaagaggaagaagauaaagauucuauucuugggcagauacagaaucuccagaacauggacuuggauaccauaaaagaaaaagcccaggccaccuucacugaaaucaagcagacagcggagcagaaguguuccgugaugugaggggugggagggguggagggagggaaccagccauccuuggaaaagaccacucucuugugggacguuucaagcaguacauguuuuaauguagugaacacaguuaggaaaaccacgaugauccauugacagacaauaauuugguuguucuaaauauuccuggcagagcauuuagcuaacaccuugcagcgggaaccuuacuuuccuuuuaguuauaaaugagauaaacuggaaaauuucaguuguaaaugaugaugcagaacacauaucugcuuaaagaccuugagaugagccaggaagaaacaaaagcaaggggcauuuccucuccaacuuucuuccuuggaggccaaguucucacccuguccaacuauucgcaggacaccaggucccuucagagagaaauguggagagucaaggugucuacugggagccggguuucccacagggagcugagucuacagacuccagggcaaucaaaggucaccacccccaccccucaccucuaggauccuugaauuugucaaugauacucaucaaguaugcuuggauccuuugguccuuggaugcuucucagccaaguggcgguagcacagauguggugaacaaugacgaauugaggcagggaauagaccucacuagcccuuugcaauggagaucaucguucuaguggccaugugaagaauggaaccaagggaggcacaauuagaggcagagggaaaccaggcagacggcugcucuuuuugaguugagcuuaacucuccuugucugaacuuggugauagcaaugggaacaaaguggguagacuaacagagagcauuaagaaguuaaaucaaucucucucugucuccucccaaccucucucucucuuucauccccuucucucccuaucucucuuuuuuuuuucuucuccugucccuucccaucccaccccuuuagacuaccuuccaguaaaucacacugucauuuggugccacaagcuuucaggguagacacugauuuuuccccccuaauaucugcucucuuucaaaaggaauaauucaaaagacuuaggacaauuaccacugaaacacuucgagcuauuuagcuaaagcccaccaaaccaaaacaaaauacugauuuuuuuuuuuuuuuuuggugacucuguucauacagugaauaaagaucuaucaaaggaaaaggaaacugagaccgaaaacuuagggucuaaguuguucuaaacccaggguucucaaauguguuguacaaaaaguuucauguaauaaaauuaagcaaauaaaacaaaugaauagagguccaaaa

SEQ ID NO: 965 - RNA, 2013 nt, Homo Sapiens
aagaggagaggcauaaauuuaggaucucacccuucauuccacagacacacacagccucucugcccaccucugcuuccucuaggaacacaggaguuccagaucacaucgaguucaccaugaauucacucagugaagccaacaccaaguucauguucgaucuguuccaacaguucagaaaaucaaaagagaacaacaucuucuauuccccuaucagcaucacaucagcauuagggaugguccucuuaggagccaaagacaacacugcacaacaaauuagcaagguucuucacuuugaucaagucacagagaacaccacagaaaaagcugcaacauaucaugugagucacagagcacuaugguucagcuuuagaucccugaacaggucauaguuuaaaccuggaacuucacaaaaacuaagaaaaggccaguuuuagggaaaaucuuggacacaaagauugagacauacagaguggguuggcauuucauggcacauaauuauuauuccucauuucugcguuacuaaaagacagucagcacuguaccucagagcauaggucuggaucaggauaggcuggguucagacuccagcuuugcucuucacaguugauaggucaggaaauguucaucaccaguuucaaaagcuucugacugaauucaacaaauccacugaugcauaugagcugaagaucgccaacaagcucuucggagaaaagacguaucaauuuuuacaggaauauuuagaugccaucaagaaauuuuaccagaccaguguggaaucuacugauuuugcaaaugcuccagaagaaagucgaaagaagauuaacuccuggguggaaagucaaacgaaugaaaaaauuaaaaaccuauuuccugaugggacuauuggcaaugauacgacacugguucuugugaacgcaaucuauuucaaagggcagugggagaauaaauuuaaaaaagaaaacacuaaagaggaaaaauuuuggccaaacaagaauacauacaaaucuguacagaugaugaggcaauacaauuccuuuaauuuugccuugcuggaggauguacaggccaagguccuggaaauaccauacaaaggcaaagaucuaagcaugauugugcugcugccaaaugaaaucgauggucugcagaagcuugaagagaaacucacugcugagaaauugauggaauggacaaguuugcagaauaugagagagacaugugucgauuuacacuuaccucgguucaaaauggaagagagcuaugaccucaaggacacguugagaaccaugggaauggugaauaucuucaauggggaugcagaccucucaggcaugaccuggagccacggucucucaguaucuaaaguccuacacaaggccuuuguggaggucacugaggagggaguggaagcugcagcugccaccgcuguaguaguagucgaauuaucaucuccuucaacuaaugaagaguucuguuguaaucacccuuuccuauucuucauaaggcaaaauaagaccaacagcauccucuucuauggcagauucucauccccauagaugcaauuagucugucacuccauuuagaaaauguucaccuagagguguucugguaaacugauugcuggcaacaacagauucucuuggcucauauuucuuuucuaucucaucuugaugaugauagucaucaucaagaauuuaaugauuaaaauagcaugccuuucucucuuucucuuaauaagcccacauauaaauguacuuuuccuuccagaaaaauuucccuugaggaaaaauguccaagauaagaugaaucauuuaauaccgugucuucuaaauuugaaauauaauucuguuucugaccuguuuuaaaugaaccaaaccaaaucauacuuucucuucaaauuuagcaaccuagaaacacacauuucuuugaauuuaggugauaccuaaauccuucuuauguuucuaaauuuugugauucuauaaaacacaucaucaauaaaauaaugacauaaaauca

SEQ ID NO: 966 - RNA, 3225 nt, Homo Sapiens
aaaaguuucuuuucuuugaaugacagaacuacagcauaaugcguggcuucaaccugcuccucuucuggggauguuguguuaugcacagcugggaagggcacauaagacccacacggaaaccaaacacaaaggguaauaacuguagagacaguaccuugugcccagcuuaugccaccugcaccaauacaguggacaguuacuauugcgcuugcaaacaaggcuuccuguccagcaaugggcaaaaucacuucaaggauccaggagugcgaugcaaagauauugaugaauguucucaaagcccccagcccugugguccuaacucauccugcaaaaaccugucagggagguacaagugcagcuguuuagaugguuucucuucucccacuggaaaugacugggucccaggaaagccgggcaauuucuccuguacugauaucaaugagugccucaccagcagcgucugcccugagcauucugacugugucaacuccaugggaagcuacaguugcagcugucaaguuggauucaucucuagaaacuccaccugugaagacguggaugaaugugcagauccaagagcuugcccagagcaugcaacuuguaauaacacuguuggaaacuacucuuguuucugcaacccaggauuugaauccagcaguggccacuugaguuuccagggucucaaagcaucgugugaagauauugaugaaugcacugaaaugugccccaucaauucaacaugcaccaacacuccugggagcuacuuuugcaccugccacccuggcuuugcaccaagcaauggacaguugaauuucacagaccaaggaguggaauguagagauauugaugagugccgccaagauccaucaaccugugguccuaauucuaucugcaccaaugcccugggcuccuacagcuguggcugcauugcaggcuuucaucccaauccagaaggcucccagaaagauggcaacuucagcugccaaaggguucucuucaaauguaaggaagaugugauacccgauaauaagcagauccagcaaugccaagagggaaccgcagugaaaccugcauaugucuccuuuugugcacaaauaaauaacaucuucagcguucuggacaaagugugugaaaauaaaacgaccguaguuucucugaagaauacaacugagagcuuugucccugugcuuaaacaaauauccacguggacuaaauucaccaaggaagagacguccucccuggccacagucuuccuggagaguguggaaagcaugacacuggcaucuuuuuggaaacccucagcaaauaucacuccggcuguucggacggaauacuuagacauugagagcaaaguuaucaacaaagaaugcagugaagagaaugugacguuggacuugguagccaagggggauaagaugaagaucggguguuccacaauugaggaaucugaauccacagagaccacugguguggcuuuugucuccuuugugggcauggaaucgguuuuaaaugagcgcuucuucaaagaccaccaggcucccuugaccaccucugagaucaagcugaagaugaauucucgagucguugggggcauaaugacuggagagaagaaagacggcuucucagauccaaucaucuacacucuggagaacauucagccaaagcagaaguuugagaggcccaucuguguuuccuggagcacugaugugaaggguggaagauggacauccuuuggcugugugauccuggaagcuucugagacauauaccaucugcagcuguaaucagauggcaaaucuugccguuaucauggcgucuggggagcucacgauggacuuuuccuuguacaucauuagccauguaggcauuaucaucuccuuggugugccucgucuuggccaucgccaccuuucugcugugucgcuccauccgaaaucacaacaccuaccuccaccugcaccucugcgugugucuccucuuggcgaagacucucuuccucgccgguauacacaagacugacaacaagaugggcugcgccaucaucgcgggcuuccugcacuaccuuuuccuugccugcuucuucuggaugcugguggaggcugugauacuguucuugauggucagaaaccugaagguggugaauuacuucagcucucgcaacaucaagaugcugcacaucugugccuuugguuaugggcugccgaugcuggugguggugaucucugccagugugcagccacagggcuauggaaugcauaaucgcugcuggcugaauacagagacaggguucaucuggaguuucuuggggccaguuugcacaguuauagugguaagcaaauacuacaacagccuggcgaaguguguucugaaggaggagcaaggagaccugcgagaucuggaauuuccagggacgugugcagcugagaggaucaacucccuucuccugaccuggaccuuguggauccugaggcagaggcuuuccaguguuaaugccgaagucucaacgcuaaaagacaccagguuacugaccuucaaggccuuugcccagcucuucauccugggcugcuccugggugcugggcauuuuucagauuggaccuguggcaggugucauggcuuaccuguucaccaucaucaacagccugcagggggccuucaucuuccucauccacugucugcucaacggccagguacgagaagaauacaagagguggaucacugggaagacgaagcccagcucccagucccagaccucaaggaucuugcuguccuccaugccauccgcuuccaagacggguuaaaguccuuucuugcuuucaaauaugcuauggagccacaguugaggacaguaguuuccugcaggagccuacccugaaaucucuucucagcuuaacauggaaaugaggaucccaccagccccagaacccucuggggaagaauguugggggcggucuuccugugguuguaugcacugaugagaaaucaggcguuucugcuccaaacgaccauuuuaucuucgugcucugcaacuucuucaauuccagaguuucugagaacagacccaaauucaauggcaugaccaagaacaccuggcuaccauuuuguuuucuccugcccuuguuggugcaugguucuaagcaugccccuccagagccuaucauacgccugauacagagaaccucucaauaaaugauuugucgccugucugacugauuuacccuaggaggu

SEQ ID NO: 967 - RNA, 6002 nt, Homo Sapiens
cugccacagacccgcgccaggacgacccugccuccgcggcugucccuagccagggcccaaccugguucuauuaauaacuaagcaaacuagaacaccucagccggaggcuggggugcgcggcugcugcaccugcagccugaacccggggguccugacacgccgcauuuugggcugggaccagcuggagccggaagcggaggugcaguguggcuagccggagaccggaagcggaagcgcgcuugugucuugugagaagagccgcgcuugcagcgucugggagaaucuuucggucuccgcgagaggugcuucauuccacgaaaaaaguauaauucaagcucagauuuguguugaaaccagccucaaguuucaccuauccucacugauccguggacuucuguaugaucagggugcuguccugagagcgcugcgggauaaaggaggagcguccugcuucccggcugcccuguugcugucggagucacaggauggcggcugucguccugcccccaacugccgcucugucuucccuguucccagccucucagcgagaaggacacacagagggcggagagcugguuaaugagcuccugaaaagcuggcuaaagggcuuggugaccuuugaggauguggccguggaguucacccaggaggagugggcauugcuggacccugcccaaaggacacuguacagggacgugaugcuggagaacugcaggaaccuggccucacuggggaaccaaguugauaaaccuaggcugaucucccagcuggagcaagaagauaaagugaugacagaagagagaggaauucucucagguaccuguccagauguggagaauccauuuaaagccaaaggguuaacuccuaagcugcauguuuuucgaaaagaacaaucuagaaauaugaaaauggagaggaaucaucuuggagcaacacucaacgaauguaaucaguguuuuaaagucuucagcacaaaaucuucccuuacacggcacaggaagauucauacuggagaaagacccuauggcugcagugaaugugggaaauccuacagcaguagaucuuaccuugcuguucauaagagaauccacaauggggagaaacccuaugaaugcaaugacugugggaaaaccuucagcagcagaucuuaccuuacuguucauaagagaauccacaauggggagaaacccuacgaaugcagugacugugggaaaaccuucagcaauuccucauaccucagaccgcacuugagaauucacacuggagaaaaaccguacaaauguaaccaguguuuucgugaguuccgcacucagucaaucuucacaaggcacaagagaguucauacgggggagggucauuauguauguaaucaguguggaaaggcuuucggcacgaggucaucucuuucuucgcacuauagcauucauacaggggaguacccuuacgaaugccacgauugugggagaaccuucaggaggaggucgaaucugacacagcacauaagaacucauacuggagaaaaacccuacacauguaaugagugugggaaauccuuuaccaauagcuuuucucuuacaauucacaggagaauacauaauggagagaaauccuaugagugcagugauuguggaaaauccuuuaauguucucucauccguuaagaaacacaugagaacucacacuggaaaaaaacccuaugaauguaauuauugcgggaaauccuucacaaguaacuccuaccuuucugugcauacgagaaugcauaauaggcaaaugugaauucaauaacugugggaaaagcauucauugaucuuucaugccucagauaacaugagcaaacucuaacaagauguaugaaucaccugcuacuguguaacaaauuaccccccaaaauuuuguggcuucaaacaaaaacacuuguuaucucaaaauuuuuguaggucaggaauucagaaacaacauagcucuauaguucuucaggauaucucaagagguuacaguccagaugucagcagaacuguaaucauccagaauuguuacuggugaagggaccacuuccaaauggcuuacaagcccgacaagugcaugcuagcuguuuccaagggagcugcgcuuccaaaucacguaggccucucaacagggcugaguuucuuuauggaagcaacuucuccccaaagccagugaucuaaaggagccaacacagaaagcauaaugucuuuuaugaccuagcuucagugagauauguuuucaugucccuguuacauuggucauacacaccaauccugauacaauguggaagaacaccacaggagguaugaacaguagacauuuggaaccaucuggaaaacuugccaugaaaucaguggaggaaagccuucagcugacccucauuuuuuuuuuuuuaagacaaugucucacucugucacccagucuggagcgcaguggugugaucacagcucacugcagccucuacuuccugggaucaaguaauucuccugccccagccuccaauguagcugggacuacaggugcaugacaccaugucuggcuaauuuguuuuuuuuuaaacuagagggaggguuuugccauguugcccagacuagucucaaacuccuagguucaagcaguccuuucaucuuggccuccagaaguacugggauuacaggcaugaaccaccaugcccagccaacuucuaaacugaucaauaugggaguagcauucaaucacccacagguuaacucacucuagagagaaaucuugugaguguaaucuguaugguaaaacuuugagcucaaacuuucccccuaccaaaaaaaaaguaucuacuggggagcugcccagguaaugcaguagcuguaggaaagccuucagugauggcuucagggagucacaugacaacucacaauaaggggaaacccuguguguggcaucaaaaauggaaaaccaggggacacucauuccuuaagucacauuucggagaucauacaacagaggaauauguugaguauacacaguguugaaaagccugugacacaaacagucauauuaccaagcacaagacaguauaguuugguaugcuauaaaagccuugaauauucucuccauuuuuaagaagugagauucauacuagaaaaaccauugaauuccaucaguauuagaaugucauuuuuccacauuuuuaggaaccuaacucaguguaagauaacaauuuauacaauuuauuuuuugagacaggguuucaucugugcccaggcuguagugcaguggugcaaucuuggcuuauuguaaccucugccucccaggcuuaagggauccucccaccucagccucccaaguagcugggacuguaggcaugcaccaccaugccugucuaguuuuuguaaagauggggauucaccauguuucccaggcugcucucaaacuccugggcucaagugauccaccugccucagccucccaaaaugcugggaauacaggaacgagcuaccacucucagccagaacuucuuaagauaaaggaugagggaauguuuucagugauaccucuuauauuaggaaaaauauguaaauguuccuuggaugcaauacucacgaguguauuaauuucagaaaaauuuucagugauuccucccuuuaugcaugagagaauucauuuagaggaagcccuaggaacguaaucaauguuaggaugccucaucucuuaacugaguggccacgcaguaacuuagaacaaaagguguaagugcuaugaauguggaauuaccuucaucaaugucucauuuguagguugggccacuagcucguucauuuucagucuuuuaauauaaacauuuauggcuauagugguccugaaaaucuuacuaccucguuuuauauacaguguauuuauuauaauucuaaaacaucaauacaccaaauauucagaaagguauuuccaaacagcuccugagugaucuaguuuguuauaauagaaauuagacauuugccaggugugguggcucacaccuauaaaccuagcauuuugggaggcugaggcgggcagaucaccggagguaaggagcuugagaccagccuggccaacauggugaaaccccgcuucuacuaaaaaauacaaaaauuagccgggugugguggcaggcaucuauaaucccagcuacucaagaggcugaggaaggagaaucacuugaacccgggaaauggagguugcagugagccaagaucaugccacuucacuccagccugggcaaaagagugcaacucugucucaaaaaaaaaaaaaucagacaauauuugauauauuuuuuucuaauuuaauaguauuuugccagaguacauggacuuugugauuuugguuguuuucucuuuguguccuaauauagcaaauacuguuucuuuuuuuuuuuuuuuuuuuuuuugagacggagucuugcucuguuguccaggcuagaaugcaguggcgcgauuguggcucacugcaagcucugccucccagauucacgccauccuccugccucagccucccgaguagcugggacuacaggugcccaucaccaugcccggcuaauuuuucauauuuuuaguagaaaugggguuucacuguguuagccaguauggucucaaucuccugaccucgugauccaccugccucggccucccaaagcacugggauuacaggcgugagccaccaugcccggcacaaauacuguuucuuaauguucauucucccuacuuaaagaaaaagauaaguugucaaugagcaguauugaaaauguacaguggggccaggcgccauggcucaugccuguaaucccagcacuuugggaggccgaggcaggcggaccaccugaggucaggaguucaagacuagcuuggccaacguggugaaaccucgucucuacuaaaaaaaauacaaaaauuagcugggcgugaugacaggugccuguaaucccagcuacuugggaggcugaggcaggagaaucgcuugagccugggaagcggagguugcagugagccgagauugcacaaccacacuccagcuugggcgacagagugagacuccaucucaaaaaaagauguacaguguacuaggcuuuccugaagcuuagacaggcuuuaucccacucugcuggcuaaaagaaguaggaauaacgcacugggugagacaccgucuggcuuauucucaucuauuuucuuuucauucuuuuggaaaguggacacaaagcauagaguuaaaagagcuuuuuuuuuuuuuuuuuuuuuuuucuucacuguggugauaaaaaccacagugcaggggcugggcgugguggcucacgccuguaaucccaccacuuugggaggccaaggcaggcggaucaccugagguggggaguucgagaccagccugaucaacauggagaaaaccugucucuccuaaaaauacaaaauuaaccgagcauguuggcgcaugccuguaaucucagcuacuuggaaggcugaggcaggagaauugcuucaaacugggcagagguugcagugagccaagguugacccacugcacuccagccugggcaacaagagcaaaacuccaucucaaaaaaaaaaaaaaagaaagaaacagugccgaaaaaucacaaugauuugaguucuucaaaaaccuuugauuggcugcauuggcucuguucugcauauuacuagacuucuuacaugaucacaaguaaccacuaauugguuaaaaccaaagagagagagagagagaguguguguguguguguguguguuugguugggggguguuguguuagcuuccaggugaaugcauuaucuguuaauccuguuuauugaucuguuuuuauaagugcuccaugauucucugaaaacaguauacuauguaucuaauuuuuggauacaggauggacauacguacucaaacuguguuuuucaauuuguacuguauuuguuucucucgaccugacuuagugauagagguauauuaaagucuuccacuagcaugguagauuaacaaa

SEQ ID NO: 968 - RNA, 429 nt, Homo Sapiens
ggagggucggcuuugggcggaacuggcuuuguugaccgggagaaacgagaugggggugaagcuggagauauuucggaugauaaucuaccucacuuucccuguggcuauguucuggguuuccaaucaggccgagugguuugaggacgaugucauacagcgcaagagggagcuguggccaccugagaagccaugaguaaggaaccgagagcagaggaguagaugguuuccuuauugccuucuccuggaagagugaagcggaucccacgcggaccccuuucuucaagagauagaggaauucaaagagagguuacggaagcggcgggaggagaagcuccuucgcgacgcccagcagaacuccugaggccuccaagugggaguccuagccccuccccugaugaaauauacauauacucaguuccuuguuauuca

SEQ ID NO: 969 - RNA, 1308 nt, Homo Sapiens
uggacaaauuugcgggcuggggaccauggaaguggaggaaaucuacaagcaccaggaagucaagaugcaagcaccagccuucagggacaagaaacagggggucucagccaagaaucaaggugcccaugacccagacuaugagaauaucaccuuggccuucaaaaaucaggaccaugcaaaggguggucauucacgacccacgagccaagucccagcccagugcaggccgcccucagacuccacccagguccccugcugguuguacagagccauccugagccuguacauccuccuggcccuggccuuuguccucugcaucauccugucagccuucaucauggugaagaaugcugagauguccaaggagcugcugggcuuuaaaagggagcuuuggaaugucucaaacuccguacaagcaugcgaagagagacagaagagaggcugggauuccguucagcagagcaucaccauggucaggagcaagauugauagauuagagacgacauuagcaggcauaaaaaacauugacacaaagguacagaaaaucuuggaggugcugcagaaaaugccacaguccucaccucaauaaaugagaggacauuguggcagccaaagccacaacuuggaagauggggcugcaccugccaacgaagacgggaaaugaccccccccccccagccuagugugaaccugccccucgucccacguauagaaaaaccucgagucauggugaaugagugucucggaguugcucguguguguguacaccugcgugcgugugugugcgugugugcgcguguguucguguaugugcgugugugcgugcgcgugugugugcauuuugcaaaggguggacauuucaguguaucucccagaaaggugaugaaugaauaggacugagagucacagugaauguggcaugcaugccugugucaugugacauaugugagucucggcaugucacgguggguggcugugucugagcaccuccagcagaugucacucugaguguggguguuggugacaugcauugcacgggccugucucccuguuuguguaaacauacuagaguauacugcggcguguuuucugucuacccaugucauggugggggagauuuaucuccguacaugugggugucgccaugugugcccugucacuaucuguggcugggugaacggcugugucauuaugagugugccgaguuaugccacccugugugcucagggcacaugcacacagacauuuaucucugcacucacauuuugugacuuaugaagauaaauaaagucaagggaaaacagcguc

SEQ ID NO: 970 - RNA, 543 nt, Homo Sapiens
cuccaguccucuccucacaguguggaaacacucuuuccuucaaaaccuucauuuguaccagcaggaaacucucacccggagucaauguaaagucgugaccuaaauaaauugucauguucccaaaccuuuucuccaggggacaaugcaaacaaguuuuucacugagucugacccucacagauuuucuucauguauacaaauuacagccugacucagcgaccccaugaaugcuaaaaccaaaacacuguccaggaaauggccccaggcgccaaaggcuccagacuggucucaggcucuccugcccacugcaguuuauucacuugcuucucaccaacacugauccacuuagguaagaaaaaagaccuucaauccccuuugcuguuuguuuguuuuuaagaaacuagcagaguuccugcuuuccuucugugguuauguauaagcuggaagacaaaaaauucuaaaauacuuuauauggauuuuaaaacuggcaaguaaugauuccuuugagaaaacaaagauaucagcuaugcuauuaugauuuaua

SEQ ID NO: 971 - RNA, 1948 nt, Homo Sapiens
cguuauccucaggaagcccugagcgcugagaggcacuguuacagaaccgaacugggguccacucgcuaggccuaccuaggugccuggaauuucccuucgaggaacgcaggaguuuucuuuauuuucaugcuugggaaggcucauuaggccccuaagagagggucccuuccccaucucaggacuaaaaugcaaugaagauguugcucagaggcagcuggagagggaugggucuguggaggaugccccgcagagugaagucgagaugaugcagccaccagggccggaggggagggacauuccacuuuuuaaaucagcuuucugaagcaugaucuccauauaaucaccuagaagcguacagcacaaugaucuugacagaugccagcauccuuggaaccacugccaccaccaacgucucaaaccauuccaucaaacccagaacacuccuggugcccugaagcgucucccuucaguggcagaaccagcagagauucaguggucacaaggcuggucuggaacuccugggugcaagcgauccuuccaccucggccucccaaagugcugggauuagaggcauaagccaccgcgcccagccaggaauggauuuucucacaguucucgauggcggaagucugagaucaaggucuuggcagggcuaggucucucugaggccuuucuccccagcuuauaggucgccgccuccucucucugucuuuccuugucuuccuuguguccacaguuguguccaaauuccccuuucucauaaggacgucagucauguuggauuagggcccucccuccugaccuuguuuuagcuuaaucucugcaacuuaacccuuaaccucaguaaagauccuauuuccaaauguguucacauucugagguccugaggauuaggacuuugaaaggauuaaaacaggcucuucuggcauauugacaauuucagcuaaagacucuugagaaacagcaggugcaaaaagaucacagugaccuccaugcuguaccuugagaugaaauuccaaugcgaaagaugcccucuccacccuagaagggaaagcaacauccuuaucuuugggagugaaaaguccaaacugagagcauacugugaguaccucauuagcaucauuccauucucugagcuuccccgcagacuucaguugcuucuucacagcucugcucuuugucccguccaaucucugaguaacuaacucacugcuucugcaggucuucauuucugcaggagggcucccaugcuacauaaauccugcauuacacuuuucuccuguuagucuauguuauguccauuuaauucucaggcccagccgggacccuaagaggacagagguggaguuuuuccaccccuacaacuuuacccaaucacaauucaauccuaacagugccuuucucuggaggggcucugccagcaugaauuccuuuacggguggaagccucacaguccagucuaccagugagguccacaugggauuggcuggagggagcuacgaagucaagcggcgucagguacagagaaacaaaucccacauccaagggccaggaggcgguagagcaaaccacgcacagccgggugacuuaagggcaaggaagucuuccugcaggaggugaauuuggcacaagggauacguuuuuaggcccugaguggaggaucuggguuucaaacuggacuuuugaaaaacacacucuuauuguagaagggccugcggguuuguuuuaaucacuucucaaagcuacgcuaggcauucgcagcucaggauccccaguuuagccuaauaaaaaaaaguaauuacaucauauuacagauaauuugauugugucugagacgauaauugaguuaaaacgcuuauuguaacagacacaucagauuggcaaggaggaagcucggcuuaaauacaaacaguguugagaguggaauuaaaggauugccauugcaguu

SEQ ID NO: 972 - RNA, 1795 nt, Homo Sapiens
ccccuuuuugcauacugaccagcccuggcaacggagcucaaggcaucuuugugccacugcucaacagugagugaugucaugggcacggccaggucuuuaucaguucugccggauaaauagccaacugcacuaggucuggagagacagcaaggugcugugcggcagagcauuuggggucucaaagaagcaguggccaccaccauggauacaggccccgaccaguccuacuucuccggcaaucacugguucgucuucucgguguaccuucucacuuuccugguggggcucccccucaaccugcuggcccugguggucuucgugggcaagcugcggugccgcccgguggccguggacgugcuccugcucaaccugaccgccucggaccugcuccugcugcuguuccugccuuuccgcaugguggaggcagccaauggcaugcacuggccccugcccuucauccucugcccacucucuggauucaucuucuucaccaccaucuaucucaccgcccucuuccuggcagcugugagcauugaacgcuuccugaguguggcccacccacugugguacaagacccggccgaggcuggggcaggcaggucuggugaguguggccugcuggcuguuggccucugcucacugcagcguggucuacgucauagaauucucaggggacaucucccacagccagggcaccaaugggaccugcuaccuggaguucuggaaggaccagcuagccauccuccugcccgugcggcuggagauggcugugguccucuuuguggucccgcugaucaucaccagcuacugcuacagccgccugguguggauccucggcagagggggcagccaccgccggcagaggaggguggcggggcugguggcggccacgcugcucaacuuccuugucugcuuugggcccuacaacgugucccaugucgugggcuauaucugcggugaaagcccgguguggaggaucuacgugacgcuucucagcacccugaacuccugugucgaccccuuugucuacuacuucuccuccuccggguuccaagccgacuuucaugagcugcugaggagguugugugggcucuggggccaguggcagcaggagagcagcauggagcugaaggagcagaagggaggggaggagcagagagcggaccgaccagcugaaagaaagaccagugaacacucacagggcuguggaacugguggccagguggccugugcugaaaacuagguccuccgggggaggaggguguagcuggcgugucauccucagggcgcuuccucgcucacgccaggagggacuuggaguggcgagcuggggcccgauggggcuugggggcagaguagacaucuagccucccuaaggguaugcgcgcuaaagcccagcucucgaucucaccuccauccccauccacccacacacuauggauugggcucugggaaggggucagggugagaggcugcucuggagaacaaugagguccucauagcagcaggcagcuccuguguuuucuugaggguggcagaggagcuaagagcagugcccaggucugagggggcugcccagugaguggcaggggcaggagaggggagaaccccauccucagagcugcucccagccagcgagucaggagcgggggagacagggcuccagggaugaggccgcauucugcucccacagugccuuuuccagaaaguucccauugcucaauaaauguggaucaucagagacauuuaugaacaaugacagaagaaaaauuacccaaauaaauguggaagcaagc

SEQ ID NO: 973 - RNA, 949 nt, Homo Sapiens
aaaggaggauguugcugaucucaguacaagcaauguuagagaaaggggaagauggaaguggacgaggaccagugaguggaaggugacaaauggaagcaaagaaacccauccagaccauugaagaugcuugagcgagaagaaagaggcgguggagggaauggaagcccgaggaagucauuuguugcaauaggaugccucagagcacguguagggugcggggcagagcccaugcagaggggcuguggaaggcuggcagggugcagguggccccacucuccgucacccugaggaauauguggucagaguuaaagcucagucuguuucugggaucagccuuucacaagcucuaaaagauucacugugcagaacuggagguucuagagaaagaccacgccuccuccuacagguaacucuugauucaggaagcagcucuuggcuuaucccugggcuuaguggaauucaaauaccugaccauaggacaccaagggcuuugggaccugaaaggcacaucauguccuggugacaucugaguuaccuggggcaugcacagccagccuccagcaucccagggagagcuguguauggggucaggcucaagcaggucccagggcaccagugacccaaugggugacucagacucccauggcaccugcuccuucuguuucucccuccaccauauauaugagcucaugggaaacacugugugaccucuuacagaggaggaaagugcauggacuuccaguuucuagaacugugauacaauaaacuccuguugcuuaucuuauuuugucauggcagcccuagcaaacuacuacagggacugugaggguuaagaugacaccaaacaucaaaugccacucccuguuccaacacugagaccauuccacagccucugaaugacaagacaggccuucaaaaucaagaccaccuggcuagauucuggauauua

SEQ ID NO: 974 - RNA, 80 nt, Homo Sapiens
cuggggucaccugucuggccagcuacguccccacggcccuugucaguguggaagguagacggccagagaggugaccccgg

SEQ ID NO: 975 - RNA, 2078 nt, Homo Sapiens
cacaggaccggaagugacccucuuuauuucccuuccucacguggugcaggcaggaagugacgcgccuggcccgggagcugcggucgcagaggccgacggagccggagucgcggacgccgcggggucuccgggacaggaacccucagugcugcgucuagauucugcaggggagguuugcugggaccuuggcuccacgcagccagcgaaauggcagccacacucgauuugaaaucaaaggaggagaaggaugcugaguuggacaagaggaucgaggcucuucggcggaagaaugaggcccucauccggcgcuaccaggagauugaggaagaccguaagaaagcugaacuugagggagucgcagucacagcuccccgaaagggccgcucaguggagaaggagaacguggcaguggagucggagaagaaccuggguccuucccggaggucuccugggaccccucggcccccaggggccagcaaggggggccggacuccuccacagcagggaggccgggccggcaugggccgagcaucgcgcagcugggagggcagccccggggagcagccucgaggaggaggagcugggggccguggccggaggggccggggccgagguucaccucaccucucuggagcuggagacaccucaaucucugaccguaaauccaaggagugggaggagcggcgcaggcagaacauugagaagaugaaugaggagauggagaagaucgccgaguaugagcgcaaccagcgggaagggguucuugaacccaacccagugcggaacuuccuggacgacccccggcgacgcagcgggccccuggaggagucugagcgggaccgccgggaggagagccgccggcacggccgcaacugggggggccccgacuucgagcgggugcgcuguggccuugagcacgagcggcagggccgccgagcuggccugggcagugcuggagacaugacguuguccaugacgggccgggagcggucggaguaccugcgcuggaagcaggagagggagaagaucgaccaggagcggcugcagaggcaccgcaagcccacuggccaguggaggcgcgagugggaugccgagaagaccgaugggauguucaaggauggcccagucccugcccaugaaccaucccaccgcuaugaugaccaggccugggcccggcccccgaagcccccuacuuuuggggaguuccugucccagcacaaagcugaggccagcagccgcagaaggagaaagagcagucggccccaggccaaggcagcgcccagggccuacagugaccaugaugaccgcugggagacaaaagaaggggcagcauccccagccccugagacuccacagccuacuucccccgagacuucccccaaggagacacccaugcagccacccgagaucccagcuccugcccaccggccuccugaagacgagggggaagagaaugagggggaagaggaugaagaaugggaggacauaagugaggaugaggaagaggaggagaucgagguggaagaaggugaugaggaggaaccagcccaagaccaccaagccccagaggcugcccccaccgggauccccugcagugagcaggcccacggaguccccuucaguccggaggagccccugcuggagccccaggccccuggcacgccuuccagcccuuucucaccacccagcggccaccagccuguguccgauuggggugaagagguggagcugaauucuccccggaccacucaccuggcuggcgcccucuccccgggugaggccuggccuuuugagaguguaugaagcuggcugccugugugugugugugugugugugugugugugugugugugugugugcgcgcgcgcgcgcgcgcgcgcgcgcgcuagagggguguggcuggugggggacccuuggggcugggcccugggacccagugugccccacagcccugucagcugaggggguagcgcagcccaugcucuucuguacugucaugcccgucucuggaauguccacucccagagccugccccagcccuucgagcccccuccccaauaaagaauucacauccuccaa

SEQ ID NO: 976 - RNA, 1969 nt, Homo Sapiens
acuuugucguacuccuuccuugcugacuaagaggaacagaacacagagcagccuggcgguguccuaccaacaagccuccguuucuccuuccuguacacuagggcuccugaaacucaccugaugaagucuccgucugucacccaggcuggaguguaauggagcaaucucggcucacugcaaccucugccucccagguucaagcgauucucuugccucagccucccgaguagcuggaauuauaggugcaugccaccacgcucggcuaauuuuuuguauuuuuaguaaagacggaguuucaccauguuggucaggauggucuccgucucuugaccucgagaucagcccgccucggccucccaaagugcugggauuacaggcgugagccacugugcccggccuugguuucuaaauacuauuuugaaguaucuguggagaaaugguuacuucgagggcuggggcaggaauauauaagauaacauuggaacaaauucugacgccagaacaugaagaaauauuugaaaaaggauggggcauauugacugaacacagaagacaaacaugcaugaccucagccuaaucgugagaaaacaucaaagaaauccaaauugauaaacauucuguaaaauaauuggccaugcucagcaaaagugucacaaucacaaaagacaagggaagaauaagaaacggucacagccuggaggaaucuaaggacauaacaacugagugcaaugugagauccucgauucgaucuuggagaagaaagaggacguuaagagaaauauugacaaaauucaaauaaggucugcacauuagguaaugguaagauacguugacaucaauuuccugguuggauacuuguauuacauauacuauuauguauauaauuauuauauuacaauuacauauacaguuguauauuauauauaauacaauaaauguauauauaugauuauaauacaauaaauguauauauacaguuuuauauauaacaacuauuauacauauaauacaauuauauauauagcuaacaucaggauaggcugguugaggauuuauaugaaucuuugcuaauuuugcauguuuaaaauuauuucaacauaaaaaaauuauaugggucauguaguuuuuugugcaguuuaauucuaggcaccauaguuucuguuuuaauggguguauuuucuucuuucaaggaauugggauagucuguuguauuaaaaaccuauucauuuuuguacauuaagauucuucuggccaggcgcaauggcucaagccuauaaucccagcacuugggaaccugaggcaggcagaucaccugaggucaggaguucaagaccagcauguccaacauggugaaaccccaucucuacuaaaaauacaaaaaaaauuagccaggcaugguggcacaugccuguaaucccagcuacuugggaggcugaggaggagacucacuagaacucaggaagcagagguugcagugagccaagacugcgccacugcacucuggccuaagcaacagagggagacuccaucucaaaaaaaaaaaaagauuauuucucuaacuuacugguuuaucuuuuauagcuuauuucaggugauuuguuguguuugucuauagaguaaaauaacaugucuaaugaguuauaauuuaauguccuuccauucaaucacuguauuucaaauuuauuccaauauuuuggaauaagcuuccaauauuuuaacuuaaauagggaaggucauacuugguauuuuccugaccucagcuggaaugccuucauaguguucacaugaacacauuuggccugagagagacuuauuaugccgagaauguguguaacccuuuuuacuuaggaauuguggguggaguuuuuccccccgcccaagaaugauuguuaauuuccguccaucauuuuccuuugauuguucuucaucucgaaaacaaauaauaaaauaauaaaauaaauaaauaaaa

SEQ ID NO: 977 - RNA, 2958 nt, Homo Sapiens
agccccaaacucaccaccuggccguggacaccugugucagcaugugggaccugguucucuccaucgccuugucuguggggugcacuggugccgugccccucauccagucucggauugugggaggcugggagugugagaagcauucccaacccuggcagguggcuguguacagucauggaugggcacacuguggggguguccuggugcacccccagugggugcucacagcugcccauugccuaaagaaguaaguaggacccugggaucuggggagggaauggcugugucccacaggaauaacagcgggaugcuucccccagggucacuucucaggaauagccaggucuggcugggucggcacaaccuguuugagccugaagacacaggccagagggucccugucagccacagcuucccacacccgcucuacaauaugagccuucugaagcaucaaagccuuagaccagaugaagacuccagccaugaccucaugcugcuccgccugucagagccugccaagaucacagauguugugaagguccugggccugcccacccaggagccagcacuggggaccaccugcuacgccucaggcuggggcagcaucgaaccagaggaguucuugcgccccaggagucuucagugugugagccuccaucuccuguccaaugacaugugugcuagagcuuacucugagaaggugacagaguucauguugugugcugggcucuggacaggugguaaagacacuuguggggugagucaucccuacucccaacaucuggaggggaaagggugauucuggggguccacuugucuguaauggugugcuucaagguaucacaucauggggcccugagccaugugcccugccugaaaagccugcuguguacaccaagguggugcauuaccggaaguggaucaaggacaccaucgcagccaaccccugagugccccugucccaccccuaccucuaguaaauuuaaguccaccucacguucuggcaucacuuggccuuucuggaugcuggacaccugaagcuuggaacucaccuggccgaagcucgagccuccugaguccuacugaccugugcuuucugguguggaguccagggcugcuaggaaaaggaaugggcagacacagguguaugccaauguuucugaaauggguauaauuucguccucuccuucggaacacuggcugucucugaagacuucucgcucaguuucagugaggacacacacaaagacgugggugaccauguuguuuguggggugcagagaugggagggguggggcccacccuggaagaguggacagugacacaagguggacacucucuacagaucacugaggauaagcuggagccacaaugcaugaggcacacacacagcaaggaugacgcuguaaacauagcccacgcuguccugggggcacugggaagccuagauaaggccgugagcagaaagaaggggaggauccuccuauguuguugaaggagggacuagggggagaaacugaaagcugauuaauuacaggagguuuguucaggucccccaaaccaccgucagauuugaugauuuccuagcaggacuuacagaaauaaagagcuaucaugcugugguuuauuaugguuuguuacauugauaggauacauacugaaaucagcaaacaaaacagauguauagauuagaguguggagaaaacagaggaaaacuugcaguuacgaagacuggcaacuuggcuuuacuaaguuuucagacuggcaggaagucaaaccuauuaggcugaggaccuuguggaguguagcugauccagcugauagaggaacuagccaggugggggccuuucccuuuggauggggggcauaucugacaguuauucucuccaaguggagacuuacggacagcauauaauucucccugcaaggauguaugauaauauguacaaaguaauuccaacugaggaagcucaccugauccuuaguguccaggguuuuuacugggggucuguaggacgaguauggaguacuugaauaauugaccugaaguccucagaccugagguucccuagaguucaaacagauacagcaugguccagagucccagauguacaaaaacagggauucaucacaaaucccaucuuuagcaugaagggucuggcauggcccaaggccccaaguauaucaaggcacuugggcagaacaugccaaggaaucaaaugucaucucccaggaguuauucaagggugagcccuuuacuugggauguacaggcuuugagcagugcagggcugcugagucaaccuuuuauuguacaggggaugagggaaagggagaggaugaggaagccccccuggggauuugguuuggucuugugaucagguggucuauggggcuaucccuacaaagaagaauccagaaauaggggcacauugaggaaugauacugagcccaaagagcauucaaucauuguuuuauuugccuucuuuucacaccauuggugagggagggauuaccacccugggguuaugaagaugguugaacaccccacacauagcaccggagauaugagaucaacaguuucuuagccauagagauucacagcccagagcaggaggacgcugcacaccaugcaggaugacaugggggaugcgcucgggauuggugugaagaagcaaggacuguuagaggcaggcuuuauaguaacaagacgguggggcaaacucugauuuccgugggggaaugucauggucuugcuuuacuaaguuuugagacuggcagguagugaaacucauuaggcugagaaccuuguggaaugcagcugacccagcugauagaggaaguagccaggugggagccuuucccagugggugugggacauaucuggcaagauuuuguggcacuccugguuacagauacuggggcagcaaauaaaacugaaucuuguuuucagaccuua

SEQ ID NO: 978 - RNA, 1754 nt, Homo Sapiens
gcaguuccugagagaagaacccugaggaacagacguucccucgcggcccuggcaccuccaaccccagauaugcugcugcugcugcugcugccccugcucugggggagggagaggguggaaggacagaagaguaaccggaaggauuacucgcugacgaugcagaguuccgugaccgugcaagagggcauguguguccaugugcgcugcuccuucuccuacccaguggacagccagacugacucugacccaguucauggcuacugguuccgggcagggaaugauauaagcuggaaggcuccaguggccacaaacaacccagcuugggcagugcaggaggaaacucgggaccgauuccaccuccuuggggacccacagaccaaaaauugcacccugagcaucagagaugccagaaugagugaugcggggagauacuucuuucguauggagaaaggaaauauaaaauggaauuauaaauaugaccagcucucugugaacgugacagccuugacccacaggcccaacauccuuauccccgguacccuggagucuggcugcuuccagaaucugaccugcucugugcccugggccugugagcaggggacgcccccuaugaucuccuggauggggaccucuguguccccccugcaccccuccaccacccgcuccucagugcucacccucaucccacagccccagcaccacggcaccagccucaccugucaggugaccuugccuggggccggcgugaccacgaacaggaccauccaacucaauguguccuacccuccucagaacuugacugugacugucuuccaaggagaaggcacagcauccacagcucuggggaacagcucaucucuuucaguccuagagggccagucucugcgcuuggucugugcuguugacagcaaucccccugccaggcugagcuggaccuggaggagucugacccuguaccccucacagcccucaaacccucugguacuggagcugcaagugcaccugggggaugaaggggaauucaccugucgagcucagaacucucuggguucccagcacguuucccugaaccucucccugcaacaggaguacacaggcaaaaugaggccuguaucaggaguguugcugggggcggucgggggagcuggagccacagcccuggucuuccucuccuucugugucaucuucauuguagugagguccugcaggaagaaaucggcaaggccagcagcggacgugggagacauaggcaugaaggaugcaaacaccaucaggggcucagccucucaggguaaccugacugaguccugggcagaugauaacccccgacaccauggccuggcugcccacuccucaggggaggaaagagagauccaguaugcaccccucagcuuucauaagggggagccucaggaccuaucaggacaagaagccaccaacaaugaguacucagagaucaagauccccaaguaagaaaaugcagaggcucgggcuuguuugaggguucacgaccccuccagcaaaggagucugaggcugauuccaguagaauuagcagcccucaaugcugugcaacaagacaucagaacuuauuccucuugucuaacugaaaaugcaugccugaugaccaaacucucccuuuccccauccaaucgguccacacuccccgcccuggccucugguacccaccauucuccucuguacuucucuaaggaugacuacuuuagauuccgaauauagugagauuguaacgug

SEQ ID NO: 979 - RNA, 97 nt, Homo Sapiens
accaagugauauucauugucuaccugagcuagaauacaaguaguuggcgucuucagagacacuuguaugcuagcucagguagauauugaaugaaaaa

SEQ ID NO: 980 - RNA, 6741 nt, Homo Sapiens
gaucgcguggggagccggucuuggagcagcgggauuagcuucuaaagucucuuucaucucuccuaaggaagaagccuagaagaggaggaagaggaaagaaaaggagucaggaaugccucuuagauaucucuuccaaaugcaugaugaaaaaggugggaagauuacuugagccagggaguugaaggcugcagugagcccuguuuuugccaccacacuccagcuugggauugauuucuaaagacucauguuacaugaggaagcagcucagaagaggaaaggaaaggagccaggcauggcucuuccucagggacgcuugacuuucagggauguggcuauagaauucucauuggcagaguggaaauuccugaacccugcgcagagggcuuuguacagggaagugauguuggagaacuacaggaaccuggaggcuguggauaucucuuccaaacgcaugaugaaggaggucuugucaacagggcaaggcaauacagaagugauccacacagggauguugcaaagacaugaaaguuaucacacuggagauuuuugcuuccaggaaauugaaaaagauauucaugacuuugaguuucagucacaaaaagaugaaagaaauggccaugaagcauccaugccaaaaaucaaagaguugauggguagcacagaccgacaugaucaaaggcaugcuggaaacaagccuauuaaagaucagcuuggauuaagcuuucauuugcaucuuccugaacuccacauauuucagcccgaagagaaaauugcuaaucaaguggagaagucugucaacgaugcuuccucaauuucaacaucccaaagaauuucuuguaggccugaaacacauacuccuaauaacuaugggaauaauuuuuuccauucaucauuacucacacaaaaacaggaaguacacaugagagaaaaaucuuuccaauguaaugagacuggcgaagccuuuaauuguagcucauuuguaaggaaacaucagauaauccauuuaggagaaaaacaauauaaauuugauauauguggcaaagucuuuaaugagaagcgauaccuugcacgccaucguagaugucacacuagugagaaaccuuacaaguguaaugaauguggaaaguccuucaguuacaagucaucccugacaugccaucguagaugucacacuggugagaaaccuuacaaguguaaugaauguggaaaguccuucaguuacaagucaucccuuacaugccaucauaggugucacacuggugagaaaccuuacaaguguaaugaauguggaaaguccuucaguuacaagucaucccuuagaugccaucguagacuucauacuggaauaaaaccuuacaaguguaaugaguguggcaagauguuuggucaaaauucaacccuuguaauucauaaggcaauucauacuggagagaaaccuuacaaguguaaugaauguggcaaggcuuuuaaucaacaaucacaccuuucacgucaucauagacuucauacuggagagaaaccuuacaaguguaaugacugugguaaggcuuuuauucaucagucaagccuugcacgucaucauagacuucauacuggagagaaaucuuacaaaugugaagaaugugacagaguuuucagucagaaaucaaaccuugagagacacaagauaauucauacuggagagaaaccuuacaaguguaaugagugucacaagaccuucagucacaggucaucucuuccaugccaucguagacuucauaguggugagaaaccuuacaaguguaaugaaugugggaagacuuuuaauguacagucacaccuuucacgucaucauagacuucauacuggagagaaaccuuacaaauguaagguuugugacaaggcuuucaugugccauucuuaucuggcaaaccauacuagaauucauagcggagagaaaccuuacaaguguaaugagugugguaaggcucacaaucacuugauugauucaucaaucaagccuugcaugucaucauagacuucauacuggagagaaaccuuacaaaugugaagcaugugacaaaguuuucagucacagaucacgccuuaaaagacauaggagaauucauacuggagagaaaccuuacaaguguaaugaguguggcaaagccuuuagugaccagucaacacuuaccaucaggccauucaugguguagggaaacuugacuaauguaaugauugucacaaagucuucaguaacgcuacaacgauugcaaaucauuggagaauccauaaugaagagagaucuuccgaguguaauaaauguggcaaauuuuucagacaucguucauaccuugcaguucaucagugaacucauacuggagagaaaccuuacaaaugucaugacuguggcaaggucuucagucaagcuucauccuaugcaaaacauaggagaauucaugcaggagagaaaugucacaagugugaugaguguugcaaagccuuuacuucauguucacaccucauuagacaucagagaaucccuacuggagagaaaucuuacaaaugucaucaguguggcaaggucuucaguccgaggucacuccuugcagaacaucagaaaauucauuuuugagauaacuguucccaaugcagugaguauagcaaaccaucaagcauuaauugacauuggagucaauucagcauugacuugaguuuguguugacuuaacauugaguucaagccuuaauugacaugcagguguuuaugauaagaggauugggccaggugcaguggaucacgccuguaaucccagcacauugggaggccaaggcacauaggucacuugaggucaagaguuugaaacaagcauggccaagagaugugagccaguuuucccagccuguuuauuauuauuuuuugagauggaguguugcucuugcugcccaggcuagagugcaauggugcgaucuugacucacagcaaccuccgccuccuggguucaagcgauuccucugccucagccucccuaguugcugggauuacagguauaugccacgacgccuggcuaauuuuuuguauuuuuaguagggaaaggguuucuccauguuggucaggcuggucucaaacucccgaucucaggugauccgcccaccucagccucccaaagugaugagauuacaggcauaugccaccgcgccuggcauuguuucuucuuuuccuuuuuuuuuuuuuuuuuuuuuuuugagauaguacuuuuuaaagagauaguacuuuuuugagauaguacuuuuuuaaagggauauaccauaguaguuuuaaaagggauaucaggcuggguguggcagcucacgccgguaaucccagcacuuugggaggccaaggcaggcagauaacaaagucaggagauugagaccguccuggcuaacacggugaaaccucgucucuacuaaaaauacaaaaacuuagccgggcaugguggugggcaccuguagucucagcuacucagggggcugaggcuggacaauggugugaacccaggaggcggugcuugcagggagccgagaucgugccacugcacuccaggcugggcgacagagugagagucugucucaaaaaaaaaaaaaaaaagauaucaaacccggggugucucaucccacagcacuuuggaagacugaagugaguggaucaucuaagaucagaguucaagagcacccuggcuaacauggugaaaccccaucucuacuaaaaauacaaaaguuagccaggggugggggugugcaccuuuaguuccagcuacuugggacacugaggcaugagaaucacuuaaaccugggagguagagguuacagcgaaucaaaaccgugccacuguacugcagcgagguuggcagagugagucuccaucucaaacaaacaaaugaaaaaaacagacaucaaaaaugcuuuuguucucguugugucauagacuucccuuuuuuuuccuucugguuccucuucaguucucuauuuauuuuuucuuuuuugcagauugaguuugagauauaucuuaguuuuaauaguuuuauuucuuaacacauaaugacuucugaaagaugccuuugcagcauccuguaaucagcucacaucauucguuucuguacuuguauauuuuccaguuguuuuccgguugaccccaaaauucgugagauuuuuuuccuacaacaauuucaaaagaguugcuguuugaaauuaguugcauccaguucagaucgaggucugcaugcuuucuagucuuuguuauuuauuggaaggcugugguaccuacuacuuaaguuugauuguugcaguguguacuugguaaagaugucagugaccuuuuaaauaaacaucaaaauguaguuuaagcaguuagucuguuuuucaguuuucuuuccuuaugucauuuuuuaaaaucuugagcugggagcuauuuauuguguguuucccucaaggcccugugguccauucuggaaaaauguugaaacaugggcuggaguggcauagagcgcugcuccaaaagcacccauguauucuuuucuuuuuuggaaauggagucucgcucugucagcuuggauggagugcaguggugcgaucucagcucacugcaaccucuaccuccuuggaucaagugaugcuccugccucagucuccugaggagcuggaauuacaggcacccaccagcacacccagcuaguuuuuguauuuuuaguagagacaggguuucaccauguuugucaggcuggucucaaacuccugaccucgcgauccacccgacucagccucccacugugaugggauuacaggcaugagcuaccacgucgagacucuuuuuuuuuuuuuuuuuuagauggaguuuugcuuuuguugcugaggcuggagugcaauggugcgaucuggugucacuccaaugucuuccuccuggguucaagugauuucuccugccucauccuacugaguaguugggauuacaggugcccuccaccacucccggcucauuuuuugcauuuuuaguagagacaggguuucaucauguuggcaggcuggucuugaacuccugacuucaggugaucugcccaccucgaccucccaaaaugcuaggauuacaagcgugagccauugugccugaccacucauguauucuugauugaaauaauuugcuuauuucuuaguucuacagcugacccucuuucacuguuuccaaggucaauagcuguguguucacacuucugcauuuuauaaauguuccugugaguuuuuuguaaggaagaauuaacugucaggaaucaaugucaucagaaccuugcaaaagaaguuucuuuagcccagguuugugaaagagguuucucuaauuuucaaggaugggggugauaagagcaaccuuugccauuagcccuuccaggaccccauguaagacuuuagacaccuucucacucaucucagaccuucucaggguaacuuggugaaaaugucuuccgaucugagccccagugagccucccugcaacuuggcgacgaggggcuugaccagaaaaggucaacccgagugucccugaccguugaaaugauuggcaaaauggagugcgugucuggguguggcuuuuuuuuuuuugaggagugcccaguugugauuagaauuuucaaugggaugcagugcccuaaaaaugaaaaacaaaagcagaagaauggaagaaauagagguagacucagacacagagaccaucuucaaggccuuucucuguaugaggacaucacagcaaaaucuaaagcaggucacgucaaucccuggcagggaacccuccaccggcuucccguguuccccaggacaaaagcccaaccccucacuguggcuccacagccccgugugcagggccccugccaguguccagccuccuccuggcagcuugcccucaucucaugacucccucugccccagucacauuugcuuuucucuuuucccaaacaucaaaacccuuccugucucaggucauugucccugcucuuacccuauguacccugucccuuucuccuccuucaggucuaggcucagagcucucucccaugcccucccaccccuggucucaagcuccugagcucaagugaucuacccaccucggccuccuagagugcugggaugacaggcaugagccacugcaaccagccucugcaugggguuuccucaacuuuaggucugugcccugaaggggagcucauuccagcccaguucccaacugcugcagcaugugugugugggcuucuccagaaggggagccagaguuucccuguaggaguuuauccuccauggugaggagggccgcaggggggacuguauuugcucagggugaggucuccuuugugucaggccucugagcccaagcuaagccaucguauccccugucaccugcacguauacauccagauggccugaagcaacugaagauccacgaaagaagugaaaauacccuuaagugaugacauuccaccauugugauuuauuucugcaccaucuugacugaucaaugugcuuuguaaucucccccacccuucagaaggcucuuuguaauccuccccacccuugagaauggacuuggugagauccacccccugccugcaaagcauugccccuaacuccaccgccugucccaaaagcuacaagaacuaaugauaaucccaccauacuuugcugacucucuuuucacacucagcccgccugcacccaggugaaauaaacagccucguugcucaca

SEQ ID NO: 981 - RNA, 6285 nt, Homo Sapiens
agauucgcgaaaacccggaagcggaucgcguggagugacggucccacggcagcgcgauugacuucuaaagacucuugguaugugaggaagaaaccuggaagaggaagaggaaagcaaaggagucagggauggcucuuccucagggucuauugacauucagggauguggccauagaauucucucaggaggaguggaaaugccuggacccugcucagaggacucuauacagggacgugaugcuggagaauuauaggaaccuggucucccuggacacaggguuucuccuuuuuugucuggccgaucucaaacuccugcccucaggugauccaucaaccucagccuccgaaacugcugcgauuacagauaucucuuccaaaugcaugaugaaggaguucucaucaacagcacaaggcaauagagaagugauccacacagggacauugcaaagacaugaaagucaucacacuggagacuuucgcuuucaggaaauugauaaagauauucauaacuuagaguuucaguggcaagaagaugaaagaaauagccaugaagcacccaugacagaaaucaaaaaguugacugguagugcagaccgauaugaucaaaggcaugcuggaaacaagccuauuaaagaucagcuuggaucaagcuuucauucgcaucugccugaacuccacauguuucagacccaagggaaaauugguaaucaaguggagaagucuaucaacgaugcuuccucaauuucaacaucccaaagaauuucuuguaggcccaaaacccauauuucuaauaacuaugggaauaauuuccggaauucuucguuacucacacaaaaacaggagguacacaugagagaaaagucuuuccaauguaaugagaguggcaaagccuuuaauuauagcucacucuuaaggaaacaucaaauaauccauuuaggagagaaacaauauaaaugugauguauguggcaaggucuuuaaucggaagcgaaaccuagugugccaucguagaugucacacuggggagaaaccuuacagguguaaugaguguggcaagacuuucagucagacguauucccuuacaugccaucguagacuucauacuggagagaaaccuuacaaaugugaagaaugugacaaagcuuucaguuucaaaucaaaccuuaaaagacauaggagaauucaugcuggagaaaaaccauacaaguguaaugaauguggcaagaccuuuagucagacgucaucccuuacaugccaucguagacuucauacuggagagaaaccuuucaaguguaaugaguguggcaagaccuuuagucggaagucaucccuuacaugccaucauagacuucauacgggagagaaaccuuauaaguguaaugaauguggcaagaccuucagucaggaguuaacccuuaaaugccaucguagacuucauaccggagagaagccuuacaaguguaaugaauguggcaagguuuuuaauaaaaaggcaaaccuugcacgucaucauagacuucauaguggagagaaacccuacaaguguacugagugugucaagacguucagucgaaauucagcccuuguaauucauaaggcuauucauauuggagagaaacguuacaaguguaaugaguguggcaagacguucagucgaauuucagcccucguaauucauacggcaauucauacuggagagaaaccuuacaaguguaaugaauguggcaaggguuuuaaucggaaaacacaccuugcaugucaucauagacuucauacuggagagaaaccuuacaaguguaaugaauguggcaagguuuuuaaucgaaaaacacaccuugcacaucaucauagacuucauacuggagauaaaccuuacaaguguaaugaauguggcaagguuuuuaaucaaaaagcacaccuugcacgucaccauagacuucauacuggagagaaaccuuacaaguguaaugaauguggcaagguuuuuaaucaaaaagcaaaccuugcacgucaucauagacuucauacuggagagaaaccuuacaaguuuaaugaguguggcaaagcuuuuaauugaaaagcaaagcuugcacaucaucauacaauucauacuggaaagaaacaagugcaaugaguguggcaagaccuucugucacaauucaguccuuguaauucauaagaauucauacuggagagaaacaaguguaaugaacguugcaaaauuuuuaaucaacaagcacaccuuccacgucaucauagacuucauaguggagagaaaccuuagaaaugugaagcaugugacaaaguuuacaguggcaaaucgagccucaaaagacaggagaauucauacuggagagaaagcuuacaaaggugaagaauaucacagaguuuucagucacaagucaaaccuugaaagacauaaaauaaaucauacugcagagaaaccauaaaauuguaagaguucgugacaaggcuuucgggcaugacucacaccuggcacaacauccuagaauuuauacuggagagaaaccuuacaaguguaaugagucuggcaaagccuuaaugagcagucaacacuuacucaccaucaggcaauccauggugaaggaaacuugacuaauguaaugauugucaccaagucuucaguaacgcuacaaccauugcaaaucauuggagaacccauaaggaagagagaucauacaaguguaauaaucggcaaauuuuucagacaucguccauaccuugcaguucauuggcgaacucauacuggagacaaaccuuauaaaugucaugauugaggcaaggucuucagucaagcuucauccuaugcaaaacauaggagaauucauacaggagagaaaccucacgugugaugauuguggcaaagccuuuacuucacguucacaccuccuuagacaucagagaaugcacacuggacggaaaucuuacaaaugucaucaguguggcaagguuuucagucugacuucacuccuugcagaauaucagaaaauucauuuugagauaauuguuccaaaugcaaugaguagagcaaaccaucaagcaguaauugacauuaaaguguuuauguuaagaggauugggccagguacagugucucacaccuguaaucccagcacuuugggaggccaaggcggguagaucacuugaggucaggaguuucagaucagucuggccaacaaacaugagccacuuuucccaguuugcuuuuuguucuuuaacaaaaacugauagggauuuuuauggguaccguguugaaucuaaaucacauuggguuauauaaucauuuaacaauauuaauuuuuccaauccaucaauauggguuauaugucuguauauguuuuuaaucauauugauguauauuuguagauuucaagguacaaacuucucaccuuuuuacuuuuauuucuauuucuuuaaguucucuagcaaauggaaguguuuuuaaauuuucuuuuaaaauuguuuauuguuacaaacuucucaucuuuuugcuuuuauuccuaaguauuucuuacuuuaaguucucuagcaaauggaaguguuuuuaaauuuucuuuuaaaauuguuuauuguuaauguauggaaauucagcuaauuuuuggugcugauauuguacugugcagauacacugaaucuguuuauuacuuccaguaguauuuugguugagucuuugugauuuucuacacagaagaucaugucaucuacaaacacauauaauuuuacuucuuucuuucugauuuggauggguuugauuucuuuugcuauuucauugcucuggcuaggacagccaguauuuauugaauagaaggggugagagcauucuuccaucaugugagauccuacaggaaaaucauuccauguucccugcuucguuaucuacucguuggucauuucauggauggccuuucuauuguugagguaaauuuccuuuucugucuauuuuguucagaauuucuaugaugaguggauuuugaauuuugugaaauacuuuuucuccaucuauugagaugaugugguuuucaucuuucauucuguucaaguggcauaucacauugauuugcuugacuauguugaaccauccuugcaucccagaaauaaguggcacuugaguaucuacaguccuuuuuacauccucuugaauacagcuuuuuaguacaaggggucuucaagaaguucauggaaaaauacauauuuugcauauuaugagaaaauuguguaugaauuucccaguuuuugcaccaaaauaaacugguacgaaucuguuaugucugaacagguccuaguuugaggcacccagaaggauaagacaugaguuuuaaaagagacuuucucugccgggcgcaguggcucaugccuguaaucccaacacuuugggaggccaagguggguggaucaccugagauccagaguucgagaccagccucaccaacauggagaaacagcaucucuacuaaaaauacaaaauuagccaggcaugguggcaaaugccuguaaucccagauacucuggaggcugaggcaggagaauggcuugaacccgggaggcagagauugcugugagccgagauugcaccauugcacuccagccuggucaacaagagcgaaacucugucucaaaaaaaaaaaaaagaaaagaaaagaaaagagacucuaucaaagcaauauaaauccugcuaaaauugaaacaaaaaggagcaucaaauuuacagugagaccagaugcaguggcucaggccuguaaucccagcacuuucagaggccaagacaggugggucauguaagcccagguauucaagacaagccugggcaacauggugaaacccccuugucuacaaaaaauacaaaaauuagcugggcacgguagcacaugcaugcagggccagcugcuguggagucugugguaggaggauagcucgagccugggagguugaggcugcagugagcuaugaucaugccacugcauuccagcaugggugauggagcgagauacuggcucaaaaaaaaaaauacuucuuguaaaguuuggguagaggaauaaugaaaucauugaugcuuuaugaaaagauuauggagaugaugcccagaagaaauaaacaguuuguaaauggauaacuuaguuugaguugggacaagacaauguugaaggugaugcauggaguggcaggcacaccauccacaucaguuuuuuuguuuguuuuuguuguuguuguuuuuuugagauggugucucgcucugucucccaggcuggaaugcaguggugcaaucucggcucacugcaaccucugccucccggguucaagugauucuccugucucugccuccuuaguagcugggacuacaggcgcgugccaccacaucagcuaauuuuuguauuuuuaguaagacgggguuucaccauguuggcaaggcuggucuugaacuccugaccucacgaucugcccaccucagccucccaaaguguggagauuacaggcaugagccaccaugccccuugcacaucaguuuuacaaaaaaauuuaucuuguuugugccacaaugaagaggacugacagguaacagcagaaacaauagucaggaguuugagaacaggcugauuaacauggugaaaccccgucucuacuaaaaauacaaaaauuagcugggugugguggcgggugcuuguaaucccaguuacucaggaggcugaggcugcauuaucgcuuuaaccuggggggcggagguugcagugagccaagaugggggcaauaagagcaaaacuuugucucaaaaaaaaauaaauaaauaaaaaauaaaauaugucaagccccuucucuuccugucuccucucgugguguguacuugacuccccuucucgccagaucucacaggacuuucagauuuaagcaauaccuggccaagaaacaaaagcaaaaucauuccauucccccaguggauucagaucaaaacugguaauaaaaucagguacgacuccaaaaggagacauuggagaagaacgaagcggggucuauaaggaauugcacgugagauggcacacauauuuaugcugugugagcauuacaaucgcguuaccauaucaagcugaaaaugucaccacuaucuggaguguuggaaauguuuuauugggaauauguuuuuucucugaaucugcuaugaacacgucaguuggguggguucaguaauaaauaugugagacuuuucauuucaaaauaaaaaaggcaaaugauguaaaguugucaggggaguguccauuggcagcaccugccuccuga

SEQ ID NO: 982 - RNA, 87 nt, Homo Sapiens
ucucaggcugugacccucuaaagggaagcgcuuucuguggucagaaagaaaagcaagugcuuccuuuuagaggguuaccguuuggga

SEQ ID NO: 983 - RNA, 61 nt, Homo Sapiens
cccucuacagggaagcgcuuucuguugucugaaagaaaagaaagugcuuccuuuuagaggg

SEQ ID NO: 984 - RNA, 101 nt, Homo Sapiens
gcgagaagaucucaugcugugacucucuggagggaagcacuuucuguugucugaaagaaaacaaagcgcuucucuuuagaguguuacgguuugagaaaagc

SEQ ID NO: 985 - RNA, 2491 nt, Homo Sapiens
agcuggggcgcggccgccugucugcacagacagcaccaugucgcucauggucgucagcaugguguguguuggguucuucuugcugcagggggccuggccacaugagggaguccacagaaaaccuucccuccuggcccacccagguccccuggugaaaucagaagagacagucauccugcaauguuggucagaugucagguuucagcacuuccuucugcacagagaagggaaguuuaaggacacuuugcaccucauuggagagcaccaugauggggucuccaaggccaacuucuccaucggucccaugaugcaagaccuugcagggaccuacagaugcuacgguucuguuacucacucccccuaucaguugucagcucccagugacccucuggacaucgucaucacaggucuauaugagaaaccuucucucucagcccagccgggccccacgguucuggcaggagagagcgugaccuuguccugcagcucccggagcuccuaugacauguaccaucuauccagggagggggaggcccaugaacguagguucucugcagggcccaaggucaacggaacauuccaggccgacuuuccucugggcccugccacccacggaggaaccuacagaugcuucggcucuuuccgugacucuccauacgaguggucaaacucgagugacccacugcuuguuucugucacaggaaacccuucaaauaguuggccuucacccacugaaccaagcuccgaaaccgguaaccccagacaccugcauguucugauugggaccucaguggucaucauccucuucauccuccuccucuucuuucuccuucaucgcuggugcugcaacaaaaaaaaugcuguuguaauggaccaagagccugcagggaacagaacagugaacagggaggacucugaugaacaagacccucaggaggugacauaugcacaguugaaucacugcguuuucacacagagaaaaaucacucgcccuucucagaggcccaagacacccccaacagauaucaucguguacacggaacuuccaaaugcugagcccugauccaaaguugucuccugcccaugagcaccacagucaggccuugaggggaucuucuagggagacaacagcccugucucaaaacuggguugccagcuccaauguaccagcagcuggaaucugaaggcgugagucugcaucuuagggcaucgcucuuccucacaccacaaaucugaacgugccucucccuugcuuacaaaugucuaagguccccacugccugcuggagagaaaacacacuccuuugcuuagcccacaauucuccauuucacuugaccccugcccaccucuccaaccuaacuggcuuacuuccuagucuacuugaggcugcaaucacacugaggaacucacaauuccaaacauacaagaggcucccucuuaacacggcacuuagacacgugcuguuccaccuucccucaugcuguuccaccuccccucagacuagcuuucagccuucugucagcaguaaaacuuauauauuuuuuaaaauaauuucaauguaguuuucccuccuucaaauaaacaugucugcccucagaaacccuucaaauaguuggccuucacccacugaaccaagcuccaaaaccgguaacccaagacaccugcacguucugauugggaccucaguggucaucauccucuucauccuccuccucuucuuucuccuucaucgcuggugcuccaacaagaaaaaugcugcuguaauggaccaagagccugcagggaacagaacagcgaauagcgaggacucugaugaacaagacccucaggaggugacauacguacaguuggaucacugcguuuucacacagagaaaaaucacucgcccuucucagaggcccaagacacccccaacagauaccagaguguacacggaacuuccaaaugcugaguccagauccaaaguugucuccugcccaugagcaccacagucaggccuugaggggaucuucuagggagacaacagcccugucucaaaaccggguugccagcucccauguaccagcagcuggaaucugaaggcgugagucugcaucuuagggcaucgcucuuccucacaccacaaaucugaaugugccucucucuugcuuacaaaugucuaagguccccacugccugcuggagagaaaacacacuccuuugcuuagcccacaauucuccauuucacuugaccccugcccaccucuccaaccuuacuggcuuacuuccuagucuacuugaggcugcaaucacacugaggaacucacaguuccaaacauacaagaggcucccucuuaacacggcacuuagacacguccuguuccaccuucccucaugcuguuccaccuccccucagaguaucuuucagccuucugucagcaguaaaacuuauauauuuuuuaaaauaauuucaauguaguuuucccuccuucaaauaaacaugucugcccuca

SEQ ID NO: 986 - RNA, 1035 nt, Homo Sapiens
augaaaucagaaucugauuggauuaaaaaggagggaaaggguguggcuaagguggguggagacacccucugguauaaaagccccuggcaggcagcucucacuccagaucugagcuguccgcagaagcagcuggaggccaggggagaaacuccagaaggagagacauuugccauggcugagcacuucaaacagaucauuagauguccugucugucuaaaagaucuugaagaagccgugcaacugaaauguggauaugccugcugccuccagugccucaauucacuccagaaggagcccgauggggaagguuuacugugccguuucugcucuguggucucucagaaggaugacaucaagcccaaguacaagcugagggcgcugguuuccaucaucaaggaacuagagcccaagcugaaaucuguucuaacaaugaacccaaggaugaggaaguuucaaguggauaugacguucgauguggacacagccaacaacuaucucaucauuucugaagaccugaggaguuuccgaaguggggauuugagccagaauaggaaggagcaagcugagagguucgacacugcccugugcguccugggcaccccucgcuucacuuccggccgccauuacugggagguggacgugggcaccagccaagugugggaugugggcgugugcaaggaaucugugaaccgacaggggaagauugugcuuucuucagaacacggcuucuugacuguggguugcagagaaggaaaggucuuugcugccagcacugugccuaugacuccucucugggugaguccccaguugcacagaguggggauuuuccuggauguagguaugagguccauugccuuuuacaauguuagugaugggugccauaucuacacauucaucgagauuccuguuugcgagcccuggcguccauuuuuugcucauaaacguggaagucaagaugaucagagcauccugaguaucuguucugugaucaauccauccgcugccagugccccaguuucuucugagggaaaguaa

SEQ ID NO: 987 - RNA, 1301 nt, Homo Sapiens
ggaaguaccucucugagcgguuggugccggguauaaaagaaggccgcgcagccacggcugcucacgacgccgcggaucccgaagccuguguagcagugagacaucagugaggcugcaggacgagcaggauuggaagcgccccggccagaaagugaccccccaccccuuucaggacccugugaacgggaacagccauccagaggguucaggaaggcguccgcgcccucaccucuucuccccaugagcucccccagagcuguggugcagcugggcaaagcucaaccugcaggcgaagaguuggcuacagcaaaccaaacagcccagcagcccagcagcccagccaugcggcgccucacagucgaugacuuugaaaucgggcguccccugggcaaggggaaauuugggaauguguaccuggcucggcucaaggaaagccauuucauuguggcccugaagguucucuucaagucgcagauagagaaggaaggacuggagcaccagcugcgccgggaaauugagauccaggcucaucuacaacaccccaauauccugcgccuguauaacuauuuccaugaugcacgccggguguaccugauucuggaauaugcuccaaggggugagcucuacaaggagcugcagaaaagcgagaaauuagaugaacagcgcacagccacgauaauagaggaguuggcagaugcccugaccuacugccaugacaagaaagugauucacagagauauuaagccagagaaccugcugcugggguucaggggugaggugaagauugcagauuuuggcuggucugugcacacccccucccugaggaggaagacaaugugugggacacuggacuacuugccgccagaaaugauugaggggagaacauaugaugaaaagguggauuuguggugcauuggagugcucugcuaugagcugcuggugggauauccacccuuugagagcgccucccacagugagacuuacagacgcauccucaagguagaugugagguuuccacuaucaaugccucugggggcccgggacuugauuuccaggcuucucagauaccagcccuuggagagacugccccuggcccagauccugaagcaccccuggguucaggcccacucccgaagggugcugccucccugugcucagauggcuuccugagcccugucugccucuguucccuuuguguguguucagggagcucuccuggcucugccaccucauuugucuuuauuuuuuucucuuuuaagauguaagaugcuaauuaauaaaagcugaaucauuucauacca

SEQ ID NO: 988 - RNA, 7681 nt, Homo Sapiens
cucuuguagcggccacguugaucugcgauacgcguguuugcccagugaguggccccggacugcuacgugggacugcggugaaugaacccagaagguggagaggaaccguucucggugcacagaggcggcucugcagcccggugagggcgccugcugcucccgggcagugcuuuccccaaguaguccgauggcugcggcugcgccgaggcgcccuacucaggagcaacuuggcgagguucagacucuuggagccagaagcuacaugaccccuaaacguuuccacgugugcacguaacguaaggccgagacuuccggggucucuaguagcggcuguguaucggcgaugcggguguuuccccaguuuguggccccugagugcugggugggaccgcggugacugaaccuagaagguggagaggaaucguccucggugcccagaggcggcucugcagccccgugacggcgaccacugcucccgggccgugcuuccccaaguaguccgauggcagcggcugugccgaggcgcccaacucagauggaguuucgcucuuguugcccaagcuggagugcaauggugccaucucggcucacugcaaccuccaccuccuggguucaagcaauucuccugccucagccucccaaguagcuaguauuacaggcaccugccaccacagcaggcuaauuuuuguauuuucgguagagacaggguuucaccaugcugaccaggcuagucuugaacuccugaccgggugaucugccugccucggccucaaagugcuggaauugcaggcgugagccacugugccuggccaguuguaacuauuuaucacugucuggacucauaaacauuuugagaugacuuugggagggcaccaguggaugugguuucaacuccguguuggggaccuugggaggaggaugggcaagggugggugugugggagagguggguugugguaccucagcagaggggcugcuugugguuucaucugucacuaucauagcagggcacugugaccuuugaagauguggcugugaacuuuucccaggaggaguggugucuucuuagugaggcucagaggugcuuguaccgugaugugaugcuagagaaccuggcucucauauccucgcuggguuguugguguggaucaaaagaugaggaggcaccuuguaagcagagaauuucuguacaaagagagucucagagcaggacuccuagggcagguguuucuccuaagaaggcucaccccugugaaauguguggccucaucuuggaggauguuuuucacuuugcugaccaccaggaaacucaucacaagcagaagcugaacaggaguggagcauguggaaaaaacuuggaugacacugcauaccuucaucagcaccagaagcagcauauuggagagaaauucuacagaaagagugucagagaagcaucguuuguaaagaaacguaagcucagggugucacaggagccauuugucuuccgcgaguuugggaaggacguucugcccaguucaggauugugccaagaagaagcugcuguagagaagacagacagugaaacuaugcauggcccacccuuucaggagggaaaaacuaauuacaguuguggaaaacgcacaaaagccuucagcaccaaacacucaguuauuccacaccagaaacuuuucacuagagauggauguuaugugugcagugauuguggaaaauccuuuagcagauaugucagcuucaguaaucaucagcgagaucacacugcaaaaggaccuuaugauuguggagagugugggaaaucuuauagucgaaagagcagccuuauucaacaucagcgaguccacacuggacagacagcuuaucccugugaggagugcgggaaaucuuuuagucagaagggcagccuuauuagccaucagcuuguucacacuggagaagggccuuaugaguguagagaaugugggaaaucuuuuggucaaaaggguaaccucauucaacaucagcaaggucacacuggagagagagcuuaucacuguggggaaugugggaaaucuuuucgucagaaguucugcuuuauuaaccaucagcguguucacacuggagaaaggccuuacaaguguggagaaugugggaaaucuuuuggucaaaagggcaaccucguucaccaucagcgaggucauacuggagaaaggcccuaugagugcaaggaaugugggaaaucauuuagguacagaucccaccucacugaacaccagagacuucacacuggggaaagaccuuacaauuguagggaaugugggaaauuauuuaacaggaaguaucaucuucugguucaugagagaguucacacuggagaaaggccauaugcgugugagguaugugggaaauuauuuggcaauaagcacagcgugacuauacaucagaggauucacacuggagaaaggccguaugaaugcagugaaugugggaaaucauuucuuuccagcucugcgcuucauguucauaaaagaguucauucuggacaaaagccuuauaagugcagugaauguggaaaauccuuuucugaauguuccagucucauuaaacacaggagaauucacacuggagaaaggccuuaugaaugcaccaaauguggaaaaacauuucagcgaagcucuacccuccuucaucaucagaguucacacaggagaaaggccuuaugagugcagugaauaugggaaaucguuugcugaagcaucccgucucguuaaacacaggagaguucauacuggagaaaggccuuaugagugcugucaauguggaaaacaucagaaugucugcuguccucggucuuaagcgacuucguguugagauggagucuuguucugucacccaggcuggagugcaguggugcagucuuggcucgcugcaacuugggccuccuggguucaugcaauccuccuaccucagccuccugaguagcugggauuaugaguacacaccaccacgcccagcuaauuuuuguguuuuuaguggagaugggguuuuaccauguuggccaggcuggucucaaacuccugaccucaagugauccacccaccuugacucccaaagugcugaaauuacaggcaugagccucugcaccuggccuucauucuuuucguauugcuuagaauaugacaugcugaaccaggcaugguggcucaugcuuguaaaccugaugcuuugggaggacaaggugguucauuggaggccaggaguuagagaucagccugggcaacauagccagaccuccucucuacaaaaagaaaaaagaaugacaugcuucuuguuuuugucuguuauaaaugaaacugcuauauuugaaugcaguuguucauguagguauguuucacuaugguaauaugguggugugcagugccugagucacgugauagauuaaaguacaacucuuuuuugagacagagucucacucugucacccaggcgggaguuagguggcaugauuucggcucacugcaaccucugccucccaaguucaacugauucuucugccucagccucccgaguagcagggauuaccggugugcaccaccaugccuggauaacuuuuuuuuuuauuucuauuagcaaugggguuucaccaugcuggccaggcuuguuaugaacugaccucaagugaucugccugccucagcuucucaggugugaccuacugugcuuggccuaauguacaacuuuuuaagcaaugccaaacuaugacuuaagaaugaaauuauugcucauuuguauaucuaucuaccaucaguguccaagaauuucuguucuaucuuaccaagagggaguaugguuaguauuugaaauuguuuauuauuuuaauaagugguuauaacuuuugagucagugguuuauguuuugcauuuuuuuuguuuugagacaaagucucgcucugucucccaggcuagaguaccguggcacaaucucagcucauugcaaccucugcuuccugggcucaagcacucugcccaccucagccuccagaguagcuggaaauacagguaugcaccaccacaacuggauaacuuuuguauuuucuguagagaggguuuuaccuuuuugcccagucugaucgcgaacuccugggcucaggcgauccacuugccuaggcuccaaaagugcuuggucuacaggggugaggcacccugccuggccucaccuguaggcuuguuuuuuaaaaugaauuuuaucuauuucccauuucauuaauauauuuaaaaauaaugaaauaacaaagacguauguuggacuucauucauucuucagugaugucacuuugcugcaaggaauauuugguuuucuuuuuuuuuuuuuuuuccagauggagucuagcucugucuccuaagcuacagugaaguggcaugaucucggcccacugcaaccuccaccuccuguguucaagcgauucugccucagccuccugaguagcugggacuacaggcaugugccauuauaccuggcuaauuuuauuuauuuauuuuaguagagaugggguuucaccauguuacccaggcugcucucuaccuucugagcucaagugauccaccugccucggccucccaaagugcugggauuacaggugucagccacuguaccuggcugaauacuugguuuucaguaccacaagaacuaugagcugguuauccacuucauguggaaucauaagcgucccaaagugacaauacauauagauugccaggcagugaaacaguuaagaugccaccauagcuuucuuuucaacaucuuucuaagauuaccuuacuauuucuuuuguuccaaguuuguacuuccucacaguucucacauauggaaaggauacacacuuuguagaaacaagaacuuuauguuauccaaguucuaggauagccaugagcuccaauuaucucagagcucugaguccucuacucaauacccauugagauuuauguguucugaggcuuuugucuucuagcuacuuacuucauucuccauggguaacgucauucauccacauuaacuaauuuccucacuccaagcucuuuucuagagauaaucuccagucccugugcagaaacugucauugcacuuucugcugaaauggcaguuucuucucagcaaggugagauuauggaauccagaaucuuuuuucaggggucacaugcccauuuccccacuugcaugaaugucgacacugcagccacaguuuuggccguaaaugugaauuuggcaaguaaccacuguucccagggaaaugucccaaucagaagaagauuaucugggacacugauacugacagggagaugggacauucugagggacccggaggcagggugccaccuccucaacuucccugagggcugccuagaaucuguuuccucucacucugaauuauucuuccucuuauggcugaccaaaaacauggaaccucacaaaguccacuguaacagcuuuauauuugugaagugaagaacaugaagacaguuucaagcaaaguuauugaguggacacuuuguguuuuuuuugagaagucucacucuuucacccaggcuggagugcaguggcacgaucucggcucacugcaacuccaccucccggguucacgccauucucuugccucagccuccugaguagcugggaccacaagcgcccaccacgucagcuuaauuuuuuuguuuuguuucuugagacagagucuugcucucuugcccagguuggagugccgugucgcaaucucagcucacugcaacuucuaccuccuggauucaagcacuucuccuugccucagccaccucuuuagcugggauuacaggugcgugccaccacacccagcuaauuuuuguauuuuuagcagagaccagguuucaccauguuggucaggcuggucucaaacuccugaccucgugauccacccaccucggccucccaaagugcuggaauuacaggcgugagccacugcaccuggccuguauucuuuucuuuaguagagacgggguuuuacuguauuugccaggauggucucgaucuccagaccucgugauccgcccgccuuagccucccaaagugcugggauuauaggcgugagccaacacgcccuggccacuucuugucuuugcaacauuuuuuagauauguauuuguguuuuuuggggagcuuaauuugcuaauggaaucucuguuauuuuccuaacaugcuugguggauacaagaguuaagacuuccugucccguuuaguguaacaaaagaaaguuaagaaauguggauaaaagauuguaaguuagaaauggcaagauaaucagcuauaugaagaaucuuggccaggugugguggcugaggccuguaaucccaccacuuugggaggcugaggugggcggaucacaaggucaggaguucaagaccacccuggccaauauugugaauuccugucucuacuaaaaauacaaaaauuagucgggcaugguggcgggugccuguagucccagcuacucgggaggcugaggccagaaaaucgguugaaccugggagguggaaggugcacugagccaauaucacaccagugcacuccaaccuggugacagagagacacaucaucucaaaaaaaaaaaaaaaacucaauccauaaauguuauacuuuauaacuuuauaacagcauguuauaugggcuuagauauuaucccuaaauuuuuuuuuuuuuuuuuuuuuuugagacagagucucacucugucacccaggcugaagugcaauggcauggucucggcucacugcaaccuccgccucccagguucaagugauucucuugccucagccucccgaguagcugggccuauagguucccuccaccacgcccagcuaauuuuuguauuuuuaguagagaugggcuuucacuacguuagccaggcuggucucaaacuccugaccucaugauccaccccccucggccuccuaaagugcugggauuacaggcaucugccaccgcacucggcuuaucccuagaaauccuaugauagcaugauguauaggcaccuaaaggcauggcacuugagaaaugugaauaagauuguaaguuacaaauagcaagguacagucagauguuaacagucucagccccuaaaugucaccuuguauuacagcauguuauauaagcacauacaggcacauacaugaaauagugauacuucauucucaguaauaucuucauccuucucacuggaaagaucuuugaugauuuuuaaucaacauaggaguuucaaugauaucuagaaguuuaaaagggcucguucaaacaaauuaugaccacacacacugaagaguauguuugucucuugugguguaaauuuuuuuuuauuacaccaaauuauguucacacaaaaccuuuguaaucagggggaauuaaagagccuuccuggaaaauggagguugcaaucagccgagauggugccaucgcacucuagccuggggaauagagugagauccugccucaaaaaaaacaaaaaaauucuuuauuuucuccauaaacuacaguuuauauaagcaaaaguuucaguacuaagcaauuuuagucucugcagucucuugucuugaauuaauacaacuuuuguuaauucucuuaugaaguuaaucuuccugcuuguaugugaauuaaauauaugucaaacuuuuuuuguacaaaagauuca

SEQ ID NO: 989 - RNA, 472 nt, Homo Sapiens
ccgugaggugcccagaagaucaugcagucaucagucccacggagcagccugcgaggcugaggcuccucccacuggaccgccccccaacuggcaccacugcugccccugccccuacucucagccucacgugacucucgggcagaagcagugguggggcagccagggcagcgucaagagucugagccagcugcaggacaaguucgagcaucuuaaaaugauucaacaggaggagauaaggaagcucgaggaagagaaaaaacaacuggaaggagaaaucauagauuuuuauaaaaugaaagcugccucugaagcacugcagacucagcugagcaccgauacaaagaaagacaaacauccugauccauaugaauuccucuuauuaagaaaaauaaaacauccaggauucaaugaagaacugacuaucaccuuguuaaucauucagaaacauguugcaggcuuaagccauuuuuga

SEQ ID NO: 990 - RNA, 2287 nt, Homo Sapiens
cgcagggaccgugcuccgccgucuccgccgcaucuuccacccucgccgccgccgcagcuccccgcgcucgugccaccgccgccgcguccacccucagcgccaccgccaugcgggagaucgugcaccugcaggccggccagugcggcaaccagaucggggccaaguuuugggagguuaucagugacgaacauggcaucgaccccacaggcacauaccauggggacagugaccugcaacuggagaggaucaacguguacuacaacgaggccacaggaggaaauuauguccccagagcggugcugguggaccuggaacccggcaccauggacucuguccguucuggccccuucggucagaucuuucggccggacaacuucguguuuggccaauccggagccggcaacaacugggcaaaggggcacuacacggagggcgcagagcugguggacgcuguccuggacguaguccggaaggaggccgagagcugcgacugccuucagggcuuccagcugacccacucgcugggggguggcacgggguccggaaugggcacgcugcucaucaguaagauccgcgaggaguucccagaccgcaucaugaacaccuucagcguggugcccucgcccaaagugucagacacggugguggagcccuacaacgccacgcugucugugcaccagcugguggagaauacggaugagaccuacugcaucgacaacgaggcacucuacgacaucuguuuccgcacccucaagcugaccacccccaccuacggggaccucaaccaccuggugucggccaccaugagcggggucaccaccugccugcgcuucccgggccagcugaacgccgaccugcgcaagcuggccgucaacaugguucccuuuccucgccugcacuucuucaugcccggcuucgcaccccugaccagccggggcagccagcaguaccgggcccugacggugcccgagcucacccagcagauguucgaugccaagaacaugauggcggcgugcgacccgcgccacggccgcuaccugaccguggccgccguguuccggggccgcauguccaugaaggagguggacgagcagaugcugagcgugcagagcaagaacagcagcuacuucguggaguggauccccaacaacgugaagacggccgugugcgacaucccgccccgcggccugaagauggccgcgaccuucaucggcaacagcacggccauccaggagcuguucaagcgcaucuccgagcaguucacggccauguuccggcgcaaggccuucuugcacugguacacgggcgagggcauggacgagauggaguucaccgaggccgagagcaacaugaaugaccugguaucugaguaccagcaguaccaggacgccacggccgaggagggcgaguucgaggaggaggcggaggaggagguggccuaggcugcucccaucgcuucccaccuguccccucgaggcuucugaccuuugauccgcuaggccccccaucucugaacccuagagccccgcuuucccuccaaggcugacuccccgcugacccuaacaauaccuuuggagcucgcuuuaccucuggcuacuucaucuccgacccuggcuccccuuugagcccuaauuuaucuuuaacccccuugagcucuuccaaccuugacauucccaggaggagccccgcuucaccccuucugacucuggaaaccgcaccuuuaacuuugcagaccuuccuucaccccugacuucugcuucaccuuugaccucugccccccaugaaucccauuuuaccucuagaccuauaaguucugguuuauguuugaccccucccucugagcugcacuucaccgcugaccuugccucaccuuuaaccccccaccugagccccagcuccuaccucugaccccaacuucucuuugaucucugaauccccucugacuccaacuucucuuucacccucuaugagucccauuuuacuucuacaccugcaaguccugguuuauauuggaccccucccuccgagcugcaguucaccuuugaccuugccucaccuuucaccccccaccccccacagcgucagcuccuaccucugaccccagcuucucucugauucccacaggccccaugcauccucccugccucacuccccucagccccugccgaccuuagcuuaucugggagagaaacaaggccuggugccugugaggaagagaggucaccccuacccucccuccccgcuucccugccucacccucaauaaauaaauuaauuguugucaugga

SEQ ID NO: 991 - RNA, 1722 nt, Homo Sapiens
aguggcucuacuuucagaagaaagugucucucuuccugcuuaaaccucugucucugacggucccugccaaucgcucuggucgaccccaacacacuaggaggacagacacaggcuccaaacuccacuaagugaccagagcugugauugugcccgcugaguggacugcguugucagggagugagugcuccaucaucgggagaauccaagcaggaccgccauggaggaaggucaauauucagaacggcuucagcuagggagcggggagcccaauagagucagaggccaaauagaacaggaacuuggaacaagcagaauuuagcauaaugaauccuccaagccaggagaucgaggagcuucccaggaggcgguguugcaggcgugggacucagaucgugcugcuggggcuggugaccgccgcucugugggcugggcugcugacucugcuucuccuguggcacugggacaccacacagagucuaaaacagcuggaagagagggcugcccggaacgucucucaaguuuccaagaacuuggaaagccaccacggugaccagauggcgcagaaaucccaguccacgcagauuucacaggaacuggaggaacuucgagcugaacagcagagauugaaaucucaggacuuggagcuguccuggaaccugaacgggcuucaagcagaucugagcagcuucaagucccaggaauugaacgagaggaacgaagcuucagauuugcuggaaagacuccgggaggaggugacaaagcuaaggauggaguugcagguguccagcggcuuugugugcaacacgugcccugaaaaguggaucaauuuccaacggaagugcuacuacuucggcaagggcaccaagcaguggguccacgcccgguaugccugugacgacauggaagggcagcuggucagcauccacagcccggaggagcaggacuuccugaccaagcaugccagccacaccggcuccuggauuggccuucggaacuuggaccugaagggggaguuuaucuggguggaugggagccacguggacuacagcaacugggcuccaggggagcccaccagccggagccagggcgaggacugcgugaugaugcggggcuccggucgcuggaacgacgccuucugcgaccguaagcugggcgccugggugugcgaccggcuggccacaugcacgccgccagccagcgaagguuccgcggaguccaugggaccugauucaagaccagacccugacggccgccugcccacccccucugccccucuccacucuugagcauggauacagccaggcccagagcaagacccugaagacccccaaccacggccuaaaagccucuuuguggcugaaaggucccugugacauuuucugccacccaaacggaggcagcugacacaucucccgcuccucuauggccccugccuucccaggaguacaccccaacagcacccucuccagaugggagugcccccaacagcacccucuccagaugagaguacaccccaacagcacccucuccagaugagaguacaccccaacagcacccucuccagaugagaguacaccccaacagcacccucuccagaugcagccccaucuccucagcaccccaggaccugaguauccccagcucagguggugaguccuccuguccagccugcaucaauaaaauggggcagugauggccucccacauuuguccccuucuugga

SEQ ID NO: 992 - RNA, 1614 nt, Homo Sapiens
ggggguggccgagggggaagagugugugucugcgggagaaagaggagaaucgcccaagcggccucggaagccccagggaguggaggcucccgccguggagccaugugguguaugugugguaacaccacgucuacgccccucucacugaugcugccgcggugucuggagcugagcgggaaacagccgcgguuaguuuuuuauauggacuuggagacacagggcacagcugggcugacgcccucuccaccguccggcucccucacgucaauuccaucuguccccaugugccuaggaucccugugacucucaacaugaagauggugacaccuuccugauuugaccugauggggcugaguccagaugccccagaggacgaggcuggcaucaagaaggcagcagagaacaucaaggccuugauugagcaugaaaugaagaacgggaucccugccaaucgaaucguccugggaggcuuuucacagggcggggcccugucccucuacacggcccucaccugcccccacccgcuggcugguaucguagcaucgagcugcuggcugccucugcaccgggccuucccccaggcagcuaaaggcaguggcaagggccugaccauccuccagugccauggggagcuggaccccauggugcccguacgguuugggacccugacggcuguugucacaccugccaggguccaguucaagacauacucgggugucaugcacagcugcuguccucaggagauggcagcugugaaggaauuucuuggagaaguugcugccuucugucuaacuagucgcuggccccagugcggugccccagcucaugggggacucagcaagcaagcguggcaccaucuuggaucugagccagucgagccccuguccccacccuuccuggccuguccuuuucccacaggccucuggggcagguggcaaggccuggccgggcuuuccuuccuggccucagccaccuggcucugucugcagcaggggcaggcugcuuucuuaucccauuucccuggaggcaggccucccuggcagcaguauuggaggggcuacaggaagcuagagaaaggggcccagcugcugacccacucacucaggaccucacucacuagccccgcuuuggggccccuccugugaccucaggguuuggcccauggggcccuuccaggccccugcucuaacugauucugcccagauaaucgugugucuccugccuccacucagcuacuucucagucaugaagguggccauggcccugagguccccuugcugcugugggcucccugucccugggcaggagugcuggugaggagguggagccuuuugaggggggccuucccucagcuguuuccccaaacuggggggcugggcccugccuccccauuacccuccuucccugcaggccuggagccuguagggcuggacugagguucaggucucccccaagcugucucacucugacuuuguccccacucuagagcagggaaggggugggggaggaguugugucucaucuucugucuccaugugguuuuugggugcuuuucuuguuguguccuggauucugauaaaauuaaagaaauugcuuccucaaaaaaaaaaaaaaa

SEQ ID NO: 993 - RNA, 71 nt, Homo Sapiens
gccaacccaguguucagacuaccuguucaggaggcucucaauguguacaguagucugcacauugguuaggc

SEQ ID NO: 994 - RNA, 70 nt, Homo Sapiens
ugggaagugaugacaccugugacuguugauguggaacugauuuaucgcguauucguacuggcugauccug

SEQ ID NO: 995 - RNA, 930 nt, Homo Sapiens
augaaaucauggaacaauacaauaauuuuagaauuucuucuccugggaauuucagaggaaccagaauugcaggccuuccucuuugggcuguuccuguccauguaccuggucacugugcucgggaaccugcucaucauccuggccacaaucucagacucccaccuccacacccccauguacuucuuccucuccaaccuguccuucguagacaucuguuuugucucuaccacugucccgaagaugcuggugaacauccagacacacaacaaagucaucaccuaugcaggcugcaucacccagaugugcuuuuucuuacucuuuguaggauuggauaacuuccuucugaccgugauggccuaugaccgguuuguggccaucugucacccucugcacuacauggucauuaugaacccucaacucuguggacugcugguucuggcauccuggaucaugaguguucugaauuccauguuacaaagcuuaaugguguugccacugcccuuuuguacacacauggaaaucccucauuuuuucugugaaauuaaucaggugguccaccuugccuguucugacaccuuucuuaaugacauagugauguauuuugcaguagcgcugcugggcggugguccccucacugggauccuguacucuuacucuaagauaguuuccuccauacgugcaaucucaucagcucaggggaaguauaaggcauuuuccaccugugcaucucaccucucaguugucuccuuauuuuaugguacaugcuuagggguguaccuuaguucugcugccacccacaauucacacacaggugcugcagccucagugauguacacuguggucacccccaugcugaaccccuucaucuacagucugaggaauaaacacauaaagggugcuaugaaaacauucuucagaggaaagcaauag

SEQ ID NO: 996 - RNA, 8071 nt, Homo Sapiens
gcggcgcggaggcuggcccgggacgcgcccggagcccagggaaggagggaggaggggagggucgcggccggccgccauggggccgggggcccguggccgccgccgccgccgucgcccgaugucgccgccaccgccaccgccacccgugcgggcgcugccccugcugcugcugcuagcggggccgggggcugcagcccccccuugccuggacggaagcccgugugcaaauggaggucguugcacccagcugcccucccgggaggcugccugccugugcccgccuggcugggugggugagcggugucagcuggaggaccccugucacucaggccccugugcuggccguggugucugccagaguucagugguggcuggcaccgcccgauucucaugccggugcccccguggcuuccgaggcccugacugcucccugccagaucccugccucagcagcccuugugcccacggugcccgcugcucaguggggcccgauggacgcuuccucugcuccugcccaccuggcuaccagggccgcagcugccgaagcgacguggaugagugccgggugggugagcccugccgccaugguggcaccugccucaacacaccuggcuccuuccgcugccaguguccagcuggcuacacagggccacuaugugagaaccccgcggugcccugugcacccucaccaugccguaacgggggcaccugcaggcagaguggcgaccucacuuacgacugugccugucuuccuggguuugagggucagaauugugaagugaacguggacgacuguccaggacaccgaugucucaauggggggacaugcguggauggcgucaacaccuauaacugccagugcccuccugaguggacaggccaguucugcacggaggacguggaugagugucagcugcagcccaacgccugccacaauggggguaccugcuucaacacgcuggguggccacagcugcgugugugucaauggcuggacaggcgagagcugcagucagaauaucgaugacugugccacagccgugugcuuccauggggccaccugccaugaccgcguggcuucuuucuacugugccugccccaugggcaagacuggccuccugugucaccuggaugacgccugugucagcaaccccugccacgaggaugcuaucugugacacaaauccggugaacggccgggccauuugcaccuguccucccggcuucacggguggggcaugugaccaggauguggacgagugcucuaucggcgccaaccccugcgagcacuugggcaggugcgugaacacgcagggcuccuuccugugccagugcggucguggcuacacuggaccucgcugugagaccgaugucaacgagugucugucggggcccugccgaaaccaggccacgugccucgaccgcauaggccaguucaccuguaucuguauggcaggcuucacaggaaccuauugcgagguggacauugacgagugucagaguagccccugugucaacgguggggucugcaaggaccgagucaauggcuucagcugcaccugccccucgggcuucagcggcuccacgugucagcuggacguggacgaaugcgccagcacgcccugcaggaauggcgccaaaugcguggaccagcccgauggcuacgagugccgcugugccgagggcuuugagggcacgcugugugaucgcaacguggacgacugcuccccugacccaugccaccauggucgcugcguggauggcaucgccagcuucucaugugccugugcuccuggcuacacgggcacacgcugcgagagccagguggacgaaugccgcagccagcccugccgccauggcggcaaaugccuagaccugguggacaaguaccucugccgcugcccuucugggaccacaggugugaacugcgaagugaacauugacgacugugccagcaaccccugcaccuuuggagucugccgugauggcaucaaccgcuacgacugugucugccaaccuggcuucacagggccccuuuguaacguggagaucaaugagugugcuuccagcccaugcggcgagggagguuccuguguggauggggaaaauggcuuccgcugccucugcccgccuggcuccuugcccccacucugccuccccccgagccaucccugugcccaugagcccugcagucacggcaucugcuaugaugcaccuggcggguuccgcugugugugugagccuggcuggaguggcccccgcugcagccagagccuggcccgagacgccugugagucccagccgugcagggccggugggacaugcagcagcgauggaauggguuuccacugcaccugcccgccugguguccagggacgucagugugaacuccucucccccugcaccccgaaccccugugagcaugggggccgcugcgagucugccccuggccagcugccugucugcuccugcccccagggcuggcaaggcccacgaugccagcaggauguggacgagugugcuggccccgcacccuguggcccucaugguaucugcaccaaccuggcagggaguuucagcugcaccugccauggaggguacacuggcccuuccugcgaucaggacaucaaugacugugaccccaacccaugccugaacgguggcucgugccaagacggcgugggcuccuuuuccugcuccugccucccugguuucgccggcccacgaugcgcccgcgauguggaugagugccugagcaaccccugcggcccgggcaccuguaccgaccacguggccuccuucaccugcaccugcccgccaggcuacggaggcuuccacugcgaacaggaccugcccgacugcagccccagcuccugcuucaauggcgggaccuguguggacggcgugaacucguucagcugccugugccgucccggcuacacaggagcccacugccaacaugaggcagaccccugccucucgcggcccugccuacacgggggcgucugcagcgccgcccacccuggcuuccgcugcaccugccucgagagcuucacgggcccgcagugccagacgcugguggauuggugcagccgccagccuugucaaaacgggggucgcugcguccagacuggggccuauugccuuugucccccuggauggagcggacgccucugugacauccgaagcuugcccugcagggaggccgcagcccagaucggggugcggcuggagcagcugugucaggcgggugggcaguguguggaugaagacagcucccacuacugcgugugcccagagggccguacugguagccacugugagcaggagguggaccccugcuuggcccagcccugccagcauggggggaccugccguggcuauauggggggcuacaugugugagugucuuccuggcuacaauggugauaacugugaggacgacguggacgagugugccucccagcccugccagcacggggguucaugcauugaccucguggcccgcuaucucugcuccugucccccaggaacgcugggggugcucugcgagauuaaugaggaugacugcggcccaggcccaccgcuggacucagggccccggugccuacacaauggcaccugcguggaccuggugggugguuuccgcugcaccugucccccaggauacacugguuugcgcugcgaggcagacaucaaugagugucgcucaggugccugccacgcggcacacacccgggacugccugcaggacccaggcggagguuuccguugccuuugucaugcuggcuucucagguccucgcugucagacuguccugucucccugcgagucccagccaugccagcauggaggccagugccguccuagcccggguccugggggugggcugaccuucaccugucacugugcccagccguucugggguccgcguugcgagcggguggcgcgcuccugccgggagcugcagugcccggugggcgucccaugccagcagacgccccgcgggccgcgcugcgccugccccccaggguugucgggacccuccugccgcagcuucccggggucgccgccgggggccagcaacgccagcugcgcggccgcccccugucuccacgggggcuccugccgccccgcgccgcucgcgcccuucuuccgcugcgcuugcgcgcagggcuggaccgggccgcgcugcgaggcgcccgccgcggcacccgaggucucggaggagccgcggugcccgcgcgccgccugccaggccaagcgcggggaccagcgcugcgaccgcgagugcaacagcccaggcugcggcugggacggcggcgacugcucgcugagcgugggcgaccccuggcggcaaugcgaggcgcugcagugcuggcgccucuucaacaacagccgcugcgaccccgccugcagcucgcccgccugccucuacgacaacuucgacugccacgccgguggccgcgagcgcacuugcaacccgguguacgagaaguacugcgccgaccacuuugccgacggccgcugcgaccagggcugcaacacggaggagugcggcugggaugggcuggauugugccagcgaggugccggcccugcuggcccgcggcgugcuggugcucacagugcugcugccgccagaggagcuacugcguuccagcgccgacuuucugcagcggcucagcgccauccugcgcaccucgcugcgcuuccgccuggacgcgcacggccaggccauggucuucccuuaccaccggccuaguccuggcuccgaaccccgggcccgucgggagcuggcccccgaggugaucggcucgguaguaaugcuggagauugacaaccggcucugccugcagucgccugagaaugaucacugcuuccccgaugcccagagcgccgcugacuaccugggagcguugucagcgguggagcgccuggacuucccguacccacugcgggacgugcggggggagccgcuggagccuccagaacccagcgucccgcugcugccacugcuaguggcgggcgcugucuugcugcuggucauucucguccugggugucaugguggcccggcgcaagcgcgagcacagcacccucugguucccugagggcuucucacugcacaaggacguggccucuggucacaagggccggcgggaacccgugggccaggacgcgcugggcaugaagaacauggccaagggugagagccugaugggggagguggccacagacuggauggacacagagugcccagaggccaagcggcuaaagguagaggagccaggcaugggggcugaggaggcuguggauugccgucaguggacucaacaccaucugguugcugcugacauccgcguggcaccagccauggcacugacaccaccacagggcgacgcagaugcugauggcauggaugucaaugugcguggcccagauggcuucaccccgcuaaugcuggcuuccuucugugggggggcucuggagccaaugccaacugaagaggaugaggcagaugacacaucagcuagcaucaucuccgaccugaucugccagggggcucagcuuggggcacggacugaccguacuggcgagacugcuuugcaccuggcugcccguuaugcccgugcugaugcagccaagcggcugcuggaugcuggggcagacaccaaugcccaggaccacucaggccgcacuccccugcacacagcugucacagccgaugcccagggugucuuccagauucucauccgaaaccgcucuacagacuuggaugcccgcauggcagauggcucaacggcacugauccuggcggcccgccuggcaguagagggcaugguggaagagcucaucgccagccaugcugaugucaaugcuguggaugagcuugggaaaucagccuuacacugggcugcggcugugaacaacguggaagccacuuuggcccugcucaaaaauggagccaauaaggacaugcaggauagcaaggaggagaccccccuauuccuggccgcccgcgagggcagcuaugaggcugccaagcugcuguuggaccacuuugccaaccgugagaucaccgaccaccuggacaggcugccgcgggacguagcccaggagagacugcaccaggacaucgugcgcuugcuggaucaacccagugggccccgcagcccccccgguccccacggccuggggccucugcucuguccuccaggggccuuccucccuggccucaaagcggcacagucgggguccaagaagagcaggaggccccccgggaaggcggggcuggggccgcaggggccccgggggcggggcaagaagcugacgcuggccugcccgggcccccuggcugacagcucggucacgcugucgcccguggacucgcuggacuccccgcggccuuucggugggcccccugcuuccccugguggcuucccccuugaggggcccuaugcagcugccacugccacugcagugucucuggcacagcuugguggcccaggccgggcgggucuagggcgccagcccccuggaggauguguacucagccugggccugcugaacccuguggcugugccccucgauugggcccggcugcccccaccugccccuccaggccccucguuccugcugccacuggcgccgggaccccagcugcucaacccagggacccccgucuccccgcaggagcggcccccgccuuaccuggcagucccaggacauggcgaggaguacccggcggcuggggcacacagcagccccccaaaggcccgcuuccugcggguucccagugagcacccuuaccugaccccaucccccgaauccccugagcacugggccagccccucaccucccucccucucagacugguccgaauccacgccuagcccagccacugccacuggggccauggccaccaccacuggggcacugccugcccagccacuucccuugucuguucccagcucccuugcucaggcccagacccagcuggggccccagccggaaguuacccccaagaggcaaguguuggccugagacgcucgucaguucuuagaucuugggggccuaaagagacccccguccugccuccuuucuuucucugucucuuccuuccuuuuagucuuuuucauccucuucucuuuccaccaacccuccugcauccuugccuugcagcgugaccgagauaggucaucagcccagggcuucagucuuccuuuauuuauaaugggugggggcuaccacccacccucucagucuugugaagagucugggaccuccuucuuccccacuucucucuucccucauuccuuucucucuccuucuggccucucauuuccuuacacucugacaugaaugaauuauuauuauuuuuauuuuucuuuuuuuuuuuacauuuuguauagaaacaaauucauuuaaacaaacuuauuauuauuauuuuuuacaaaauauauauauggagaugcucccucccccugugaaccccccagugcccccguggggcugagucugugggcccauucggccaagcuggauucuguguaccuaguacacaggcaugacugggaucccguguaccgaguacacgacccagguauguaccaaguaggcacccuugggcgcacccacuggggccaggggucgggggaguguugggagccuccuccccaccccaccucccucacuucacugcauuccagaugggacauguuccauagccuugcuggggaagggcccacugccaacucccucugccccagccccacccuuggccaucucccuuugggaacuagggggcugcuggugggaaaugggagccagggcagauguaugcauuccuuugugucccuguaaaugugggacuacaagaagaggagcugccugagugguacuuucucuuccugguaauccucuggcccagccucauggcagaauagagguauuuuuaggcuauuuuuguaauauggcuucuggucaaaaucccuguguagcugaauucccaagcccugcauuguacagccccccacuccccucaccaccuaauaaaggaauaguuaacacuca

SEQ ID NO: 997 - RNA, 83 nt, Homo Sapiens
cacagaguuauacuggagauauggaagagcuguguuggguauaaguaacaggcuuuucuuuaucuucuauguggcucuuugca

SEQ ID NO: 998 - RNA, 83 nt, Homo Sapiens; identical to SEQ ID NO: 997

SEQ ID NO: 999 - RNA, 5817 nt, Homo Sapiens
cuucccauuccgccggcagcgcgguccuccuccuccuccuccaccuccuccuccucugccuccuccucccccccgugcuccucccuccccgagccucccucgcccgcccuccuucuucccuccgcacguucgggguucgcggcggagcgcggcgcgggggggacgcggagagccugggcgcagcagcauccugcgggcggccgcucuccgggggggaggcugagagcaggcccgccucgcccccccgcgggcccgccgcccccucccucccuguccucagcccggcagcggcggcggcggcggcaguggcagucgccggagaagcaucaugccgaggaggaagcagcaggcgccccggcgcgcagcagacaagagcaucaauuggguggagguucucagcacgugguggguggagaacgugcugcccuagucucuucacacuaccccuguguaccuguggagccuaaaacaccugggaaggaagcaaaccccagagcuccgaaaccuccauuuccaaaaaggaucgagagccagucuccuagaaauggagcccuuaguggugguccacgcuggagacgaugacaaacaauuggacccuuguguccccaagcugugggcucccuggcgaugacaccggagcugucucuauuuugccugucgggggaauguuccagcgcauuuucccuuauuaugacuugauuaaggacacaauaaacccuugccaugauuuuuaaaaagucaacucacagggcaccaggcaggagaugcgggucccauuuugcucuaaacagagugggcaggggcgcuguuuuccucucuuuaucaccaugcucuagguaaagccugccuguggaacuugugcccucuucucuuucuauccacaaacuccauaagggguucuuuagcaacuaagcaagaaggcuucucuguugucuccuuaauuaaggaugccugcugcagggaucucacucagagggagccgggcaccuuuuaccuuucuccaucuaagccuauguuuccgaagaguuaaaggcugcugcccugguggacgaagguuuagacccagaggagcauacggcagauggagagcccucggccaaguacaugugcccggagaaggagcucgccagggccugccccagcuaccagaacuccccggccgccgaguuuuccugccaugaaauggacagcgagucacacaucagugagaccagugaccgaauggcugacuuugaaagcggcuccaucaagaacgaagaggagaccaaggaggucacggucccacuggaagacacgacugugucggauagccuggagcagaugaaggccguguacaacaacuuccucuccaacuccuacugguccaaccucaaccucaaccugcaccagcccuccucggagaagaacaacggcagcagcagcagcagcaguagcagcagcagcagcuguggcagcgggagcuucgacuggcaccagagcgccauggcuaagacgcugcagcaggugucacagagccgcaugcucccggagcccagccucuucagcaccgugcagcuguaccggcagagcagcaagcucuauggcuccaucuucacgggggccagcaaguuccgcuguaaggacugcagcgcugccuacgacacccugguggaguugacggugcacaugaacgagacggggcauuaccgcgacgacaaccaugagaccgauaacaacaaccccaagcgcugguccaagccucgcaaacgcuccuugcuggaaauggaagggaaggaagacgcccagaaggugcugaagugcauguacuguggccacuccuuugagucccugcaggauuugaguguccauaugaucaaaacaaaacacuaccaaaaagugccucugaaggaacccgucacuccugucgccgccaaaaucaucccugccacucggaagaaagcuucccuggagcuggagcuccccagcuccccagauuccacagguggaacccccaaagccaccaucucagacaccaacgaugcacuucagaagaacuccaacccuuacaucacgccaaauaaucgguacggccaccagaauggggccagcuaugcauggcacuuugaggcccggaagucgcagauccugaagugcauggagugugggagcucgcaugacacccugcaggagcucacugcccacaugauggucacuggccacuucaucaaggucaccaacucugcuaugaaaaaggggaagcccauuguggagacgccugucacaccuaccaucacaacccugcuggaugagaagguccaguccgugccccuggcagccaccaccuucacgucccccuccaauacaccugccagcaucuccccaaaacugaauguggaggucaagaaggaagucgacaaggagaaagcggucacugacgagaaaccuaagcaaaaagacaagccuggcgaagaagaggagaagugugacaucucuuccaaauaccauuacuugacugaaaaugacuuagaagagagucccaagggggggcuugauauccucaaauccuuggaaaacacagugacauccgcaaucaacaaggcccagaacggcacuccuagcugggggggcuaucccagcauccaugccgccuaccaacuucccaacaugaugaaguugucccugggcucgucggggaagagcacgccccugaaacccauguuuggcaacagugagauugucuccccgacgaaaaaccagacccuggucucuccacccagcagccagacgucccccaugcccaagacaaacuuucaugccauggaggagcuggugaaaaaggucacugagaaaguugccaaaguggaggagaagaugaaggagccggaugggaagcuuuccccgcccaagcgggccacucccuccccauguagcagcgaagucggggaacccaucaagauggaggcauccagcgaugggggcuuccgcagccaggagaacagccccagccccccgcgggaugggugcaaggaugggagcccccucgcugagccgguggagaauggcaaggagcuggugaagccccuagccagcaguuugaguggcagcacggccaucaucaccgaccacccgccugaacagccuuuuguuaacccuuugagcgcccugcagucagucaugaacauucaccugggcaaggccgccaagcccucccugccugcccuggaccccaugagcaugcuuuucaagaugagcaacagccuggcggagaaggcugcuguggccaccccgccgccccugcaguccaagaaggcagaccaccucgaccgcuauuucuaccacgucaacaacgaccagcccauagacuugacaaaagggaagagugacaaaggcugcuccuuggguucagugcuucugucacccacguccacagccccggcaaccuccucauccacggugacaacggcaaagacaucugccgucguaucauucaugucaaacucgccgcuacgcgagaaugccuugucagauauauccgauaugcugaagaacuugacagagagccacacgucaaaauccuccacuccuuccagcaucuccgagaagucugacauugacggggccacucuggaggaggcugaggagucgacgcccgcccagaagaggaagggccgccagucaaacuggaacccccagcaccuccugauccuccaggcccaguuugccgccagccuccggcagaccucagaagggaaguacaucaugucagaccugagcccccaggagcggaugcauaucuccagguucaccgggcuguccaugaccaccaucagccacuggcuggccaacgugaaauaccagcuucgaaggacagguggaacaaaguuccucaaaaacuuggacacuggccaccccgucuucuuuuguaacgauugugcgucccaaaucaggacuccuuccacguacaucagucaccuagagucacacuuaggcuuccggcuacgggacuuauccaaacuguccaccgaacagauuaacagucagauagcacaaaccaagucaccgucagaaaaaauggugacguccucccccgaggaagaccuggggacuuccuaucagugcaaacuuugcaaucggaccuuugccagcaagcacgcuguuaaacuucaccuuagcaaaacacacgggaaaucuccggaagaccaccuucuguaugucucugaguuagagaagcaguagcauuugcuuuugauagaaaggacugcaguuugcuuugagggaaacuguggaaggcaccuucaggcccccucugacuuguuguucuuggcacauguucuuauuuuaacugcagagaaucacucugggcuggacuguuuuguauaacuguacaguguuuaauagaggugcauaaucagcuguuguuacugguaaaauaugaagguuaaaaugcagugguaaguguuuggaacuuuguguaaacgggauuuaguugugagcauccucccgaugcuucaagcugcaugcauuaacagacaguuuaauuaagcauuuauaacggaaucaggcacaccuuuuccacgagacucgagugugcuggcauuucucacccuuucaucuuuagcccucugaguacuuugaagcacuuuugcauuaauuugguuaaaaaauaaaauaaaauaauaauaauguaugaagcucuguuuuuuaaacuccuuaccagcuuaguuauaaugaauaauaugaaccuccauuuaugcaggucugcagggguauaacacgccuugaaauuuaaaagaauauuauuuucacauugaaacauagauguauauauuguauagauuucagacucucuuaugaaaaaaaaugugauugugguuaaaugaccuuuuucuugcauuuauagcaacaguguuuuaugcaccugcuaugcucugggcauaagcugugccuauguauaguguauauuucuuuuuuucuuuuuuuuaaggucuauggguuuuguuuuuuacaugcaaacauuguaaauuauacagaagauaccacagauagcauuuauaaaguauacagaaacauuaucugaaagcaaaguaugauaguuuguuuugcuauacaguacaucuauauugauagagguucauguuuaaauuauacauauuuauuagcaucauauugucauuuguuuugagcagucugaauaaacgagaccgggaaagacaucccuggcaggcaucagaacuauuuugcacaugauuuuuaaagguauuuauuagaaaucaaagaacacucaaaauaaacucagugcucaaaggguuaagucuauuugaaaagguuaaaaaaaagaacaaaaaaaaaaaaagaacuuguacuguauuuccuaaacauugauaaagccuuuaaaauguuuguacuguaauacuuugcuuaaaagucaugaggcauucugugauccaaccucuuucacuuauuuauaagcccucuugguugcuauuccauauuguaggaugccuuucuauuucaauugguaacuuucuguuuuguucuuccuaauuauucucccaagaucccacacugcagcuuuaucuuuaggcuuaugaaagguaacccgugguuaccggcucuccaagugauucuguucuucuccauuuuuggcaguuaauuugcagaaguaacugacagcugacaccauaugagaaccuuuguauaaaauauuggcauguaaacagcacagacaccguaacacacucugugcccuguuugguuguugacaaugaagcaccauuaugugacucuucauauaacccuuuuuucuacggcagcauuaaaauugucuuuuugcuauaa

SEQ ID NO: 1000 - RNA, 953 nt, Homo Sapiens
acggcggggcgaagcgcccaggggccugugcgucccucccugcugagcgagggggccugucauugccgugggcgugacccagaccccaaccacagugcaucccgcccuggcccagccagagaaggaagcugagucuggggucugcugggccagcaggaagucccagcagggugugaagcaagacuuuccgggccacuccuggaaucccccagcagauaaaggcggccccuccaccgggcgcuccuagcggucucccggacccugccgcccugccacuaugucccgccgcucuaugcugcuugccugggcucuccccagccuccuucgacucggagcggcucaggagacagaagacccggccugcugcagccccauagugccccggaacgaguggaaggcccuggcaucagagugcgcccagcaccugagccugcccuuacgcuauguggugguaucgcacacggcgggcagcagcugcaacacccccgccucgugccagcagcaggcccggaaugugcagcacuaccacaugaagacacugggcuggugcgacgugggcuacaacuuccugauuggagaagacgggcucguauacgagggccguggcuggaacuucacgggugcccacucaggucacuuauggaaccccauguccauuggcaucagcuucaugggcaacuacauggaucgggugcccacaccccaggccauccgggcagcccagggucuacuggccugcgguguggcucagggagcccugagguccaacuaugugcucaaaggacaccgggaugugcagcguacacucucuccaggcaaccagcucuaccaccucauccagaauuggccacacuaccgcucccccugaggcccugcugauccgcaccccauuccuccccucccauggccaaaaaccccacugucuccuucuccaauaaagauguagcucaaaa

SEQ ID NO: 1001 - RNA, 67 nt, Homo Sapiens
auggggccuucucuucccaguucuuccuggagucggggaaaagcuggguugagaaggugaaaagaaa

SEQ ID NO: 1002 - RNA, 84 nt, Homo Sapiens
cuccccauggcccugucucccaacccuuguaccagugcugggcucagacccugguacaggccugggggacagggaccuggggac

SEQ ID NO: 1003 - RNA, 7573 nt, Homo Sapiens
ggccgcgggcgccgccgaccgggacucagcagccccgccaggcagccgccugugaugcugccgucccccgucgccccguggccccacaaugacccacagccccgcgacaagcgaggacgaggaacgccacagugccagcgagugucccgaggggggcucagaguccgacagcuccccagacgggccaggucgaggcccccgggggacccggggccagggcaguggggcaccugguagccuggccucuguuagaggccuccagggccgcucaauguccgucccagacgacgcccacuucagcaugauggucuucaggauuggcaucccggaccugcaccagacaaaaugccuucgcuucaaccccgaugccaccaucuggacggccaagcagcaggugcucugugcccugagcgagagccugcaggaugugcucaacuauggccuguuccaaccggccaccuccggccgcgaugccaacuuccuggaggaggagaggcugcugcgggaguacccccaguccuuugagaaggggguccccuaccuggaguuccgauacaagacccgaguuuacaaacagaccaaccuggaugagaagcagcuggccaaguugcacacgaagacgggguugaagaaguuccuggaguaugugcagcucgggacaucugacaagguggcgcggcugcuggacaaggggcuggaccccaauuaccaugacucggauucgggagagacccccuugacacuggcggcccagaccgaaggcucuguagaggugauucgaacccugugccugggcggggcccacauugacuuccgggcccgggauggcaugaccgcacugcauaaggccgcaugcgcccgacacugccuggcacucacggcgcuccuggaccuuggggguucccccaacuacaaggaccgucgggggcugaccccucuguuccacacggccaugguggguggugacccccgaugcugcgagcugcuccuguucaacagggcccagcugggcauagcugaugagaacggcuggcaggaaauccaccaggccugccagcggggucacucucagcaccuggagcaucugcuuuucuacggggcugagccuggagcccagaacgccucggggaacacggcucugcacaucugcgcccucuacaacaaggucugccuagcagcggccaccccaggccccucacauccccgauagccgccucccccagggccaagcucagacacuccucuugacugcaucucugcacccuccacuucuucacuauuuccacccuuucauccagucauuccuccauucauuccuccauccauccauccauccauccauccauccauccaacagauauuuacugagcuccucuguaucaggccuggagcugggugcuggggacaaaguguugagcucauggccuagcagagggcagacaacauaguuugcugcuacaguccagagugcucagagcaaagucacagggaauccagaucccugcgggagagaccugugccaggauccuccuguaucgaggugccgacaaggaugugaagaacaacaacggacagacccccuuccagguggcagugauugcugggaauuuugagcugggggagcugauccgaaaccaccgagaacaggaugugggugagugacagggagcucggacugcacagagaaccuggggcgguugagguuucauggugggaugggggaguugggggaccugacuugggggccaggauaggauggagaaaacccuagaggaccaaaaaugucuggaugguggugggggagcaauuccaggccccccucccuuucucaucucugucuuucucccucaugccucucucccaccaucucuugcccccgcauggcccccugcuugccuuuucuccccuaacaucugccccccgccgccacugugcccucucagugcccuuccaggagucccccaaguacgcggcccggcgacgggggcccccaggcacagggcugacggugcccccggcgcugcugcgggccaacagugacaccagcauggcgcugcccgacuggaugguguucuccgccccgggggccgcguccucuggggccccuggcccuaccucagggucccagggccagucgcagcccucggcccccaccaccaagcucagcagcgggacccuccgaagugccagcagcccccggggugccagggcccgcucuccaucccgagggaggcacccugaggacgccaagaggcagccccgaggccggcccagcuccagcgggacaccccgggaagggccagccgggggcacggggggcucagggggccccgggggcucccugggcagccgcgggaggcggaggaagcucuacucagcgguacccggacgcuccuucauggcugugaaguccuaccaggcccaagccgagggggagaucucccugagcaagggcgagaagaucaaaguacuuagcaucggggaaggaggcuucugggaaggccaggucaaaggucguguuggcugguuccccucugacugccuggaagaaguggcgaaucgcucucaggagagcaagcaagaaagccgcagugacaaggcaaagagacucuuccggcauuauaccgugggcuccuacgacagcuuugaugccccaagcuuaauggaugggauuggcccagggagaugcaauuaauggcccuggagcagagguuugggucuggguugccgggugggggacagccucugugucucaugaugucuucuccacuccccccaccacccccccauuucuccugccucccugccagcgauuacaucauuaaggagaagacagucuugcugcagaagaaggacagugagggguuuggguucgugcuccggggggccaaggcgcagacccccaucgaggaguucacccccaccccggccuucccggcgcugcaguaccuggagucgguggacgaggguggcguggcauggcgagcuggacugcgaaugggagacuuccucaucgaggugaacgggcagaauguggugaaggucggccaccgacagguggugaacaugauccgccaagggggcaacacgcugauggugaagguggugauggucaccaggcacccggacauggaugaggcagugcacaagaaagcaccccagcaggccaagcggcugccgcccccaaccaucucccugcguuccaaaucuaugaccucagagcuggaggagauggucucccccuggaagaagaagagugaguacgagcagcagccggcgccggugcccagcauggagaaaaagcggaccguguaucagauggcucucaacaaacuggacgaaauccuggccgcagcucaacagaccaucagugcaagcgaaagcccuggucccgguggccucgcgucccugggcaaacaccgacccaaagguuucuuugccacugagucgagcuucgauccccaccaccgugcccagccaaguuacgagcguccuucuuuccugccuccaggaccuggguugaugcuccggcaaaaaucuaucggugcggcagaagaugacagaccuuaccuagcacccccagccaugaaauucagccgcagccugucugugccugguucggaggacauucccccgccacccaccacguccccaccggagccucccuacagcacaccuccaguccccuccuccucagggcgccucacccccuccccucggggagggcccuucaacccuggcucugguggcccccuccccgccuccuccccugcauccuuugacgggcccuccccucccgacacucgcguggggagccgcgagaagagccuguaccacagugggccccugcccccggcccaccaccacccgccccaccaccaccaccaccacgccccgcccccucagccccaccaccaccacgcccaccccccucauccucccgagauggagacaggcggcucucccgacgacccuccaccccgccuggcucuggggccccagcccagccugcgaggcuggaggggcggcgggcccagcccgaccccgggggccccguccccaucgcaccacggcagcgcgggcgggggcggcggcuccucccagggcccggcucuacgcuauuuccagcugcccccgcgggcggccagcgcagccauguacgugcccgcccgcucgggccgcggccgcaagggcccgcuggucaagcagaccaagguggaaggcgagccccagaagggcggcggccucccgcccgcgccgucgcccacguccccggccuccccgcagccgccgcccgccguggccgcgcccucggagaagaacuccauccccauccccaccaucaucaucaaggccccguccaccaguagcagcggccgcagcagccagggcagcagcaccgaggcggagccccccacccagccggagcccacgggaggcggcggcggcggcggcuccucgcccagccccgccccggccaugucacccgugcccccgucccccucgcccgugcccacccccgccucgcccagcggcccggccacgcuggacuucacgagccaguucggggccgcccuggugggggcggcccggagggaggggggcuggcagaaugaggcgcgccggcgcuccacgcuguuccuguccaccgacgcgggggacgaggacggcggggacggcgggcugggcacaggggcggccccgggcccgcggcugcgccacuccaaauccaucgacgagggcauguucuccgccgagcccuaccuccgacuggagucugcgggcagcggcgcgggcuacggcggcuacggggccgguagccgagccuacggggguggcgggggcagcagcgccuucaccagcuuccugcccccgcgaccccuggugcacccgcugaccggcaaggcccuggaucccgccuccccgcuggggcuggcccuggccgcccgcgagcgagcgcugaaggaguccucggagggcggcggggccccccagccgccucccaggcccccaucgccccgcuacgaggccccgccgcccaccccgcaccaccacucgccccacgcccaccacgagccagugcugcgucucuggggggccuccccgccggacccugcgcgccgggagcugggguacagggccgggcugggcagccaggagaagucccuucccgccagcccgcccgccgcccggcguucccugcuacaccgccugccgcccaccgcucccgggguggggccccuccugcugcagcuggggacggagcccccggccccgcaccccggaguaagcaagcccuggagguccgcagcccccgaagaacccgagcggcugccgcugcacgugcgguuccuugaaaacugccagccccgggccccugugacgagcggaagggguccccccucggaggacgggccgggggucccgccgcccagcccacgccgguccgugccccccuccccgaccuccccgagggccagcgaagagaacgggcugccccugcugguccugccgccucccgcccccucgguggauguggaagauggcgaauuccuuuucguggaaccgcugccuccgccucuggaauucuccaacagcuucgaaaagccagagucgccccucacgccugggccuccccacccgcugcccgacacaccugccccugccaccccguuacccccugugccacccccggcuguggccgcagccccucccacccuggacuccaccgcauccagccugacauccuaugacagcgagguggccacccugacccagggggccuccgccgcuccuggggacccccauccaccaggcccgccugccccagcagcaccggcucccgcugccccacagccuggcccggacccuccgccuggcacggauucuggcaucgaggagguggacagucggagcagcagugaccacccacuggagaccaucagcagcgccuccacgcugagcagccuaucugccgaaggugguggcagcgcagggggugggggcggggcuggggccgguguggccagugggccggagcuucuggacaccuauguggccuaccuggacggccaggccuuugggggcagcaguacucccggcccgccauacccuccucagcucaugacucccucuaagcuccggggccgggcgcuaggagccagcggaggccugcggccuggccccagcgggggacuccgagacccuguuacccccaccagccccaccgucucggugacaggggcuggaaccgaugggcugcuggcccugcgugcuuguucaggaccccccacggcaggcguggcgggggguccgguggcuguagagccagaagucccaccggugcccuugccgacggccuccucucugccccggaagcugcugcccugggaggagggcccgggcccaccgccaccaccucugcccgggcccuuggcccagccucaggccucagccuuggccacaguaaaagccagcaucaucagugaacucagcuccaagcuucagcaguuugggggcuccucggcagcuggcggcgcucugcccugggcccgaggaggcagugggggaggcggagacagccaccacgggggagccagcuauguccccgagaggaccuccucccugcagcggcagagaggcaguauagaauaguggugaagagcucagacuuuggugccauauaaccgggcucugccacuuccuguguguccuuagacucuccgacgacucccaguccucacuccucuccaagccugucagcagccuguuucagaacuggcccaaaccaccucugccgccacuccccaccggaacaggggucuccccuacagccgcugcggccccaggggccaccucacccucagccuccuccuccuccacguccacccgccaccuccagggcguggaguucgagaugcggcccccucugcuccgccgggcccccagccccucgcugcugcccgccucggagcacaaggucagcccugcgcccaggcccucgucccugcccauccugccuuccggaccccucuacccaggccucuuugacauccguggcuccccaacuggaggggcaggaggcucggcugaccccuucgccccagucuuugugccgccacacccggggauauccggggggcucgggggagccuugucaggggccucgcgcucccucucaccgacccgccugcucucgcugcccccggacaagccguuuggcgcuaaaccucugggguucuggaccaaguucgacguggcugauuggcuggaguggcuggguuuggcggagcaccgagcccaguuccuggaccacgagaucgauggcucccaccugcccgccuugaccaaggaggacuacgucgaucuaggugugaccagggugggccaccgcaugaacaucgaccgggcucucaaauucuuccuggagaggugauggcuggccuggacggaccagccccguccacagaacucuugagccugcuggccucuugaccucugaccccugacugucauucucuccccgggccagggacucuguucaaacugcgcccugcccucaucucccaaggcc

SEQ ID NO: 1004 - RNA, 1774 nt, Homo Sapiens
gggcuugcagaggagagagggaguggggcugggucuucccacccuggguccuuuccuccuuccccacuccguuuagcuguaaagcucaauuaagugugauuagcugagaagaguuucugcagaauuagagcacgccccaccccugucuucgugguccccuucccuuaacccggaaacuggaugggccaggacaaagagaguuaagagcuuugucaguggucugucuggagcgacagauggaaggaaagggaccgguugagcaacaugacagguggcugaggagccaggugcagagugguagaguuggcuggcggaguggccagcacaugagaagacaggcagguagguggacggagagauagcagcgacgaggacaggccaaacagugacagccacguagaggaucuggcagacaaagagacaaggugagaaggagcaagcaggucauccccuuggugaccuucaaagagaagcagagagggcagagguggggggcacagggaaagggugaccucugagauuccccuuuucccccagacuuuggaagugacccaccauggggcucagcaucuuuuugcuccuguguguucuuggugaguucucccggagcagggagagggcaggacugcgacuggaucccuucacccccaugaggaggccccaccacccuccccaucucagcucuggcccccagccugguggugaggaggagaggggcuuucucugugccuccauuuaccugcagcucucagguccagggcucagccaggcagccacaccgaagauuuucaauggcacugagugugggcguaacucacagccguggcagguggggcuguuugagggcaccagccugcgcugcggggguguccuuauugaccacagguggguccucacagcggcucacugcagcggcagcagguacugggugcgccugggggaacacagccucagccagcucgacuggaccgagcagauccggcacagcggcuucucugugacccaucccggcuaccugggagccucgacgagccacgagcacgaccuccggcugcugcggcugcgccugcccguccgcguaaccagcagcguucaaccccugccccugcccaaugacugugcaaccgcuggcaccgagugccacgucucaggcuggggcaucaccaaccacccacggaguaaggggcccagggccaggggucaggggucaggauggguacaagucugggaugcagggcgagaggucgaaucaugacaccucagaggaaggauggacccauucccggaucugcuccagugccucaaccucuccaucgucucccaugccaccugccaugguguguaucccgggagaaucacgagcaacauggugugugcaggcggcgucccggggcaggaugccugccagggugauucugggggcccccuggugugugggggaguccuucaaggucugguguccugggggucuguggggcccuguggacaagauggcaucccuggagucuacaccuauauuugcaaguauguggacuggauccggaugaucaugaggaacaacugaccuguuuccuccaccuccacccccaccccuuaacuuggguaccccucuggcccucagagcaccaauaucuccuccaucacuuccccuagcuccacucuuguuggccugggaacuucuuggaacuuuaacuccugccagcccuucuaagacccacgagcggggugagagaagugugcaauagucuggaauaaauauaaaugaaggaggggc

SEQ ID NO: 1005 - RNA, 3333 nt, Homo Sapiens
aggguucccaaaucuggccagucuuucugcccuuucccuugcgggucgcaccccgcccaggccccucucccgccccaggucucucagucuuuuuucucagggcguguagcuuccugcacacccggaagcagaucgcgcggggaaaagaucacagcgcugcgcgucaguuuccgucuaccuggacuaaacauuugcuucgccccgucugccugaaucgaacgugcacuuggcagucuucccuuguccauacccguuuccuggggaucgcuacggaccuuaaaauaccagcaacagccccuucgccccaaggucuugcucugucagacuagaguacagugccaugaucuccgcucacugcagccucaaccuccugggcucaagcagucuuucugccucagagugcugggauuacagacgggagccaccacgccaggccuacgagauuugacuuguaaagaauuaauuauauugacugagagagaagcccagaagaggaagaagaggaaagaaaaggagucagggauggcucuuacacagggaccuuugacauucagggauguagccauagaauucucucaggaggaguggaaaucccuggacccugugcagaaagcuuuguacugggaugugauguuggagaacuacaggaaccuggucuuccuggguauccuuccuaaauguaugaccaaggaauuaccaccaauagggaacaguaauacaggagaaaaaugccaaacagugacgcuggaaagacaugaauguuaugauguugaaaauuuuuacuuaagggaaauccagaaaaaucuacaggaccuugaguuucaauggaaagauggugaaauaaauuauaaagaagugccaaugaccuauaaaaacaaucuuaaugguaaaagaggucaacauagucaagaggauguagaaaacaaauguauugaaaaucagcuuacauuaagcuuucagucacgucugacugaacugcagaaauuucaaacugaagggaaaauuuaugaguguaaccaaucugagaagacaguuaauaacaguucccuaguuucaccacuucaaagaauucuuccuaguguccaaaccaacauuucuaaaaaauaugagaaugaguuuuugcagcugucauuacccacccaacuugagaaaacacacauuagggaaaaaccuuauauguguaaaggguguggcaaagccuuuagagugucuucaagucuuauuaaccaucagaugguacauacuacagagaaaccuuacaaaugcaaugaauguggcaaagccuuucaucggggcucacuacuaacuauacaucagauaguccauacaagggggaagccauaucaaugugguguauguggcaagaucuucagacaaaauucagaucuuguaaaucaccggagaagucacacuggagagaaaccguacaaauguaaugaauguggcaaguccuuuagucaaaguuauaaccuugcaauacaucagagaauucacacuggagagaaaccuuacaaauguaaugagugugggaaaaccuucaaacaaggcucaugccucacuacacaucagauaauccauacaggagagaaaccauaucaaugugauauauguggcaaggucuucaggcagaauucuaaucuuguaaaucaccagagaauccacacuggagagaaaccauacaaaugcaacauauguggaaaguccuuuagucaaaguuccaaccuggcaacucaucagacaguucauaguggaaacaaaccuuacaaaugugaugaguguggcaaaaccuuuaaacggagcuccagccucacuacacaucagauaauccauacaggagagaaaccauauacaugugauguaugcgacaaggucuucagucaacguucacaacuugcaaggcaccagagaagucauacuggagagaaaccuuacaaaugcaaugaauguggcaaggucuucagucagacuucacaucuuguggggcaucggagaauucauacuggagagaaaccuuacaaaugugauaaaugugguaaagccuuuaaacagggcucauuacucacucgacauaagauaauucauaccagagagaaacguuaccaaugcggugaauguggaaaggucuuuagugaaaauucaugccuuguaagacauuuaagaauucauacuggggagcaaccuuacaaauguaauguguguggcaaggucuucaauuacaguggaaaccuuucaauucauaagagaauacauacgggagagaaaccuuuccaauguaaugaauguggcacagucuucaggaacuacucaugccuagcacgucaucuaagaauucauacugggcagaaaccuuacaaauguaauguguguggcaaggucuucaaugacaguggaaaccuuucaaaucauaagagaauucauacuggagagaagccguuucaauguaacgaaugcggcaagguuuucaguuacuacucaugccuagcacgucaucggaaaauucauaccggagagaaaccuuacaaauguaaugauuguggcaaagccuauacucagcguucaagccucacuaaacaucugauaauucauacuggagagaaaccuuacaauuguaaugaguuuggaggggcauuuauccaaaguucaaaacuugcaagauaucacagaaauccuacuggggagaaaccacacaaauguagccauugugguagaacuuuuagucauauaacaggccugacguaccaucagagaaggcauacuggagagaugccauacaaauguauugaauguggccaggucuuuaauuccacuucgaaccuugcaaggcaucggagaauucacacuggagagaaaccuuacaaauguaaugaauguggcaaggucuuucgucaucaaucaacacuagcacgucaucggaguauucauacuggagagaaaccuuacguguguaaugaguguggcaaagccuuuagagugcguucaauucugguuaaucaucagaaaaugcauacuggggacaaaccuuacaaauguaaugaaugugguaaagcuuuuauugaaaggucaaagcugguguaccaucaaagaaaucacacuggagagaagccauacaaauguauugaauguggcaaggccuuugggcgguuuucuugccucaacaaacaccaaaugauucauucuggagaaaaaccuuauaaauguaaugaguguggcaaaucuuucauuagucgcucaggccucacuaaacaucagacaaaacauacugcagagagucuuaaaacaaaauucaauguggaaaagccuuuagauguucuccuaacuucuggguucaaauaa

SEQ ID NO: 1006 - RNA, 1250 nt, Homo Sapiens
gugagaaggaaacugcaagaguggggcagagaaccagagugucagagcaaaaccuccucuaucugcacauccuggggacgaaccgggcagccggagagcugcggccggcccagucccgcuccgccuuugaaggguaaaacccaaggcggggccuugguucuggcagaagggacgcuaugaccgcagaauuccucucccugcuuugccucgggcugugucugggcuacgaagaugagaaaaagaaugagaaaccgcccaagcccucccuccacgccuggcccagcucggugguugaagccgagagcaaugugacccugaagugucaggcucauucccagaaugugacauuugugcugcgcaaggugaacgacucuggguacaagcaggaacagagcucggcagaaaacgaagcugaauuccccuucacggaccugaagccuaaggaugcugggagguacuuuugugccuacaagacaacagccucccaugaguggucagaaagcagugaacacuugcagcugguggucacagggucccacucgguugcccaggcuggagugcaguggugcaaucacagcucacugcagccuugaccucccaggcccagauaaacacgaugaacuugaagcucccucaaugaaaacaguggcucacgucuguaauaccaggacuuugggaagaugaggcaggaggaucacuugagcccagggguucaagaccagccuggacaacuugacaccagaaccaucuuugucgccaucuucagcugcaucuccauccuucuccucuuccucucagucuucaucaucuacagaugcagccagcacagugagcucagagaacgcaaagggagagagggggagugaaggauuuucucgguucaucaucugaggaauccaccaagagaaccagccauuccaaacuuccggagcaggaggcugccgaggcagauuuauccaauauggaaaggguaucucucucgacggcagacccccaaggagugaccuaugcugagcuaagcaccagcgcccugucugaggcagcuucagacaccacccaggagcccccaggaucucaugaauaugcggcacugaaaguguagcaagaagacagcccuggccacuaaaggaggggggaucgugcuggccaagguuaucggaaaucuggagaugcagauacuguguuuccuugcucuucguccauaucaauaaaauuaaguuucucgucuuaaaaagaaaaaaaaaaaaaaa

SEQ ID NO: 1007 - RNA, 955 nt, Homo Sapiens
acucugggagggcuaaggagccaucaugaucccuaagcugcuuucccuccucuguuucaaugaaagaaagaaaaaagaaagaaagaaaggaaagaaaaagaaagaaagaaagaaauggacugugcgugggccaaggagacacaaggggagaugggucacugcccaagccgucccucagugccuggcccagcucgguggucccugccaacagcaaugugacgcugcgauguuggacuccugccagaggugugagcuuuguucucaggaagggaggaauuauucuggaguccccgaagccccuugauucuacagagggcgcggccgaauuucaccucaauaaucuaaaagucagaaaugcuggagaguacaccugugaauacuacagaaaagcauccccccacauccuuucacagcgcagugacguccuucuacuguuggugacaggacauuuaucuaaaccuuuccuccgaaccuaccaaagggguacagugaccgcagguggaagggugacucugcagugccagaagcgagaccaauuguuugugccuaucauguucgcucuacugaaggcagggacgccaucacccauccagcugcagaguccagcggggaaggagauagacuucucucugguggacgugacagccggcgaugcugggaacuacagcugcauguacuaccagacaaagucucccuucugggccucagaacccagugaucagcuugagauauuggugacaguucccccagguaccacaucgagcaacuacucccuggguaacuucguacgacugggucuggcugccguaauugugguuaucaugggagcuuuccugguggaggccugguacagccggaaugugucuccaggugaaucagaggccuucaaaccagagugacuccaucuugaaccggggcuggguaaacugaggcugcaaccugcuggacugcauuc

SEQ ID NO: 1008 - RNA, 1191 nt, Homo Sapiens
ccucuccgccacuucccucgcuucugaccauaguuugcggggaagggagcgagcgcgucgaaaaccaaggaacgugcgcgcugacgucacgguugaggcucggagcugaggggccgcggagggcguggccugcgggcgguuauaaagaggcaguggugcgcgcgcggccggcucagugcugccgggcaccggggcggcggguuggucuacgcugugcgcggcggacgucggaggcagcggggagcggagcggggccgccggggccucuccagggccgcagcggcagcaguugggccccccgccccggccggcggaccgaagaacgcaggaagggggccggggggacccgcccccggccggccgcagccaugaacuccaacguggagaaccuacccccgcacaucauccgccugguguacaaggaggugacgacacugaccgcagacccacccgauggcaucaaggucuuucccaacgaggaggaccucaccgaccuccaggucaccaucgagggcccugaggggaccccauaugcuggaggucuguuccgcaugaaacuccugcuggggaaggacuucccugccuccccacccaagggcuacuuccugaccaagaucuuccacccgaacgugggcgccaauggcgagaucugcgucaacgugcucaagagggacuggacggcugagcugggcauccgacacguacugcugaccaucaagugccugcugauccacccuaaccccgagucugcacucaacgaggaggcgggccgccugcucuuggagaacuacgaggaguaugcggcucgggcccgucugcucacagagauccacgggggcgccggcgggcccagcggcagggccgaagccggucgggcccuggccaguggcacugaagcuuccuccaccgacccuggggccccagggggcccgggaggggcugagggucccauggccaagaagcaugcuggcgagcgcgauaagaagcuggcggccaagaaaaagacggacaagaagcgggcgcugcggcggcuguagugggcucucuuccuccuuccaccgugaccccaaccucuccuguccccucccuccaacucugucucuaaguuauuuaaauuauggcuggggucggggaggguacagggggcacugggaccuggauuuguuuuucuaaauaaaguuggaaaagcag

SEQ ID NO: 1009 - RNA, 3157 nt, Homo Sapiens
ugagaaacugcauguguugggcaagaugaacuuuucuguaaucaccugccccaacggugguaccaaccaagggcuucugccuuaccugauggcccuggaucaguaucagcuggaggaauucaagcuuugcuuggaaccccagcagcugauggacuucuggucggccccccaggggcacuucccgcguauccccugggcaaacuugagagcugccgacccuuugaaucuguccuuucuuuuggaugaacacuucccaaaaggucaggcauggaaagugguccucggcaucuuccagacaaugaaucugaccucacugugugagaaaguuagagccgagaugaaagagaaugugcagacccaagagcugcaagauccaacccaggaagaucuagagaugcuagaagcagcagcagggaauaugcagacccagggaugccaagauccaaaccaagaagaacuagacgagcuagaagaagaaacagggaauguacaggcccagggaugccaagauccaaaccaagaagaaccagagaugcuagaggaagcagaccacagaagaaaauacagagagaacaugaaggcugaacuacuggagacaugggacaacaucaguuggccuaaagaccacguauauauccguaauacaucaaaggacgaacaugaggaacugcagcgccuacuggauccuaauaggacuagagcccaggcccagacgauagucuugguggggagggcagggguugggaagaccaccuuggcaaugcaggcuaugcugcacugggcaaauggaguucucuuucagcaaagguucuccuauguuuucuaucucagcugccauaaaauaagguacaugaaggaaacuaccuuugcugaauugauuucuuuggauuggcccgauuuugaugcccccauugaagaguucaugucucaaccagagaagcuccuguuuauuauugauggcuuugaggaaauaaucauaucugagucacgcucugagagcuuggaugauggcucgccauguacagacugguaccaggagcucccagugaccaaaauccuacacagcuuguugaagaaagaauugguuccccuggcuaccuuacugaucacgaucaagaccugguuugugagagaucuuaaggccucauuagugaauccaugcuuuguacaaauuacaggguucacaggggacgaccuacggguauauuucaugagacacuuugaugacucaagugaaguugagaaaauccugcagcagcuaagaaaaaacgaaacucucuuucauuccugcagugcccccaugguguguuggaccguauguuccugucugaagcagccgaaggugagguauuacgaucuccagucaaucacucagacuaccaccagucuguaugccuauuuuuucuccaacuuguucuccacagcagagguagauuuggcagaugacagcuggccaggacaauggagggcccucugcagucuggccauagaagggcuguggucuaugaacuucacguuuaacaaagaagacacugagaucgagggccuggaagugccuuucauugauucucucuacgaguucaauauucuucaaaagaucaaugacuguggggguugcacuacuuucacccaccuaaguuuccaggaguuuuuugcagccauguccuuugugcuagaggaaccuagagaauucccuccccauuccacaaagccacaagagaugaagauguuacugcaacacgucuugcuugacaaagaagccuacuggacuccagugguucuguucuucuuuggucuuuuaaauaaaaacauagcaagagaacuggaagauacuuugcauuguaaaauaucucccaggguaauggaggaauuauuaaaguggggagaagaguuagguaaggcugaaagugccucucuccaauuucacauucuacgacuuuuucacugccuacacgagucccaggaggaagacuucacaaagaagauguugggucguaucuuugaaguugaccuuaauauuuuggaggacgaagaacuccaagcuucuucauuuugccuaaagcacuguaaaagguuaaauaagcuaaggcuuucuguuagcagucacauccuugaaagggacuuggaaauucuggagacaagcaaguuugauuccaggaugcacgcauggaacagcauuugcucuacguuggucacaaaugagaaucugcaugagcuagaccugaguaacagcaaacuucaugcuuccucugugaagggucucugucuugcacugaaaaauccaagaugcaaaguccagaaacugacgugcaaaucgguaacuccugaguggguucugcaggaccucauuauugcccuucaggguaacagcaagcugacccaucugaacuucagcucuaacaagcugggaaugacugucccccugauucuuaaagcuuugagacacucagcuugcaaccucaaguaucugugccuggagaaaugcaacuugucggcagccagcugucaggaccuagccuuguuucucaccagcauccaacacguaacucgauugugccugggauuuaaucggcuccaagaugauggcauaaagcuauugugugcggcccugacucaccccaagugugccuuagagagacuggagcucugguuuugccagcuggcagcacccgcuugcaagcacuugucagaugcucuccugcagaacaggagccugacacaccugaaucugagcaagaacagccugagagacgagggagucaaguuccugugugaggccuugggucgcccagaugguaaccugcagagccugaauuugucagguuguucuuucacaagagagggcuguggagagcuggcuaaugcccucagccauaaucauaaugugaaaaucuuggauuugggagaaaaugaucuucaggaugauggagugaagcuacugugugaggcucugaaaccacaucgugcauugcacacacuuggguuggcgaaaugcaaucugacaacugcuugcugccagcaucucuucucuguucucagcagcaguaagagccuggucaaucugaaccuucuaggcaaugaauuggauacugauggugucaagaugcuauguaaggcuuugaaaaagucgacaugcaggcugcagaaacucggguaa

SEQ ID NO: 1010 - RNA, 2297 nt, Homo Sapiens
caccgguaccgugguggaagcgcgcccugggcugccgggggcgcggccgcgguggcacuuggacccgaggaggcggcagcucuaccgucgcaggacucugcccuuccccaagagaggaaccagaaggaggaccuaucagcccuugaaauucuaaaagucaugucccuugggucagaauuguucagggauguggccauagucuucucccaagaagaauggcagugguuggcaccugcucagagggauuuguacagagacgugauguuggagaccuacagcaaccuggucucacugggucuugccguuuccaaaccugaugugaucuccuuccuagagcaaggcaaagagcccuggaugguggagagaguggugucuggaggccuguguccaguauuggaguccagauaugauaccaaggaauuauuuccaaagcagcauguuuaugaagucgaaucaccccaaugggagauaauggaaagccuuacaaguuauggucuugaguguucaaguuuccaagaugauugggaaugcagaaaccaguuugacagacaacagggaaauccagacagacauuuccaucagaugaucaucagacaugaagaaaugcccacuuuugaccagcaugcaucccuuacuuuuuaucagaaaauucauacuagagaaaaaccuuuuggguauaauaaauguagaaaagacuucuggcaaaaggaacuccuuauuaaucaucaaggaauuuauacuaaugagaaacccuauaaauguaaggaaugugggaaggccuuuaaauauggcucacgacuaauucaacaugagaauauucauucugguaagaaaccauaugaauguaaggaauguggaaaggccuucaauucugguucaaauuuuauacaacaucagagaguucauacuggugagaaaccguaugaauguaaagauugugagaaggccuuuagucgaagcucacaguugauugaacaucagcgaacucacacaggcgagaaacccuaucaguguaaggaauguggcaaggccuucaaucggaucucacaucuuaaaguacauuauagaauucauacuggugaaaaacccuaugcaugcaaggaaugugggaaaaccuuuagucaucguucucaguugauucaacaucagacuguucauacuggcaggaaacucuaugaauguaaggaaugugggaaggcuuuuaaucaaggcucaacucuuauacgacaucagagaauucauaccggugagaaacccuaugagugcaaaguauguggaaaggccuuuagagugagcucacaacucaagcaacaucagagaauucacacuggagagaaacccuaccaauguaagguaugugguagggccuucaaacgggucucacaucuuacuguacauuacagaauucauacaggugaaaagccauaugaauguaaggaaugugggaaggcuuuuagucauugcucacaauugauucaucaucagguuauucacacugagaaaaagcccuaugaauauaaggaaugugagaagaccuugagucaugauucaacuaccguucaaccucagagaaugcauaauagagaaacacaugugaauauaauaaauguagaaaagccuuccaucagcaguuaccccuuacuaaucaucagagaauuuauguuggcaagcaaccauaugaauggaaguaauggggaaagcccauuagccuaggcuaauugugacugugacuuacuucucccucuuggagaaagacuugaagaauguaaugccagugacaaugccuucauucagagguaagccuuuauccuaagucugaaaauucauaucaaagaaaauuuuauggauguaaauuguucagaucauaauugucaaaaaugcugggaaagguugggagaaauuuuauuucuaacacauuccagaaccacauuuucuaaccacaguguaguaauuuuaucaagagcaaaaguuauaguuuucuuacaaguuaaaaaaacagccagauuaucauuugcuuaacaaagaaaucaugcaauuaccauaaaugguaaugaaaagaaugaauugagaguuuaacaugccaagagaugugaaauguggccaaagagaugugaggguaaggggaaagccaaagcuacacuggaggaauuuuuauagccuuugaaugcaugcauauacaugaaaaucugaaagauaaacucauaugcacuaaacaugcuauucaagucuaccaaacauccaggcagugaaagaagaaaguaacagaaaaugaugaaauaaagagaccaucuuacaau

SEQ ID NO: 1011 - RNA, 2793 nt, Homo Sapiens
ggugcgcgggcuccuccgcagcagcagaagucuugaccuuagcucgucuaaggaaggaggcaccagggucugcguuggcccaggaggacccgagacugaguagaagcggagccgacugcaccaggcuaggagggggccggccagcgcguucgaaggugauaccgggaggcgagagcaacggucccuggcagccagugugacccagagaaaagaugugagaucaagacagcagcccagggaucgaggauggagggacucuugagcgucgcccuccagggcgcagaguuggaaggaaacuggaaacacgagggccagguugaggaccugcaggaaaaccaggaaagcuguccagagccagaggccguggccugcaagggagacccugcuggggacagcaugcaggaacgcgaugaauucagccgaaucccaagaaccauaucgagcccugcugcuacccaagccaguguccccgacgacagcaguucccggaggugcagcgcgccuggggagagcccgaaggagaggcauccugacagccgccagcgggagagagguggaggccccaagaagccguggaaaugcggggacugcgggaaggccuucagcuacuguucagcguucaucuuacaccagagaauccacaccggggagaagccauuugcgugccccgagugcggcaaggccuucagccagagcgugcaccugacccugcaccagcgcacgcacacgggcgagaagcccuacgccugccacgagugcggcaaggccuucagccagggcucguaccuggcgucccacuggcgcacgcacacgggcgagaagccgcaccgcugcgccgacugcggcaaggccuucacgcgcgucacgcaccugacccagcaccggcgcgugcacacgggcgagcggcccuacgcgugcgcccagugcgccaaggcguuccgcaaccgcucgucccugauagagcaccagcgcauccacaccggugagaagcccuacgagugcuccgcgugcgccaaggccuuccgcuucuccucagcgcucauccgccaccagcgcauccacacggaggagaagcccuaccgcugcggccagugcgccaaggccuucgcgcagaucgcgcaccugacccagcaccggcgcgugcacacgggcgagaagcccuacacgugccaggacugcggcgcgcucuucagccagagcgccucucuggccgagcaccggcgcauccacacaggcgagaagcccuacgcgugcggccagugcgccaaggccuucacccaggugucgcaccugacgcagcaccagcgcacgcacaccggagagcggccuuaccccugccacgacugcggcaagcgcuucagcaaccgcucccaccuccuccagcaccgccucgugcacaccggugagcggcccuacaggugccugcaaugcggggccgccuucagccacguguccucgcuuauagagcaccagaagauccacaccggagagcggcccuacaagugcggcgagugcggcaaagcuuucagccagggcuccucgcucgcccugcaccagcgcacgcacacgggcgagcggcccuacaccugccccgagugcggcaaggccuucagcaaccgcuccuaccugauccagcaccacaucgugcacaccggggagaagcccuacgagugcagcggcugcgggaaggccuucagcuucuccuccgcgcucauccgacaccagaggacgcaugcagacaguucgggacgccuuugcccagcucccacgccugacucaacaccugggcucucacagggaggagaaaccugucaacaggggugcccuggcagaaacccgcguggaccagcagaagauuaagagcugagggccuccuuuccaaccucacaaugcuaugggggagauacuguguuauccccgacgcuuccugugaggaaaccgaggcucagagaagcuuguuaacuugccugagggcacacaguggggaagacacagggcuaagacuguaccucacaucugccagacuccccugcggucuuccuggugcaaaauuauaaauggggcacgggcaaguagaccugcagaaacaccuauggcuggccuuuaauuucuuucuuuuuuucuuugagacagugucucucucugucacccaggcuagagugcaguggagcgaucucggcucacugaaacuucugccucccggguacaagugauucuccugccucaaccucccgaguaguuaaaauuacaggagucuggcuaauuuuuuuuuuuuuuuuuuucugagacggagucuugcucugucgcccaggcuggagugcagugaugcaaucucggcucacugcaaccuccgccucccggguucaagugauuccccuaccucagccucccgaguagcugggacuacaggcgcccggccaccacacccggacuaguuuuuuuguauuuuaguagaggcgggguuucaccauguuggcuaggauggucucgaucuccugacuucguuauccacccgccucggccucccaaagugcugggauuacaggcaugagccaccgcgcccagccuaauuuuuguauuuuuaguagaggcaggguuucaccauguuggccaggcugucucgaacuccuaacaucaggcgaucugccugccuuggcaucccaaagugcugggacuacaggccugagcuacggugccuggccagcuggccuuuucauuguugauuuuauugaguaagcccuugcucaguaaauuuaauugaauuaaagugaauaaaagguuugguuucuuugg

SEQ ID NO: 1012 - RNA, 3779 nt, Homo Sapiens
caguuugaguuauuaacacgaggaaaauaaaacacauauccauauaaagaaaugaauucaaguauuuacagcagcuuuauuuguaauauacaaaaaucuauaaauaauauaaaugucccuaaacacauggauaaacacugacuuauccauagaacagcaugauacucagcaauacaaagauucaucauuuuugaaucucaaaauaauuauacagcaugaagaaaaccaguaaguauauauauauacacacacacauauauaaacacauauguauauauauacguauacguauaugcguauacguguguguguguguguguguguguguguguauguaucucaguaaaaacuccagaaaaugcaaacuaauuuacuguaaaggaaaucaguugaaccugaagagcuggggaagggagaaagauuauaaaaagauacaagguaaauauaugggugacacacaaauucauuuuuaugguuguaaugaugguuucauggcuuuaccaaacuguacacuuuggauacguguacuuuguugcaugucaguuauacaaauuagaccuucaaaaagcuuuaaaaaguggcucaaaauuaagagccuagauguuccuuuuuuuuuaaucaggguggcaaccugauauggacuucaccaucucucucucuccucaugcccugagagaggcaaccuugccucaggggcagcaaauuuuggcaagcaaugaaggcuguugccaccugaauuaauaggaauguuggcugagucacaaaagccacaucccuggaccgcggaaugauccuucucucuauucuuguucuccuaccugcauagcaauggccuugaggugaacagcccagacaggauacaaggagccacaaaaccuuuauagacuauuuucuuuuuuuuuuuuggagacggagucucacucuguugccugggcuggagugcaguggugcaaucucagcucacugcaacuuccgccuucuggguucaagcgauucuccugccucagccucccaaguggcugggacuauaggcgcaugcugccacgccuggcuaauuuuuuguauuuuaguagacaugggauuucaccauguugcccaggcuggucuugaacuccugagcucaggcaauccgcccgccuuggccucccaaaguguuaggauuacaccaugcccggccagacuauuuucugauaaugaucucagcgauaguaaacagaagauccugagaauuucuguaugcacugauccuacacaaccauauucacuggaaaauuuguagaugaacuuuuagaagagucauuccaucuaauuuacugcagucuucuccacuccccauuuaccuggaguuucugucccaauuacuguugaaccuguaauuucaccuccacaccuauagucugacaacaaauggcaccagucuacacugacuuauaugccauggcaccuggcuccuuugcaggaccugggcaacagauuccccucaccagugcuaggaauuauguggaucuccuguggacaacugaacaaaauucacguucacagaagcacuggggauugucacaacugccuccuuuucauggugaccucugaccugacaaaaauggcaccaggccacaauacaggaacacaaagccuggcagucuuuacuuugaggccuugggcagcaggccaauuagagcaauacagaacaaagagcugucuucugccaucacauugucccuucugaguacagaaaguuugagaucuccacaaaaucuauucaccccuucaugcugacaucacuauucugcuuacaagucauucuaugcaaugaauagaacacccaagauuaaaggugcguaaauuuuuuuaaaaccuuuauaaaaacauuauaaauuaaagcaaugugcaccaagcaguuuccaggcuggugaaucagaauguggaaaaauucauuacaagcaucaugugagaccgacaauguuccuuaaaaaaguaauccuuagaaagcugacagcacaacucagauucucuggaccacaacugggucagguguauacucuaaagucagagaaaagacaugaagacccuacaugcuugggcuauuaauaauuuccccaagcaaaugggagaguacagagguuugcuucucugagcacuguggggaagugacucaugcacauggugugcaccugccaggugguaggggugaaaugugaaauggcuucagccucagaaauuggcagugacauaaaucaggcuauaggccucggcagauuagaaauuacaaugaaccuccucagagcuucccacauaccugaaacuuaugaagaauaccccacugugggugcucaaaguuuaaauuuacgaagauggcuaccacagucuccuccagugcuauuauacugaauaaagaaauagcacauucccuucacauuuaaggccuuucuucagugugaacucuccgaugucgaaugagguuagauuugcggcuaaaggauuucccacauucacugcauucauaaggccuuucuccagugugaacucuuuggugcugaauaaggucugauuuguggguaaaggguuucccacauugacugcacucauaaggucuuucuccagugugaccucucugguguugaaugaggcuagagcucuggcuaaaggauuucccacauucacuacauucauaaggccuuucuccagugugaacucucugguguugaaugaggcuagcacuuuggcuaaaagacuuuccacauucacuacauucauaaggccuuucuccaguaugaagucuccggugcugaaugaggccagagcgcugucuaaaagauuugccacauucacugcacucauaaggucuugugccaguaugaauucuccgguguugaaugaggucagauuugcggguaaaggauuuuccacauucacugcauucauaaggucuuucuccagugugaacucuuugguguugaaucaggauaaauuugcggcuaaaggauuucucacauucacugcacucauaaggccuaucaccagugugaaugcugcggugucgaaugagguuagagaauugucuaaaggauuucccacauucucugcauucauaaggucuuucuccacugugaauucucugguguugaaugaguuccgauuugcagcuaaaagauuucccacaaucacugcacugauaaggcauuucuccagugugaacucuucuaugucgaaugagauugaagauuugucuaaaggauuucccacacucacagcacugauaaggccuuucuccagagugaacucucuggugucgaaaaaggcuagagcuuugucuaaaggauuucccgcacucgccacauucauaaggccuuucuccagugugaacucucugguguucaaugagguuagauuuguagcuaaagguuuuccuacauucaccacacucaugacgcacuccuccagugugacgucucugguggugaaugaauucagauuuauggauaaaggcuuucucacgaucacugcauucauaaggccuuucuccagugugaauuaucuuguguaagauuagguggcacuuuuugcuaaaggauuccucacauucacuacacucaaacaucuuuuguccagugugaauuugcuggugcugaacaaguguguucuugcaagugaaggcuuucucacauuugcuacacucauaaagcccuccuucagaacagacacucugaugcugaacaaguguguguuuguggcuugaagcuuuucuguauucaccccacuuguaauaacuuuuugcauug

SEQ ID NO: 1013 - RNA, 4834 nt, Homo Sapiens
gaaagcgaagcguugcggggaaacgaaagccggaggcccaggcggggcaggagcccuggggcuggggcgcccuuccggccucuccuccucgccgcgagaugugcgcgauaaacggccggcgcucgggagcagacgcuuggccccggggccccaggugcgcggcuccgcgggccugcgcgguccccaggcgccggcucccggggcugacaccgaaugaggccccgcgccgucggccccaagaauaugacaguaucagaauaacaggagcuaacccuaacugaacacuuaaaguuugccaggcacuauucugaauucuucacaaaaauuagcaguuuuacucugcacaaaaaucgccugagauacguugcuuugcugaugaagaaauggaaauccagagaaauaaagucgcuuacucagucacccagcuacaugauuuguggcucuggaaguucagcuacuaggacucuuccaacuuccuacaggugucacgaaagcacaagaccacacacuuacacacaguucugaugaaagagggcuaaaaggaagauuucaguaaaaaggucaacaaggcuuucuaaaaaaacuguaaagguaaauaaaugaugugucgcaguaauucucaccaauuaggaagcaucuuagaaaagcauuggauuuccucuaguuaaaaacaucuauaaaaagugauaucaaaauauaggaagauguaaauaucuaaauuuuaacacugucaccuugcauaaauuaggcugaauagcugauggaauaaaacucagcugaguguuagucaaagaagguguguccugcuccccaaugacagguugcucagagacugcugauuuccaucccuauauaaagagagucccuggcauacagagacugcucugcuccaggcaucugccacaaugugggugcuuacaccugcugcuuuugcugggaagcucuugaguguguucaggcaaccucugagcucucuguggaggagccuggucccgcuguucugcuggcugagggcaaccuucuggcugcuagcuaccaagaggagaaagcagcagcugguccugagagggccagaugagaccaaagaggaggaagaggacccuccucugcccaccaccccaaccagcgucaacuaucacuucacucgccagugcaacuacaaaugcggcuucuguuuccacacagccaaaacauccuuugugcugccccuugaggaagcaaagagaggauugcuuuugcuuaaggaagcugguccuugucuuccugucuuuccuagaguaccuucucaacuaguaacuucagcaacaucucuagcuucuuucccuccuuguuuaacuuuuuaacaaaagcauagcauacaugcaccagauuacacauauucuggaugugcacccugaugaauuucacaaagcaaucacagccagguaaauagccugcagauucagagagaaagcaucaccagcgccagaagugcaugcugcacuccagccacuacccugguauggagaagaucaacuuuucagguggagagccauuucuucaagaccggggagaauaccugggcaaguuggugagguucugcaaaguagaguugcggcugcccagcgugagcaucgugagcaauggaagccugauccgggagaggugguuccagaauuauggugugcuccaugggauggcauucuucuuauugcuauugcuauuuuuauuguugguucuuauauuuccuucccuccugggccuucagccaggccugcugaggaacuggaagggaggaaaaacuaaucuugcuuacucuaauugcuuuucaagcugugcacggcauuauggcaguuuuaguuccuuagggcucucaguaaacaaguuuggcaaguuagauaauagaccuuuuacugagaugacuaucuuguacauugcaauuuagcaaauacaagaucuauggccuuaguuuagacacuagugaguauuuggacauucucgcuaucuccugugacagcuuugacgaggaagucaauguccuuauuggccguggccaaggaaagaagaaccauguggaaaaccuucaaaagcugaggaggugguguagggauuauagagucgcuuucaagauaaauucugucauuaaucguuucaacguggaagaggacaugacggaacagaucaaagcacuaaacccuguccgcuggaaaguguuccagugccucuuaauugagggugagaauuguggagaagaugcucuaagagaagcagaaagauuuguuauuggugaugaagaauuugaaagauucuuggagcgccacaaagaaguguccugcuuggugccugaaucuaaccagaagaugaaagacuccuaccuuauucuggaugaauauaugcgcuuucugaacuguagaaagggacggaaggacccuuccaaguccauccuggauguugguguagaagaagcuauaaaauucaguggauuugaugaaaagauguuucugaagcgaggaggaaaauacauauggaguaaggcugaucugaagcuggauugguagagcggaaaguggaacgagacuucaacacaccagugggaaaacuccuagaguaacugccauugucugcaauacuaucccguugguauuucccaguggcugaaaaccugauuuucugcugcacguggcaucugauuaccuguggucacugaacacacgaauaacuuggauagcaaauccugagacaauggaaaaccauuaacuuuacuucauuggcuuauaaccuuguuguuauugaaacagcacuucuguuuuugaguuuguuuuagcuaaaaagaaggaauacacacaggaauaaugaccccaaaaaugcuuagauaaggccccuauacacaggaccugacauuuagcucaaugaugcguuuguaagaaauaagcucuagugauaucugugggggcaaaauuuaauuuggauuugauuuuuuaaaacaauguuuacugcgauuucuauauuuccauuuugaaacuauuucuuguuccagguuuguucauuugacagagucaguauuuuuugccaaauauccagauaaccaguuuucacaucugagacauuacaaaguaucugccucaauuauuucugcugguuauaaugcuuuuuuuuuuuugccuuuaugccauugcagucuuguacuuuuuacugugauguacagaaauagucaacagauguuuccaagaacauaugauaugauaauccuaccaauuuucaagaagucucuagaaagagauaacacauggaaagacgguguggugcagcccagcccacgguggcuguuccaugaaugcuggcuaccuaugugugugguaccuguugugucccuuucucuucaaagauccugagcaaaacaaagauacgcuuuccauuugaugauggaguugacauggaggcagugcuugcauugcuuuguucgccuaucaucuggccacaugaggcugucaagcaaaagaauaggaguguaguugaguagcugguuggcccuacaucucugagaagugacggcacacuggguuggcauaagauauccuaaaaucacgcuggaaccuugggcaaggaagaaugugagcaagaguagagagagugccuggauuucaugucagugaagccaagucaccauaucauauuuuugaaugaacucugagucaguugaaauaggguaccaucuaggucaguuuaagaagagucagcucagagaaagcaagcauaagggaaaaugucacguaaacuagaucagggaacaaaauccucuccuuguggaaauaucccaugcaguuuguugauacaacuuaguaucuuauugccuaaaaaaaaauuucuuaucauuguuucaaaaaagcaaaaucauggaaaauuuuuguuguccaggcaaauaaaaggucauuuuaauuuagcugcaauuucaguguuccucacuagguggcauuuaaaugucgccugaugucauuaagcaccauccaaaaagucugcuucauaaucuauuuucaagacuuggugauucugaaaguuuugguuuuugugacuuuguuucucaggaaaaaaaauauuccuacuuaaauuuuaagucuauaauucaauuuaaauaugugugugucucauccaggauaggauagguugucuucuauuuuccauuuuaccuauuuacuuuuuuuguaagaaaagagaaaaaugaauucuaaagauguuccccauggguuuugauugugucuaagcuaugaugaccuucauauaaucagcauaaacauaaaacaaauuuuuuacuuaacaugagugcacuuuacuaauccucauggcacaguggcucacgccuguaaucccagcacuugggaggacaauguggguggaucacgaggucaggaguucgagaacagccuggccaacauggugaaaccccgucuccacuaaaaauacaaaaauuagccaggcaugguggcguacacuuguaauuccagcuacucaagaggcugaggcaggaggauugcuugaacccugaaggcagagguuacagagccaagauagcgccacugcacuccagccuggaugacagagcaagacuccgucucaaaaaaaaaaaaaaaaaaaagcaagagaguucaacuaagaaaggucacauaugugaaagcccaaggacacuguuugauauacagcagguauucaaucaguguuauuugaaaccaaaucugaauuugaaguuugaaucuucugaguuggaaugaauuuuuuucuagcugagggaaacuguauuuuucuuuccccaaagaggaauguaauguaaagugaaauaaaacuauaagcuauguuaaauaca

SEQ ID NO: 1014 - RNA, 430 nt, Homo Sapiens
guuugagcaaagcuguaggugauuugacaaaaucaucugcaaaaccagauuucuaacaccucccugcuguguaucucauuucugcugauguguggugcuucauaagauggggacguuaagcaugcagcaacuacagucauuuguucucagaggagggcauuuccacucugaauuuccaguuccaaacauuucaguuuuccaccaagacaucauuccuggguuugggauuccugaauuuucgucuggaccaaagagaaacaagaaaagcuggagucacacuaccaaaggccgaagcugagcaacagagcucuggagucagcugccuggguucagcaugcagcgcugccguggacgaucugucucucuugcauauaugacuuaccaguuuuacuuucagucucuccauuucuaauuaaaugagaugcagaaa

SEQ ID NO: 1015 - RNA, 447 nt, Homo Sapiens
cgggaucuuccuucuauugcccagugccccgugaagcccuugaacaaaaccagaagaaagugaaaaauaaacagccuuauacgguugucaucauccuauccccagugauggagccauacuugggucugaaauauuuugacacagaugaagcaagucuuugcaauuuccaaaggaaaggcuucugugacacacucucuuguuugaaggagugacaauaaccugagaauugcugguaguauuauuuguuguuauuacugucaucaaaagauauuuaauuagaaucucuuuuauaugugacugauaaagccagugaaauggucacacugauucuacaguaagccauuuuugagcaccuauuauacacaaagcacugugcaggaagguugcauaguaaguugagugugacccagacuccaacucugagaagcuuauaauagggugaaggag

SEQ ID NO: 1016 - RNA, 1650 nt, Homo Sapiens
cggaagagugggacguuauggaaccuucucagcuuauucagagaggcuucuucuuccuauuuagucucccucuggcuuucccugcugggaucugggugguagaagcagcagggggaucaacgaacaggcugagcgccaagaagccugaagauuccagaaucuagcgggaaaagcauucagagucagaaugaagagccccagaggcagagcugcccaaggcuuugggagcccaccucuugcaucacugugcccuggaugugagacguggaaucaaggagauuauuuuggagcuuuaagacguaauggcacccugcuggguuucagacuugaguggagccugcagccuuucuuucggccgguuucucccuuuuggaacgggaguauuuacccaaugccuguacccccaugacgugcccguguccccuuccuccaccacaagauuguaaguuuucuggagccuccccagaagcugagaagaagcugcuaugcuuccuguucagccugcagaaccgccacuuccagcaucgauggugucaggucagguccucuggguagaagaaauggagucaguuaggagugcuggagacugaguaagagguggcagcugaggcuuacuaccccaggaaagggaugccaccagagaaggcagacaaccaagauggcgacucucaauuuuugagcuccuaauuuucucaugucagacauaagaaaaaaaaauauuuuuuaaagaaaaagcuuuagguugcaaaaaucuaggccuuucaacuuuaaaauccuauucuugcaagccuuggagaauaaagcuuaugcauaaacaguagauuuggaaacagaaauaugccuaauuacccagagccauucuuucaauacgccagugauuguuuaaagauucuauaggcuggagucaauggcaggaggcgggugggaaaagagucaagagggaggagagaagaagcaagaggguuggguagauauugucacaugacccugagaggaggauucugggucaaaccccuaggggguuguguguaauggagacuccagauccauuugggaaucuggcuccaaagaagacuucaccuugccuucugaguggagcccugaaguggcaagacucauagaauucccccacggguccacacaagagagaaugaauagagaaggcugcgugcuggcuggaccaaggcagccucgggugacaccaccaccaccaccgccgcugccgccaucgccaucaccacugccgcugccaucaccgccaccaccaccaccaucaccaccaccaucaccacauuauggacaauagcccaauguuuccugaguucccuagaggguugaaagagaauaggaccuagagagaucacauaguugggacaggcacucauuaauuugauccaaugacaagagaccagaugggaagaaggaugccuugagagaugucagugugcacccauggauagaagcagcuggugacuggguacuugggaagccacauggacacacacaaagcuccuggaagacguuuucaaggaguugggcugugcugggauccagaacuggcugaagaaaccaugagcugacauaaaauuucugccaccuagcagaauggaggcuccauuuggaaauuaaauuauauacuuaaaaaaacua

SEQ ID NO: 1017 - RNA, 10673 nt, Homo Sapiens
cuuggggugcuuccuguuucucaguaaagugaaguugcggcgaccucgugccugccuuaugugcaccugugccagcaucuuucucaguuucacuccggcuggcccuggcucaucuccuugaggaggaaguguguguccucuccugcacgccucuccuuccuggggagcccuggcucacagcuggagccagcaggccuggaggcugcagacccuggacugggacuuguugcuuuugagagcuccccugaagccuggcuccucagguuuauucaaggagagcuuugcugagagcuggagcacgccagcaguggagcucguggccacccagccccugcucagacaggaggcugcggcccaggacuguguggcuggugggggccagggugggccaggccuggggcugccccguccuugccucccugggcccaugagcaucaacgucucuauagagaccaaggacccuggauuccuccagugacagggguuuggccucuggacagagaggucccggauguuacaggucagagcccuccagacccccaaggacuguacucacugcccagaaauagcugcugccucugggcaaccuuguaggcaccuucuccacccaggacaugggcacccgugacgauguccccgaagccaagguccugguccccguggccguguacugcgggagcaucccucggaccagugcugggccccgggugcucccgccuggaagcaucaacuccagucugccucauggagaagguucucuccagccugagccaagagcccugcugaacaacgaggaaccgucacagcuccugcguggacucggacagcuggguggccucaagcuggacaccccuuccaagggcuggcaggcaaggaauggucaccccaggaaccucagggccuugucuuugggggaccagccccuggugcuccucccuucuccggagucagaggccaacagcguggccagggacaccauccagauuaaggacaagcucaagaaaaggaggcucucagagggcuuggcagcgucuucccgagccucucuggauccagggggaggcccccaaggaguuccccugcacagcaccaucccccgagccaccucucagaggcugcugagggugcccaggccgaugccucucauccagagcaucccuaccaccccugaggccagcggagucaaagagaagggccuggaccuaccggggagcauuccggguccucacgaguugagacccggugcucaggaggcgcagaucuccuggcaauaccugcacugcaaugaugagaagaugcagaagucccugggcgccaucgugaucccacccaucccaaaggccaggacgguugcagcgacccccucccgugugccuggcucccuucccagcccguuaccuccaggccagggaguccucacaggccugagggccccacgcacgcgauuggcucgggggagugggccucgggagaagaccccugcaucucuggagccaaaaccuuuggccucacccaucagagacaggccugccgcugccaagaagccugcccugccuuuuucucagucugcucccacgcugacagccuucuccuuugacugugccagagaagccugcccuccgcugaaagaagaggaccagaaggagaucggcaccaagauccaagucaccaucuccaagucugcccgggagaagaugcagcugaagcagaugaaggagauggagcugcuucggaggcuggaggagcccaggacagggcaggagcucacuucccagugccugggcucccagagagccuucaugaaggaaggccuccuuccccuccggggcagcgggacacugucugugcccacuaggcugagcggcccaugcagaaacgacgucagcaucauccugaggaagugggccagccgggccucccugcccagcauccccaucagccggcaggagccccgcuuugcccgccacgccucagcaaggaagcagcugugaacagcagaaagaggaugagaggauuggggaagaccucgguuucuuuccuguugcuucauaaaaugucagggcuggacagcacuggcuacagacaggaaucagaggguccagagcuucuaccagggcaccucaggaaucgugccugggacauggggacgcucuguccccauucuaccagaggagcuucuauguugccucauuuuuuuuuuuuguauacugggcauucaugugagauuucauuuggaaagauuuugcuacugaaaaaaacuuaaaaacagucagcuugguucagaguuucucuaacucauuaccugcggugcucacguuggggucuccugaaugggaagaagaggaggagauggaucuuagagccuguaaggaguugaggccuuucucgaacccggagcuggggcugagggaugcacuccagugccucaacagcagugacuggcagaugaaggagaagggucuggugagcauccagcgcuuggcagccugucacucagagguccucaccgggaagcugcacgacgugugcuugguggugacuggggaggucaccaaccugcgguccaaggugucucaccuggccaucagcaccuugggagaccucuuccaggccuugaagaagaauauggaccaggaggccgaggagaucgcccgcugcuugcugcagaagauggcggacaccaacgaguucauccagagagcagccggccagucucugagggcuaugguggagaaugugacccuugcccgcucccuggugguccucaccucggcgggugucuaccaccggaaccccuugauccggaaauacgcggcugagcaccucucagcugugcuggagcagaucggcgcugagaagcuucucucgggcaccagagacagcacagacauguuggugcacaaccuggugaggcuggcacaggacuccaaccaggacaccagguuuauuuuauuaaucuauuuuuuaacuggguagggauugcuuuuguaauuagaaaaaguauuaaaaacucucuuuaauuaggaagauuauguaaagcuguaaagcaaauuuauuuugcauuucagaggcuguuucuuuaucuugcucucucuccuguggcagauuuuauggccggaagauggugaauaucuugauggcgaacacuaaguuugaugcauuucugaagcaaucucucccaucuuacgacuugcagaaggucauggcggccauuaaacagcagacuccuuuuggcucaugcucuguguguauuuuuucaagggaauagaagauaaugaugaacuucccucugccaaaggccgcaagguguugaggagucugguggugugugagaacgggcugcccaucaaggaggggcucagcugcaauggcccaaggcugguggggcugcgcuccacacugcagggccgcggggagaugguggagcagcuacgggagcugacacggcugcuggaggccaaggacuuccggucccggauggaaggcguggggcagcuccuggagcucugcaaggccaagacggagcuugucacugcccaccugguccaggucuuugaugcuuucaccccaaggcuucaggauuccaacaagaaagugaaccagugggcgcuggaguccuucgccaagaugaucccccuccucagagagagcuuacaccccaugcugcucuccaucaucaucacuguugcagacaaccucaacuccaagaacucagggauuuacgcugcugccguggcugugcuggaugcgaugguugagagccuggacaaccuuugccuucuaccagcgcuugcugggcgagugcguuuccugaguggccgugcggugcuggaugucacagaucgccuggcaggugagcacccccagccccaccccaccccaucuccuggcagauuucuguucucuccuggucugugguugaaccauucacccaguuaucuuagaccugaaauaaucccccccaaucauuuaaaauuuugaaaaucugcuuuuuuugugugugacaaucuccauauugccagaagacaaucuuuguuuuugaucaaaaugaaguagguuuguacaaaagcaaaaguguuuuuaaaaaacuguuacagguugaaucucccuaaucagaaaauuagaaaugcuccaaaaccugaaacuuuuugagcgcugacaugacauuaaaagaaaauguacauuggggcauuuccgauuucagauuuuuggauuagggaugcagaacugguaucaugaaaauauuccaaaaucagaaaaaaagccgaaguacuucugguaccaaacauuuuagauaagggacacucaaccugugugcguuucuuccuccuugcaaacaaggcugcuucuagccuauagaguaccuuugugugagucagaaaaaagccuccuuuuucagacagaccaugccuagugggugcauauggcuuggucaguugacagcaccaucaagagaauuagaaaaaguugccauguacaacuuuagcaugugcagccuggcaagcaggcaccagcuggguuucaaccccucaggaccccuuggccagugcugggacuguauuauguggagacggggccuuagccugagucuacucagccuugcucaagcuucagcuggugaaggguugcuccaauccuguuucugcuuugagucugcaggagaaguccaagugacuucauuccagggcugaaaucuguucuugugguccuugagguggcaacacagaaaggacacaggcuuugguguccacacacccaucugccaccaccagcccugaccuugggcagguuacuuaucuugguuucaugaucauuuuugcuugcacaaagccuccuccccugccuugggaaggucccaucuagggaggggggcagagggacucuguucccuagacucccgauggucccccugaaaugcagacagaucaugcaccagcccugcuuuaaucuuugugagacuccugagcugucuucaggauaguguccaggcccccuggaguggcccacagcugucacugcugcucuaggaugugccgccuuccucccaccccagcucuaugcucauugaauccucaugaccaccccacaggaggauguagauuccacuugguggagaaaaggagaauggagcucagaaaagugaaaugcacaaggucucuuggugaggagcccaggauguguccugggagccuggcugaagggccaagaccccaacccugugcugugcugcuucccccuggcacucugccuccugggugccugcaugcaguggccggucucucaacuucuugcucugcccacuuguggcugcccugcccggaaagccuucuccauucuucuuccucuaccugggggaugccugcuuggcucuggcauuaccuucucccugugugcuucucaagacugcaucccacaugguaucacuggucugucuacugcccuccccuccuagcccagcugugagcauccagagaggggccuggcacaugcugcauggcugaggaccuuggcaccagcugcccuuucagcuucuccccugccccaucucuugcgccuggccuugccucuaugcagguucuguccuuccagcauuccuggaguggccucuuaccuuacgggaaggcaggugcgagugaggcagggcuggcugcaggugagcugggggagaacaggguauguaaguaagaugguccuagacaccagacaaggaacccuuugccauugcucaaagucagcauuuucugcaugaaagguuuaccuguccuugucuggguaauuuacggggcccagaggugggcaaguaucuucaccuuauccacuuacuguaauuuuuucuugucuauuuccaagagaccucaaaagaagagcuucuccauaggucuucuguuaacucuguguccaccaggaacacagaagaaaauuuuuauugacacaggcgaggccuaauaauagcacagcuuaauaggaguaaaucuucugcuaauuacuucagcugcuucuaagcuugaguuuaauggggcuugcucccgcaugcuggcccccagaagggccucaccaucuuugccagcuuaagagucaacaccugccagccaggcgacugccacauccuugcaccuggggaauguggcucugaaguagccugaguucuauuagccaagacgugaucagagaagguggccugggcuguggaauugaguuuggguggggacugcuacucuuccuguggagugagcuuccugggggcugaaguguaaacacgccucacucuguggaagagaauucaaggagcaagaguggauaaaauguagcaggauggggaaggaggcucuguuggggggcagguagagcccccccagccuuugguggggguggggguggagggugcgugccuggguuuggcucuugagauaguucucacuuuucccugcuguauuagccuguucucaugcugcugauaaagacauauccgagacuggguaauuuauaaagaaaaagagguuuaauggacgaacaguuccauguugcuggggaggccucacaaucaugccacucaucuuacaugguggcaaggaagacagaauuugugcaggaaaauucccccuuauaaccuuuuaaaaccaucagaucucaugagacuuacuaucacaagaaguacaccggaaagaccugcccccaugauucaauuacuuccuaccggcucccucccaugacacguaggaauugugggagcuacaauucaagaugagauuuggguggggacacagccaaacuauaucaccccccauuaaaagaauuguguuaaaauacacaacauaaaauguaccaccuuaaccauuuuuaguuguacaguucagugguaguguccaugauuuuugcagucaucuuccgaacuguuaccuugcaaaacagaaacuacguccccauuaggcacuagcuccccauuccucccuuccccagucccuggcaaccaccaacuacuuucugucucuacgauuuuggcuauucuagguaugucauauaaauggaacuguacaguuugucuuuuugugucuggcuuaauucacacagcagaauguccucaagauuuauccauguuguagcgggugucagaauuuccuuccuuuuuuuuuuuuuuuuuucagagagauucucguucugucacccaggcuggagugcagugaugagaucucagcucacugcaaccucugucuccuagggucaagccauucucaugcuucaggcucccaaguaacugggauuacaggcgcccaccacaacacccagcuaauuuuuuuuuuuuuuuuuuuuuuuagacagagucuugcuuuguugcccaggcugggguguaguggcgcgaucucagcucacugcuaccccugccucccuggucccgguucaagcaauucuccuuccucagccucccaaguagcugggauuacagucacgcaccacuaugcccagcuaauuuuuguauuuuuuuuuuuuuuuuaguagagaugggguuucuccauguuggccaggcuggucuugaacuccugaccucgugauccacccgccuuggccucccaaagugcugggauuacaggcgugagccacugcgccuggcccgauuuuuguaguuuuaguagagacaggguuuugccauguuggccaggcuggucuugaacucuugaccucaagugauccacccaccugggacccccacagugcugggauuauagucaugaaccacagcaccuggccagaauucccuuccuuuugaaggcugaaaaacauuccauuaaauguauauaccacauuuuguuuauccauuccucaauggacacugggcugcuucugccuuuuggcgauugugaaaaagguugguauaaacacgggcauagaaaucucuguguucucaccuauuuuugcauuccauagggauucaggauacuuuugaguuaucguuauucaguguaggcggcuacucagggucauucguuuucuuuugguucccucucacugucccccuucuaguuuccccucaucucccacccuggggcugacagggacugcuuucuugucaccuguucucuuccuacucagccuguuucaagcacaaggaauagaacucucaacucuuuccaaccaguguaccucuuugcuccacuuuagaaagcuccuccaagcccuuuaccccaggauccuuuccuggggaaugcuggggugacccaaaaggugcaguccugcccuuccaguuaucaggaccaccuucaccucugaggauccugugacccucggagguucccugcaagagccccaagggugcagccucaaagccaacauuccuugauaaaugucaccaagagagugucaggcugaccagaggguggcccagggcaucuucccugguuccuccuuauuccaggcuggcuuugaaaucagagggacccguggggcucuaaggggaagguauccuaggggauuagaugaugugguccugaugaaggaaggacaaauugcaguuucaugaaaaauaaaacaagguggcucaccuaugaucccagcacuuugggaggucaagaugggcagauugcuuaagaccaggaguucaagaccagccuggguaacauaaugagacccccaucucuacaaaaaaaauuuuuaaaaaaauaacugagcguggaggcgcaugccuguggucccagcuacuggggaggcugaggcaggagaauuacuugagccuaggaggucgagacugcagugaaccgugaucgugccacucuacuccagccugggugacagagcaagacacugucucaauaaauaaauaaaacaaaaaauaaagcuccagaucaccucugaaauauggaaucccuagaaauuuggggacagcaugcgguagaaagaguguggacuuuggaguccaggcagauuaggccuuuguccucugcuuugcccuuugccuugauuugagucuugcuuuccuccucuggaaaacggacaagcauccugccucucaggggugcugugagcaugaaauggagcugugaugugaagcucugagcccugggcucaggcaguuuccaggauauggaaacuguuuuccacagaauucccggcccacagaaucaauaaagcgcugcuguuaguguuguuugccugccccagcacuuauccuucggcuggaugacaggcagagcaugugaaucgcaaagccagcuucgauagugcuaaugcgcuuaggauaaugcggccacagcugaaggccugagcagccccucuggggacccaggagagcccuugaugugguuuuaauguggccacagcccuggcauuuacucaggugaugaagagcugguuggcagauucagcuggcuucuggguuuuccgggguuuagagaggguugggggccuugggaaaccagauaugggggcuuaucacuggaauggucugugcagagcuugcugguucacaagcacguucaugccucugcugcuggucucguccugagguuuggcauccgggcaccggggaggcugugcuaggcuucuccccugccagcugucuugucugccagcaugcuucaugugagagggucuugauuucccuccccaguaguuuuucucuguauuuguguggacuuccauagguggugauguggauaaaugcaguauuacuauaguuacuauuugucaccugccugccuacagguaggcacuuuauguauauuaucgaauuucuaacaaucuggagagguugguucagcauuuuuauccuuacuuuauggguuuggaaaaggcucagaaaggucggguggcuuccucaugcugacacaguugaugggggcaggauuguaaccaggcgugccugccucuuuccuguucccugggcuggaggaaccauuaugauugucagagauucugcauauuucugccuuugcgugccccuuucuccauaaaaaauauuuaaaaauuauaguuucugacugguugguauaagcacagauauaaaccagguuggacauauucauauauuuucuacuaauguuaaaagaagcuaacacauuuucauaggcugcuaaaugugucaugauccuuaguugcugugccugcugggcugccagcccuuugggggacaaaguuggugucccaagagagggaagugggagagggagagagugccuggcucaagugacucuccuuuucugccugacagugcugguggccucaguuuacccccggaagccucaagcuguagagcggcauguccuucccauccucuggcacuuccugaacaccgccaccaggaauggcacccugccuggacccagcgggaacauccgcgggguggugugccggcuguccaggagccuccaggagcacaugggcucccgccugcuggacuuugccgccagccagccaaagcacguccucaagacgcuccaggaacucuuagacucagaguccuugggaggcagccgcaaggccacugacagagggguggccccugacagcaagacaacuggcagcucauacccuuuucagcuggauuaaagauggaucugaaaugggcaauuauuauuuaucuuauuuuuuugauggacuauucuccugguuacuuucccccuuagaguuccagauguacaugguauauuuugaaguagaaauaaaagaauuacuuauuuuucuaa

SEQ ID NO: 1018 - RNA, 7329 nt, Homo Sapiens
cgcucgcucucggccacccucgccgggccccgcugcggcgcgcgcugcaacccccggccggacgcgcggacccucaccuugcgcggcccgcuccccucgccccuccccgcuccccgggcuccgcgcuccccacccccacgcccuccuccugcucccagccacaaucggccggggucuggggccgcucagcugcccgcagagccuccucccucgccaccgacuuggucuccucccgccuuucccgggcucucggcagcucucgggggagcccgaacgcgcggggaaaggcgagccgcacggccgggggagggggccggaccgcgcgcgaccggucgcgcccgcuggggcccgcgauggcgggggccuggcucaggugggggcuccugcucugggcagggcuccucgcguccucggcgcacggccggcugcggaggaucaccuacguggugcacccgggccccggccuggcagccggcgccuugccccugagcgggcccccgcguucgcggacauucaacgucgcgcucaacgccagguacagccgcagcucggcggcugccggcgcccccagccgugccucccccgggguccccucggagaggacccggcgcacgagcaagccgggcggcgcggcccugcaggggcucagaccgccgccgccgccgccgccggagccugcgcgucccgcgguccccggcgggcagcuccaccccaaucccggcggccacccggcagccgccccguucaccaaacaaggcaggcaaguugugcgcuccaaggugccgcaggagacccagagcggcggaggcucuaggcugcagguucaccagaagcagcagcugcagggggucaaugucuguggagggcggugcugucauggcuggaguaaggccccuggcucccagaggugcaccaaaccuagcuguguuccgccaugucagaauggagggaugugucuccggccacaacucuguguguguaaaccagggaccaagggcaaagccugugaaacaauagcugcccaggacaccucgucaccagucuuuggagggcagaguccuggggcugcuuccucguggggcccuccugagcaagcagcaaagcauacuucaucuaagaaggcagacacucuaccaagagucagcccuguggcccagaugaccuuaacccucaagccgaagccuucagugggacucccccagcagauacauucucaagugacuccucuuucuucccagaguguggugauucaccauggccagacccaggaauacgugcucaagcccaaguacuuuccagcccagaaggggauuucaggagagcaguccacugaagguucuuucccuuuaagauaugugcaggaucaaguugcggcaccuuuucagcaaccccuuugcauuacaucugccugucaggguuggcucuuuaaucugucgugcccucgguauugcucuuugucugcccgugaauaaagugcagcauuguggagacaccacugaauacagagcagcgagcacugaaggcuucccucuuuccuuaaaccugucggguugugggcucucucuuuuccccucuugcuccuuucuuuucuuuuuuucuguuuuuuuaaaccuuccaaggcaaguucauggauacuaagcugauguguuuguuguucuuuuucucccugccuccgcuccuagugaguaaccacacuggccgcaucaagguggucuuuacuccgagcaucuguaaagugaccugcaccaagggcagcugucagaacagcugugagaaggggaacaccaccacucucauuagugagaauggucaugcugccgacacccugacggccacgaacuuccgagugguaauuugccaucuuccauguaugaaugguggccagugcaguucaagggacaaaugucagugcccuccaaauuucacaggaaaacuuugucagaucccaguccauggugccagcgugccuaaacuuuaucagcauucccagcagccaggcaaggcguuggggacgcaugucauccauucaacacauaccuugccucugaccgugacuagccagcaaggagucaaagugaaauuuccuccuaacauagucaauauccaugugaaacauccuccugaagcuuccguccagauacaucagguuucaagaauugauggcccaacaggccagaagacaaaagaagcucaaccaggccaaucccaagucucguaccaagggcuuccuguccagaagacccagaccauacauuccacauacucccaccagcaggucauuccucacgucuaccccguggcugcuaagacacagcuuggccggugcuuccaggaaaccauugggucacaguguggcaaagcgcucccuggccuuucaaagcaagaggacugcuguggaacuguggguaccuccuggggcuuuaacaaaugccagaaaugccccaagaaaccaucuuaucauggauacaaccaaaugauggaaugccuaccggguuauaagcggguuaacaacaccuuuugccaagauauuaaugaaugucagcuacaagguguaugcccuaauggugaguguuugaauaccaugggcagcuaucgauguaccugcaaaauaggauuugggccggauccuaccuuuucaaguuguguuccugaucccccugugaucucggaagagaaagggcccuguuaccgacuugucaguucuggaagacaguguaugcacccucugucuguucaccucaccaagcagcucugcuguuguagugugggcaaggccuggggcccacacugugagaaauguccccuuccaggcacagcugcuuuuaaggaaaucuguccugguggaauggguuauacgguuucuggcguucauagacgcaggccaauccaucaccauguagguaaaggaccuguauuugucaagccaaagaacacucaaccuguugcuaaaaguacucauccuccaccucucccagccaaggaagagccaguggaggcccugaccuucucccgggaacacgggccaggaguggcggagccagaaguggcaacugcacccccugaaaaggaaauaccuucauuggaucaagagaaaaccaaacuugagccuggucaaccccagcugucuccaggcauuuccacuauucaucugcauccacaguuuccagguauagugauugaaaaaacaucaccuccugugccuguugaaguagcuccugaagcuucuacgucuagugccagccaagugauugcuccuacucaagugacagaaaucaaugaauguacugugaacccugauaucuguggagcaggacacugcauuaaccuaccagugagauauaccuguauaugcuacgagggcuacagguucagugaacaacagaggaaauguguggauauugaugaguguacucagguccaacaccucugcucccagggccgcugugaaaacaccgagggaaguuucuugugcauuugcccagcaggauuuauggccagugaggaggguacuaacugcauagauguugacgaaugccugaggccggacgucuguggggaggggcacugugucaauacugugggggccuuccggugugaauacugugacagcggguaccgcaugacucagagaggccguugugaggauauugaugaauguuugaauccaagcacuuguccagaugagcagugugugaauucuccuggaucuuaccagugcguucccugcacagaaggauuccgaggcuggaauggacagugccuugauuauuuacuuuggcuccaaugcuuggcuucuucuuucaaguuguuugccuucaguguuuacagaaguggauucccacaaccaaggaaagggugguuaaugagucagucuggaagugcuauuuuuguuaucguggacuagagucagcucaccauaauuagugauauuuugugaaagcaacgcagagcaccuaggcagugccauuuccuuggcucuucucaguaugugcagggaacacacccgugugcacacucacagauacguguuugccacauuuuaguacaacuccguuucugcauuccacuauguggacgagugccuggaaccaaacgucugcgcaaauggugauuguuccaaccuugaaggcuccuacauguguucaugccacaaaggcuauacccggacuccggaccacaagcacuguagagauauugaugaaugucagcaagggaaucuauguguaaacgggcagugcaaaaauaccgagggcuccuucaggugcaccuguggacagggguaccagcugucggcagcuaaagaccagugugaagacauugaugaaugccagcaccgucaucucugugcucaugggcagugcaggaacacugagggcucuuuucaaugugugugugaccaggguuacagagcaucugggcuuggagaccacugugaagauaucaaugaaugcuuggaggacaagaguguuugccagagaggagacugcauuaauacugcaggguccuaugauuguacuuguccggauggauuucagcuagaugacaauaaaacaugucaagauauuaaugaaugugaacauccagggcucugugguccgcaaggggagugccuaaacacagaggguucuuuccauugugucugccagcaggguuucucaaucucugcagauggccguacgugugaagcuucuguuugaggagcugaagccucguugacaccagggcugaccugcccggcucuaagcagggcuaaauaacucccacauagcugaaggaaggagggcccuucccugauuucccgugacuuggagaagugucagcaucuggucguaguuaaugaaccacaaugaagaggcaaacucugucaacaugaauugucuuuaaguguagcauggcagcuucuauagcaauaaaaauggcaccacuggcauauugaugaauguguaaacaacacuguuugugacagucacggguuuugugacaauacagcuggcuccuuccgcugccucuguuaucagggcuuucaagccccacaggaugggcaaggguguguggaugugaaugaaugugaacugcucagugggguguguggugaagccuucugugaaaacguggaaggguccuuccugugcgugugugcugaugaaaaccaagaguacagccccaugacugggcagugccgcucccggaccuccacagauuuagauguagauguagaucaacccaaagaagaaaagaaagaaugcuacuauaaucucaaugacgccagucucugugauaauguguuggcccccaaugucacgaaacaagaaugcugcuguacaucaggcgugggauggggagauaacugcgaaaucuuccccugcccggucuugggaacugcugaguucacugaaaugugucccaaagggaaagguuuugugccugcuggagaaucaucuucugaagcugguggugagaacuauaaagaugcagaugaaugccuacuuuuuggacaagaaaucugcaaaaaugguuucuguuugaacacucggccuggguaugaaugcuacuguaagcaagggacguacuaugauccugugaaacugcagugcuuugauauggaugaaugucaagaccccaguaguuguauugauggccaguguguuaauacagagggcucuuacaacugcuucuguacucaccccaugguccuggaugcgucagaaaaaagauguauacgaccggcugagucaaacgaacaaauagaagaaacugaugucuaccaagauuugugcugggaacaucugagugaugaauacguguguagccggccucuugugggcaagcagacaacguacacugagugcugcugucuguauggagaggccuggggcaugcagugugcccucugcccccugaaggauucagaugacuaugcucagcuguguaacauccccgugacgggacgccggcagccauauggacgggacgccuugguugacuucagugaacaguauacuccagaagccgaucccuacuucauccaagaccguuuucuaaauagcuuugaggaguuacaggcugaggaaugcggcauccucaauggaugugaaaauggucgcugugugaggguccaggaagguuacaccugcgauugcuuugauggguaucacuuggauacggccaagaugaccugugucgauguaaaugaaugcgaugaguugaacaaccggaugucucucugcaagaaugccaagugcauuaacaccgaugguuccuacaaguguuugugucugccaggcuacgugccuucugacaagccaaacuacugcacuccguugaauaccgccuugaauuuagagaaagacagugaccuggagugaaacagaaucuacauaaccuaagcccauauacucugcacuguguaaaggaaaagggagaaauguauuauacuugagacauugcaccuaccccggaaggcuggaaauacagaaacagcauggaauugcaaguccucugaagacaaugagaggauuuaggaugagcccgauagguguggcagaccaaauggacauuucucuaaaaaaccaguauauauagucuguucauauguaaaauucaauggaagagagguggaacagugcuguuauuuuaaacagaagguuguauuauuauguuguuuuguuuuuuuacuauugcuugauuaaauuuggcauuuaaauagugguggaaauauuuuauauaauuuucauuuuuugguugugcaguuccuuggcuacuguuuuucuuuuacuucaguuuuuuaaaaaucucaaaugaaaaagucuucgauacaauauuguuaagcuguauuauaaguauuguuacacaggguuaugcaauucccggccuggagcauuuuugaaauucaaauugucuguccuguggagcaggcagugauuuuguuccaaaacuuuguauacacauuuggagaaaaguacuuuauauuuucaguguuuugucugauuuuaauguccguucuuagccaagcugcuagcagguguuaauuggaucccuuuccuucacugaaauggaagaguuuauaagcuuacguuaguauuguaauauguaaaguaagcccaacaaaaauuuuuaaaaauuugaugauccccaauauaucuaccauuguauguuaaauaaaucaccauuuuuguagaaaaaauucuaccugagaguaauugucaaugaguacauguguauaaguuguaucccacucuccccacuuuuaucuuuuccaguggucuucuguuaauguagugucuuuuacaaguuaaucauuaaauuuguuagaucuuguuaugggcuaaa

SEQ ID NO: 1019 - RNA, 2452 nt, Homo Sapiens
aguccucaucugcagugaugacaguaguagguggaacaugccuguccuugggcaacagggcagugcacgugccagcaccaagugguuccagaaguuuacgaagacaaaagaggaaugacgacucagcauauucuuuggagucuugcucuugcugccaggcuggagugcaguggcgggaucucggcucacugcaaccuccaccuuguggguucaagcaauucuccugccucagccucccgaguagcugggauuacagggagcguuccacuuggcugggagcagauaaugugugcaucccgagagcagacagaaccaagagcaggcaaacuuagaagacacucagcuaagcacuugcugacuucuuacagguucaccgaucagguaauuauccaguugauauuuaucuuguuccagucaccuuuagaaagcuguuuggugaguacaauguuaauauagagacaaucagaauggugugugcuuuuguacaaaacuuguggauccaucaaugaggcaucugccauuuuuucuuucuuccccucuauauuacaaguucuggaaugccuguucuaauucuccaaggagaauuagaaaauaaaaggcagagucuagagccaugucaauauccucccacagaauguguauggagaauauuccacugggaaccaugauagauaaaaacuuaccaggaagagcaaaacaucaagagagucugacaaaagcucugcccuccucuguaacccagcagccucugcagaaucauccuuucuucauuguuuuaaaauguuguuaaauaccuugucaguugcuuuaaagggacccagacccauucugauauuuuuacaaaauaaauccagucuuuggguaaagguauaguaauacuauccauggaucugaugcugcaaagauggcccugccuccaugccuuguugaacaugaugaugccccugggaaugggaggugaugguuuuuuacuucggcccuaguacagaguaugcucuugaagcuggauuccaucagcagagcucucaaaucuccaggcagccucuauugauugaucugaguuggcagaugaguuggcagauaggcuuuuuuuuuuuuuugaggaaaaagaagaaagagaaagagacaaaggaaaaggagaaagacaagagaggaagaagcaggaggaaaacaguggagagaagaagaaaaaagagaaaaaauaaauuacagcuaucugggcuuccaugggagugccaacucugacagcugagacaucucugacuuggcucuuucaccucuugugcaagggaagaacagcacuauuuuuaaaggaggucauuaguuuuggaaaucacuaguggguaaaaaagaccaauuugcaacuaggcucucaugcucuguugaaaacuaugucacaauaucacaauacuagaugcugggcucaagacagcaaacagaaagcaaggcagagagggagaaauaacaagaauggaagagucguucuuccaaaaagggccaucugugacccugagagauaaaccuggcagaccagggcucacaucuuaguaaaucaccuguaaauaaagcuugcaagggcagugacuggaagcugggagagagggucaacagcugaaucucagccugauggaggccaccauuuaauaaguaaauacaugcacggcuauuuagauccugcaucagacaggucaucagaaaacaugaagcuaaaugcaguaaagaauuacucucuugaacucuugaaaauaucaaaaacaugaagcuaaaugcaguaaagaauuagucucuugaacucuugaaaauaucauuuucuuauagaaaugguuuaaaaauuucuuuuuuauuauuucuaauuuuccuucagaaaauugugaguuuuaaccuacaacacauacacuccaagguaaugccacucuaaugcugucuaguugaucugaauaacuaacuggucaauuaucagauccaccaaacugucucucuggagauuaacuucugccagcauauugguuucuguucauuuucacaagauugacaggcucauuacagcaauauuaacaucuuccuuugagcacucacacugugcaauuguaauuuugcauauguugaugagcaggcaauuacaucaaagagugaacacugggcugaugugcaaggcacuauuuaauuauaaaaacaguauaggauugagcccugucacugagucuuccauuccuucuaucucgccuguuucuaauuuauuucucuauuucuucauuucuuccuugacugucuucauucuuugcuuuuuauuucuuucuccuuaaaugacagaccuuuucuuagaugccauuucucuaugucugcgcuuaagacaagaauuuuuuuccuccuaguuguugguuaaugucugcaaaugugagagcauguuaacaugacaaacaacaaggaauuugaaauaaacuuaaaugaaaca

SEQ ID NO: 1020 - RNA, 465 nt, Homo Sapiens
ccgaucgccucggaagccccguagaccaucacggacgccgagcuuccaguaacucacagugaaagcuuguuuaaugaagcuagcuucaaugcugugagcugcucuauagacgcccauguaggaggaaacucaaggggcccccagccacuagccauugaggaacugaggcccucaauccaacaacccacaaggaacugaauccugccaacaaccacugagugagccuggaagcggauccugcccagcugaaacucgagaagauuguagcucugcugcccugaccacuauucuaacugcacccuugagagagacccucagccagcuaaucuguaccuggauuccuaaccuggagaaacugaaauagcaacgcauguugauguaagugcuaaguuugggaguaauuuguuauguaacaauaaauaacuaauaauacuuauuauuuaggcaauaaaaccauagaaaaua

SEQ ID NO: 1021 - RNA, 81 nt, Homo Sapiens
cauccuccuuacgucccaccccccacuccuguuucuggugaaauauucaaacaggagugggggugggacauaaggaggaua

SEQ ID NO: 1022 - RNA, 824 nt, Homo Sapiens
aaugguuauucuggaaguacaucaguacguucaguagcagaaagaagagcaaggagaaguuggugaagcuggggcaaagugaggauaugugugcgugcagaucacucaguaugggaaauggauuguggaguaaucagaguggcuguggggagaccucuuaggaagaaauuacaguucaguauucuaaauaggaggaguagccacagagaugggaaaaaagugaaugaagucaaaacauaauucagaggagaggccucccuuuguucuucauagccaccuuuggauuugugagcccucacaucaggaucuacuaacaguuuauguccaugcugcagauauaaaggaugaaguuguagggcaggaagucuuauguaacuuggagcagcuacucaauggaaaucacaaacagaaugaguuucauccacaugucaagacacuacuaccaacagagcuauuucaggacaccuaccuaaauaacuagcugucucuuccacuuaaagcaagagcguauaauggaguuaggaugacuggauacacauguaagucaucaucuuuacgugcuuauugucacuuggaucuggcagguugacuauugaauaguacccgacuggcacuaauaaaauugcuaaacugcugugagagucuucucuuaucuucaagaagaauaaaaagugaagcugacauuacuuggaaagagaauaaacaaaaucugucaugaggacugcagggaugaaugacacaaaccagccauuucuuugagagucaggaaauaucuaguuuauacaauaagcugaucuaccaauaaaauacaauugguguugaaa

SEQ ID NO: 1023 - RNA, 74 nt, Homo Sapiens
augauuauaugagggacagaugccagaagcacugguuaugauuugcaucuggcauccgucacacagauaauuau

SEQ ID NO: 1024 - RNA, 8485 nt, Homo Sapiens
gcggccgccgcccagccaggugcaaaaugccgugucauugggagacuccgcagccggagcauuagauuacagcucgacggagcucgggaagggcggcggggguggaagaugagcagaagccccuguucucggaacgccggcugacaagcggggugagcgcagccggggcggggacccagccuagcccacuggagcagccggggguggcccguuccccuuuaagagcaacugcucuaagccaggagccagagauucgagccggccucgcccagccagcccucuccagcgaggggacccacaagcggcgccucggcccucccgaccuuuccgagcccucuuugcgcccugggcgcacggggcccuacacgcgccaagcaugcugagggucuucauccucuaugccgagaacguccacacacccgacaccgacaucagcgaugccuacugcuccgcgguguuugcagucuccgcggaggagcagcgaaggcgacagcucucuuggcgcggcugccugggagccgggcgcuugcugggugggugcucgggcccggugcucccgcucccgcccugacugcgcgccugugugccgccggggcugcccagccaugcugugcugccugcuggugagggccagcaaccuccccagugcgaagaaggaccggcgcagcgacccugucgcaagccugacuuuccgaggggugaagaagagaaccaaagucaucaagaacagcgugaacccuguauggaaugagggauuugaaugggaccucaagggcaucccccuggaccagggcucugagcuucaugugguggucaaagaccaugagacgauggggaggaacagguuccugggggaagccaaggucccacuccgagagguccucgccaccccuagucuguccgccagcuucaaugccccccugcuggacaccaagaagcagcccacaggggccucgcugguccugcagguguccuacacaccgcugccuggagcugugccccuguucccgcccccuacuccucuggagcccuccccgacucugccugaccuggauguaguggcaggcgggggacagagccgggccgagacuuggucccugcucagugacagcaccauggacacgagauacucuggaaagaaguggccggcccccacggacacaggaggagaggaagacacagaggaccagggacucacuggagaugaggcggagccauuccuggaucaaagcggaggcccgggggcucccaccaccccaaggaaacuaccuucacguccuccgccccacuaccccgggaucaaaagaaagcgaagugcgccuacaucuagaaagcugcugucagacaaaccgcaggauuuccagaucaggguccaggugaucgaggggcgccagcugccgggggugaacaucaagccuguggucaagguuaccgcugcagggcagaccaagcggacgcggauccacaagggaaacagcccacucuucaaugagacucuuuucuucaacuuguuugacucuccuggggagcuguuugaugagcccaucuuuaucacggugguagacucucguucucucaggacagaugcucuccucggggaguuccggauggacgugggcaccauuuacagagagccccggcacgccuaucucaggaaguggcugcugcucucagacccugaugacuucucugcuggggccagaggcuaccugaaaacaagccuuugugugcuggggccuggggacgaagcgccucuggagagaaaagaccccucugaagacaaggaggacauugaaagcaaccugcuccggcccacaggcguagcccugcgaggagcccacuucugccugaaggucuuccgggccgaggacuugccgcagauggacgaugccgugauggacaacgugaaacagaucuuuggcuucgagaguaacaagaagaacuugguggaccccuuuguggaggucagcuuugcggggaaaaugcugugcagcaagaucuuggagaagacggccaacccucaguggaaccagaacaucacacugccugccauguuucccuccaugugcgaaaaaaugaggauucguaucauagacugggaccgccugacucacaaugacaucguggcuaccaccuaccugaguaugucgaaaaucucugccccuggaggagaaauagaagaggagccugcaggugcugucaagccuucgaaagccucagacuuggaugacuaccugggcuuccuccccacuuuugggcccugcuacaucaaccucuauggcagucccagagaguucacaggcuucccagaccccuacacagagcucaacacaggcaagggggaagguguggcuuaucguggccggcuucugcucucccuggagaccaagcugguggagcacagugaacagaagguggaggaccuuccugcggaugacauccuccggguggagaaguaccuuaggaggcgcaaguacucccuguuugcggccuucuacucagccaccaugcugcaggauguggaugaugccauccaguuugaggucagcaucgggaacuacgggaacaaguucgacaugaccugccugccgcuggccuccaccacucaguacagccgugcagucuuugacgggugccacuacuacuaccuacccugggguaacgugaaaccugugguggugcugucauccuacugggaggacaucagccauagaaucgagacucagaaccagcugcuugggauugcugaccggcuggaagcuggccuggagcagguccaccuggcccugaaggcgcagugcuccacggaggacguggacucgcugguggcucagcugacggaugagcucaucgcaggcugcagccagccucugggugacauccaugagacacccucugccacccaccuggaccaguaccuguaccagcugcgcacccaucaccugagccaaaucacugaggcugcccuggcccugaagcucggccacagugagcucccugcagcucuggagcaggcggaggacuggcuccugcgucugcgugcccuggcagaggagccccagaacagccugccggacaucgucaucuggaugcugcagggagacaagcguguggcauaccagcgggugcccgcccaccaaguccucuucucccggcggggugccaacuacuguggcaagaauugugggaagcuacagacaaucuuucugaaauauccgauggagaaggugccuggcgcccggaugccagugcagauacgggucaagcugugguuugggcucucaguggaugagaaggaguucaaccaguuugcugaggggaagcugucugucuuugcugaaaccuaugagaacgagacuaaguuggcccuuguugggaacuggggcacaacgggccucaccuaccccaaguuuucugacgucacgggcaagaucaagcuacccaaggacagcuuccgccccucggccggcuggaccugggcuggagauugguucguguguccggagaagacucugcuccaugacauggacgccggucaccugagcuucguggaagagguguuugagaaccagacccggcuucccggaggccaguggaucuacaugagugacaacuacaccgaugugggacguauguugucaaguugcaucuuuucugccucccugcucacaucugucugucuccucucauugcuugccuguucgguuuuguccuuagaacggggagaaggugcuucccaaggaugacauugagugcccacugggcuggaagugggaagaugaggaaugguccacagaccucaaccgggcugucgaugagcaaggcugggaguauagcaucaccauccccccggagcggaagccgaagcacugggucccugcugagaagauguacuacacacaccgacggcggcgcugggugcgccugcgcaggagggaucucagccaaauggaagcacugaaaagggugagccagcagguggugggugggagugaggccuguggucacagguggccaguaggcacagaugcagaccugcaugcccacagacacaugcaugugugcacacagcaugcacagacaccugggacucacuggaggugcucacagaucacacccagcauacccaaagaucacaccccacaggcaggcggaggcggagggcgagggcugggaguacgccucucuuuuuggcuggaaguuccaccucgaguaccgcaagacagaugccuuccgccgccgccgcuggcgccgucgcauggagccacuggagaagacggggccugcagcuguguuugcccuugagggggcccugcagaugguccagacggugaccagagcaguagggagccaguaugaguuguugacaagaagagugcucuggucagagcuaggcuuuaggaccaucagucaagcagccauggaggaugcuugggaggcagagccucccaucaggaaaccccaggagucuuguguagagauccaggagagagacuguccugagggaucacugaaacuaggcgugaagucagcagccaugggcgggugauggauuguaauucaccugugacuugccuaugauacauggaagagaccaaaguggcaaagccccgaguccugggacagcuuggcuggcagagagaaccagaaagggaggcgguggcuucagagggcagaucccacagaccugcagcuggaggaccagagaguuuuggaagguuuaggaaauggagcaggcgacaguuuggguagugggcaggagggagaggagagaggcacauggagaaauuugaggcggcgugauggaugacaagagugaagauuccauguccgucuccaccuugagcuucggugugaacagacccacgauuuccugcauauucgacuaugggaaccgcuaccaucuacgcugcuacauguaccaggcccgggaccuggcugcgauggacaaggacucuuuuucugaucccuaugccaucgucuccuuccugcaccagagccagaagacggugguggugaagaacacccuuaaccccaccugggaccagacgcucaucuucuacgagaucgagaucuuuggcgagccggccacaguugcugagcaaccgcccagcauugugguggagcuguacgaccaugacacuuauggugcagacgaguuuaugggucgcugcaucugucaaccgagucuggaacggaugccacggcuggccugguucccacugacgaggggcagccagccgucgggggagcugcuggccucuuuugagcucauccagagagagaagaguaugaugugaacccgaauaaguagacugaauaggaguagggcugcucugggugaagugucuggaggaaugggcacagugccagccuagcaucccuucuacccucaaggaauagaggcugcaaaccauggacugucugaucacugacauaguccaugagugucaugagggugaugggggccuuaggugacaagcacaugaccagagcucucuuuucuucacuccagccggccauccaccauauuccugguuuugagcuagugcgccuugauacuaauagagaacuuuuuccccuuccaaccccucucaccaucuccuggaugugccacaucccauggcugugggccaggugcaggagacaucaaggauccuggaugagagaugauaacccggaagggucugagccaggaggcaggagaaccaggcuggcgggcaggcacaugguccucucugggacugagaggggcugaaguggaucugccaggauggaauaggcagugugugcacgcauaugcuguucugaggacacagaccugcccuacccaccaccccagagggaggccaacaucuacaugguuccucagaacaucaagccagcgcuccagcguaccgccaucgagauccuggcauggggccugcggaacaugaagaguuaccagcuggccaacaucuccucccccagccucgugguagagugugggggccagacggugcaguccugugucaucaggaaccuccggaagaaccccaacuuugacaucugcacccucuucauggaagugaugcugcccagggaggagcucuacugcccccccaucaccgucaaggucaucgauaaccgccaguuuggccgccggccuguggugggccaguguaccauccgcucccuggagagcuuccugugugaccccuacucggcggagaguccauccccacaggguggcccagacgaugugagccuacucaguccuggggaagacgugcucaucgacauugaugacaaggagccccucauccccauccagcuugcagacggucugucgagcuuggcccccacuaacacggcuucuccuccauccaguccucaugaggaagaguucaucgauugguggagcaaauucuuugccuccauaggggagagggaaaagugcggcuccuaccuggagaaggauuuugacacccugaaggucuaugacacacagcuggagaauguggaggccuuugagggccugucugacuuuuguaacaccuucaagcuguaccggggcaagacgcaggaggagacagaagauccaucugugauuggugaauuuaagggccucuucaaaauuuauccccucccagaagacccagccauccccaugcccccaagacaguuccaccagcuggccgcccagggaccccaggagugcuugguccguaucuacauuguccgagcauuuggccugcagcccaaggaccccaauggaaagugugauccuuacaucaagaucuccauagggaagaaaucagugagugaccaggauaacuacauccccugcacgcuggagcccguauuuggaaagauguucgagcugaccugcacucugccucuggagaaggaccuaaagaucacucucuaugacuaugaccuccucuccaaggacgaaaagaucggugagacggucgucgaccuggagaacaggcugcuguccaaguuuggggcucgcuguggacucccacagaccuacugugucucuggaccgaaccaguggcgggaccagcuccgccccucccagcuccuccaccucuucugccagcagcauagagucaaggcaccuguguaccggacagaccguguaauguuucaggauaaagaauauuccauugaagagauagaggcuggcaggaucccaaacccacaccugggcccaguggaggagcgucuggcucugcaugugcuucagcagcagggccuggucccggagcacguggagucacggccccucuacagcccccugcagccagacaucgagcaggggaagcugcagaugugggucgaccuauuuccgaaggcccuggggcggccuggaccucccuucaacaucaccccacggagagccagaagguuuuuccugcguuguauuaucuggaauaccagagaugugauccuggaugaccugagccucacgggggagaagaugagcgacauuuaugugaaagguuggaugauuggcuuugaagaacacaagcaaaagacagacgugcauuaucguucccugggaggugaaggcaacuucaacuggagguucauuuuccccuucgacuaccugccagcugagcaagucuguaccauugccaagaaggaugccuucuggaggcuggacaagacugagagcaaaaucccagcacgagugguguuccagaucugggacaaugacaaguucuccuuugaugauuuucugggcucccugcagcucgaucucaaccgcaugcccaagccagccaagacagccaagaagugcuccuuggaccagcuggaugaugcuuuccacccagaaugguuugugucccuuuuugagcagaaaacagugaagggcugguggcccuguguagcagaagagggugagaagaaaauacuggcgggcaagcuggaaaugaccuuggagauuguagcagagagugagcaugaggagcggccugcuggccagggccgggaugagcccaacaugaacccuaagcuugaggacccaaggcgccccgacaccuccuuccugugguuuaccuccccauacaagaccaugaaguucauccuguggcggcguuuccggugggccaucauccucuucaucauccucuucauccugcugcuguuccuggccaucuucaucuacgccuucccgaacuaugcugccaugaagcuggugaagcccuucagcugaggacucuccugcccuguagaaggggccgugggguccccuccagcaugggacuggccugccuccuccgcccagcucggcgagcuccuccagaccuccuaggccugauuguccugccagggugggcagacagacagauggaccggcccacacucccagaguugcuaacauggagcucugagaucaccccacuuccaucauuuccuucucccccaacccaacgcuuuuuuggaucagcucagacauauuucaguauaaaacaguuggaaccacacagca

SEQ ID NO: 1025 - RNA, 1845 nt, Homo Sapiens
auucacuccagugaccaucccugagaucuuuuuauaaaaaacccagucuuugcugaccagacaaagcauaccagaucucaccagagagguaagugggagcugagagaagaugagaccuguggaagggcaaccucacauaauacaggagaacgcaugggagggucccuuccucagggagcacaggagcucugagacucagcaaggcuguacugggaggucucagggaugguccuaggggacuacagaaggaaaaagacaagaggcaguaggauaucuguguguccucccgcugaccacacuuccuuuagugacccgauugccuccucaagucgcagacacuaugcugccucccauggcccugcccaguguguccuggaugcugcuuuccugccucauucuccugugucagguucaaggugagauuucucugccucuagcacuggguucccuaugaauccucagagccaagaaaaggaggaaggcuccugugugucacgugagguaaugacguggugucuaaugaaacugccugcaguuccugcaucaucacuccuuccuucauguuaacuugcagugggaggcuccacugugguccacuaacaauggaaugagauggcuuccauuuagucaguggacucuaauauacacuggugggaaaguguggagggucagcaaugagauguggggagggacaaugauuggaggacccaauauagagauagcccacagugaagagaguguugaaugguugaauaaggggaaaggguaauaacagacuagaugguggcccauuuaguagggcuauuuugagauaaagaacuucugaaaacacaagggaagaugaagagcugucaggaauguggucuuccuccccaagggcagaccuagauauuccccaaggucaucucccacccacccccuacucuucauuuuacucucucccuuuucuuccaccccaggugaagaaacccagaaggaacugcccucuccacggaucagcugucccaaaggcuccaaggccuauggcucccccugcuaugccuuguuuuugucaccaaaauccuggauggaugcagaugugagugguuagaugugggguuggaggugauaggggaaaguccaugcaggucucagggggaggagggucuccuucaggagaguuccuugggaaugaggaugaacacgcuuaucuuucacacagucccuggcuugccagaagcggcccucuggaaaacuggugucugugcucaguggggcugagggauccuucguguccucccuggugaggagcauuaguaacagcuauucauacaucuggauugggcuccaugaccccacacaggugcgaguauauccuccccucucuguuaccucucaagguacuguuguugcccaggcgcacucccuguccccagucccugggcucugagccugauggagauggaugggaguggaguagcacugaugugaugaauuacuuugcaugggagaaaaaucccuccaccaucuuaaacccuggccacugugggagccugucaagaagcacaggauuucugaaguggaaagauuauaacugugaugcaaaguuacccuaugucugcaaguucaaggacuagggcaggugggaagucagcagccugagcuuggcgugcagcucaucauggacaugagaccagugugaagacucacccuggaagagaauauucuccccaaacugcccuaccugacuaccuugucaugauccuccuucuuuuuccuuuuucuucaccuucauuucaggcuuuucucugucuuccaugucuugagaucucagagaauaauaauaaaaauguuacuuuauacgua

SEQ ID NO: 1026 - RNA, 137 nt, Homo Sapiens
caggcugugaugauuggcgcagggguacggaccucagcugagucaugggagcugaauguauguguuucuccuuuguccugcauguggcaggcugauggggagcacuuacaugagacuguugccucaaucugagccug

SEQ ID NO: 1027 - RNA, 456 nt, Homo Sapiens
auggaagccccagcacagcuucucuuccuccugcuacucuggcucccagauaccaccggagaaauuguaaugacacagucuccagccacccugucuuugucuccaggggaaagagccacccucuccugcagggccagucagaguguuagcagcagcuacuuauccugguaccagcagaaaccugggcaggcucccaggcuccucaucuauggugcauccaccagggccacuggcaucccagccagguucaguggcagugggucugggacagacuucacucucaccaucagcagccugcagccugaagauuuugcaguuuauuacugucagcaggauuauaacuuaccucccacagugauucaacaugaaacaaaaaccucaacaagaccaucaguguuuacuagauuuuaccagcugcuuccuuuacagacagcuaauguggccacucaguuuuag

SEQ ID NO: 1028 - RNA, 336 nt, Homo Sapiens
augcucugggucccuggauccagugaggauauugugaugacccagacuccacucucccugcccgucaccccuggagagccggccuccaucuccugcaggucuagucagagccucuuggauagugaugauggaaacaccuauuuggacugguaccugcagaagccagggcagucuccacagcuccugaucuauacgcuuuccuaucgggccucuggagucccagacagguucaguggcagugggucaggcacugauuucacacugaaaaucagcaggguggaggcugaggauguuggaguuuauuacugcaugcaacguauagaguuuccuuccaca

SEQ ID NO: 1029 - RNA, 443 nt, Homo Sapiens
gucagucucagucaggacacagcauggacaugaggguccccgcucagcuccuggggcuccugcuacucuggcuccgaggugccagaugugacauccagaugacccagucuccauccucccugucugcaucuguaggagacagagucaccaucacuugccgggcaagucagagcauuagcagcuauuuaaauugguaucagcagaaaccagggaaagccccuaagcuccugaucuaugcugcauccaguuugcaaaguggggucccaucaagguucaguggcaguggaucugggacagauuucacucucaccaucagcagucugcaaccugaagauuuugcaacuuacuacugucaacagaguuacaguaccccucccacaguguuacaagggaccagugggucaggcacauauuuuaaacucaaaauuagcaggguggaggcu

SEQ ID NO: 1030 - RNA, 353 nt, Homo Sapiens
auggacaugaggguccccgcucagcuccuggggcuccuacugcucugggucccaggugccagaugugacauccaguugacccagucuccauccucccugucugcaucuguaggagacagagucaccaucacuugccgggugagucagggcauuagcaguuauuuaaauugguaucggcagaaaccagggaaaguuccuaagcuccugaucuauagugcauccaauuugcaaucuggagucccaucucgguucaguggcaguggaucugggacagauuucacucucacuaucagcagccugcagccugaagauguugcaacuuauuacggucaacggacuuacaaugccccucc

SEQ ID NO: 1031 - RNA, 440 nt, Homo Sapiens
auguucgcagagcacagcccccugcccugaagacuuauuaauaggcuggucgcacccugugcaggagucagucccaaccaggacacagcauggacaugagggucccugcucagcuccuggggcuccugcugcucuggcucucaggugccagaugugacauccagaugacccagucuccauccucccugucugcaucuguaggagacagagucaccaucacuugccaggcgagucaggacauuagcaacuauuuaaauugguaucagcagaaaccagggaaagccccuaagcuccugaucuacgaugcauccaauuuggaaacaggggucccaucaagguucaguggaaguggaucugggacagauuuuacuuucaccaucagcagccugcagccugaagauauugcaacauauuacugucaacaguaugauaaucucccu

SEQ ID NO: 1032 - RNA, 402 nt, Homo Sapiens
uugacugaucaggacuccucaguucaccuucucacaaugaggcucccugcucagcuccuggggcugcuaaugcucugggucucuggauccaguggggauauugugaugacucagucuccacucucccugcccgucaccccuggagagccggccuccaucuccugcaggucuagucagagccuccugcauaguaauggauacaacuauuuggauugguaccugcagaagccagggcagucuccacagcuccugaucuauuuggguucuaaucgggccuccggggucccugacagguucaguggcaguggaucaggcacagauuuuacacugaaaaucagcagaguggaggcugaggauguugggguuuauuacugcaugcaagcucuacaaacuccucccaca

SEQ ID NO: 1033 - RNA, 390 nt, Homo Sapiens
aauuaggacuccucaggucaccuucucacaaugaggcuccuugcucagcuucuggggcugcuaaugcucugggucccuggauccaguggggauauugugaugacccagacuccacucuccucgccugucacccuuggacagccggccuccaucuccuucaggucuagucaaagccucguacacagugauggaaacaccuacuugaguuggcuucagcagaggccaggccagccuccaagacuccuaauuuauaagguuucuaaccgguucucuggggucccagacagauucaguggcaguggggcagggacagauuucacacugaaaaucagcaggguggaagcugaggaugucgggguuuauuacugcacgcaagcuacacaauuuccu

SEQ ID NO: 1034 - RNA, 445 nt, Homo Sapiens
gcaugucccucccagccgcccugcaguccagagcccauaucaaugccugggucagagcucuggggaggaacugcucaguuaggacccagagggaaccauggaaaccccagcgcagcuucucuuccuccugcuacucuggcucccagauaccaccggagaaauuguguugacgcagucuccagccacccugucuuugucuccaggggaaagagccacccucuccugcggggccagucagaguguuagcagcagcuacuuagccugguaccagcagaaaccuggccuggcgcccaggcuccucaucuaugaugcauccagcagggccacuggcaucccagacagguucaguggcagugggucugggacagacuucacucucaccaucagcagacuggagccugaagauuuugcaguguauuacugucagcaguaugguagcucaccu

SEQ ID NO: 1035 - RNA, 378 nt, Homo Sapiens
aggaaucagacccagucaggacacagcauggacaugaggguccucgcucagcuccuggggcuccugcugcucuguuucccaggugccagaugugacauccagaugacccagucuccauccucacugucugcaucuguaggagacagagucaccaucacuugucgggcgagucaggguauuagcagcugguuagccugguaucagcagaaaccagagaaagccccuaagucccugaucuaugcugcauccaguuugcaaaguggggucccaucaagguucagcggcaguggaucugggacagauuucacucucaccaucagcagccugcagccugaagauuuugcaacuuauuacugccaacaguauaauaguuacccu

SEQ ID NO: 1036 - RNA, 394 nt, Homo Sapiens
gggucagagcucuggggaggaacugcucaguuaggacccagacggaaccauggaagccccagcgcagcuucucuuccuccugcuacucuggcucccagauaccacuggagaaauagugaugacgcagucuccagccacccugucugugucuccaggggaaagagccacccucuccugcagggccagucagaguguuagcagcaacuuagccugguaccagcagaaaccuggccaggcucccaggcuccucaucuauggugcauccaccagggccacuggcaucccagccagguucaguggcagugggucugggacagaguucacucucaccaucagcagccugcagucugaagauuuugcaguuuauuacugucagcaguauaauaacuggccu

SEQ ID NO: 1037 - RNA, 2484 nt, Homo Sapiens
uucgugaccaacaccccaggcaaggcuuggggcccccgucugcugcuggacaguaaguccuggccccguggcagugaaucuguggggugcucugauugugggcacuauggaagcuaaaccccaugcuccaggugggguggagggccuucagaggacuccuggacagugccaggcucuaggcugaggugggggacacaggagaaaccaggccaggcccaucccuacuggagcuucucccuaagcaguggaggcucagccacugugaggagguaggcaaggcccugcagaaagagggguguggaaaucugggggcucccaggaagggccgcugcuggagaugggguucuuaccaggaugggcucugaagauaagcagggaggauuugggagggcagagaugaggcccagagcuucuggcagagggcauggccugcacaaaggucugggggccggacagccugcacguguucugggaagcgggaaggagacacaggccuuguguuucugaggcccaacuuuagacugugcccugcuggggaggugccagggaaugucugaggcugggccugacccugcuccuuaccccaugggagcagcagagccaugaagaagaaguuaguggugcugggccugcuggccgugguccuggugcuggucauugucggccucugucucugacugcccucagccuccaaggaaccugacaaccauguguacaccagggcugccguggcugcagaugccaagcagugcucggagauugggaggagggcugucgguggcagugccuggggagauccgaggcuaugagcuggcacaccagcagcaugggcggcugcccugggcucgccucuuccagcccagcauccagcuggcccgccagggcuuccccgugggcaagggcuuggcagcagcccuggaaaacaagcggaccgucaucgagcagcagccugucuugugguaugucugugggugcagcccccugacacaggcagggcaggcacagcccaaggaccuugcaggccguagcagcaguggagcggcccucugccuucaggacccugcgcugauaaugggaugaggagauacagacccuucccaccacauguggggacacauucugagcauggggucccaguggccacuguggcuggccauguguccugaguggcaagggacacuaggagguucccggaagggacacuaggaggacgagcgcugagugacagggccacccacccgugacaggcgcugccccugcuuugugcuggucuccugugugggcagguguggggguuggucuagcuaaguccaccccaccugcugccucacaugagcccccucugccccagugagguguucugccgggauagaaaggugcuuugggagggggagagacugauccugcugcggcuggcugacaccuaugagacgcuggccauugagggugcccaggccuucuacaacggcagccucauggcccagauugugaaggacauccaggcggcuggugaguggguaaccucaagggccugggugaggaacucugcaguggaaacccugagcuguagcccagagccaugggguccuccugucuugccugagccugcaggaaguuccugguggaggagggucagugacuggccauguggguccacagcuccugcuuauaucaaaaccaagagaggccacacaguccaggagagcaagucccuguugggguaaaugcagguguaggcaagagccagggcuagggaagcgcuagaauacagccugaagauccaggaggacuucuuggaggaggugguggcugggcugcagauaacuucguuaggcagagagaggaagggauuccuagcagaggaacagcugggcuaaggcccaguagagggggcuuugauucaccaagaggguuacaagggaugaggguugcuuugagagaggcauggggaaggggauuuguggagcaggggccuggagcuuggcuguggcuuucuucagguaauuuuugucacuguuucauggaggagggugauuagcgugucaaccuuuaccacugaggcuggaaauuggcaugccaauacccugucugucuggagcugacuccaggagaauuaagagccucccucccucccucuauccauucaucgugaggagaagaggccaagcagcagggacaccggcaggaauucuccaguuagaaaaggcccucugagccaggugcgguggcucacgucuguaaucccagcacuuugggaggccgagguggguggaucaccugaggucaggaguucaagaccagccuggccaacauggugaaacccugucucuacuaaaaaugcaaaauuagucaggcaugguggguugugccuguaaucccagcuacuugggaggcuguggcaggagaaucgcuagaaccuggggggcugagguugcagugagccgagauugcaccacugcacuccacagagugagacuccaucuc

SEQ ID NO: 1038 - RNA, 7083 nt, Homo Sapiens
gaaacauuuaccagauguguggcuugaguguccauucccgcaacaaaaacgcucugcaguaaagcuccgagauggcuguguuuguguuggacugcucuagaugcacaacccuccuggacaaagcguuuuuccucagccuucaccacccauggaggaggugugauuaccucuauucacagaaaggagacugggacccaaccaaggcaagucauuugcuucagaccacagagcaaagaaucauucugucauuccagaaauauuugucaggcgccccuggugugucagauuggcagcucuucacuuguaucuuuucauaucaaaaaugggaggugacacccaguuuaaggaaaauuccaaggcauuugucucgacuaaugugaaagaugauuacaguggccagaggacugccaaggcuccuucucaagcugcuugagucaaugaggacggccgagggauuaaagcccuaagaggcugugacacagccaucuccaaaaccccacuuucuccuuccuuugagccuccguaccagcuggggcguccggcaagaugugaguugucacucugcugcggcacagaccugaauuaacaacucuagcuagggcugacuucaaaaagcacuuucguuuuuuaauaaccaacaucagcucagcaggcuucauuugggaaaagaaaccuugucggauuaccccgacauucuccaccuccugggaggccagccauucccaaaugccccaaggaugaagaacggagacgcuucuuggaggauggcccaugaagaccuccaaacaagcuggaggggccagucacuugcugaagacuagcgaaguggagggggaaagcccgagggagcugcagacucgaccacugcgcccuccccuccucucccugcaaggagcccaaggugugauccugccaggcguucguucgcugcaugaccuuggccauccuuccauuccccugggugugaauucucauuggcaaaagucggagagagccccuggccaggcaccaagcuccagaggucgcucuggcgagcguuugcuucgggaucugaugcccuggagucgccaacucaauucgcgggucgcagccaggcuccauggggguaguagagccaggucguaguggcuaggccggagccgacucggagcgcgcggcgccggccgggaggagccggagagcggccgggccgggcggugggggcgccggccugccccgcgcgccccagggagcggcaggaaugugacaaucgcgcgcccgcgcaccgaagcacuccucgcucggcuccuagggcucucgccccucugagcugagccggguuccgcccggggcugggaucccaucacccuccacggccguccguccagguagacgcacccucugaagauggugacucccuccugagaagcuggaccccuugguaaaagacaaggccuucuccaagacuuaaaacacacuucacgcagucacagaaagagcucauagaccagacugcggggcuucaaagccuucuaucuuauuuaaucaucuguaaauaguuuaaagaagaauaugaaaguguuacucagacuuauuuguuucauagcucuacugauuucuucucuggaggcugauaaaugcaaggaacgugaagaaaaaauaauuuuagugucaucugcaaaugaaauugauguucgucccuguccucuuaacccaaaugaacacaaaggcacuauaacuugguauaaagaugacagcaagacaccuguaucuacagaacaagccuccaggauucaucaacacaaagagaaacuuugguuuguuccugcuaagguggaggauucaggacauuacuauugcgugguaagaaauucaucuuacugccucagaauuaaaauaagugcaaaauuuguggagaaugagccuaacuuauguuauaaugcacaagccauauuuaagcagaaacuacccguugcaggagacggaggacuugugugcccuuauauggaguuuuuuaaaaaugaaaauaaugaguuaccuaaauuacagugguauaaggauugcaaaccucuacuucuugacaauauacacuuuaguggagucaaagauaggcucaucgugaugaauguggcugaaaagcauagagggaacuauacuugucaugcauccuacacauacuugggcaagcaauauccuauuacccggguaauagaauuuauuacucuagaggaaaacaaacccacaaggccugugauugugagcccagcuaaugagacaauggaaguagacuugggaucccagauacaauugaucuguaaugucaccggccaguugagugacauugcuuacuggaaguggaaugggucaguaauugaugaagaugacccagugcuaggggaagacuauuacaguguggaaaauccugcaaacaaaagaaggaguacccucaucacagugcuuaauauaucggaaauugaaaguagauuuuauaaacauccauuuaccuguuuugccaagaauacacaugguauagaugcagcauauauccaguuaauauauccagucacuaauuuccagaagcacaugauugguauaugugucacguugacagucauaauuguguguucuguuuucaucuauaaaaucuucaagauugacauugugcuuugguacagggauuccugcuaugauuuucucccaauaaaagcuucagauggaaagaccuaugacgcauauauacuguauccaaagacuguuggggaagggucuaccucugacugugauauuuuuguguuuaaagucuugccugaggucuuggaaaaacaguguggauauaagcuguucauuuauggaagggaugacuacguuggggaagguauguguguaauggaacagaguaaaggcuuauuguuguaaaacuacuuaguaaaauguggauuccaucuuucuagaagaucguggcauagggguauauguuucacaauuuuaagaaccucuucagaaguguaugaugauuuuuacauuuauuaaaugcauuuacuucucucauauuuugucagagcaauaauuaagugauuuucauuuaguuuugaaaaacuuaaugacuaguuaaacccaacaguugcuuuacaacugauacaauuaaacaggagugguagagaucaaaugauugaauaauaaguuuuuaaaauuccaacaaaguuuucugaguucuaaaugaaauauuugucuuuugagggccaauuuuugaguuagucuauaaaaugggagguuugcaguggcucaugccuuuuaucucaguacaacccugggaggccagggugagagggucacuugagccuaggaguuugaggcugcagugauccaagaucacgccacugcgcuccagugugagcaacagaacaagagacugucucuuaaaauuaauuaauuaaaaacaugggaaacuccuuuaauuuuaaguaagacaagaaaaaggcauuaggagccauacgguugugaaaagccuuguguggcuuugguucaggagagaaugaugauaaauagaauuuuacuuacuauauugugcuuccuguuuuucagacauuguugaggucauuaaugaaaacguaaagaaaagcagaagacugauuaucauuuuagucagagaaacaucaggcuucagcuggcugggugguucaucugaagagcaaauagccauguauaaugcucuuguucaggauggaauuaaaguuguccugcuugagcuggagaaaauccaagacuaugagaaaaugccagaaucgauuaaauucauuaagcagaaacauggggcuauccgcuggucaggggacuuuacacagggaccacagucugcaaagacaagguucuggaagaaugucagguaccacaugccaguccagcgacggucaccuucaucuaaacaccaguuacugucaccagccacuaaggagaaacugcaaagagaggcucacgugccucucggguagcauggagaaguugccaagaguucuuuaggugccuccugucuuauggcguugcaggccagguuaugccucaugcugacuugcagaguucauggaauguaacuauaucauccuuuaucccugaggucaccuggaaucagauuauuaagggaauaagccaugacgucaauagcagcccagggcacuucagaguagagggcuugggaagaucuuuuaaaaaggcaguaggcccggugugguggcucacgccuauaaucccagcacuuugggaggcugaaguggguggaucaccagaggucaggaguucgagaccagcccagccaacauggcaaaaccccaucucuacuaaaaauacaaaaaugagcuaggcaugguggcacacgccuguaaucccagcuacaccugaggcugaggcaggagaauugcuugaaccggggagacggagguugcagugagccgaguuugggccacugcacucuagccuggcaacagagcaagacuccgucucaaaaaaagggcaauaaaugcccucucugaauguuugaacugccaagaaaaggcauggagacagcgaacuagaagaaagggcaagaaggaaauagccaccgucuacagauggcuuaguuaagucauccacagcccaagggcggggcuaugccuugucuggggacccuguagagucacugacccuggagcggcucuccugagaggugcugcaggcaaagugagacugacaccucacugaggaagggagacauauucuuggagaacuuuccaucugcuuguauuuuccauacacauccccagccagaaguuaguguccgaagaccgaauuuuauuuuacagagcuugaaaacucacuucaaugaacaaagggauucuccaggauuccaaaguuuugaagucaucuuagcuuuccacaggagggagagaacuuaaaaaagcaacaguagcagggaauugauccacuucuuaaugcuuuccucccuggcaugaccauccuguccuuuguuauuauccugcauuuuacgucuuuggaggaacagcucccuaguggcuuccuccgucugcaaugucccuugcacagcccacacaugaaccauccuucccaugaugccgcucuucugucaucccgcuccugcugaaacaccucccaggggcuccaccuguucaggagcugaagcccaugcuuucccaccagcaugucacucccagaccaccucccugcccuguccuccagcuuccccucgcuguccugcugugugaauucccagguuggccugguggccaugucgccugcccccagcacuccucugucucugcucuugccugcacccuuccuccuccuuugccuaggaggccuucucgcauuuucucuagcugaucagaauuuuaccaaaauucagaacauccuccaauuccacagucucugggagacuuucccuaagaggcgacuuccucuccagccuucucucucuggucaggcccacugcagagaugguggugagcacaucugggaggcuggucucccuccagcuggaauugcugcucucugagggagaggcugugguggcugucucugucccucacugccuuccaggagcaauuugcacauguaacauagauuuauguaaugcuuuauguuuaaaaacauuccccaauuaucuuauuuaauuuuugcaauuauucuaauuuuauauauagagaaagugaccuauuuuuuaaaaaaaucacacucuaaguucuauugaaccuaggacuugagccuccauuucuggcuucuagucugguguucugaguacuugauuucaggucaauaacgguccccccucacuccacacuggcacguuugugagaagaaaugacauuuugcuaggaagugaccgagucuaggaaugcuuuuauucaagacaccaaauuccaaacuucuaaauguuggaauuuucaaaaauuguguuuagauuuuaugaaaaacucuucuacuuucaucuauucuuucccuagaggcaaacauuucuuaaaauguuucauuuucauuaaaaaugaaagccaaauuuauaugccaccgauugcaggacacaagcacaguuuuaagaguuguaugaacauggagaggacuuuugguuuuuauauuucucguauuuaauaugggugaacaccaacuuuuauuuggaauaauaauuuuccuccuaaacaaaaacacauugaguuuaagucucugacucuugccuuuccaccugcuuucuccugggcccgcuuugccugcuugaaggaacagugcuguucuggagcugcuguuccaacagacagggccuagcuuucauuugacacacagacuacagccagaagcccauggagcagggaugucacgucuugaaaagccuauuagauguuuuacaaauuuaauuuugcagauuauuuuagucugucauccagaaaaugugucagcaugcauagugcuaagaaagcaagccaauuuggaaacuuagguuagugacaaaauuggccagagagugggggugaugaugaccaagaauuacaaguagaauggcagcuggaauuuaaggagggacaagaaucaauggauaagcguggguggaggaagauccaaacagaaaagugcaaaguuauuccccaucuuccaaggguugaauucuggaggaagaagacacauuccuaguuccccgugaacuuccuuugacuuauuguccccacuaaaacaaaacaaaaaacuuuuaaugccuuccacauuaauuagauuuucuugcaguuuuuuuauggcauuuuuuuaaagaugcccuaaguguugaagaagaguuugcaaaugcaacaaaauauuuaauuaccgguuguuaaaacugguuuagcacaauuuauauuuucccucucuugccuuucuuauuugcaauaaaagguauugagccauuuuuuaaaugacauuuuugauaaauuauguuuguacuaguugaugaaggaguuuuuuuuaaccuguuuauauaauuuugcagcagaagccaaauuuuuuguauauuaaagcaccaaauucauguacagcaugcaucacggaucaauagacuguacuuauuuuccaauaaaauuuucaaacuuuguacuguua

SEQ ID NO: 1039 - RNA, 4892 nt, Homo Sapiens
agagagagggggcgggugcuaccuggcagcuccgcgggugcguggccggugcuggcugggaguucuggucucaggcaagguggggacugggcacaucaucaauacgagaagaucuuuaacuccuccaaccaugaagaccuucagaagaugaaauuccugcccaggagaguggaugcccacagagacacugguuguuucauauucugccuacuaaagacuuaucuguauucaaggaaucauggaaaacuagaagaguuucaagugacaggcaaauguccaauuuucugaagaaaaaagacaccuuuuaccuccuccaugggcgagcaaagggaauaugaaucugccgguggggcgugagcgagaagccaccaaaacaugagcuaggacagccuucucaagaagauucugccaacucaaaaauauuauucuuuuuuuuuuuuuuuugcuguuguuucugagaaacuaggugucuuaccauuuuaaaauuucauauuuuauuuaaaaggaaaccagugaauugaaaaugagacuaaauaucgcuaucuucuuuggagcucucuuuggugcuuuggggguguuacucuuuuugguggcuuuuggaucggauuauuggcuucuugcaacugaaguggggagauguucaggugaaaagaauauagagaacgucacuuuucaccaugaaggguucuucuggagguguugguuuaaugggauuguggaagagaaugacuccaauauuuggaaguucugguacaccaaucagccaccguccaagaacugcacacaugcuuaccugucuccguaccccuucaugagaggcgagcacaacucgaccuccuaugacucugcaguuagucuucuuugauuccucauggcaaaccaaauccagcagcacaucaaaaagcuuauccaccaugaucaagugggcuucaucccugggaugcaaggcugguucaauauaugcaaaucaauaaauguaauccagcauauaaacagaaccaaagacaaaaaccacaugauuaucucaauagaugcagaaaaggccuuugacaaaauucaacaacacuucaugcuaaaaacucucaauaaauuagguauugacgggauguaucucaaaauaauaagagcuaucuaugacaaacccacagccaauaucauacugaaugggcaaaaacuggaagcauucccuuugaaaacuggcaaaagacagggaugcccucucucaccacuccuauucaacauaaaaaaugaagaugaaagcaacugacugugacaaucugcuguguacacaaucuaaguguauuuuucuuucuuuucucuuuuccuccuggggucuccaguuuaccgugguuucugggcaguccugaugcuccuggggguaguugcuguagucaucgcaagcuuuuugaucaucugugcagcccccuucgccagccauuuucucuacaaagcugggggaggcucauauauugcugcaggcauccuauuuucauugguggugaugcuguaugucaucuggguccaggcaguggcugacauggaaagcuaccgaaacaugaaaaugaaggacugccuggauuucaccccuucuguucuguauggcuggucauuuuuccuggccccagcugggauauuuuuuucuuugcuagcuggauuacuauuucugguuguuggauggcauauucagauacaucacuaaaucaacuguugccacaaguauuuucuugagagauuuuaaaacaaggaauacuuuuuuuccauuuuguuucauugaucccagcauaaaguuaguagauauaacuuuuuaguugcuauucaaauuaaucauuuuacuaaaauuuucuucaguaagaagguccuagaaucucuccagacaccagcaagccucuaucuugucuaagugcugucaaggaccuaguucuuuagggaauagguaaacaggucucccuuucauugaacauguuagaguucaugcaggucgcaaaggccugauaauagcuuaauaccaugacauggggaaaaucucgauagauuuggcuuaaagucuccuuggcauucacuucugcuaauuaaaaaaaauccuugaagaauaauuaagaaugggcaagguugucagagaauuuauuuuguuucuugcccacacagauaauauccacauacacauucacuggcucuugugagcaaaugaauuuaaaaauagacagcaguuguucuaauuagugggagccauguacucaccaguuaaaaugggccacaacaaacaagacugagagcauguacuuaucuugcuuuuucaccaacagugguuugguuaccuaguuuuauucacuuaauugugcaugcuuacauaaacuuuaaacuacauuuaaaacuagcaaaucugcauaccaaauuauguauaacguagauugaauuuuuaugaacuuaaagugaguuaauuguauaauguaauauuguuuaaaauauguaaaaaccaagcauuuccgcuugguccauaauucuauuugauauuuuaaaauucucauuuaaaaauuauauugcuaucauucagcaugugaaaauuuauugauaaaaugugauuuuaauauuuuuuagauauaaacuuucaacguacuuccauaugaggauuauaauagcccugcuuuauuaaagaccauaaaauauuaacuuuccccaagauguuauggguuccaguucuucugaucauuugauuccuuuaauuacugucccucaauuucuucaucuuuacaauagauauauuaacauuuacagaucgacuauuuccuuuaaccuccuagaagaaaguuuuuguggggaaagaugauucuguauuauucaguagcauagacauuuugcauaucaaagauguucauuuggcacuaauguugauugaaaucaaauccaucugagaugccuagcucguauuugcauucuggaagccuccaucgcaggggagcucggcaggguaugugagcuuuguuggaggugcgguguuucauucugcagcuguugugaggacagagaggcauggcccacaggcaaaaaaagucaccacccagaagaugcucugggauagaggaacugcuccuuuucaucagcucuuccaaugccgugggagaggugaucccagucuucucuguacaucuugugcuuuuccauuaagacuuguuccagugggaaggagcuuuggaaaaauugcaaaggucugaaucuucagggcauuuucaugacaggacuugccaauaauaauaauaauaauaauaauaauaauaauaauaaagcuccagaggccuaacugguuucucaagucauuucagugauaucauugaaacguuuuugugguacuucccuuugucuuucacuguuucauuuuuauauugcuucauuuacuucuuugcuuuuggcuuuguuauuagaaaaaauaauuaugaggucuguugugcauguugacugugauauuaaguuauggcaugccauuaaguuuuccagacgauguuggauguaucugauuaguucaugucaucuguaaauacaauucuuuuuuguaguacuuuggaauggagccuuuuucugguguacuguaugccauuuaaguuucacauacaagcugcuuucggcaaaggcuugaauauuuauaaauuucagaugguuauccucacuuuauaguacacuuaaguggcuaccauauauuuuuuauaugacaauuggcugaauagcugauguguaugacacuuuuacacagauuugcacuuuggaacuauuuuauaguuguaaugcaucaaucaaauacauuucaagcacauuucuugaucaauuuaccagcaacccucugaaggaaugaaggagaguugugauugcuaugucaaugagugaaauauacuuaaaaauggcagaguuauauaguacauuauuguagcaaccuuauaucugauuugagauacuguguugccaaauguccauguuauguuuauuucucuauugguuguauuuauuaauuuuuagaagccuuuaaacuguguuagaaucuuuuugaaaaauguugauuuugcaucauaaaguuucaauuuaucaaggauaucuuuucaguuacacuuuuagaaagagugaauaaaaagggcagugaguuaugcucuuggacuuggugaaagcuaucaucucuccauauuguauuuguucagcugguuuaauucacucagguggaugauugcacauacauuggaauuggcuggagagacuacacagagaaguuuaaugaucguguacaauuugaggguugaugguagggcuuucuaaaaaaaguaauaucaaguguguuguuaguauucauuuagucauuuuuauuacuaaucuauaaauauauuuauuaaauuugaagauuaaauggaauuauaaaggaauauauuggaggaaauggaauuucuucucucuguuacucaagccucucaaaguccuuauugucccagccucugcgugaaacgucuucagccaucaaugacaucucacuccuucaagcccuuaugccacugcugggauggaccagucacuggaccugcauuacagugggcuuauauugaccuuuaccucuacacuuguauauaacucguuuucccauuuaguugcaagacacuuggaagcacagaccaaggcuuacauuuguguuuuaauguuuuucuuguaaaugcuuuaugccuaaauguuucuguacuacucuucuuuccaaauccuuauuguuuaaaaguuucucuccuacuauaccaugccuuauaaauauugauugaaugaauggaugaaaugcauaccugcuuauauuucuaauuaaaggcaauuugggauuauaguauuuguuuuuccaaaaauguuuccaauuacccauucccuugucaguucccaug

SEQ ID NO: 1040 - RNA, 82 nt, Homo Sapiens
ugagcuguuggauucggggccguagcacugucugagagguuuacauuucucacagugaaccggucucuuuuucagcugcuuc

SEQ ID NO: 1041 - RNA, 806 nt, Homo Sapiens
gagaaggaaaaggauguuguacaugggcagaaaggugaaaauuguggccagaggcagauugugcuaucagguaaauaagcccaggcuauugugcuggaugaugagaggucacuggaacacugaugagccauaacagcugaggccauucuagaauaggcagcuuuagccaaccaggcagcugacugcagauacaggccugcauccagaugaguccagaaaagcaaccuagacacuacuggcaaagacauugaaaagaaucacacugcuaaaccaguagcagcuuuuaucuucuucucagauuguauacaugcaggauaaaaguguuucuaacacauagacuucuauauuccagcauaaagauguauuaggcgcauuuauacuuuuacaucgaagccuguuucaacaugaacggagcccagauauuuauguaggccaguaauuggaguguauuucccuguucaauuucacauugucuauaaaaggguuucucaugaucgaugacuuucuaguuaaauucagaagaaaacaucuugcagcuacugcccuauugccauggccacacaucacugccuucuagacaugggaaguuggugacuuaauccucguuauacccugauuuuggacaaauuuuacaagaagaauaggacuucuacuucucuaugucuacaugcaccuggaacagugcuaggucuaugcuuacaaauugauugguucaggucaccgccaugagccucaggacagaaaauugccggauaugagagagagagagagauuugacugggcuaagaaagaaaugaacacgauuu

SEQ ID NO: 1042 - RNA, 1579 nt, Homo Sapiens
agucacauuucagccacugcucugagaauuugugagcagccccuaacaggcuguuacuucacuacaacugacgauaugaucaucuuaauuuacuuauuucucuugcuaugggaagacacucaaggauggggauucaaggauggaauuuuucauaacuccauauggcuugaacgagcagccgguguguaccacagagaagcacggucuggcaaauacaagcucaccuacgcagaagcuaaggcggugugugaauuugaaggcggccaucucgcaacuuacaagcagcuagaggcagccagaaaaauuggauuucaugucugugcugcuggauggauggcuaagggcagaguuggauaccccauugugaagccagggcccaacuguggauuuggaaaaacuggcauuauugauuauggaauccgucucaauaggagugaaagaugggaugccuauugcuacaacccacacgcaaaggagugugguggcgucuuuacagauccaaagcaaauuuuuaaaucuccaggcuucccaaaugaguacgaagauaaccaaaucugcuacuggcacauuagacucaaguauggucagcguauucaccugaguuuuuuagauuuugaccuugaagaugacccagguugcuuggcugauuauguugaaauauaugacaguuacgaugauguccauggcuuugugggaagauacuguggagaugagcuuccagaugacaucaucaguacagguaagguuuuaaauugaggaccaaaacuaugauuuguuucuuuacagugucccugaaaguaaagggacacuguuaaauaguaaauaguaguuauuauucacuuuuuaaaguugaaagaaccaacaccagaugcagcuugcuagguuguaaaaugcgaaaugucaugaccuugaaguuucuaagugaugcuucagugacagcuggagguuuccaaaucaaauauguugcaauggauccuguauccaaauccagucaaggaaaaaauacaaguacuacuucuacuggaaauaaaaacuuuuuagcuggaagauuuagccacuuauaaaaaaaaaaaaaaggaugaucaaaacacacaguguuuauguuggaaucuuuuggaacuccuuugaucucacuguuauuauuaacauuuauuuauuauuuuucuaaaugugaaagcaauacauaauuuagggaaaauuggaaaauauaggaaacuuuaaacgagaaaaugaaaccucucauaaucccacugcauagaaauaacaagcguuaacauuuucauauuuuuuucuuucagucauuuuucuauuugugguauauguauauauguaccuauauguauuugcauuugaaauuuuggaauccugcucuauguacaguuuuguauuauacuuuuuaaaucuugaacuuuauaaacauuuucugaaaucauugauuauucuacaaaaacaugauuuuaaacagcuguaaaauauucuaugauaugaauguuuuaugcauuauuuaagccugucucuauuguuggaauuucaggucauuuucauaaauauuguugcaauaaauauccuugaacacaca

SEQ ID NO: 1043 - RNA, 357 nt, Homo Sapiens
cgaugggagaccugguccagcccuguccauugugacccacaccuccucaggacugagcagaaagagcugcugcaauaaacaguuugacuaucauuccugaagugccagaguuugagcaaacaucacauaagugugcugcagaaaugagagagugcacaacgugccaaauguacuaacauucuaaaagcagaauugggaacacauuuaaugaaaaaaaucauucagacuucagcacuauaccucagcaaguaauuugaguaaaaacugaauacugaagguguuuauuucaacuugauuauucuuuauuacauugcauuacuguuuuauacugauuaaaaugcugacuuucuauguuaa

SEQ ID NO: 1044 - RNA, 102 nt, Homo Sapiens
gugcccccuucagcagcacauauacuaaaaauuggaugauauagauuagcauggccccuaugcaaagauuacacgcaaauuugugcauuguuccguauuuug

SEQ ID NO: 1045 - RNA, 4885 nt, Homo Sapiens
uaaagucaucaaaacaacguuauauccugugugaaaugcugcagucaggaugccuugugguuugagugccuugaucaugugcccuaaggggaugguggcgguggugguggccguggaugacggagacucucaggccuuggcaggugcgucuuucaguuccccucacacuucggguuccucggggaggaggggcuggaacccuagcccaucgucaggacaaagaugcucaggcugcucuuggcucucaacuuauucccuucaauucaaguaacaggaaacaagauuuuggugaagcagucgcccaugcuuguagcguacgacaaugcggucaaccuuagcugcaaguauuccuacaaucucuucucaagggaguuccgggcaucccuucacaaaggacuggauagugcuguggaagucuguguuguauaugggaauuacucccagcagcuucagguuuacucaaaaacgggguucaacugugaugggaaauugggcaaugaaucagugacauucuaccuccagaauuuguauguuaaccaaacagauauuuacuucugcaaaauugaaguuauguauccuccuccuuaccuagacaaugagaagagcaauggaaccauuauccaugugaaagggaaacaccuuuguccaaguccccuauuucccggaccuucuaagcccuuuugggugcugguggugguugguggaguccuggcuugcuauagcuugcuaguaacaguggccuuuauuauuuucugggugaggaguaagaggagcaggcuccugcacagugacuacaugaacaugacuccccgccgccccgggcccacccgcaagcauuaccagcccuaugccccaccacgcgacuucgcagccuaucgcuccugacacggacgccuauccagaagccagccggcuggcagcccccaucugcucaauaucacugcucuggauaggaaaugaccgccaucuccagccggccaccucaggccccuguugggccaccaaugccaauuuuucucgagugacuagaccaaauaucaagaucauuuugagacucugaaaugaaguaaaagagauuuccugugacaggccaagucuuacagugccauggcccacauuccaacuuaccauguacuuagugacuugacugagaaguuaggguagaaaacaaaaagggaguggauucugggagccucuucccuuucucacucaccugcacaucucagucaagcaaagugugguauccacagacauuuuaguugcagaagaaaggcuaggaaaucauuccuuuugguuaaauggguguuuaaucuuuugguuaguggguuaaacgggguaaguuagaguagggggagggauaggaagacauauuuaaaaaccauuaaaacacugucucccacucaugaaaugagccacguaguuccuauuuaaugcuguuuuccuuuaguuuagaaauacauagacauugucuuuuaugaauucugaucauauuuagucauuuugaccaaaugagggauuuggucaaaugagggauucccucaaagcaauaucagguaaaccaaguugcuuuccucacucccugucaugagacuucaguguuaauguucacaauauacuuucgaaagaauaaaauaguucuccuacaugaagaaagaauaugucaggaaauaaggucacuuuaugucaaaauuauuugaguacuaugggaccuggcgcaguggcucaugcuuguaaucccagcacuuugggaggccgaggugggcagaucacuugagaucaggaccagccuggucaagauggugaaacuccgucuguacuaaaaauacaaaauuuagcuuggccugguggcaggcaccuguaaucccagcugcccaagaggcugaggcaugagaaucgcuugaaccuggcaggcggagguugcagugagccgagauagugccacagcucuccagccugggcgacagagugagacuccaucucaaacaacaacaacaacaacaacaacaacaacaaaccacaaaauuauuugaguacugugaaggauuauuugucuaacaguucauuccaaucagaccagguaggagcuuuccuguuucauauguuucaggguugcacaguuggucucuuuaaugucgguguggagauccaaaguggguuguggaaagagcguccauaggagaagugagaauacugugaaaaagggauguuagcauucauuagaguaugaggaugagucccaagaagguucuuuggaaggaggacgaauagaauggaguaaugaaauucuugccaugugcugaggagauagccagcauuaggugacaaucuuccagaaguggucaggcagaaggugcccuggugagagcuccuuuacagggacuuuaugugguuuagggcucagagcuccaaaacucugggcucagcugcuccuguaccuuggagguccauucacaugggaaaguauuuuggaaugugucuuuugaagagagcaucagaguucuuaagggacuggguaaggccugacccugaaaugaccauggauauuuuucuaccuacaguuugagucaacuagaauaugccuggggaccuugaagaauggcccuucaguggcccucaccauuuguucaugcuucaguuaauucagguguugaaggagcuuagguuuuagaggcacguagacuugguucaagucucguuaguaguugaauagccucaggcaagucacugcccaccuaagaugaugguucuucaacuauaaaauggagauaaugguuacaaaugucucuuccuauaguauaaucuccauaagggcauggcccaagucugucuuugacucugccuaucccugacauuuaguagcaugcccgacauacaauguuagcuauugguauuauugccauauagauaaauuauguauaaaaauuaaacugggcaauagccuaagaaggggggaauauuguaacacaaauuuaaacccacuacgcagggaugaggugcuauaauaugaggaccuuuuaacuuccaucauuuuccuguuucuugaaauaguuuaucuuguaaugaaauauaaggcaccucccacuuuuauguauagaaagaggucuuuuaauuuuuuuuuaaugugagaaggaagggaggaguaggaaucuugagauuccagaucgaaaauacuguacuuugguugauuuuuaagugggcuuccauuccauggauuuaaucagucccaagaagaucaaacucagcaguacuugggugcugaagaacuguuggauuuacccuggcacgugugccacuugccagcuucuugggcacacagaguucuucaauccaaguuaucagauuguauuugaaaaugacagagcuggagaguuuuuugaaauggcaguggcaaauaaauaaauacuuuuuuuuaaauggaaagacuugaucuaugguaauaaaugauuuuguuuucugacuggaaaaauaggccuacuaaagaugaaucacacuugagauguuucuuacucacucugcacagaaacaaagaagaaauguuauacagggaaguccguuuucacuauuaguaugaaccaagaaaugguucaaaaacagugguaggagcaaugcuuucauaguuucagauaugguaguuaugaagaaaacaaugucauuugcugcuauuauuguaagagucuuauaauuaaugguacuccuauaauuuuugauugugagcucaccuauuuggguuaagcaugccaauuuaaagagaccaaguguauguacauuauguucuacauauucagugauaaaauuacuaaacuacuauaugucugcuuuaaauuuguacuuuaauauugucuuuugguauuaagaaagauaugcuuucagaauagauaugcuucgcuuuggcaaggaauuuggauagaacuugcuauuuaaaagaggugugggguaaauccuuguauaaaucuccaguuuagccuuuuuugaaaaagcuagacuuucaaauacuaauuucacuucaagcaggguacguuucugguuuguuugcuugacuucagucacaauuucuuaucagaccaauggcugaccucuuugagaugucaggcuaggcuuaccuauguguucugugucaugugaaugcugagaaguuugacagagauccaacuucagccuugaccccaucagucccucggguuaacuaacugagccaccgguccucauggcuauuuuaaugaggguauugaugguuaaaugcaugucugaucccuuaucccagccauuugcacugccagcugggaacuauaccagaccuggauacugaucccaaaguguuaaauucaacuacaugcuggagauuagagauggugccaauaaaggacccagaaccaggaucuugauugcuauagacuuauuaauaauccaggucaaagagagugacacacacucucucaagaccuggggugagggagucuguguuaucugcaaggccauuugaggcucagaaagucucucuuuccuauagauauaugcauacuuucugacauauaggaauguaucaggaauacucaaccaucacaggcauguuccuaccucagggccuuuacauguccuguuuacucugucuagaauguccuucuguagaugaccuggcuugccucgucacccuucagguccuugcucaagugucaucuucuccccuaguuaaacuaccccacacccugucugcuuuccuugcuuauuuuucuccauagcauuuuaccaucucuuacauuagacauuuuucuuauuuauuuguaguuuauaagcuucaugaggcaaguaacuuugcuuuguuucuugcuguaucuccagugcccagagcagugccugguauauaauaaauauuuauugacugagugaa

SEQ ID NO: 1046 - RNA, 2645 nt, Homo Sapiens
cgagagccugaauucacugucagcuuugaacacugaacgcgaggacuguuaacuguuucuggcaaacaugaagucaggccucugguauuucuuucucuucugcuugcgcauuaaaguuuuaacaggagaaaucaaugguucugccaauuaugagauguuuauauuucacaacggagguguacaaauuuuaugcaaauauccugacauuguccagcaauuuaaaaugcaguugcugaaaggggggcaaauacucugcgaucucacuaagacaaaaggaaguggaaacacaguguccauuaagagucugaaauucugccauucucaguuauccaacaacagugucucuuuuuuucuauacaacuuggaccauucucaugccaacuauuacuucugcaaccuaucaauuuuugauccuccuccuuuuaaaguaacucuuacaggaggauauuugcauauuuaugaaucacaacuuuguugccagcugaaguucugguuacccauaggaugugcagccuuuguuguagucugcauuuugggaugcauacuuauuuguuggcuuacaaaaaagaaguauucauccagugugcacgacccuaacggugaauacauguucaugagagcagugaacacagccaaaaaaucuagacucacagaugugacccuauaauauggaacucuggcacccaggcaugaagcacguuggccaguuuuccucaacuugaagugcaagauucucuuauuuccgggaccacggagagucugacuuaacuacauacaucuucugcugguguuuuguucaaucuggaagaaugacuguaucagucaauggggauuuuaacagacugccuugguacugccgaguccucucaaaacaaacacccucuugcaaccagcuuuggagaaagcccagcuccugugugcucacugggaguggaaucccugucuccacaucugcuccuagcagugcaucagccaguaaaacaaacacauuuacaagaaaaauguuuuaaagaugccagggguacugaaucugcaaagcaaaugagcagccaaggaccagcaucuguccgcauuucacuaucauacuaccucuucuuucuguagggaugagaauuccucuuuuaaucagucaagggagaugcuucaaagcuggagcuauuuuauuucugagauguugaugugaacuguacauuaguacauacucaguacucuccuucaauugcugaaccccaguugaccauuuuaccaagacuuuagaugcuuucuugugcccucaauuuucuuuuuaaaaauacuucuacaugacugcuugacagcccaacagccacucucaauagagagcuaugucuuacauucuuuccucugcugcucaauaguuuuauauaucuaugcauacauauauacacacauauguauauaaaauucauaaugaauauauuugccuauauucucccuacaagaauauuuuugcuccagaaagacauguucuuuucucaaauucaguuaaaaugguuuacuuuguucaaguuagugguaggaaacauugcccggaauugaaagcaaauuuauuuuauuauccuauuuucuaccauuaucuauguuuucauggugcuauuaauuacaaguuuaguucuuuuuguagaucauauuaaaauugcaaacaaaaucaucuuuaaugggccagcauucucaugggguagagcagaauauucauuuagccugaaagcugcaguuacuauagguugcugucagacuauacccauggugccucugggcuugacaggucaaaaugguccccaucagccuggagcagcccuccagaccuggguggaauuccaggguugagagacuccccugagccagaggccacuagguauucuugcucccagaggcugaagucacccugggaaucacaguggucuaccugcauucauaauuccaggaucugugaagagcacauaugugucagggcacaauucccucucauaaaaaccacacagccuggaaauuggcccuggcccuucaagauagccuucuuuagaauaugauuuggcuagaaagauucuuaaauauguggaauaugauuauucuuagcuggaauauuuucucuacuuccugucugcaugcccaaggcuucugaagcagccaaugucgaugcaacaacauuuguaacuuuagguaaacugggauuauguuguaguuuaacauuuuguaacugugugcuuauaguuuacaagugagacccgauaugucauuaugcauacuuauauuaucuuaagcauguguaaugcuggauguguacaguacaguacugaacuuguaauuugaaucuaguaugguguucuguuuucagcugacuuggacaaccugacuggcuuugcacagguguucccugaguuguuugcagguuucuguguguggggugggguauggggaggagaaccuucaugguggcccaccuggccugguuguccaagcugugccucgacacauccucauccccagcaugggacaccucaagaugaauaauaauucacaaaauuucugugaaaucaaauccaguuuuaagaggagccacuuaucaaagagauuuuaacaguaguaagaaggcaaagaauaaacauuugauauucagcaacugaaaa

SEQ ID NO: 1047 - RNA, 80 nt, Homo Sapiens
cuauaugcaguggaccaggauggcaagggcucuccugaaaggacaguagagcccuugccauccugguccacugcauauag

SEQ ID NO: 1048 - RNA, 541 nt, Homo Sapiens
ggcaaaucauuauauugcucccagccuuaaaaaucuucaauaaguuaaagagaggacucaggcuuaauggcaauccuguuaucuuaccaaugaggagacuaaacaccuaguuggagaucaccuccuuacuggcucagagcuucaggaaauagcucaaggaugugcaaauacuaaacaguagagcugggauuuagauccacaucuacuuaauuuuagugcguaugcucuaacugcugccacagaagggaugcagaggaagacggucaguuacccagagggugauaucuuugacuuaauguucaccauaaagacagcuaucaacaaaagacuugaauucuaacuuguuaucuauugcaggaaagugccugcaauauggugacuccugcagagcaccugacaaucagagaagaguuagaauacauuaagcucagcaucacauauguaguuugaauacaacuccaccuccuucucuuucuuucucuucuuuccugccuuuguugcccuacccaggauuaaaaccuuaggucuuauguuaaaagaa

SEQ ID NO: 1049 - RNA, 2983 nt, Homo Sapiens
gggagaagccgagggcagcuuagccacggccgguucccguucccuccaggacgcgagggucgccuuggguggggaaccgcgaccgggcgaggaccuaucccgguguggggcuucccgauuucgaaagaaucucgcugcacccccgcccagaguucagaccaagcgaaaaguuauuugagaggccucgggggcgcggggugaggagucguggcggaggccuuggucggggcgccguggauauccccgagucaccgcgucccucuccugcagcucccgcgucgcugggaggagcgagggagcgagcgggaaggggucuagcuggccuuugcucggcccuccccagcgcccggcuuugaacccgcccugcacugcugucugggcggguccggggacucagcacucgacccaaaggugcaggcgcgcgagcacaacccauggcugcgcugggcugcgcgaggcugaggugggcgcugcgaggggccggccguggccucugcccccacggggccagagccaaggccgcgaucccugccgcccuccccucggacaaggccaccggagcucccggagccgggccugguguccggcggcggcaacggagcuuagaggagauuccacgucuaggacagcugcgcuucuucuuucagcuguucguucaaggcuaugcccugcaacugcaccaguuacagcaugaaggaagaaggcauggcuuagcuaaaaggagaaaugucccagaaaccuccauacugacagccaggaaguagucucagaggcuuuggauuccaggaaagaagcuggugcuuuacaaggccaaguacgguccaauguggauguccuacuuagggccucagaugcacgugaaccuggccagugccccgcucuuggagcaagugaugcggcaagagggcaaguacccaguacggaacgacauggagcuauggaaggagcaccgggaccagcacgaccugaccuaugggccguucaccacggaaggacaccacugguaccagcugcgccaggcucugaaccagcgguugcugaagccagcggaagcagcgcucuauacggaugcuuucaaugaggugauugaugacuuuaugacucgacuggaccagcugcgggcagagagugcuucggggaaccaggugucggacauggcucaacucuucuacuacuuugccuuggaagguacccuugcugggagaggggcuggggaagggaaugggucagggagagguugugcucccucuccucaagggcuccuggauuccauauguccugguucugccuccugugauggccucugugcacuacucagcuauuugcuacauccuguucgagaaacgcauuggcugccugcagcgauccauccccgaggacaccgugaccuucgucagauccaucggguuaauguuccagaacucacucuaugccaccuuccuccccaaguggacucgccccgugcugccuuucuggaagcgauaccuggaugguuggaaugccaucuuuuccuuuggugaggacucccagauggggcccagggaagagagaugggggugacuccaggucugugcaucagcggucucucccaggccuuuucccucaugcuaccaguugucggaguggcucuugguccuuggagaucaugacuuuuggcuuuguccuuuccucuucucuguugcuuucacagggaagaagcugauugaugagaagcucgaagauauggaggcccaacugcaggcagcagggccagauggcauccaggugucuggcuaccugcacuucuuacuggccaguggacagcucaguccucgggaggccaugggcagccugccugagcugcucauggcuggaguggacacgacauccaacacgcugacaugggcccuguaccaccucucaaaggacccugagauccaggaggccuugcacgaggaagugguggguguggugccagccgggcaagugccccagcacaaggacuuugcccacaugccguugcucaaagcugugcuuaaggagacucugcgguaggacagaaugcuguucuggggggcacaggaucucuuuguggggagggaaucagaggaggaaaucugaagugaagacaggugggcuggggcuagugacaaggaugagaugggagagguaggggagaaggaguggggcacuuuguacccccaugaauccagagcagacuccagacauucuuuucccugcagucucuacccugugguccccacaaacucccggaucauagaaaaggaaauugaaguugauggcuuccucuuccccaagaacgugaguggggcuagagagcccgauugcccaggagugcccuaugcccccgaagagaggcauucaugcugcccaaucuuccuuuauagacccaguuuguguucugccacuauguggugucccgggaccccacugccuucucugagccugaaagcuuccagccccaccgcuggcugagaaacagccagccugcuacccccaggauccagcacccauuuggcucugugcccuuuggcuaugggguccgggccugccugggccgcaggauugcagagcuggagaugcagcuacuccucgcaaggcugauccagaaguacaaggugguccuggccccggagacgggggaguugaagaguguggcccgcauuguccugguucccaauaagaaagugggccugcaguuccugcagagacagugcugagcugagucuccgccuugcuggggcuuguccuagaggcuccagcucuggcacagugguuccuggcugcugccaugucucagaugaggagggagagaaggaggccgccagacucgagaggugggaggaacuccuugcacacacccugagcuuuugccacuucuaucauuuuugagcaacucccucucagcuaaaaggccaccccuuuaucgcauugcuguccuuggguagaauauaaaauaaagggacuuuuauuucuuauugga

SEQ ID NO: 1050 - RNA, 95 nt, Homo Sapiens
agugaaauugcuaggucauauggucagucuacuuuuagaguaauugugaaacuguuuuucaaaguagcuguaccauuugcacucccuguggcaau

SEQ ID NO: 1051 - RNA, 278 nt, Homo Sapiens
aggucgaugaugauugguaaaaggucugauugcacugaaugucacggucccuuuguugcccucaacucccagcagcccauuuuuucccucccgucacauuuaagucauguguaugggaucauggagcagcugauaauuugggauucugucaguguguguuucugagagugaucggcucacagcugacgaguauccaacaaaaccaguuacacaggagacugacgaguggcagucaugggugugauggugcaugaucucaaguuuucaaucugagaccu

SEQ ID NO: 1052 - RNA, 4288 nt, Homo Sapiens
aggcaguuacacuguuaggcagcaacagugcugaugcuggacuguggcaggcagagggugcuauccugacacacuucaccuuagugcaggaaacuucaauuugguggaagaaaggcgauuucgaggugccaaucugggcgacacuucccaguuggagagucagcaaaagggagagggcaauuccaagaagagggaaaagcuugugcacaggugagugugugcaaagguuucccgcuggcgccuggcucccuccggguuucguuucccgccggcgccuggcucccgccagguuucguuuccgaggcggggccgagggcggcgucgcugaggcgcccauggccuucgcccgccggcuccugcgcgggccacugucggggccgcugcucgggcggcgcggggucugcgcuggggccauggcuccgccgcgccgcuucguccuggagcuucccgacugcacccuggcucacuucgcccuaggcgccgacgcccccggcgacgcagacgcccccgacccccgccuggcggcgcugcuggggcccccggagcgcagcuacucgcugugcgugcccgugaccccggacgccggcugcggggcccggguccgggcggcgcggcugcaccagcgccugcugcaccagcugcgccgcggccccuuccagcggugccagcugcucaggcugcucugcuacugcccgggcggccaggccggcggcgcacagcaaggcuuccugcugcgcgacccccuggaugacccugacacccggcaagcgcugcucgagcugcugggcgccugucaggaggcaccacgcccgcacuugggcgaguucgaggccgacccgcgcggccagcuguggcagcgccucugggaggugcaagacggcaggcggcugcaggugggcugcgcacaggucgugcccgucccggagcccccgcugcacccgguggugccagacuugcccaguuccguggucuucccggaccgggaagccgcccgggccguuuuggaggaggcuaggcagauguccuccugugacacagaugagcccugaggaugcccccauggaucuugggaauauuuuccaagcuuacgggacagcguuguggagcaguuaagagcgcaaguguaccuccuuuauuccugaagcccgggcagugcuugaccuggucgaccagugcccaaaacagauccagaaaggaaaguuccagguuguugccaucgaaggacuggaugccacggaucuucucaucaccaccuguccugagcuccaggcagcagcugagaauuguaaaaccacggugacccagucaguggcagauucacuuaaggcuguccucuuaaagucaccacccucuugcauuggccaguggaggaagaucuuugaugaugaaccaacuaucauuagaagagcuuuuuacucuuugggcaauuauauuguggccuccgaaauagcuaaagaaucugccaaaucuccugugauuguagacagguacuggcacagcacggccaccuaugccauagccacugaggugagugggggucuccagcaccugcccccagcccaucacccuguguaccaguggccagaggaccugcucaaaccugaccuuauccugcugcucacugugaguccugaggagagguugcagaggcugcagggccggggcauggagaagaccagggaagaagcagaacuugaggccaacaguguguuucgucaaaaguaggugucccagugcaaugcaaugugagcggcaggcauuccugaagggagaugaaccacuggcacuggcuuuaggauugugaggaagugauauuguuuccaguuuucaaacacaagagacaacauccucuaaguuacuucagccccuuccaaugggcuugucaccacagggcugcagcauuguuaucuuaaagcaaaggucaucggacuagggaucagacccugccacugauccuggcugugcuaggagcagcugcaccuggguaagacaguaagugucucugugccucaguuuccccagucauaguauaaucacacagagcacuagauaacgagcucauaguaacaucuaccuauuagaugcuucccgugugucaggcauuuuacugauguuaugucauccuugugaggaaaacauuagccguauuuuacaguuuacaacuuuaaggcucaaaggauuaagugauuugucuaaauguacauaacuauucacuaguaaaaccgggauuaaaaucuuucugauuuugcagccaguguuuuuguuuuaauuagaaaguuauaaacacgacugcagaagagagucuggccaggccuccugccucaugacugaguaugaaucaguucuacaccacugccuuuaaaaacugaagcagaaauauuuucucuaacugaacaaugauagcccuguuaucauaacauaguaauguuauaaauaaugguagcugcuguggguaaagauauuauguuaagcaauuuacuuguauuaauuccauuaaacuucagugaacauuugcaaggaagguagaaauguccuaccagcggauggagaauccuggcugccaugugguugaugccagccccuccagagaaaagguccugcagacgguauuaagccuaauccagaauaguuuuagugaaccguaguuacucuggccaggugccacgucuaacuagauuagauguuguuugaaacaucuacauccaccauuuguuaugcaguguucccaaauuucuguucuacaagcauguuguguggcagaaaacuggagaccaggcaucuuaauuuuacuucagccaucguacccucuucugacugauggacccgucaucacaaaggucccucucaucauguuccagugagaggccagcgauugcuuucuuccuggcauaguaaacauuuucuuggaacauauguuucacuuaaucacuaccaaauaucuggaagaccugucuuacucagacagcaccagguguacagaagcagcagacaagaucuuccagaucagcagggagaccccggagccucugcuucuccuacacuggcaugcugaugagaucgugacaugcccacauuggcuucuuccacaucugguugcacucgucaugaugggcucgcugcaucucccucagucccaaauucuagagccaaguguuccugcagaggcugucuauguguccuggcugcccaaggacacuccugcagagccauuuuuggguaaggaacacuuacaaagaaggcauugaucuugugucugaggcucagagcccuuuugauaggcuucugagucauauauaaagacauucaagccaagaugcuccaacugcaaauauaccaaccuucucugaauuauauuuugcuuauuuauauuucuuuucuuuuuuucuaaaguauggcucugaauagaaugcacauuuuccauugaacuggaugcauuucauuuagccaauccaguaauuuauuuauauuaaucuauacauaauauguuuccucagcauaggagcuaugauucauuaauuaaaaguggagucaaaacgcuaaaugcaauguuuguuguguauuuucauuacacaaacuuaauuugucuuguuaaauaaguacaguggaucuuggagugggauuucuugguaaauuaucuugcacuugaaugucucaugauuacauaugaaaucgcuuugacauaucuuuagacagaaaaaaguagcugagugagggggaaauuauagagcugugugacuuuagggaguagguugaaccaggugauuaccuaaaauuccuuccaguucaaaggcagauaaaucuguaaauuauuuuauccuaucuaccauuucuuaagaagacauuacuccaaaauaauuaaauuuaaggcuuuaucaggucugcauauagaaucuuaaauucuaauaaaguuucauguuaaugucauaggauuuuuaaaagagcuauagguaauuucuauauaauauguguauauuaaaauguaauugauuucaguugaaaguauuuuaaagcugauaaauagcauuaggguucuuugcaaugugguaucuagcuguauuauugguuuuauuuacuuuaaacauuuugaaaagcuuauacuggcagccuagaaaaacaaacaauuaauguaucuuuaugucccuggcacaugaauaaacuuugcugugguuuacuaaucuagucccagcugggaggaaccuuauaccauccuucucuccaccugcucggcagugaaguuugugggacuggaaucuuggauucaucacacucgagucaaggccuggaauga

SEQ ID NO: 1053 - RNA, 3724 nt, Homo Sapiens
gacagauccuuuccauucgcugucaugucucucccucagcccacgccgcggauggccgagcucagaaagccuaccuccucuuuaacgccuccugaggacccggauucccaaccaccuaguagcaagcggcucugucuugaggagccuggaggugucuuuaaggcgggcuggcgacugccucuggugccucgcuugucugaggcggaaaaagucugggaguuguccccuagacccuucaagggacuccuuguuucaacgaaugcuauuuucgauaacuccacagacucguguguggagaaaucagucagugggaagcagauauguaaucugaaaugcucaaaucucaaauuccaaaugaguagcuguuugcagucuccccccucacaaaguccugauucugauuugagggcuucaggaaggucugaggcaggccugcaugacagagaggcuuucagugugcaccgcaguaauagcuccaaagcagggguuagucaacuucugcccagcaccucuauacacgauauacauggaauuagaaaugagaaucgaaaacaacaguuuguccaaggaagagacaauguucacaaagaaaauccauuuuuagauguuaccuuuuacaaggaaacuaaaucaccauuucaugaaauuaagaacagauguaaagcuaacaguguugugccaucaaauaaaagagaaaauaacauuucaucaucuguacuaaaaauaucaaaaucucaaaaccagcccagcuuggaaauugccaaaccuagcuauuuuagagauagcggcacaauaagugucccucaguuuccaauggacuuaaauagcaaaauguccucugucuauuuaaaggaaauagcgaagaaaaagaaugacaaaaaagaggcauauguuagggauuucacaaacauuuacuggucccaaaauagaccugauguuaagaagcaaaaguuacagaaugauaaaaaaacuguagaagcggaaaacauuuuuuccaaauguuaugaaaaugacuacccaucacucaguagccaaaauacuuguaagagaaaagacuugaucaguucaaacuacuguaacugcaguaguauccaguguaauguaagagacucuagaaagaauuucgcuauacuagaaaaugcaaauugggaggaagcagaaugucuggacaguuacguacuuaccaggcuggaaaaaucucaaaacugggacuguaacguuagacauauuuugagaagaaauagaggaaauuguuggauuauaaauaauugcaagacuaaaugugaaaauaugaaaaaaacugaagaaaaauggaauuggcuauuauuauuagaaauagaccuuuuaagcaaggaagauuaccacugugcaaaagucaucaaugcauaugaagaacaaucaaagcuucucguaagagaaauauuagguagucagacagcuuuaauaacgacuguuuggcuaaaugguaaaggagaaaaugauaauacucuacaguugagauacaauacuacacaaaaagucuuucaugugaacaacccuuuugaaaguuucauuauagaaauuuuuuauuuccauaaaaguauuucaggaaauaaaaaagauaauaguauuuuaaccugcuguaacauuuugaaguguaaaaagcaaauugguauaauugguauucaaaaucuaauaaccagaaacaugaauacaaauauaaagaauggaauuuuaagcauauauuuacaagauaguguuucagaaccuuuagauauucuauugaaaacuaacauagcuuuuuugcucaauaacuuugacucuuuaacaagaauugaaaaugauuuugaauuagaagaggaaugcauuuucaagugcaugcuuuauuugaaguauccaaaaaauauaguggaaaaucauacugcauaucuaguaaagauuuuaacuucuucaagacuauuagaagauaauaugaaaccuauguuaaagaaaaggaaguuauuuagaacugaacaaguuuuugaaaagucuaagaaaaaacucauuaauuccuucaguaugacaacucaaaauacagguuuuccgauuuuugaaacauaugaaaaaauuccccuuuuaauggacuuugaugacauggaugaaauuucuuuaauaagagaaauuacuugucagaauaugaguuguccucaacaaguugugaauguggaaaauugggcucacuauaauucuaguacuguuaaagcacaugguaauucuuguccucaauuuauacagaacaaccgaggauacauuaaugaaaauuuuuaugaaguaaauaugcacagccaagauuuaaauauggaaagaaaacagggacauaauaagaucaguaacuuugacugugagcacauauuugaagaucucugcaauguuaggcaacaggccauaccagcaagccacaacauaauacauaaugaagagacccauaccacuucuauaacucaaguacuaaauuuuuggaacuugcuaagugaaauagaagaaaaaaaauaugacuuaauuuugaaagaggaaguaaaagucacagcugaaaguuuaacaaauaguugccaaguucacaaagauacuaagauagaaaaggaagagaaagauaguuuuuuuccaauggaugacauguuuucuguacagucaguuucauuaauaaguaaggaaguaaauguggaagaaaauaaauauguuaaucaaaauuauguaacaaauacaaaugaauaugagaguauuuugccagaaagggagauagcuaauucaaaggauuuucacagaaagaaugacucugcauuauauauuaaucaucaauuugaaacuggucugagugaagggaaugaugaauguuuucaggacuuagcugcuaaauauuuaucaacagaagcucugacaauaguaaaagauuuugagaugaagagaaaauuugacuuaguacuugaagaacuucguauguuucaugaaauuaguagggaaaaugaacuucuaagcacuguggaaacaaacaaugggcaagaaaauuacuuuggagaaaaugaugcugagaagguaaaaauggagauagaaaaagauuugaaaaugguuguggucaacaaaauacgugcaucuuccucguuccaugauacuauagcagguccuaauaugggcaaaagucaccaaaguuuauuuaaauggaaaacuguacccaauaauggagaacaggaaguuccuaaugagaguuguuauccaaguagaucagaggaagaauuacuuuacucuacuucugagaaagauugugaaacaccuuuaccuaaaagaccugcuuuucucccugaugaauguaaagaagaauuuaauuauuuauugagaggagguagucacuuuccacauggcauuucaagaguacgaccgcuuaagacaugcaguaggccaaucaggauugguuugucaagaaaagcaaggauuaaacaacuucauccuuaucugaaacaaauguguuacggaaacuuaaaagaaaauuuuugacuuucauauuucaaaacauuuuacaacaucuagaaauguuuuguuuucuuuggauauauguucuuccagcuuggggguuuggggcuugcuuuauuauaaaguggagaaguuuuuuuuuuugaguguauaaauuaugguauuaccuuucaaaguuauaaaauauuuuauggauuuuuauaugauauaaaaauguacacauuaaagccguuucauuauugga

SEQ ID NO: 1054 - RNA, 3628 nt, Homo Sapiens
agaaugucauccucaagggaagugcagagagauuucuucaguccucagcugaguauaagcuggccuccuggagucugugaacacaaacguccaaugugagugugccugugcaagccccuggcuguuuauacuccggaggguguccccgugcgucaucgguggaguggaccaaaacuggugaucuguuugcccugugugaccuugcccagaacccugcugacugagagaacacaucugcuggaaguccucugggauucaagguacagggacacuguccucucacagaacaagaagguaucuggucuacaagaacucgaggccucacugaaacggaaagcaaauacaaagaaacuuuauuuuaaaaacaugucuuggucucccaagaagagggcaauuggauugcucagccagaaugaagaguaguuuuacagaaaaaagaggacaauauugggaucaccuuugaccuuuccauuuggaaauaauauuuucuauuguguuauagaaaggugggaagcuuucauccagaacaaugaauuucauaaaggacaauagccgagcccuuauucaaagaaugggaaugacuguuauaaagcaaaucacagaugaccuauuuguauggaauguucugaaucgcgaagaaguaaacaucauuugcugcgagaagguggagcaggaugcugcuagagggaucauucacaugauuuugaaaaaggguucagaguccuguaaccucuuucuuaaaucccuuaaggaguggaacuauccucuauuucaggacuugaauggacaaagucuuuuucaucagacaucagaaggagacuuggacgauuuggcucaggauuuaaaggacuuguaccauaccccaucuuuucugaacuuuuauccccuuggugaagauauugacauuauuuuuaacuugaaaagcaccuucacagaaccuguccuguggaggaaggaccaacaccaucaccgcguggagcagcugacccugaauggccuccugcaggcucuucagagccccugcaucauugaaggggaaucuggcaaaggcaaguccacucugcugcagcgaauugccaugcucuggggcuccggaaagugcaaggcucugaccaaguucaaauucgucuucuuccuccgucucagcagggcccaggguggacuuuuugaaacccucugugaucaacuccuggauauaccuggcacaaucaggaagcagacauucauggccaugcugcugaagcugcggcagaggguucuuuuccuucuugauggcuacaaugaauucaagccccagaacugcccagaaaucgaagcccugauaaaggaaaaccaccgcuucaagaacauggucaucgucaccacuaccacugagugccugaggcacauacggcaguuuggugcccugacugcugaggugggggauaugacagaagacagcgcccaggcucucauccgagaagugcugaucaaggagcuugcugaaggcuuguugcuccaaauucagaaauccaggugcuugaggaaucucaugaagaccccucucuuuguggucaucacuugugcaauccagaugggugaaagugaguuccacucucacacacaaacaacgcuguuccauaccuucuaugaucuguugauacagaaaaacaaacacaaacauaaagguguggcugcaagugacuucauucggagccuggaccacuguggagaccuagcucuggaggguguguucucccacaaguuugauuucgaacugcaggauguguccagcgugaaugaggauguccugcugacaacugggcuccucuguaaauauacagcucaaagguucaagccaaaguauaaauucuuucacaagucauuccaggaguacacagcaggacgaagacucagcaguuuauugacgucucaugagccagaggaggugaccaaggggaaugguuacuugcagaaaaugguuuccauuucggacauuacauccacuuauagcagccugcuccgguacaccugugggucaucuguggaagccaccagggcuguuaugaagcaccucgcagcaguguaucaacacggcugccuucucggacuuuccaucgccaagaggccucucuggagacaggaaucuuugcaaagugugaaaaacaccacugagcaagaaauucugaaagccauaaacaucaauuccuuuguagaguguggcauccauuuauaucaagagaguacauccaaaucagcccugagccaagaauuugaagcuuucuuucaagguaaaagcuuauauaucaacucagggaacauccccgauuacuuauuugacuucuuugaacauuugcccaauugugcaagugcccuggacuucauuaaacuggacuuuuaugggggagcuauggcuucaugggaaaaggcugcagaagacacagguggaauccacauggaagaggccccagaaaccuacauucccagcagggcuguaucuuuguucuucaacuggaagcaggaauucaggacucuggaggucacacuccgggauuucagcaaguugaauaagcaagauaucagauaucuggggaaaauauucagcucugccacaagccucaggcugcaaauaaagagaugugcugguguggcuggaagccucaguuugguccucagcaccuguaagaacauuuauucucucaugguggaagccaguccccucaccauagaagaugagaggcacaucacaucuguaacaaaccugaaaaccuugaguauucaugaccuacagaaucaacggcugccggguggucugacugacagcuuggguaacuugaagaaccuuacaaagcucauaauggauaacauaaagaugaaugaagaagaugcuauaaaacuagcugaaggccugaaaaaccugaagaagauguguuuauuucauuugacccacuugucugacauuggagagggaauggauuacauagucaagucucugucaagugaacccugugaccuugaagaaauucaauuagucuccugcugcuugucugcaaaugcagugaaaauccuagcucagaaucuucacaauuuggucaaacugagcauucuugauuuaucagaaaauuaccuggaaaaagauggaaaugaagcucuucaugaacugaucgacaggaugaacgugcuagaacagcucaccgcacugaugcugcccuggggcugugacgugcaaggcagccugagcagccuguugaaacauuuggaggaggucccacaacucgucaagcuuggguugaaaaacuggagacucacagauacagagauuagaauuuuaggugcauuuuuuggaaagaacccucugaaaaacuuccagcaguugaauuuggcgggaaaucgugugagcagugauggauggcuugccuucauggguguauuugagaaucuuaagcaauuaguguuuuuugacuuuaguacuaaagaauuucuaccugauccagcauuagucagaaaacuuagccaaguguuauccaaguuaacuuuucugcaagaagcuaggcuuguuggguggcaauuugaugaugaugaucucaguguuauuacaggugcuuuuaaacuaguaacugcuuaaauaaaguguacucgaagccaguaa

SEQ ID NO: 1055 - RNA, 697 nt, Homo Sapiens
aguaaaggaagccuggaaugcuggaagaucuacaaacaauauuaucugaacaacaguuacagcugugauuaaaguacaaagagaaaaaaaacaguagauuuaacaguaaacuagguggaggaagggauagaagcuaaacagcauuucacuguaguaggaaaaacacugacuugagaguuaauaaguguucaaguauuuuauuguaauucuuuaauuguuuguuaaaccuaaacauaguuugauaguguuuuuuugcugcugauuauauauccugauaucagcugguuuauauuccuuaaauuagggaaaaauguucaauuuuuucaaaugguuuuucaaaguuucuacuuguucaaaucaaguagaacuaauuaauucucuauccaaagauuuuagacaugccuccagacccaaauacucugaugagaaaaagacagcuucucuguuuuuggaacucaaacuuucagcaacaugcuuucaauauuaacauauaauagacuacuguuauaugacacuaaauguaaaaucuaagugaauauacuuuauuggacauacuuuuuugauaacuuucauaacaaguuagcaugaacacaaauaauaucucacuuuauuauagaacacaacauaaucuuuuacauucuauuuaagguccuuccuacacccuacugcauaaucauccacaaauauaacuuuaucc

SEQ ID NO: 1056 - RNA, 10774 nt, Homo Sapiens
aauuuaccccaaucccguagcagacgagggcuugugcgagagggggccgggcggcugcagggaaggcggaguccaaggggaaaacgaaacugagaaccagcucucccgaagccgcgggucuccggccggcggcggcggcggcggcggcggcggcgcaguuugcucauacuuugugacuugcggucacaguggcauucagcuccacacuugguagaaccacaggcacgacaagcauagaaacauccuaaacaaucuucaucgaggcaucgagguccaucccaauaaaaaucaggagacccuggcuaucauagaccuuagucuucgcugguaucacucgucugucugaaccagcgguugcauuuuuuuaagccuucuuuuuucucuuuuaccaguuucuggagcaaauucaguuugccuuccuggauuuguaaauuguaaugaccucaaaacuuuagcaguucuuccaucugacucagguuugcuucucuggcggucuucagaaucaacauccacacuuccgugauuaucugcgugcauuuuggacaaagcuuccaaccaggauacgggaagaagaaauggcuggugaucuuucagcagguuucuucauggaggaacuuaauacauaccgucagaagcagggaguaguacuuaaauaucaagaacugccuaauucaggaccuccacaugauaggagguuuacauuucaaguuauaauagauggaagagaauuuccagaaggugaagguagaucaaagaaggaagcaaaaaaugccgcagccaaauuagcuguugagauacuuaauaaggaaaagaaggcaguuaguccuuuauuauugacaacaacgaauucuucagaaggauuauccauggggaauuacauaggccuuaucaauagaauugcccagaagaaaagacuaacuguaaauuaugaacagugugcaucgggggugcaugggccagaaggauuucauuauaaaugcaaaaugggacagaaagaauauaguauugguacagguucuacuaaacaggaagcaaaacaauuggccgcuaaacuugcauaucuucagauauuaucagaagaaaccucagugaaaucugacuaccuguccucugguucuuuugcuacuacgugugagucccaaagcaacucuuuagugaccagcacacucgcuucugaaucaucaucugaaggugacuucucagcagauacaucagagauaaauucuaacagugacaguuuaaacaguucuucguugcuuaugaauggucucagaaauaaucaaaggaaggcaaaaaggugaguaucauuaugcauugaacauauuuugaucugaaguuuuauuucagacuuauuuauuguucuuaauacuuguagaguauuguacacccuuauuugagcagaguuucagaagcagaaagcuugaaaucuauaaacaaauaauuuuagaugugucgagaaaucuuugacuaugugcacaugcuacacuguaaacauaaagcacuuuggggguaucgcuagaguaauuagguuaagggcauuauuuuguacaaaucuuuggcacccagauuugaccuuccugacaugaaagaaacaaaguauacuguggacaagagguuuggcauggauuuuaaagaaauagaauuaauuggcucagguggauuuggccaaguuuucaaagcaaaacacagaauugacggaaagacuuacguuauuaaacguguuaaauauaauaacgagaaggcggagcgugaaguaaaagcauuggcaaaacuugaucauguaaauauuguucacuacaauggcuguugggauggauuugauuaugauccugagaccagugaugauucucuugagagcagugauuaugauccugagaacagcaaaaauaguucaaggucaaagacuaagugccuuuucauccaaauggaauucugugauaaagggaccuuggaacaauggauugaaaaaagaagaggcgagaaacuagacaaaguuuuggcuuuggaacucuuugaacaaauaacaaaagggguggauuauauacauucaaaaaaauuaauucauagagaucuuaagaaaaaaaaaaaaaaaaaaaaaccaaguaauauauucuuaguagauacaaaacaaguaaagauuggagacuuuggacuuguaacaucucugaaaaaugauggaaagcgaacaaggaguaagggaacuuugcgauacaugagcccagaacagauguugaucguuaauuuacacagaggauucagcuauucggcgguacagauuugaaccuaggcagucagacuccacagauuuugcuaauaaauagacauuguuuugugguguaagauguuuuggucaaauaacuuuuuugggcuuuagaaggcuggauauuuauguaaggagcauaacaaagguaaaucuauuuuggucucuuuagauuucuucgcaagacuauggaaaggaaguggaccucuacgcuuuggggcuaauucuugcugaacuucuucauguaugugacacugcuuuugaaacaucaaaguuuuucacagaccuacgggauggcaucaucucagauauauuugauaaaaaagaaaaaacucuucuacagaaauuacucucaaagaaaccugaggaucgaccuaacacaucugaaauacuaaggaccuugacuguguggaagaaaagcccagagaaaaaugaacgacacacauguuagagcccuucugaaaaaguauccugcuucugauaugcaguuuuccuuaaauuaucuaaaaucugcuagggaauaucaauagauauuuaccuuuuauuuuaauguuuccuuuaauuuuuuacuauuuuuacuaaucuuucugcagaaacagaaagguuuucuucuuuuugcuucaaaaacauucuuacauuuuacuuuuuccuggcucaucucuuuauucuuuuuuuuuuuuuaaagacagagucucgcucuguugcccaggcuggagugcaaugacacagucuuggcucacugcaacuucugccucuuggguucaagugauucuccugccucagccuccugaguagcuggauuacaggcaugugccacccacccaacuaauuuuuguguuuuuaauaaagacaggguuucaccauguuggccaggcuggucucaaacuccugaccucaaguaauccaccugccucggccucccaaagugcugggauuacagggaugagccaccgcgcccagccucaucucuuuguucuaaagauggaaaaaccacccccaaauuuucuuuuuauacuauuaaugaaucaaucaauucauaucuauuuauuaaauuucuaccgcuuuuaggccaaaaaaauguaagaucguucucugccucacauagcuuacaagccagcuggagaaauaugguacucauuaaaaaaaaaaaaaaaagugauguacaaccacuucggaaaacaauuuggcauuaucuaguaaaguugaauccauguauacccacauagcuaucaauucuauuccuacauacgugcuuacaagaauguccauaaaacccuguuuauaauagccaaaagaacagggaacaaccauaaugcacaucaaaagaagaauggauuaaaaaaauuauauucacacacaggaguacuauauaguauugaaaacaauugaaguacagcuaaauguaauaacguaacacaauacaacucucagaaacauaauguuaagcgaacaaagcagguuuucagaaaauauaugcagaauaauuccauuuauauaaaguuccagagcaugcaaaacuaaaucauuuuguauaaaaaacccaacaaaugugaugagacaauaaugggaaggaagggaaugagaaauauuaaauucuggauggugguuaucuuugagggaggggaaugaugugauuggggaaauggacuuucaaagguaaugguaacuuccuuaagcuggaugguagguccacuaguguuugcugcauaguuauaccuuuuaucuuaaauacauuuuguaucuauuguaacaaccacuuuaaagacaaccgugcuguaaggcaguagcuaaaaacagaaaauaguccaucgggaaggguaagauggcuuucugcugagcacagggcuagaagugacagcccagugggccuuccaacuauaugccaggguguuagaugaguagagaggagaccacccaggaagucuggacaaggggucuggcaugagcucuggagaagauauauuugaggaacaugggguaugcuaguuuguuguccugaauugcuguagagaagauaauuuaaauugcaucuuagaagacgacccugagggugaauuucaacuuagggcaauuguuuuaguuuguuucuuauugguuuaaauggauacuugaagcuggauaauuuauaaggaaaagagauuuauaugacuuacaguucugcaggcuguacaagaaacauggcaccagcaucugcuucuuccccggcugcuuccacucaugguggaaggugaaggggagccggaugugcagagaucauauggcaagagaggaagcaagagagcgagggagaaggugccaggcucuuuuuaaauaaccggcucuugagggaacuaauagauugagaacuccuugcuucuccuccccagcacaccccacccccagggacggcauuaauguauucaugaggggucuucccccaugacccaaacaccucccaucaggccccaccuccaacacugggaucaaauuucaacaugagauuuugggggacaaacaugcaaacuauagcagcaaccagcuaccauucuaaaacugccauaugauuuuaggauuuuuaaaaagggccaaauuuagguuaagcaaaaagugaaaauacaguaagagaaaauaguuuuauaaaggcuuuaaaaaguguucauaaagagcaguucauagauuuuucacguaacguucaucaauagaugcuaaaacuauuggaugaaaagcuauuguggaauaggaucuucuacaaggauuuaaauauaauccuacagaagagguaucaauuauacaggggaaaauguaccuuuacaauggucaccacaauaaccaagugauucaauuuagcaucacccaagguggaacacccuaacauuaugccccuccugaugugacuuaagaauuuuaccuauuuaguuuucuugcacaaaguguuaaacuggaauuuaaucaugaggaaauuauuagacaaauccugaauguagucauucuauaagaugauugacuugggcuucucaaaaagucagugucaugaaaaaaaaaaaaaggggagagacuuguaagauacaaugaccaaaugcaauguuugaaucuuuauuguauucuggauauuuaaaaagacaaaagcuggacgcaguagcuaaugccuguuaucccagcauuuuugggaggucaaaaggggaggauggcuugagcauaggauuuugagacuagccugggcaacacagugaguucucaucucuacaaaaaaucagaaaauuagcugggcaugguagugugcaucuguggucccagcuacuugggggggugaggugggaggaucacuugagccuaggaggucaaggccgcagugagccaugaucauguuacugcauuccagccugggugacagagugagaucauaucuaaauaauaauaauaauaaaagaaagcaacaacccagcaaacagcuauaaagauaucuucgggacaauugagaacauuugaauauagacugcauauuagauaacaaugccaaauaacuguuuucucaggugugauaauaguauauguagaaaaugucuuuuuguuuuguuuuauuuuguuuuuguuuguuuguuuguuuugagacagagucucacugugucgcccaggcuggagugcaguggcacgaucucggcucacugcaaccucugccucccagguucaagugauucuccugccucugcuuccugaguagcugggauuacagguaucugccaccacuccagguuaauuuuuucuauuuuuaguagagacggaauuucaccauguugacccagcugguuuugaacuccugaccucaggugauucacuugccuuggccucccaaaguguugagauuacaggcaugagucacugcacccagccaaaaauguuuuuuuaggcaaugcaugcacaaacauuuagaggccaagugugucaugaugucugcaacuuucaauguucagcaaaaaucaacauggagagagaaagagggcacacauguggcaaaauauuagccauuguacaauugguaaaucuagaugacaguacacagguguuuguuguauuauucuuugaacuuuucuguagauuuggaaauguucugcguagagagaaaucuuuuuuuaaaaaaacaauaucugguuuugauuaaugaggcuauauucaaaagaaacacuaaaugauguggccaguuagugagaauguagccuuaucuuuacugaccucauuuuaauauuccuacucuggcugggcaugguggcucacgccuauaaucccagcacucugggaggccgagacggguggaucaccugaggucagggguucgagaccagccuggccaacauggugaaaccccaucucuacuaaaaauacaaaaauuagcuggguguggugguaggcgccuguaaucccagcuacucgggaguccguggcaggagaaucgcuugaacccaggagguggagguugcagugagcugagaucacgccauugcacuccagccugggugacaagagcaaaacucagucucaaaaaaaaaaaagaaaaaaaaagauauauauauuccuacucuuauuaaaugaauauagcauuucuuagcaacuucuuuugauuugugaguauauauuuucuuggccucaaaauuaaaguaaaaaguauccucuuacucagaggaggacaggggcaagagccugggaccuuauuugcuaauuaaaaugcacacacacacacacacacacagaaauuuugagagccauuuuaauauaauugccucccuagaaacauaccuuuuagggaauuuuuaucacuaaaccacauguuauuuaaauacguacauguuuaacauaaauacauacauaaaauucacaugcauacuuaacacuuauguuaaauauauucaauguauauacauauguacacaauauaugcauauauacauguggguaugugguaugugugcauguguguguauggccagcuacauaauuugugggacuaagggcaaaaugaaacuguacggcccucguucaaaaauuagguguggggugcuucuaagcacagucuugugcaacugcacagguugcauguccaugaagccauccugugugugugcacauauguguaugaauauguauuuuauauaauacauauauaugcauguauguaucugagaagaaauguuuaaaaggcuacauacaagcuuuuccaggucucuacuaucuguuaacuaacuagagacauaacucacaauaugcaguccccacugaguguucaccauaauuugagauucuuggcauguuaacuuuucauuauggaauauugaauaauuucaauauuauucauacauuucuuuauguucaaacauacacaaaaauagaauaaugaaacucuacccaucacccagcugcaacaaauaucaauacuuuaccguucuuaauacaucuaaccccuuacuuuuuguuuguuucuuuuggugaaguauuuaauuguaauuuuuuuuuuaagagacaggaucucacucugucacccaggccagaguacagugguacgaucacagcuccuuguaaccucgaacuccuaggcucaagugauccuccugccucagccgcuugaauagcugggacuacaugcauacaccaacacacccaacuaauuuuuaaauuuuuuguagaaauauggucuugcuguguuucccaggcuggucucaaacuccuggccuugagagauucuccugccuuggucuuccaaacugcugggauuacaauauccggcccuacuggaauauuuuaaaguaaaucucagguguuacaucauugcacuuguaaguacuuuaaaauguaucucuagcagauaaaucuuuuuaacaaaaccacagcaucauugucacacucaaaaaauugacaagauuuccuuaauuaucauauaauagucuguauuguuucuaucucaaaaauacaguuuucuugguuguugaaaucuagauccaacauugcauuugguugaugugucuccuuuacucuguaaaauuuaccccugcguuuuaguucuuuucggcuuuuauuuguccuguggaauuuccuccacucaggauuugacugagaguauccccagaguguccaguuagaccuagaagcuggauuugauccugguucauuuauuuucccccaagaauacuccauaggugaugcuauacacuuucucuuacaucauuucaggaggaacaugaugucugauuguuccacuuucagugauuuuaauauugaucaaugaguucuggugguaccaacuacuacaaaguuucucaucaaucuuucaccugaugguuuuagcagcuauugauaauuguugccuggauccauuauuucauuucagggguuguaaaauagugauuuucugguucuaucaaaccucuugcauuuaucaucuaugauucuucuuuaaggaacuuucucuaaaucugaaugggaaagaugcgauaaauauuuaucaaauuuuagagugaguuagugcccuagcaaccuccacaguugacaaaugaguauuucuuuaaagcaagguauggcccaaccaauacuuugaaacuagcauguuuagaauagagcaggaggaaacuauauuugaaaggucagaaguggaaagacuaagagggccugaacaauaagaggacagaaccaagaggaguuggcaacuaauuggauguggggauuaaggaaagguaagcaucaaagauuaccuccaaguuuguuagaagguuaguagcaggauucugaugccauucaaguaaauacaagucucagucagaugaaccccaagagccacauguauuugagggguacuuugucucacacuuuuaccuguuacaugguuuucaguaauuuagaauuuaagccaguaguggggcgacuguacaucuaucgacauggugagguagagcauguuugggaggaaagacguugaaucccauuuggugacagugagcuugaggugcugccagaacacugcacugaagauaggaggagacuguaggaaauacaagauaggaaaggucuccacugaaauguuaacucuuucucucuaaacggccauccaggccucaaugucugcaguuucugaucugugauuaugacuuauccaaaucuuacauuucuuaaaaauagucauagaugaagggaaucacaguugauaguuauauggugacauuauuggcuuaaauucuaaauaacuagaaacuguauaauaggcaaaacugugaggcaaauaaaaugcuucucaaaucuguguggcucuuaugggguuaauuugauuuggaccuguauuaauuucuuauggcugcuauaacuaacaaauuaccacaaacuuggugguuuaaaacaacacacauuuauucucuuucuguucuggaggccagaagucuaaaaugagauucacugggcugcaguucacugggcaaggccaugcuccucuggaggcuuccaugaugcaucccauauucaguguuucccgaguaagccccacccaugcaggucugcaguuuuaccucaacaggcuuuugcacucaguggcucucuccugugguuucuaucugaaauucucuucauuuuuuuuuuaauaacugcuuuauugagauauaauucacaugccauacaauucaccuauacaguauacaauucaguaguguuuacuauauucagaguugugcaacuaucauuuuucucacccccaaaagaaacccuaugcccguuaguauucacucuguuuucucacaacucuagguaaccacuaaucuacucuccaucucuauagauuugcccaugcuagacauuucauauaaauggaaucauacauguggucuuuuucacugaguauauuuucaaggugcaucccagcuguggcaugaaucagcaucucauuccuuuuuauugccaaauaauauucuaucauauggauaugucgcauuuuauguauccauucaucagcugauggacauuuggguuguuuguacuuuuuggcuaccaugaauaaugcuacuaugaacuuuuguguacaaaucuuauguggacuuguuuucauuucucuuggauguauauuccuaggagaauggcuggauuauacaguaacucuuuccucauaacuuugcauaucaaaauuauauccaucuuucagaacccaaauucaguguuauuuccaaaguguuccaacaucucccacucaaaaugaaucuucucccuaguacucccauuguuuaguaccuaauuguucuuaccaguuugucuuagagcucagucauuccuacacagcacuuuucuucauuauacugcuaauuucauuacacuguaagaguggggacaagcuguucuucuuguauaccagaaaguagugagugcacugcugugaagaaagcaggaacucaaaaguuaagaauuuugaaugagccuauaaaaugugucuaauaaauaauaauguucauuuucaaaucucaacaauuaaauguuuaacaaauaacacuugaaauaaauguuuauuagaaaaaccaa

SEQ ID NO: 1057 - RNA, 6216 nt, Homo Sapiens
agaggggugcgggccgcacucagaggccguccaagacacuggcaagccgcagaagcccaguucgccggccaugaagcagcgguucucggcgcugcagcugcugaagcugcugcugcugcugcagccgccgcugccacgagcgcugcgcgaggcgcucugcccugagcccugcaacugcgugcccgacggcgcccugcgcugccccggccccacggccggucucacucgacuaucacuugccuaccucccugucaaagugaucccaucucaagcuuucagaggacuuaaugaggucauaaaaauugaaaucucucagauugauucccuggaaaggauagaagcuaaugccuuugacaaccuccucaauuugucugaaauacugauccagaacaccaaaaaucugagauacauugagcccggagcauuuauaaaucuuccccgauuaaaauacuugagcaucuguaacacaggcaucagaaaguuuccagauguuacgaaggucuucuccucugaaucaaauuucauucuggaaauuugugauaacuuacacauaaccaccauaccaggaaaugcuuuucaagggaugaauaaugaaucuguaacacucccauggcaaaauugugaugaggcaauaaaggagcucacccuuaaagaaaaaagagaaaacauggauuggaaugacucugaaaugaagagauagaugugaagcaaaagaagagaucaucucagaggacucucuuuuauaucacuggauucuaaaaauugguauccuuggugcacugccuuuguauaguacuuuuacuuuguguagauguaauuuuacauguauaauugucauguuacaaagcugugaccauguagcuucaucucagauuaaugcaaucaaaagaauacagagcagcaaccaaaaauaauuucaaaaauaacccauacucuuuacuugcaacucucaaacaccaggaaagagauucuguugauccuagaaauauuucucaacagucucuccacuccugccacuucccucacacaccacagcucuaccggcugcuuauaaaguguuuucaacucaccauugcauaauggaucuggaacuacucauucaucaugucccccaccaaaaacaagguauucaacaaacaaauuccgaaugaggugauaucacaugccuuaggauuuggggucuccccacaugucuauaucaagaacacaaaagacacaggauuagauucauguccucgagaaguucauagucucaaugagggggaaaacauaaaauaauaaaauaauaauacaagcuaguagauauucacuaugagagugugugguaccuagaaauaagaucuuagagaaguccuuuugggcuggggaagucagagaggcuuuaugguagagcuaacagauuugaauuagaccucauggaaucaguaacguuuauauggguaaaugugaaaauagcagcuaauauguauguagcccuuauuaaauaccugcacuguuuuuaaguacuuuuuaagucccauagcaaccuuaugagauaggaacuaucaacccuacuuuuagaugaggagaccaaggcaucaagagguuaaguaucucuaucucaggucaagauuuggucccagacaguauggcuccagagucauguucuuaaccguuaugcgguaccacaacauacagagaaaggcagaguaaggaauccaagugaagagauggcaggagcaaaagcauggcaggaggagaacaggaugaggcuacuacuugggaguaaacaugcuguuuaaggaauggaaagugaguuuagauaacuggcugagauggagaggacacugaauugcagagacccuuaagugccaggacaaggagacaggcuuggagguaacucuggaaaaaguaauaaaauaaucuauucaauagaguaggcuuuauucaaagaucacaaauauccaugacucccuucaacuuugaucuaaaucuaaaaauaaucagagaccaauagguauuccuccgagguaaauguacaaugaugggaguggagugaaguaggaacgaaaaggcagaagacauggaggagggugaagaagaaaaccaauguugggauaauccauagguaacuaugagcucacaagacugggccaccccacgagacucaaagaguaaccaaagauuccuucucacacaucauacuucaguaugugcacagagagcuucaugguuuucuaaugacagggacauuaacuuauguugcucaugauuuuaagaaaaagagugcaugccaguaggguguaauuuccccacucugaaguuaauaaagauugaggcuccgucucucccagagagccugugggacaaacuauauggaaauggauuugaagaaguacaaagucaugcauucaaugggacgacacugacuucacuggagcuaaaggaaaacguacaucuggagaagaugcacaauggagccuuccguggggccacagggccgaaaaccuugugaguagaauggugcugccuccccucccugcccaguguaccccaacaggacugcuuagggugucccuccacaucauccccaagcugauaugugagacaucagccucuacaccugaaaaggcugcuguuggaaagacaaaguguaucacagcugccauaauaaaguaccccaaaccgaggauauuucuuccaccaaauugcaggcccugccgagcuauggccuagaguccauucagaggcuaauugccacgucauccuauucucuaaaaaaauugccaucaagagaaacauuugucaaucuccuggaggccacguugacuuaccccagccacugcugugcuuuuagaaacuugccaacaaaagaacagaauuuuucacauuccauuucugaaaacuuuuccaaacaaugugaaagcacaguaaggaaagugaauaacaaaacacuuuauucuuccaugcuugcugagagugaacugaguggcugggacuaugaauaugguuucugcuuacccaagacaccccgaugugcuccugaaccagaugcuuuuaaucccugugaagauauuaugggcuaugacuuccuuaggguccugauuuggcugauuaauauucuagccaucaugggaaacaugacuguucuuuuuguucuccugacaagucguuacaaacuuacagugccucguuuucucaugugcaaucucuccuuugcagacuuuugcauggggcucuaucugcugcucauagccucaguugauucccaaaccaagggccaguacuauaaccaugccauagacuggcagacagggagugggugcagcacugcuggcuuuuucacuguauucgcaagugaacuuucugucuacacccucaccgucaucacucuagaaagauggcacaccaucaccuaugcuauucaccuggaccaaaagcugcgauuaagacaugccauucugauuaugcuuggaggauggcucuuuucuucucuaauugcuauguugccccuugucggugucagcaauuacaugaaggucaguauuugcuuccccauggauguggaaaccacucucucacaagucuauauauuaaccauccugauucucaaugugguggccuucuucauaauuugugcuugcuacauuaaaauuuauuuugcaguucgaaacccagaauuaauggcuaccaauaaagauacaaagauugcuaagaaaauggcaauccucaucuucaccgauuucaccugcauggcaccuaucucuuuuuuugccaucucagcugccuucaaaguaccucuuaucacaguaaccaacucuaaaguuuuacugguucuuuuuuaucccaucaauucuugugccaauccauuucuguaugcaauauucacuaagacauuccaaagagauuucuuucuuuugcugagcaaauuuggcugcuguaaacgucgggcugaacuuuauagaaggaaagauuuuucagcuuacaccuccaacugcaaaaauggcuucacuggaucaaauaagccuucucaauccaccuugaaguuguccacauugcacugucaagguacagcucuccuagacaagacucgcuacacagaguguuaacuguuacaucaguaacugcauuauugaauuguucuuaaaccuguaaaaaaaaauuaccuguaccaguaauuuuaacauaaaggguuggauuuaggaaauuauuuauuuuuagguacauuaggcaagagaccucuaccuaguagaaaguguagucuaugaccacugccacacuaaaaacuauuugucauuguuacauggcauaaauacugaaguugagaguguuuagaaauuuuuauagaaauuuugacacaguaauuuuguuugaugaaucuuuuaaaaaacugaggagguauuuugcauaucuuuuuuuucauuuucguaauuuguauugcauucuauaaaaauauuaguucauaacagaucagaaauuuaaaauaacuggccuuuuuccucagguaguuugaaaaacacacucuagagaugcacuguccaauccgguagccacuagccacauguggcuaaauuaaaauuaaauaaaaugagaaauguaguuucucaguugcacuagccacguuucaaguucucaauggcuacgugugacuagugcuuaccauacuggacagcacagacacagaauauuuucaucaccacagaaaguucuaucuguucuauuauagagacuuuuaucuaugcccuaucuggauucuacuuauuuauaauuuaagguaaacaucugaaagcacauuucagccuauuugcuuagugaaacauuaagcuguagacuguaaacuccucgugaguaggaacccugucucagugcauuuuguuuuccugcuuccuaccucaagaucuuggcaaugguacacuacaaaugugcugaguuagaauuacucugaaguuaugaaacauauaaugaaaacaauuuuuucuagagcuuauauuuuuauuugaaugaaauaaaauguuuaaauauuuaaaaauaauagagacaggguuccaccguguuagccaggaugauguagaucugcugaccucgugauccgcccgccucggccucccaaagugcugagauuacaggccuugaaaauauucaggauauccaguuacuggccacuaucuguccccugauaccaagaaguuggacacagaacuauaccuucucugauacaguaguugcuugaagagaccauggauucaauuguggaacacuaguuuguauuacugaaggcuggccaagcuguugaaauacuugcugaauuggaugcugaagaauaccugcucuuccagaagucucugucaccauaauugguacauugacuuuauaaaggugaccuuaaaaaggagaaagcaaaauugaaacaaacuucaaaaagaagccuacaagaaguacaucaaagauuacauaaaaucaaucaaaggccaacaugaagaacagagaccuaaacaguaaaaccuuuuaugacagaagcuguagaacaaaccaagcacaucuuacuaauuucaacaacuaccaguuuuuuaccaguaaaaacaugaauccagauggcauaguugcucuaccaugaggauggugugacccuguauaugauuuucuuuaaagaugguuuagaaauggaaaaauguuaaccaauuggcaauuacuuuggcucuaucaccugucaucacaacugcuugcugccuaucacccacaugacacaaugacuuaagauaaauuggacugaugucaacuugagcucuucauuuauuucgaccauuauaucuuuggaguggaagcauuguuuuuaagaaaaacaggucggcuggcgugguggcucacgccuguaaucccagcacuuugggaggccaaggcugguggaucacaagguugggaguuggagacuaaccuggccaauauggugaaacaccaucucuacuaaaaauaaaaaaauuagcugggcaugguggugcaugccuguaaucccagcuacucaggaggcugaggcaggagaaucgcuugaaccagggagucggagguugcagugaaccgagaucacgccacugcacuccagccuagugacagaguaagacucugucaaaaaaaaaaaacaaaaaacuugucaaguagguugucuaaaaauaaaaugcacuuaaacucauuugaaagaauccuuuuuaguuuaauauauguuuaugcuaaauccauccuaua

SEQ ID NO: 1058 - RNA, 3000 nt, Homo Sapiens
gcgccuccgaacgcgcgggcgcacgcugagagccgggaggaccaggugagggggccuccgucuuccgaagacaggggcccggagcuuccuccgcggggcccccaggcccgagggccgggcugcugauccgccaggcacgguguaaagaauauccagcugguggcuacaguucccccucugguuuugcugccaugcauccugggcgaacuacugguaaagggcccucuacucacacucagauugaccagcaaccuccacggcuucucauugugcacauugcucuaccguccugggcugacaucugcaccaaccucugugaggcucugcagaacuucuucucucuagccugcagcuugaugggccccagccgcaugucccuguucaguuuauacaugguacaagaucagcaugagugcauccucccuuuugugaucaaaaugcauauauccuuaggagaaguaacauugaccuaguaucagauuaaauuaguugacuccuaagagcaaguuuuuauaaagguagaugaggagaaccaaaaggucgcuugucucgguuuaacauguuggcuccuuaagcugacugcagacuaacccaaauaucucuucuuuacugaaguuauccuaaagagcguauuagauaggacguaugaauucugaagugaucaaccacaucaaaauucucacuucugggaaaaccucauuuuuaaguagagaagcuuuuggugccuagacugacuaagaaaugaagaugaugucuaagcaagugaaagggaacuuugcuagguugcagaccugcaucucagaacuccgcauguuacagagagaaggguguuucagaucacaaggugcuucucugcggcuggcaguagaggaugggcuccagcaauucaaacaauacagcagacaugugaccacaagggcagcucugaccuauaccucccuggagauuacuauucugacuucucagccuggaaaagagguggucaaacaguuggaggaaggguugaaagauacagaccuagccagagucaggagguuucaggucguugaggucacaaagggaauccuagagcacguggacucagcgucuccuguugaggauaccagcaaugaugagaguucuauucugggaacugacauugaccuucagacuauagacaaugauaucgucagcauggagauuuucuucaaagccuggcuacauaacaguggaacagaccaagaacaaauccaucuucuucuuucuucacaguguuucagcaacauuuccagacccagagauaauccaacaagccagaugucucacuaugagacaacugcucagccagcccagaaguaaaacaaugugucugaaaugugaucuccaagagcgacugcucugcccaucccuacucgcuggcacagcugacggcuccuugagaauggaugacccuaaaggagacuucaucacacucuaccagauggcuucccagucaucggccucucauuacaagcuccaagugaucaaggcuuuaaaaucuagcgggcucugcgagucauugacauauggacucccguucauccucagaccuacaagcuguuggcagcuggacugggaugagcuggagacaaaucagcaacauuuccaugcuuugugucacagccugcugaaaagggaauggcugcuguuagccaagggggaaccaccgggcccaggacacagccagagaauuccugccagcaccuucuaugugaucaugccgucacacucccucacacugcugguaaaggcgguggccacgcgggaacugaugcugcccagcaccuucccccugcuaccugaggacccacaugaugauagccuuaagaauguggagagcaugcuggacagccuggagcuggagcccaccuacaaccccuugcauguucaaagccaccuguacucacaccugagcagcaucuaugccaagccucaggggcggcuccacccacacugggagagccgagcuccgagaaagcaucccugcaagacugggcaguugcagaccaaccgagcucgagcuacuguggccccccugccuaugacuccugucccaggcagagccuccaagaugccagcagccagcaaaucuuccucagaugccuucuuccugccuucagagugggagaaggaucccucaaggcccuaagucaccagcaccagagcccagcugcccagcuuaaccauauccaugcucagguucacauaauggcuaucuguggucagacuugcucucuauccgccugagccucugugagugagggcugacugggaaacaacagccuuccuguccuguuucagugcugucccacuccucaagucuggaagcgacacacccgagccuguccuuucuccagcaaggacuuucauuuucuuuagaaucauuugcuacuguuuacacaggugaagauuaaacacccaguaagcuucuaccauuguuaggagcauucauaacucagaauuucuucuuguagcucuguguaagcagguggaugaggucagaucaccuuugguaaacuggaccucaggaacaaggaugagguuuugaaagcucauaaaagacaaguaagauugaaauccaagccucauuucagagccugugcccuucccacuacaccaccaggcuucagccuccaaagagacaagugcuugguaccuacaugcaaagugugugugcuggggggugggagggcugcccagaacaggggagaggaugguguaaaaaaagaccuacuccuuuccuguuacccucuccccacauguaccaaccuuccuguugcucccuccauccacagaauaauagcuaccauuuauaaaauguuuacucugggcugggagcaguggcucacaccuguaaucccaacacuuugagaggcugaggugggaugaucacuugaggccaggaguucgagaccagccugagcaacacugugagacccccccgccaucucuacauaaauaauaaaaacuuuuaaaaaaaca

SEQ ID NO: 1059 - RNA, 8771 nt, Homo Sapiens
gagucagcuaggaggaggccagagggaaacaguggggcuuucgaagcuuaucaaaagcaaaccuugcucuuuugaaaaagcauuuuccaacgcaaccuggggacaaagugggguuaaauuuuacacagauugcuuacgagcaagaguuaaguggcuaacaagucaugaaaucuuacggagaagcagguaaagccaaaauuaaaaacucccuccgagucagcccauucugcgacccaccuccuccccuuugcggcaggaacucuacuccaucgaggggcuuugcugcaguggcacugcccacgcauacucaacuaaaagacucagaccacgccagccaugccacgaggaugccuccaaguugugagaaaaucaagcaucuacaaggaaaggccacaugucggcauuccagccacagccucagcugaggucagagcuaacagccagcaucaaccacuaaccacacaagugaaggagacuucgaagcuucaaacugccccagcuaaugccaaguggagcagagaugaguugucccugcugaaauugcagacucaugagcaaaauaaauguaguuguuuuaagacaaguuaucagauucucaaaauggacagcgacuuaaagcaauuaaagaccacugcgacaaaugcuccugcgaacaccacuccgaaguuaauggcgcagacgucuggacuuuaaaagcuccgcugccgccuaggcgcggggcugaccugcgggggugggguggggggagggaggucgaggcccggccccacguggccgcugcugccgggcucaccccagccccgcccggaggcgccccgcggccccggcuagccagggcgggcggccaccucugcccuacuccuucccuccgcguuccgggccucggagccgccuugaggaggaugagucccuggagcugguuccugcugcagacccucugccuccugcccacgggcgcagcuucgcggcgcggggcgcccggcaccgccaacugcgagcucaagccccaacaaagcgagcugaauuccuucuuguggaccauuaagcgagacccaccaucuuacuucuuuggcacaauccaugucccguacacccgaguuugggacuucauccccgacaacucuaaggaggcuuuccugcagagcagcauuguguacuuugaguuggaucucacagaccccuauaccaucucagcucucaccagcugucagaugcugccacagggcgagaaccuccaagaugugcuccccagggacaucuacugccgccucaagcgccaccuggaguaugucaagcucaugaugcccuuguggaugaccccagaccagcgcggcaaggggcucuacgcagacuaccucuucaaugcuauugccggaaacugggagcgcaagaggccugucugggugaugcucauggucaacucccugacugaaguggacauuaagucccguggagugccugucuuagaccuguuccuugcccaggaggcugagcggcugaggaaacagacuggggcaguggaaaagguggaagagcagugccauccauugaauggguugaacuuuucacagacaagcugguguacaaaagagcugguuuacaagcuuggcuugguuuauaugcagcaauuacucagcauggagcagcccuggaugcacgaugugagcuggugccuaagaugaagggaaauaagcaagcuuaugggagagaagagaggauggagggguuuuacagagagaucugucuccuuugguuaagguugcaucacaggcacaggaaauauuagaguaacugagggagguaaacuauguggaaggagggaugcugugguuugaauguguccccuccaaaauucagauguugcuagugugaugguauuaaaaggugaggccuuuaggaggugauuaagccaugaaggcuccucuuuauaaggaccuuuuugggauuaagacuccucuuuauaaggccuuuaugggauuaaggcccuaauaaaagaggugucaugcagccauucaguuagcuugcccuucugucuucuuccaugugaggaugcagcaagaaggcccucaccagaccaaaggccagugccuugaucucggacuucccagccuccagaauggaccuuucuuuuaggucaucuuugcuuugaaccagacccuccugcagcaggaaagccugcgagcaggcagucuucagauccccuacacgacggaggaucucaucaaacacuauaacugcggggaccucagcuccgucauccucagccaugacagcucccagguucccaauuuuauuaaugccacgcuaccaccucaggagcgcaucacugcucaggagauugacagcuacuuacgccgggagcugaucuacaagcggaaugagagaauagggaagcgggugaaggcccuuuuggaggaguucccugacaaaggcuucuucuuugccuuuggagcuggugaguagugggucaccucugauuagccucugaaaucugaggcuucucccaagaagggaauguugaggugagccccugcuuacuucacaguagccuugaaaaucaggagccuugaacuacaguagcugugaaaacuguuugccuaaugguuacuggaggggacagaauggguucaaaguuccuccaaagcuccauccuuaaagaaucaucacuauuugacauguccaauaguucccugaaauuuccauucccaagcuugucuucauuugaccugacucagagcuugcucugugugaauagcccuauucuuaggguguguguugaaaacaaucaguagcagcuguuuaacaucauaguugcuggaaauagcaauauuaauugaagcuuacaaggggcugcccaaaaaacuuaaaagcaaaaucccauaggggguauagaaaagcucuaaaauauuccuagagagucacaugcaugagaagagcugugcacaugcccaggaaagaccugagaagguccuaaucucucaccucuggcugaucuugaggcucuguguaagcagagugugaaagcuaaggcaaagucauaaauugccuguugaagcaucaaauacaugcccccaaacucacacagccccucugcaaagguugggaaacuugcaaggaauuuaaggaaaucucuguucagucauuagccagccacuaaacuaacugagcagauccuucagugaucacacacaacaaagaauacagacuuuacagacuuaguccuagaaaaucacuacacaaacagcaacaacaaugcaccugggacuaagggagaggagaugaguuccagaguugguauauuauuuaaaugucuaguuuucaauaaaaacaauuauaagacacagagcaaaacuagaaaguauggcccauacccagggaaaaacaagcaaccaauagaagcuguccuugaggaaguuaauaucuuggacuuacuagaaaaugacuuuaacacuaguuauuauaaauauguucaaaaaacuaaaagaggccaggugcggaggcucacgccuauaaucccagcacuuugggaggcugaagcaggugggucaccugaggucaggaguuugagaccagccugaccaauauggcaaaacccuaucucuacuaauaauacaaaaauuagccaggcguuguggcgcacaccuguaaucccagcuacuugggaggcugaagcaggagaacugcuugaaacugggaggaagagguugcaguaagcugagaucacaccacuguacuccagccugggccacaagagugaaacuccaucuccaaaaaaaaaaaaaaaaaaaaaaacccuaaaauuaaccauaucuaaagaauuaaaggaaaguuugagaacaauaucucaccaauacagaauaucaauaaaaauauaaaaauuauuuuaaaagaaccaaauaggaauucuggaauuuaaaguguaggaacugaaaugaaaaauucacuacgggggcugaacaguagauuugaacuggcagaagaagaaucaacauacaugaagauagguugauugagaugauucaguaugagaaagagaaaggaaaaggaaugaagaaaaaugaauagaucuucagauaccugugagacacccucaagugugccaauguauaccuaacgggagucccagaagacaggagagaaaaaaagaaagaaauaaaaagaauauuugaauuuaaaauugcuugaaaaugucucaaauuugaugaaaaauauuacucugcacauucaacccaugaacuauaaguuguauaaaaucaaaaaguuucacaccaaggcgugucauagccaaacugucaaaagccaaagacacagaaucuugaaagcagugagagcaaagcagacaagggauccccaauaggauuaacagcagauuucucaucagaagccaugcaagccagaaggcuaugggagacauacucaaaaugcugaaauaaaagacugucaacaaacauuuccacauccagcaaaaaucaaaaacgaaggagaaaucuguugcaugugagcugaauagaauuuguauucugcuguuguuggaugaaguauucuuuaaaugucaauuagaucaauuugauugaugaugcucuucaguucaacuauauucccuaucugauaauuccagaaucucuaucaugucugagucugggucugaugcuuucauuguuucuucagauugugauuuuucuugccucccagugugacuuguaauuuuuaauugaaagcuggauaugauguauuuggcaaugggaagugagggaaauauguuuuuagugugaggguuuauguuaaucuuucucagaguugggcuguuuaauguuuugcuguggucugaauguuccuuaaaacuuguguguugaaacuuaagaggucgaggcugaagugagcugugaacaugccacugcacuccagccugugugacagaguaagacucucuguauuaaaaaaaaaaaaggcucucacugggcacugaaugccuaugccuagauuuuggacuucccagccucuagaacugugagaaauaaauuucuauugcuuauaaaugacccagucugugguauuuuguaacagcaacacagacuaaggcauguuugcuguaacucuaggucccagaggcuucaguuuccucuagugaccucuaguuuuuccucuaguauuuuuugucuugugcuuucuuaagaaccuucuuaaauagagucugagucuugcugcacuuucacauauaauccacuguuauuuuacuggaguccuauuguuguggugcuaaagugaagauaccauuucauacucacuaggcuauaauaaaaaagauggagaguaaaaaguuuuggugaagacauggagaaauuggcacccucauacauugcuacugggaauuuaaaaugguguagccauuuuggaaaacuguuuagcaguuuuuaaaaauuaaacauggggcuaccauuugauucagcauuucaacuuccagauauaugccuaggagaauugaaaacauauguccacacgaaaauuuguacacagauguucauggcagcauuauuuauaauagccaaaaaguggaaccaauccaacuauccaucaacugacauggauaaauaaaaggugauauauacacacaaauggaauacuauuuggccauaaaaaggaaagagguacugauauaugguacuacauggaugaacuuugaaaacauuaugcuaagugaaaacagccagucacaaaaucauaugauuauauuuauaugaaauguccagaacaggcaaaucuauagagacagaaaguauucauagauuagugguugccaggggcuggggucaaaacgaugaaaauguuuuaaaauuagauaguggucaugauugcaugauuuucugaauauacagaaaaaaucaccgacuggcauacguuaaaaggaugaauuuuauguuaugugaauuauauucaaauauuaauaaaacuguuauagaaauauaagggguuuggcucccacauuaugcucauugaaaaguucugccacaaacaaacugcaguuugugcccucagcaaugcccgugaguaugugguaguuuucuucuucuguaaguccuguguuucaugucuggauugggcaccgugugcacauuuguacugucucaacaaauggcuucuuggaacaaagcuguuagccugggccucacucuugaggcaccguaacaguggugcagaccccagaugagaaaguuaggaaacagagccagugguggugucccaaugcaccaccccgggucuguguggauggaaggugcccaggugcuggagugugggcuucugcuuuccaccccugccagacuuaggugagcucccaaaaacuucccguaugucccguggcagggguaauggggcgcuggggagaggggaaaggucgacuggguucugggcuggugggaggcuggggcacagcuuggucugagcaguucggugggugggcccucgugguggggguucugccaggcagguggaacaggcaacaccaacaccugagcuugcccaguacucagggcuugauuugucauacugaugcagggcuagauuggggcugacagccccugggcacuccugaugcccgaagugcccaggggcugugagcccccaucuagcacuggcuccuucuaaggcaaaguuauauuccuguagcugcuuucucucugugccuucugaaggcuaaguugaacagaggaaacuacagaaauugcuccgaaacacauuaccgugugcuuuuaaaacuuaaaagcugugugguuagcaaacuuuuaauugcaaaaugaggauaacugaaaauggaaaguacuggaguuuuaaaaucaagcagcgacuuuugucauggggaucuggauauaaaaugcgaagauuagaaauggaaaucaccuuugcaguagaagaaaaauugaagucagaagugcuaaguggaaacuauaaucacuuguucuaaauugccaguuccuuauuugcaaaugaauaaccuaggaucaguggugaaagacaugacuuuuuuucuuauuuaggugucgaucuuaaaucagcucaugcugauuuuuggcuccuguuugccaggguuacuucuccaguggccuccucuccuaccccacauuucuagguuacagcuaucgccccugcacuggcagcugucuaggcuggucuaggcuguggggaggagaggggaggaugggagggaaugguuuugccaaacuucccuuucugagccccugcugacccaugaacacccccuuugaugcaugagggugaaaaugaaagcaggaaccaugggccuucugcuuccuucucggggccuauuugcuguacugccgcaggcucccaggguucccugguugugacuccugagacuacaguggguuuguccuaugcagaaaccuccaagaaugacagaucuuagauuagguugccuuuacuuuuucuagaaaguggugauugggaaguagccauuccuuccgucccaccagccucccuguuuuuucagagagcacaauugcauuccauccuguaguugggaauuccccccccuccuuuuuuuuuuaauugagacagagucuugcucugucacccaggcuggaaugcaguggcaugaucucggcucacugcaaccucugccucccggguucaagugauucuccugccucagccucucaaguagcugggauuacaggugccugccaccaugcccggcuaauuuuuguauuuuuaguagagaugggguuuaaccauguuggccaggugggucuugaacuccugacuucaggugauccacccgccucggccucccaaagugcugggauuacaggugugagccacugugcucagcuugaauucuuguauuuucuccagaccaguguccucaccuuucaggauccugcucacauaucaccucuucugggaggucuuaccagguugcaguuugauguccaggcuauccccuuagcuuugugacuucaggucauuucaugggcaacaacacagugcuggauguuuugcggcgugaaggcuaugagguagaacacgccccugcuggacgacccauccacaaagggaagaguaaaaagaccuccacacggcccacucuguccaccaucuuugcuccaaaagucccuacccuggaaguaccggcaccagaagccguauccucagggcacucaacgcugccuccccuugugucccggccuggaagugccgacacgcccagugaggccgaacagagguuccggaagaagcggaggcggucacagcggaggccgcgacuccggcaauucagcgaucuguggguccgccuggaggagagugacauagucccgcaacuccaggucccuguccuggacaggcacaucuccacugaacugcggcucccucgccgugggcauucccaccacagccagaugguggccagcagugccugccugucucucuggacuccuguguucugggugcuggugcuggcuuuccaaacagagacaccccuccuguaacgacuggaagcaccaggcuaagaaccugaccccucggacuugaagaauggccauuccuguacuccacauucuggucuagccuuguugggcccaauccagaagagacugcucuugaaaaagcggcccaguguugauucuucucuuuccaaggaaugugacuuuggguuauccaacuuugggggcagguguacaguuuuguaacauagugaguugugugaaaauaaauuauaaaugaguuguaugaaaauaaauaccuuuuuuuguaua

SEQ ID NO: 1060 - RNA, 4981 nt, Homo Sapiens
acucucauguaagucaacaacauccugggauugggacacacuuucugggcacugcuggccagucccaaaauggaacauaaggaagugguucuucuacuucuuuuauuucugaaaucagcagauuugaucucaaagaaaaaccaagaccaguauuugucccagguucugcuuuuuuacaauuuccuccgaaauccagauaccugucaacaccuuggaaaaacugauuucuccccaguuaguaguguugugugacugucaucagcccaguacaaaaauggccuucuuuguuggggagcuucuuacccuccaguguuuugcccaauuuuuguccaagguggcaacauaauuuaguucaguucuuguuuauuuccaccaucaucuaugcaccaaaauuuaugugccucaaggagggaccauucagaggaugcuucccaccaguucaagugacagugucagaaccaaagcgcauauuguaggaaaucaaacaauggccuccaaguuccauuucuacccagggaugaacaaaucaacaucaaucuugguaacacaacugccacugauggugccuuacucuucucucaugacauggcacaauugauagcaaacauaaaauuuguucuuguuuaaggauuuauauccacuaauaugguaacauaguagugguuccauaguucuaaccuguuuaucaauccaguuaaucuuuuacuaucuugcaaucuguuaaugaaacuguuuuucuuuguuuuauaauuucaacuuuuagagucagggguacaugugcagguuuguuacaucacuaaauugcgugacacugagcuuugggguacaaaugauucccaucacccagguagugagcuaaauaccuacuaaauagguaguuuuucagcccuugccucgcucccucucucccuucucugguaguccccagugucuuuaguugccaucuuuauuuauguccacaugcccaacuguguguucuuaacuaaacauuuugauucauagcuacccauucuacuuccaguaaacagcaaguuuuauuugguuaaugcuaaccaaauagauuaaaaggaagucaugacaauuagacauuggcauugauuuacugaccauuuauuccacuuggaucucccaccucuaggucaaggagagccccuggaugacuaugugaauacccaggggccuucacuguucagugucacuaagaagcagcugggggcaggaagcagagaagaaugugcagcaaaaugugaagaggacaaagaauucaccugcagguauuuucaucgucguugcaccuacccagaaaucuguaauucagaugggcauuccaauaucacaguaaagagcaacaaugugugauaauggcugaaaacaggaaguccuccauaaucauuaggaugagagaugcaguuuuauuugaaaaguaaaggugaccaugguccuugggcccuaacaucuggacgaagccuuguaaaacagaaauacugagguguuuuaauccucagaaacauuuagauugggacacaaaucuuauuuuuuacucuuaaauuuuucacauuuugggggacauggucuauauuuuucucagauuucugauauguugucuuuuaaaaauguguaaaaguuacaguuccuuuucuauaguuuauuuuaaaaugugggucaauagucccacugcuuagaauaagaggcacacaggauuucaauagaaauugcaugccuuuuuuguaucuuucagagugcaagacugggaauggaaagaacuacagagggacgauguccaaaacaaaaaauggcaucaccugucaaaaauggaguuccacuucuccccgcaaaccuaggucagacuuuuccuuucaucuuuguguucaucuacuguaaaguguccgucugugucugugagggauugguuccaggaccccuguggcuaccaaaauccaugcuucucaagucccuuauguaaaauggugcaguauuugcauauaaccuacauaccuucucuugugcaaucccuaauauaauguaaaugcuauguaaucguuguuauacuguauuguuuuuauuuguauuauguuuuauugucauauuguuauuuucucucaucuuuuucaagucuuuuccauccacaguugguugaauuuguggauguggaacccauggauacagagggccaacuguauuuaggauaauuucaucacuuuuaauucaaaccagaauaugugaauaagcagacagaaagaaucuuuuugaugucgauguucaacuauuuuuggcaccauaguagaacaugguugcuuucuauuuuuucuuggguauggagguuucuugaagaccuagaacauagaagaaugccuaguuaaaaaaaaaaaucaaugaaacuacgaguuuuaggccaaaucugagaaaagaccaaagaugacuauguuugggacugaaguaaacauaucaaguuagaacucucaucacauguuugacucaaauuguggagcaaaauaguaaauaaaauauaaaaaugaaaaugaagauacgugaaauucaaaugucacaacuugccuauuauuuauuuuagugcauuuuuuugugcuuuucccaguuugguguuagguggccuuaaguucucaguaaugacacuuaucaaauaggaacuuaguguuacucaccuuuauccauucccccaacacucaacaaauugccuuugcuauaucccuaugagaugagcagaucaaauauuccccgugaguuaaugaaaacugauucaaccaaauggcgaagucagagacuaucgggggccauggagacacucugggccauuuuuaugagguagucuaggcucaucuucaugagggaacugaggucuugggggguggggguuacccaaauagguucacagaagaaccagaaauaaaaccugccuuucuagacuguaagucuugugauugucaucuaaaugguugucucuauacagcaacucaucucuagaacugaaaauaaguuuaaaucccuccuccauccccaauaauucaagcugcauuucagagaaaaccaggacuuuggaaucagacagaucaacuuugacuucuugaucugcuucuucauagcuauuuaugcuuaggcaaguuuuguuuuguuuuguuuuacguugccacucagucuucucaucuguaaaacagggauaauaacaccuuccucaaaugguuuuuuuuauuaggacuaaaagagagaauguguggaaagauguuaguggaauuccuggcacauaguucacauggacaaaaugguguuaacuacgaaaauuuuuacagagaaaagggcaacugacaaaagcagguguuuggaaugaauuaagaccauggcaggcuuuugaggccuuuauauuucuccugacugugcaauaaaaauauuuuggcucucugucuaagacuuggcugucacaguagcaaugguaauauuagcuacugugccagaagcagccuaucaauagagaaauugaaaaucugaccacacaaaugcugcagcacccagcugaaaugcauuuggaugacaaucucagaugggaaucgagagcaucuccuucugccuugcuaauagcaagcugauuuuuagaauauagucuaagugcuucucuuccauccuccccagauucucaccugcuacacaccccucagagggacuggaggaauccagacaacgaugcgcaggggcccuggugcuauacuacugauccagaacagagagaugacuacugcgacauuccugagugugaagggcaggaguggcucuagaaaauguuuucauuucugcccuucaccuguaaaauaauuuguuguaaagccccuucccacagggauauuauuaauaauugcguaacguguucaccucucggaaaggagcaaaacuuugcucagaucccagaauuaaccugauuuuuuuuuuuuuucugagacagaauuuugcucucauugcccaggcuagagugcaauggugcgaucucagcucaccacaaccuccgccuccggguucaagcgauucuccuaccucagccucccaaguagcuggaauuacaugcaugugccaccaugccuggcuaauuuuacauuuuuaguagagacaggguuucuccauguuggucaggcuggucuugaacucucgaccucaggugagccgcccgccucagccucccaaagugcugggauuacaggcaugagccaccaugcccagcagaccugaauuauuauuauuaaaauguuacaucaacauguacaaauauaaaacuacaucuaaacucuaaguacagacuucuuaugcuuaaaacucuuacacaguguuaaccccaagacagauuugcaauuaaguaguuaaaauaagacaacaaagucaauaaaggcugcaaucaagauguuggcauggcuggggucucaucugaaggcuggacuggagaagaaucuacuuccaaacuuaugugguaguuggaagaauuuaguuccucaaggcugcuaaacugauggccuguguuccuugccucugggaugguagcuugcuucaacaaagugugcaagcagagaagacagagagaguccgcuagcaagauagaagccacaaucucuuguaaucuaucauuuuugcuguauucuacugguuaaaaauaacucauuagguuagccuacuggcucucagggggaagagauuauacaaaggcaugaauuucuggaggagggaaugagggcaaagaacucugaaaaguuucucuuccacaaucugaagaacuucuagaaaguagaaggaagcaauauugcuuagggauggacaacuuggcacugguuauguguuccaagugagguaaccuuguucccaggaauaaagagaaccagaugacuguaaacauuucccuaaacugaaaugcacuguuguauguucaccugaaaugaaugguguaagcugaauaugagauuuuugacaaaauaaaaauuuugcuguguucuca

SEQ ID NO: 1061 - RNA, 38 nt, Homo Sapiens
gaucaccuucggccaagggacacgacuggagauuaaac

SEQ ID NO: 1062 - RNA, 532 nt, Homo Sapiens
gggacaccuggggacacugagcuggugcugaguuacugagaugagccagcucugcagcugugcccagccugccccauccccugcucauuugcauguucccagagcacaaccuccugcccugaagccuuauuaauaggcuggucacacuuugugcaggagucagacccagucaggacacagcauggacaugaggguccccgcucagcuccuggggcuccugcugcucuggcucccaggugccaaaugugacauccagaugacccagucuccuuccacccugucugcaucuguaggagacagagucaccaucacuugccgggccagucagaguauuaguagcugguuggccugguaucagcagaaaccagggaaagccccuaagcuccugaucuauaaggcgucuaguuuagaaaguggggucccaucaagguucagcggcaguggaucugggacagaauucacucucaccaucagcagccugcagccugaugauuuugcaacuuauuacugccaacaguauaauaguuauucu

SEQ ID NO: 1063 - RNA, 398 nt, Homo Sapiens
aggcugaucacacccugugcaggagucagacccagucaggacacagcauggacaugaggguccccgcucagcuccuggggcuccugcugcucugguucccagguuccagaugcgacauccagaugacccagucuccaucuuccgugucugcaucuguaggagacagagucaccaucacuugucgggcgagucaggguauuagcagcugguuagccugguaucagcagaaaccagggaaagccccuaagcuccugaucuaugcugcauccaguuugcaaaguggggucccaucaagguucagcggcaguggaucugggacagauuucacucucaccaucagcagccugcagccugaagauuuugcaacuuacuauugucaacaggcuaacaguuucccu

SEQ ID NO: 1064 - RNA, 442 nt, Homo Sapiens
gcaugucccucccagcugcccuaccuuccagagcccauaucaaugccugggucagagcucuggggaggaacugcucaguuaggacccagacggaaccauggaagccccagcgcagcuucucuuccuccugcuacucuggcucccagauaccacuggagaaauagugaugacgcagucuccagccacccugucugugucuccaggggaaagagccacccucuccugcagggccagucagaguguuagcagcaacuuagccugguaccagcagaaaccuggccaggcucccaggcuccucaucuauggugcauccaccagggccacugguaucccagccagguucaguggcagugggucugggacagaguucacucucaccaucagcagccugcagucugaagauuuugcaguuuauuacugucagcaguauaauaacuggccu

SEQ ID NO: 1065 - RNA, 378 nt, Homo Sapiens
aggaaucagacccagucaggacacagcauggacaugagaguccucgcucagcuccuggggcuccugcugcucuguuucccaggugccagaugugacauccagaugacccagucuccauccucacugucugcaucuguaggagacagagucaccaucacuugucgggcgagucagggcauuagcaauuauuuagccugguuucagcagaaaccagggaaagccccuaagucccugaucuaugcugcauccaguuugcaaaguggggucccaucaaaguucagcggcaguggaucugggacagauuucacucucaccaucagcagccugcagccugaagauuuugcaacuuauuacugccaacaguauaauaguuacccu

SEQ ID NO: 1066 - RNA, 378 nt, Homo Sapiens
aggaaucagucccacucaggacacagcauggacaugaggguccccgcucagcuccuggggcuccugcugcucugguucccaggugccaggugugacauccagaugacccagucuccauccucccugucugcaucuguaggagacagagucaccaucacuugccgggcaagucagggcauuagaaaugauuuaggcugguaucagcagaaaccagggaaagccccuaagcgccugaucuaugcugcauccaguuugcaaaguggggucccaucaagguucagcggcaguggaucugggacagaauucacucucacaaucagcagccugcagccugaagauuuugcaacuuauuacugucuacagcauaauaguuacccu

SEQ ID NO: 1067 - RNA, 390 nt, Homo Sapiens
aauuaggacuccucaggucaccuucucacaaugaggcuccuugcucagcuucuggggcugcuaaugcucugggucccuggauccaguggggauauugugaugacccagacuccacucuccucaccugucacccuuggacagccggccuccaucuccugcaggucuagucaaagccucguacacagugauggaaacaccuacuugaguuggcuucagcagaggccaggccagccuccaagacuccuaauuuauaagauuucuaaccgguucucuggggucccagacagauucaguggcaguggggcagggacagauuucacacugaaaaucagcaggguggaagcugaggaugucgggguuuauuacugcaugcaagcuacacaauuuccu

SEQ ID NO: 1068 - RNA, 382 nt, Homo Sapiens
gugcagaagucucucucagucaggacacagcauggacaugagggucccugcucagcuccugggacuccugcugcucuggcucccagauaccagaugugacauccagaugacccagucuccauccucccugucugcaucuguaggagacagagucaccaucacuugccgggcgagucagggcauuagcaauuauuuagccugguaucagcagaaaccagggaaaguuccuaagcuccugaucuaugcugcauccacuuugcaaucaggggucccaucucgguucaguggcaguggaucugggacagauuucacucucaccaucagcagccugcagccugaagauguugcaacuuauuacugucaaaaguauaacagugccccu

SEQ ID NO: 1069 - RNA, 390 nt, Homo Sapiens
gaucaggacuccucaguucaccuucucacaaugaggcucccugcucagcuccuggggcugcuaaugcucugggucucuggauccaguggggauauugugaugacucagucuccacucucccugcccgucaccccuggagagccggccuccaucuccugcaggucuagucagagccuccugcauaguaauggauacaacuauuuggauugguaccugcagaagccagggcagucuccacagcuccugaucuauuuggguucuaaucgggccuccggggucccugacagguucaguggcaguggaucaggcacagauuuuacacugaaaaucagcagaguggaggcugaggauguugggguuuauuacugcaugcaagcucuacaaacuccu

SEQ ID NO: 1070 - RNA, 390 nt, Homo Sapiens
gaucaggacuccucaguucaccuucucacaaugaggcucccugcucagcuccuggggcugcuaaugcucugggucccaggauccaguggggauguugugaugacucagucuccacucucccugcccgucacccuuggacagccggccuccaucuccugcaggucuagucaaagccucguauacagugauggaaacaccuacuugaauugguuucagcagaggccaggccaaucuccaaggcgccuaauuuauaagguuucuaaccgggacucuggggucccagacagauucagcggcagugggucaggcacugauuucacacugaaaaucagcaggguggaggcugaggauguugggguuuauuacugcaugcaagguacacacuggccu

SEQ ID NO: 1071 - RNA, 382 nt, Homo Sapiens
gugcaggagucagucccaaccaggacacagcauggacaugagggucccugcucagcuccuggggcuccugcugcucuggcucucaggugccagaugugacauccagaugacccagucuccauccucccugucugcaucuguaggagacagagucaccaucacuugccaggcgagucaggacauuagcaacuauuuaaauugguaucagcagaaaccagggaaagccccuaagcuccugaucuacgaugcauccaauuuggaaacaggggucccaucaagguucaguggaaguggaucugggacagauuuuacuuucaccaucagcagccugcagccugaagauauugcaacauauuacugucaacaguaugauaaucucccu

SEQ ID NO: 1072 - RNA, 314 nt, Homo Sapiens
gauccagugaggauauugugaugacccagacuccacucucccugcccgucaccccuggagagccggccuccaucuccugcaggucuagucagagccucuuggauagugaugauggaaacaccuauuuggacugguaccugcagaagccagggcagucuccacagcuccugaucuauacgcuuuccuaucgggccucuggagucccagacagguucaguggcagugggucaggcacugauuucacacugaaaaucagcaggguggaggcugaggauguuggaguuuauuacugcaugcaacguauagaguuuccu

SEQ ID NO: 1073 - RNA, 515 nt, Homo Sapiens
augccugggucagagcccuggggaggaacugcucaguuaggacccagauggaaccauggaagccccagcacagcuucuucuuccuccugcuacucuggcucccagauaccaccggagaaauuguaaugacacagucuccagccacccugucuuugucuccaggggaaagagccacccucuccugcagggccagucagaguguuagcagcagcuacuuauccugguaccagcagaaaccugggcaggcucccaggcuccucaucuauggugcauccaccagggccacuggcaucccagccagguucaguggcagugggucugggacagacuucacucucaccaucagcagccugcagccugaagauuuugcaguuuauuacugucagcaggauuauaacuuaccucccacagugauucaacaugaaacaaaaaccucaacaagaccaucaguguuuacuagauuuuaccagcugcuuccuuuacagacagcuaaugugguggccacucaguuuuag

SEQ ID NO: 1074 - RNA, 6416 nt, Homo Sapiens
gggcgcgcgagagcugcuagggcgguuucucugccucgggccuguugggcagggccggcuaaggugcgcgugcucgcugguucuaacccuucuguugggcguuucugcggagaggcgggaggcgcugagagucugcgcggagguccgugcacagacugcuuugccuguuguugcucuucggaggcggcgauccccgaaggcgagcugaaauacggcugcaggcuacaauuugcagccgacgauuaaggaagacgacgagcgggagagguggcccacccucauggagcgcuugugcucggauggcuucgcauuuccccauuacuacauuaaaccguaucaucugaagaggauccacagagcugucuuacgugguaaucuggagaaacugaaguaccuucugcucacguauuaugacgccaauaagagagacaggaaggaaaggacugcccuacauuuggccugugccacuggccaaccggaaaugguacaucuccugguguccagaagaugugagcuuaaccucugcgaccgugaagacaggacaccucugaucaaggcuguacaacugaggcaggaggcuugugcaacucuucugcugcaaaauggcgccgauccaaauauuacggaugucuuuggaaggacugcucugcacuacgcuguguauaaugaagauacauccaugauagaaaaacuucuuucacaugguacaaauauugaagaaugcagcaagguauaggucaaccaauguuauuuucaaacuaucugaaaugcauuuauuuuaacauugacacauguaagggucaauuuuucauauuuggaagcucaaacauuccuugaaugaaaauauuuugaaaugccuuaacugucuaagauuuuacuuuaaauauuggaacuuuuaaagaagcauuauagggaacagccuuuuuucaugcacuuaugguaaauaacuauaaaaacaaaugaauuacaauaaauuuauaauucaugacaacugaauuugggaaagguaauaguuaaguguuuuuccacuaaauuacuuuuuuucuaaucagugugaagugacacaggaaaguaaaauugucccuuauaaauaggcuuuauuuuaaaugucaaagaaaauuaaagaauuucacaauaaauguacauguuguugcuguugaaaugaauaucagccacuguuacuugcugugagucgaagaaaagugaaaaugguggaauuuuuauuaaagaaaaaagcaaauguaaaugccauugauuaucuuggcagaucagcccucauacuugcuguuacucuuggagaaaaagauauagucauucuucuucugcagcacaauauugauguguuuucucgagauguguauggaaagcuugcagaagauuaugccagugaggcugagaauagagucauuuuugaucuaauuuaugaauacaaaagaaagagauaugaagaucuuccuauaaauagcaauccagugucuccucagaaacaacgagcugagaaggcuacaagugacgacaaagauucuguuucaaauauagccacagaaauaaaggagggaccuauaucugggacagugucuucucagaaacaaccagcugagaaggcuacaagugacgagaaagauucuguuucaaauauagccacagaaauaaaggagggacaacaaucugggacagugucuccucagaaacaaucggcccagaagguuauauuuaaaaagaaaguuucucuuuugaauauugccacaagaauaaugggcggugggaaaucuggaacagugucuucucagaaacaaccagccucaaagacugcaagugacaagacagauucugcuuugaauacagcuacagaaauaaaggauggacuacaaugugggacagugucuucucagaaacaacaagccuugaaggcuacaacugacgaggaagguucuguuucuaauauagccacagaaauaaaggauggagaaaaaucugggacagugucuucucagaaaaaaccagccuugaaggccacaagugaugagaaagauucuuuuucgaauauaaccagagaaaaaaaggauggagaaauaucuaggacagugucuucucagaaaccaccagccuugaaggcuacaagugucaaggaagauucuguuuugaauauagccagagaaaaaaaggauggagaaaaaucuaggacagugucuuuugagcaaccaccaggcuugaaggcuacaagagacgagaaagauucucuuuugaauauagccagaggaaaaaaagauggagaaaaaacuaggagagugucuucucauaaacaaccauccuugaaggcuacaagugacaaggaagauucuguuccgaauauggccacagaaacaaaggaugaacaaauaucugggacagugucuugucagaaacaaccagccuugaaggcuacaagugacaagaaagauucuguuucgaauauacccacagaaauaaaggauggacaacaaucuggaacagugucuucucagaaacaaccggccuggaaggcuacaagugucaagaaagauucuguuucgaauauagccacagaaauaaaggauggacaaauacgugggacagugucuucucagagacgaccagccuugaagacuacaggugaugagaaagauucuguuucgaauauagccagagaaauaaaggauggagaaaaaucugggacagugucuccucagaaacaaucggcccagaagguuauauuuaaaaagaaaguuucucuuuugaauauugccacaagaauaacgggcggugggaaaucuggaacagaguauccugagaaucugcgcaccuugaaggcuacaauugaaaauaaagauucuguucugaauacagccaccaaaaugaaggagguacaaacauccacaccagcagaacaagacuuagaaauggcaucagagggagagcaaaagaggcuugaagaauaugaaaauaaccagccacaggugaaaaaccaaauacauucuagggaugaccuugaugacauaauucagucaucucaaacagucucagaggacggugacucgcuuugcuguaauuguaagaaugucauauuacucauugaucaacaugaaaugaaguguaaagauuguguucaccuauugaaaauuaaaaauacauuuuguuuauggaaaagauuaauaaaacuuaaagauaaccacugugagcaacuuagaguaaaaauucgaaaacugaaaaauaaggcuaguguacuacaaaagagaauaucugaaaaagaagaaauaaaaucgcaguuaaagcaugaaauacuugaauuggaaaaagaacucuguaguuugagauuugccauacagcaagaaaaaaagaaaagaagaaauguugaagaguugcaccaaaaaguuagggaaaaguuaagaauaacagaagagcaauauaggauagaagcugaugugacaaaaccaauuaaaccggcucucaaaucagcagagguggaauugaagacaggaggaaauaauucaaaucagguuucugaaacugaugaaaaagaagaccugcugcaugaaaaccgcuugaugcaagaugaaauugccaggcucaggcuggaaaaagacacaauaaaaaaccaaaaccuggaaaagaaauacuuaaaagacuuugaaauugugaaaagaaagcaugaagaccuucaaaaggcucuaaaacggaauggggaaacauuagcaaaaacgauagccuguuauaguggacagcuugcugcucugacagaugaaaacacaacgcuccguuccaaacuggagaagcaaagagagagcaggcaaagacuggaaacagaaaugcaaucauaccguuguagacugaaugcugcucgaugugaucaugaucaaagucacucaucaaaaagagaccaagagcuugcuuuccagggcacaguagauaaaugucgucacuuacaggaaaauuugaauucucauguucugauucuuucucugcaacuuucuaaagcugagaguaaguccagaguccucaaaacugagcuccauuacacaggagaggcucugaaagaaaaggcuuugguuuuugaacacgugcaaagugagcuaaagcaaaaacagagucaaaugaaggacauugaaaaaauguacaaaaguggauacaauacaauggaaaaaugcauagaaaaacaggaaagauuuugucaacuaaaaaaacaaaauauguugcuucaacagcaacuggaugaugcucgcaacaaagcugacaaucaagaaaaagcaauacuuaauauucaagccagaugugaugcuagaguacaaaaccuucaagcugagugcagaaagcaccgucuuuuacuagaagaagacaauaaaauguuggucaaugaacugaaucauucgaaagaaaaagaaugccaauaugaaaaagagaaagcagaaagagaaguagcugugagacagcuucaacaaaaacgagaugaugucuuaaacaaaggaucagcaacaaaagcucugcuggaugcuucaucgcgucacugcaccuauuuagaaaaugggaugcaggauucaaggaagaaauuagaccagaugagaagucaauuucaagaaauacaggaucaacuuacagcuacuauaagauguacuaaggagauggaaggcgacacacaaaagcuugaaguagaacaugugaugaugagaaaaauuauuaaaaaacaggaugaccaaauugagcggcuugagaaaauccugcagcauucaaguuugaugcugcagguguuugagagcuagaugaagcauccagccaaacuagacuacauggagcuccacagugaucgucuucaccuccagcuguuugcauuuacuucuucccucuauccuacauguguuuuccuuccccuucagauaucaaccuaugaauugccucuaccaaaaagccuacaauauugacacaaaccugggcuaguaucccuucuaugucuuccaauaagugcugucuuaugcuugucauuguauguaugacucuguaugggaauugccuguuuguuuuuucagauuauagcauacaguuguugaggggcggaccguaucaucuuuaucuuguaauuccagugcuuguccuaguaccuuagcacaugguugcugaauacaugaacgaagagugagaaaccagaagcucugauacuuaacugccaugauaaugaauucggugugcaacuaugggcaaauuauauuuaauaguaauugcauauuguacauauuuuucauucuuauuaacacugauaagcuuuucagcauauacugacuuucucuuaguuaacugugaaaucauuuagauaaagaauauaauucuuuuucauucuaacuucugaauuuaaaucugaauccucuauagcagggguccccaacucccaggccacacacaguuccaugaccuguuaggaagcaggcugcacagcaggaggugaguggcaggcaagcgagugaagcuucaucuguauuuccagccacucccuguugcucacauuaucaccugagcucugccuccugucagaucagcaaagccauuagauucucacaggagugaaaauccuacugugaacugcucguucaagggaucuaggucacaugcuccuuaugagacucuaaugccugaugauaugucauugucuccuaucucuucacgaugggaccaucuaguuacagaaaaacaagcucaggacucccauugauucuccauuaugaugaguuguguaauuauuucauuauguauuacaauguagucauaauaggaauaaagugcacaauagauguaauacgcuugaaucaccauccugaaaccaucccccaaacccccaucuguggaaaaauuaucuuucacaaaacugcugccuggugccaaaaaggcuggggacugcugcucuauagcuucugcacuagaaucuacuaaugaguaaaauuuaaaucaauaacuaguuuuaaaagcauaacaagaauaugugcugucuggcugcaguggcucaugccuguauucucagcacuuugggaggccagugcagguggaucacuugaggucaggaguucaagaccagccuggccaauauggugaaauccugucucuacuaaaaauacaaaaauuagcugggugugguggugcaugccuguagucucagcuacucgggaggcugaggugggagaaucacuugaacccgggaggcagagguuucagugagccaagaucgugccacugcacuccagccugagcaacagagugacuccaucucaaaugcaaaacaaaacagaaagaauacaugcugacgaaaaaaaucuaagacaauaaaauuguauuacuaggcuguuaacaugauauuuuguuucccguuaaaugugugacaugcaaaaguauuuauuaaaugaaaauauuuuuuaucuuuu

SEQ ID NO: 1075 - RNA, 4367 nt, Homo Sapiens
gcuuccgcucggggcggggcugggcucccgggguagguccgcggcugcugcugcguccgacccccggccggcgcggguauggagcuugggggucacugggacaugaacucggccccgaggcuggucucggagaccgcagagcggaaacaggagcagaagacaggaaccgaggcggaggcugccgacuccggugccgucggagcccgccgcuuccugcucugucucuacuuggugggcuucuuggugagugcgagcgugggggcugggagcaagugcugacuguguucgggccuggggacccaggcgguucuuggagcuuccggggagcucccagggagugggaacccgcaguccgccugcauuuauuuuguuuuaggauuuguuuggugucagcaugguugugccuuuauugagccuucaugucaagucccuuggagcaaguccaacaguugcuggaauaguaggugaguggucgauauugcucauuuuuagagcacugaacgacguauguucaaagagauuuugagauuugagcacuauaaccaagucccaugccacuaguggcaacagguacuuauggagccucugcaaggagcuggcuguguguauaaaagggcuccuccuauggcauuuugcaacucuuuucuagcacauuggugggcugcuggagcgauguagugggaagacggucuuccuugcuggcaugcauucuacucagugcucugggcuaucuccuucucggagcagccaccaauguguuucuguuuguccuggcuagagucccggcagguauuuuuaaacacacucucuccaucucaagggcucuacuuucugaugugguuccagagaaggaacggccgcuuguaaucggacacuucaacacagccuccggugugggcuucaucuugggccccguggucgguggcuaucucacugaauuagaggauggguuuuaucucacagccuucaucugcuuuuuggucuucauucucaaugcuggucucguuugguucuuuccauggagggaagcaaaaccgggcaguacagagaagggccugccauugcgaaagacccaugugcuguugggaaggagccaugacacagugcaggaggcagccaccagccgcagagccagggccagcaagaagacugcccagcccugggucgaaguaguguuggccuugcggaacaugaagaaccugcuguuuuccgaaaugugggacauauuucuggugcgcuugcugauggccauggcagucaugcuguacuacaguaacuuuguccuggcccuggaggagcgcuuuggggugcggcccaaggugacaggcuaccucaucaguuacagcagcaugcugggggccguggccggccuugcccuggggccaauccuacggcuguacaagcacaacucgcaggcacugcugcugcauuccagcauacucaccugcacacugcugcugcucuacuccuuggcccccaccaugggugcaguuguccucuccuccacucuccuguccuucuccacugccauuggcaggacgugcaucacggaccuccagcugacugugggcggggcccaggccagcggcacccuuauuggcguggggcagucugugacugcagugggccgcaucaucgccccucuccucucggggguugcccaggaggucagcccuugcggcccccccagccugggcgcuguguuagccuuaguggccauuuucauaaugucucuaaacaagcgacacucuaguggugaugggaauaguaaauuaaaaagugaguagauggauuuggacaacauaaagcaacaaaauuugagaugguugaaugagggccggaggccaugaugaaaagggcacuuuggaaaggguugggguggaagggaaauauuuccgggugggugugagcuguugggcuuccaggucagcucuuggccaugcagccaugccugcaggaugaucagaagucacggcaccucaugggaagguuaagacuggagcaaagcuuuuccaaggugagcauauucagcguuuaccuggaagucucuucuucccaccugggcuaaucagguuacaauuuucaaggguaaacaaacuaccagcuacaggauagggaaguggugguggaauaagagaacaugauaccuggaggaagggaagaaaccacaagcauuuuccuacugaaaaauagggugacaugucagucaaauucugaucaacuggaacuugaguuuccaguuaaauuccauacacuaggagggaguuuucuaucaaaauccugcagauugaagaagcugguuuauuagaaccagccugucgcuuuucaaagcugcuuaaaaauaagauacugaccucaccccuagagaugauucagugggccuggguggggccaagaaauccgugguguuuuguaagcacugcuggcgauuucucauggcaguaaagaccacacugagacugcacugauuuugauuaaaguacauaggcuuggcuguuuuuacacagcuaacuaaauuuggacucuuaaaauuguguuuguaaucacaguguguuacaccuuucccagcucucagcaguuguacugcaugauggagcagcgggccccugggaccuguucccugugcucccugccucugagagcccagcuugcucugaaguuggacuaaaccacuuagaugcugggguugccacagccugcuccuggaagccugcauuccagucagguugcauccuucuggugcugacagaacccaguggugaagccaaagcacaggaaugcuuuaaaaaugaacaguuuaugcagaauaagggucaggagucaugccagaccagaacuugaugcuacugugucuuguguuaagaaucauuuccuggccaggcucgguggcucaggccuguaaucccagcacuuugggaggcugaggcaggugaaucacuuggucaggagauggagaccauucuggcuaacauggugaaaccccgucucuacuaaaaauacaaaaaaaaaauuagccgggcgugauggcgggcgccugcagucccagcuauucgggaggcugagguagaauggcgugaaccugggaggcggagcuugcggugagccaagauugugccacugcucuccagccugggcgacagagugagacuccgucucaaaaaaaaaagaaucauuuccuuuauuuuuaguuucacgccugcaaacacaagcauucuguugaucaacggaaauauuuugaugugccauuucuugucuaaacaaguuucauauacagcaccgagggggccacgagaggcagaggcccagacagaaggugaacauagccuugcagggagacauaugccaggcaggaugaccauugggauugcaucaaguauuaaucaguuacuuaagggcuuccugucagacaguugaaguucacauuccuuuuacuuuucuuaauuaguccacuaggaugguaugccuguuuucaacuuaacacaugcauacuuguaaauauuuuaguaugcuacaguaauuugucauaucuuuaauauuuauuguuuguaaagcaguaaacauuucuguauuuuagaagucauggaguaaaaucaaauauuuaugauaaauaauuggaaguauguuuuaguuugaagauuguccuuuuuccuaucuugcugcaaggaaaaauggacuucugauuagguuuuacaauugugaacuuuuauguaaauguuaagugcuuucgaggagaccaaacuauuauuaauauauaaaauggccuugcccuuaaggagcaaauuaaaucucauggagauuagacucaaaaggcaauaaauaaucgaggguuuaugcaaugaaauagaauuucagaagaguuuggaucucaaagauuguccuucacucucagaaacaggcaaguuucuuaaaagcccuuauagucguguuuuuauuuuaaaaaucguagcacuuuauuuuugaaguuuaaaaagcccauaaacuuaaugagucuuuauaaucagacacauggaaauauagaaaaccaaagacugaucuuagaauauagaguagagagacauguuuguuauucuccacuagugacuuuaguauuuuguuaugugauguuuuuuaggugcaccuuuucucaugacuccuuuuacuuuaucuaaugucuuccucuuuaaagugugacccagagaccaguagcaucagcaucaccugagaccugugaacacugaagcuccagcucagacauguuggggaccauuuuaauaagauaccuagcugauuuuuugcacagcaaacuuugaaaaccccuggucuaagggguaguauuuguaucacuuauggaauauaaucucagggaaauuaaaucugcucaauugaca

SEQ ID NO: 1076 - RNA, 55 nt, Homo Sapiens
ccacugcuggccggggccccuacucaaggcuaggaggccuuggccaaggacaguc

SEQ ID NO: 1077 - RNA, 82 nt, Homo Sapiens
cucagcaggcuccagcucgguggcacugggggaaggcuccagaccccagccucugucaucccugcauggagcccacaucucc

SEQ ID NO: 1078 - RNA, 584 nt, Homo Sapiens
gugcaccaacauauguauaauguaagcaucaaaaggagaggaaagagacaaaaucaaaaauauauuugaauaaauaauggcuaaaaacauaugcauuuugaaaaauaucauuaaucuucacauccaaaaagcucaauaaacucuaaggaggaaaugcaacgagcucuucagcuggacauacuguagucaaaauguugaaagaaaaaaucgugugaaagcagcaaaagaggaaaacacucauccuguaccugaacgcuaagaacaacagaacguaagacugacaguugacuuaucauaaugauauccuucuuucccauugaaaaaauguaguugaugagaagugucugcuuccauugcccgugaaucccuaacagaauggugccaggcuccaccaggagaccuuccugagucccaucugaaagccuccaccugaaugcgucccucauuuuaaugacccagccaggcuaccucugaagagaagggcaguucucagcagccugaggggugcugguagagacauaccaaaaguguuguuggugccaccuuuuugcaagagaugaagagaaaguuccccugcaggcacu

SEQ ID NO: 1079 - RNA, 9153 nt, Homo Sapiens
agaggcgcuuaaguuaccaagggauuagggcugaucucaggagagguaaacgaccauccuuggaacacggagcccuucuucccugcccgguaucugcgcgugccuuggguaguccgcacaacccuccccagcuccggaugcccugggauacccggacccaggagagagcgcgucagcggggcgcagcuacuuugcacucgccgauucugacacaacagauaguuaauuggggccuucgaaaucaaggacuaagcacaccccaaacgcacacgcaauugccgguuuuugaaaacguugccucugaaugagaaagagagagagagagagagacugagaaagucgaacucgagcuuagguaaccaacaaacccaauuacuaggcuuuauugauacuaaaaggaaaaguuccccucguaaaauuucucugagcuuauuaguuauuuaaaucagccccaggguuggacgcgugacgccgaaggcaccuucugucggcuccuggaggugagcagccagcgucccugcgccgacccacagccccucgcuccguccugggcacuuggggcgaaggcgggcgcagcgagccgagaaguacugaacuccuaauaucaccaauucuucuaaguuccuggacauugauccggaggaggauucgcaguucaacaucaagcgaucgcccuccuaucuccaaagucgaaaguacuccgcgcaguuaacagagcugggagccgaggcagccgcggucgccucuugcgcgucggucugcgucuccgccggcagacgcggcacccagcgacugccuugucgccgccgccuccgcgccgggacgagugcgccuaggggcugggcgaggcggccgcgcccuggacccgccacaaggaggaggaccagacccugggccccggugcccgccugcgcccagacgcacccacccgcuggccgcggccaccgccucgcgccgcacucgguucucugccaucgguccuucgccgccucgugcaugagguccucgucaccccgcuccgaccgccgacucuccccuuccucuucccuccucccugccucccacccgccccucgccugucccucugccuccuucgcagccccgccgccguugggucgccgugcucacagcgauugauugauugauguuuaauuuccugccaggcggggccccccuccccccgcaaccuccccagcccuccuccccgccccccacuccccucuuuucuugcgguggaccagucuggcuuggguuuagauccaucccccccacccccaucccgaaauaauccagagacuuccccuacccccaccccaaauuauuauuuugaaggcgcuagaucuggggaccgaaagggggagggggagaaaucggaaaccgaggacaacccaaaaggacucacuuugccugaugacucaacgcaacuaauaaucaucucccucucagugugucucucucugcggcuugucagugaguccggcucuggcugcuggcagaggcggccgagaggggagaggcuggaggugacagcuugggcggccgccgcguuuccucccgcgcgcggucccgggucccugcgucuucucggcucuugguguuaccggucccaccgcucuggccgcgccuccucgcgagcuagccgcccugcgaaccagcagccccggcucgccgccgccgccgccgccuccggguucucagcccuuucucuccagaacgggucuccuucccgaaggugugaaaaggcucuuucagccuccuucucuuccccccuccuccgccguccccucccccgcucgcucgggugucccuuuggaggaguccuuucccucuccuccuccucccccuccucccuccccccaucaucaucauaacaaccaucuccgcaccagaagaagacacccugacccaggaccuuaaacauuaggaccuggggaagagggaaggggaaggaguaaagaggaagacuaggagaacacugcaaagccaagcaccagaaacuuuccacccuggauucucuacuuuugcuccauggacagagccccagucagccaaguuucagacagaccgugagcagucccugugcguuuuauugcgaccugccggugggaacuuugucuccgagucggagcagcauggagcggcggagcgagagcccgugucugcgggacagccccgaccggcggagcggcagcccggacgucaaggggccucccccagugaagguggcccggcuggagcagaacggcagccccaugggagcccgcgggaggcccaacggcgccguggccaaggccgugggagguuugaugauuccugucuuuugugucguggagcaguuggacggcucucuugaauaugacaacagagaagaacacgccgaguuuguccuggugcggaaagaugugcuuuuuagccagcugguggagacugcgcuccuggcccugggguauucucacagcucugcggcccaggcccaagucuuucugucaguuuuauaaaucagagaauaggaugcugaaaaucuccuagaacauuuaaaaccuuggccuucaaugauuuggcugcucaggucuaauaaucucccugguaaaagccuaccaucaugggagcugagcuaagagggcagccuguucuugauugaaagcccucaccagccucaccaacuucaaauggugguucuucuugagaaucuaugcuccagagccauggcuggagagcagcaaacccugccuccuggauuuaagggauccucccaccucagccuccggaguagcuggaaauccagcagcacgccaccaugccuggcuuauuuccguauuuuuaguaguaauaggguuucacuauauuggccaggcuggucuggaacuccugaccucaagugaaaugcccaccucggccucccaaaguacugggauuacaggcgugagccaucgcgcccagccaucuuucauauaucuuucuaaagcaaaaaaagccaaauucuuccaucaugguuuccuuugggacuucuagaccuauaguaaacagccauucaggaagaugguuugugcaaaaagaaugaaaauaaaggcaugaaggaaaauguaugcacuagcaucuucugucucucccucugagauuuuaugcucugcuucaaaaaccaguuuaaaaauaaaaaagaugagggcgguugcaaucugcuucauuuuaugcagauuagguauggcccucggguaccugccaaauugcuaauauggccuuccguugggccugauuagugugaacccggaucuuuuccauuaaagcagaaaugaauuuguugggaauaagguaacaacaaaagugauauuuucacuaauaaccgugggucagguuacauuaaagcaguuucucaguguguaccugaggcagacuacccucagcauuuaugauuuccuccauccucacuuggcuccucucugaggacaucgugguuuuuagagaccagugggaccgugaccuccuuuuauaccgaagcuacuuugagaggucauuuucuucuacauuccaaaugcaaaauguuauucucauuuuuguaaacacaucuguaggccuuacacuuguaauaacaaguaucuuaaauuauccagaaugaauguuuauauaaggauauccacucugggcaauugaauuuuuggauaauuccaauagccauuuugagugccccugggugaagcauuaauuaucuuccaaaaagauaauggagacaauaaauauggaacuaucaagcaucucuuaugacucuauuagaauacauuuuuaagaaaauauuuugguaccaaugauuguauuuugugggaaaagaauuagagguuuguaugaacuaagcagcaacuggaaguucaaaaagacaaauugggcccuaucugcagauuugggugccuaaagacuuauacaaaguaaagucagcuuugucaguugccuaauuuagcccauauugaaaaucacuggagcuuuagcacgagcaguguuucaugugaagucauuuuguaacccaaauuauuucuugcccauggaggaguaagaaacacauuuaacaguugacauucugcaucaucauggacagaccagagagagaaguagcuacacccaaaauacauacgaaagucuuuuacguggguuugcuucccauuaagugguuuauggaugaauaaaauauuuauuuuuaaaggccuuagaauaaucaagcugggaagguggaacccucucccccucaguuaugugacagaugcacccgacgcgacaguggccgacaugcuacaagaugucuaucauguugugacguugaaaauccaauuacaaaguuguucaaaguuggaagacuugccugcggagcaguggaaccaugccacaguccgcaaugccuuaaaggaacugcucaaagagaugaaccagagcacauuagccaaagaaugcccucucucccaguccauuguugacauugccccaggguuggcuuuuuggagaaagcacuaucauuguauaaauuaaagggaugguaaauucagguaaucguguuugauguuaauaguucaguuuacaggagagugacuguuuuaaguuuaaaagaaaaaagagguuagugcagguuauaaagugcucuuucuugucccuaaaaagaaguagucauauuuugaaaaaauaacuauaauuuuuuuuuucagaguaugauuucauccauuguaaauagcacauauuaugccaaugugucagcaaccaagugccaggaguuugggagaugguauaaaaaguacaagaagauuaaaguggaaagaguggaacgagaaaaccuuucagacuauuguguucugggccagcguccaaugcauuuaccaaauaugaaccagcuggcaucccuggggaaaaccaacgaacagucuccucacagccaaauucaccacaguacuccaauccgaaaccaagugcccgcauuacagcccaucaugagcccuggucuucuuucuccccagcuuaguccacaacuuguaaggcaacaaauagccauggcccaucugauaaaccaacagauugccguuagccggcuccuggcucaccagcauccucaagccaucaaccagcaguuccugaaccauccacccauccccagagcaguuaagccagagccaaccaacucuuccguggaagucucuccagauaucuaccagcaagucagagaugagcugaagagggccagugugucccaagcugucuuugcaagaguggcauucaaccgcacacagguacaauuagcauuaaacacuguaauuaacgugagguucuugacaucacagcgagcugguuaaaccaaacaaaggaggagagggguggaagacagaaaccacacacauauaccugcaaaugugacuuggucuguuuuuuucccccauuuaaucagggauuguugucugagauucugcguaaggaagaagacccucggacagccucucagucucuucuaguaaaccugagggccaugcagaauuuccucaaucugccagaaguggagcgagaucgcaucuaccaggaugagagggagcggagcaugaaucccaaugugagcauggucuccucggccuccagcagucccagcuccucccgaaccccucaggccaaaaccucgacaccgacaacagaccucccuauuaagguggacggcgccaacaucaacaucacagcugccauuuaugacgagauccaacaggagaugaaaagggccaaggugucucaagcccuguuugccaaaguggcugcaaauaaaagucagggcuggcugugugaacugcuccgcuggaaggagaacccaagcccagaaaaccgcacccucugggaaaaccucuguaccauccgucgcuuccugaaccuuccccagcaugagagggaugucaucuaugaggaggagucaaggcaucaccacagcgaacgcaugcaacacgugguccagcuucccccugagccggugcagguacuucauagacagcagucucagccagccaaggagaguuccccucccagagaagaagcgccucccccaccuccuccgacugaagacaguugugccaaaaagccccggucucgcacaaagaucuccuuagaagcccuggggauccuccaaagcuuuauucaugauguaggccuguacccagaccaggaagccauccacacucuuucggcucagcuggaucuccccaaacacaccaucaucaaguucuuccagaaccagcgguaccacgugaagcaccacgggaagcugaaagagcaccugggcuccgcgguggacguggcugaauauaaggacgaggagcugcugaccgagucagaggagaacgacagcgaggaaggcuccgaggagauguacaaaguggaggcugaggaggaaaaugcugacaaaagcaaggcagcaccugccgaaauugaccagagauaaugugaacuucuacuaggcaaagcaauacaucgguccaaggauuuucugcuuucauuucuuuaaaaguuuuuuguuaguuuguuuuuuguuuuuguuuuuggguuuuuuuggcuuuauuuuugucuuuuuaugucuguuuuguuuuucuuacccuuuuggacauuucuuuguugcacaggauacaccuauagacugaauaaguucaguauuuccgaaucagacaucgccuuggcaaagacacuaaagcguuacacuuuaucccgucucuaugacuggaucauagucauuauaaucacaggagacucugccuucauuauccuugcacuuaacggaaguuacaucaggcaaguaccaggaugaaaagaacuaugaaauaaaugaaggaagcuacaaguguguguguauauguauauguauauaucucuauauuuacauauauauauuaaaauugcaugggacagagacuuugcaauccgaaagaauagacugugaaaugaguucuuaaagaaaagacuuguuuauguauuaaaaaaaccacuucacagugagucgcuuuggcuuuuugauaaacugcggccugcucucaggguggggugacuauuuuugaauuccuauuuauuuuuuguguuugucccugauuuuuuuuuuuuaauucuauggcuuccuaucuggcagcuuaauggguaauuuuugagguauguauuuaacaaaauaaacgacacugccgaaaaaaaaaaaagugaagugaaaacaaucagggcacauuaaaaugauacaagucaaauaaaucuuaaagacacaaugcacacuuaaaaugacucaauaaaaugacuugcuacguuccguuauucaauuugucauuacuguagugaacagaugcauuucuguggaauuccaaauaaguaaaacugaaauucagugcagagaaaacuuuguccacuagugcaagucuugaucaaaugacauuuugacauuggacauauggaauucauaguaugagccacauuuuguugugaaauuuauuuaccugcuuguggcuucaaaucugaaaauuaauaagccugcucguuuaaaaguuguuuguuguugcuguuuuuuugucuuuuuguuuuuuacuagaaaauaguucaguguaauauuaaguuagaaaagaaguugcugcccaguuaaaggggcucccucucaaauaaaucuccauccuucccucucccaaaagacauuucugauuucugcuucacuuugggcuuccucuucuucguacacauuccaucuaccuaaucaaacauuuucagucccugaucucuccugucccuuuuccugggaugacagcccuaacaagaacuguuuuugaaucguugugcagcuccaggcaauagaguaugugaagcgauuucaguagaaucacuuacucauccuaaaagaaaacauuaucccaguuaccuacaucgcaauuaccuuauguaaagcagaacuaaugcugacuggauguuuaaugggaugagcauuaaagcugcaaucuacuauaguacuccagaucucuuucggcuuccuaugagaaacaccagaagcauuacuuuccacuucuacuuacaguaauugcaagaggagaccucacauucaggacuggccuagugaacguaauccaugcuuuaaacuggccauuaaacagucccacaugguuggauuuuuuuuuuuuuuuugaguugugcuuucacaaaaccuugucaaagaccucaugcaauaucacuuugaaaguuauuuucuguuuacuacacaaacauuguaauauaacuguuaauacuauuuauauauuugaaagguauaaaagguaggaguuaaaaaaaaaaccucuauguguagauauuaacucagaacuuacaauauacagggagaagacauguugcaauacaagcuaauucuagcugcucaguaaccucuggaguuuuuaaagggacauuuuccuguacuuuuucaaauaaugauguuuaaaaauuaucuugacauaagcgucauauaccuuugcaaaaggaugguuguuugcaguuagcccuggccccauccuuccuauuucuguaguaugcugcagcuuuaaucagaaaguccaugguugcugcuuccugaucuccgaguuacucuuuccaaauugucuucuuacacuguugcugaaggucacucuguacacguaauggaaacugauuuugccaagcucuuacaaggugguucaucuaucgauggcauccgcauuugguaucuuuuacacuucaaccaaaaauuuauuagguauuuuucaaugcuaagucuugccuuuuauuuuuuaauuucacugccaaguuugcagugguucuaagugaaucugugggcauuuuagccuguggucuugccagaucuuugcgaauuacaaugcauauaugucuauuuauucaauaucugucauauaauaucuauuuggaagaagaaacuuucucuuguagugccucuugacaaagcacaauuucccgccuuuuuuuuuuuuugugaaaugaaaaaaacaaauuguguuuuauugcgguaucaacaaugugaauaaggauuaacauauuguaaauguucuuuuuuccauguaaaucaacuaucuuuguuaucacuaagugauaauuaauuuuuaacuuaugugcauuguuaggcuguuagaauuuuuugguuguuaaaauaaacgcauucaauaaauauga

SEQ ID NO: 1080 - RNA, 2328 nt, Homo Sapiens
guauagacaaggcugagcaggguuccuguggcccaggauggaggccaccgcugcccugccaucccgucugccugccaugggacggcuccucugaguguucccuggccccacgugugugguguuugugugucugugccuggccaagggaggugccaacacugggcuugccacagccccaggagaggaauuuggggccuaggaaccgagggcacacgggacucuagccucauccccaggacccccuuggcucagaguguggugcuagaaacuggcccccagcccagccccaguacugccaccuuuacaccuaccccugcaaguccccagagggcugcccacgauagaagcugccaagcagggagaaccugugccaacuguggaguggggagguugggccuggacccucaaccccugcaaccuucccuagcccccucaauagaugagcaggucaggcuguggcccuuaccucacccgcaguucucgcccagugcugcagccggcucaccucucuccgcuucuugcacaucacuggccugugugugcugcuugcuccuguucuguucgcuugcucccguuccguucggcuuuugcuuugcguuagggugaagacccuagcguccagcuccccucaacgcuauauuuugacacuaaaaaagaagguuucuaaauuguaggagcaggauggaaauacuuugcugcccuugccaucuuuuaggaugggcccccaggagacugaggucuuccugggcccucauugcugcuuaucguaccccccaucaccugcacaugggacagaccgggcuggagggugaccuuggcugugugcgucccagcaaaagagcucuggcccgcaucucgcugugcccugaagggggaugaagggcgaugccucgcccgaggcuuugggcugcugcacugcaugcugggacugcuccuacucucugucccaccccucacccagcugugguccggcuuugggagaguggugaauugcgcugcccgaacucggagcggagcaggguagggaccguguacagcuugauaacccuuaauaaaaagggaguuugaccagacuucuuguugucucgcgcggcuagaauccugggaacaagagaaaugggauggggacucugccggggucuagaagaaaguauguuuaggccgucgcucagauacgcugagcaaggcggcuggcggaagggcagcuuccgacccacaguuccguggaggucuguguccugccccgagccaggauuccgugaggucuguuuccagccccgagccacgauuccguggagguuuccagcucggccuggucgucagauuucccgcccugggcacgugaccaagccggcucugcuucucuaauuugcauucguugccugcaccauuccccccgcuccccccucggagacauuuggccaaugggagccguggguaggggcugugggcggggcuacagccguggagcgcggugcgaguccaacaccgagcauucccgugggccugcaguuggcaggagggucccgggcccagagccagcggggccgugcugagacggcguacgugcccugcgugagugcguggcggcggcgcgugcgcuaggggagugggcggugaggccugguccacgugcgucccuucccgggacccccgcagcuuggcgcccagcggcuacgugagccaaggcacccggauguccgcgccccucuccgagugaccagucccggccuccggucccgcagugcccgcagccucggccggcguccacgcauugccauggugacugugggcaacuacugcgaggccgaagggcccguggguccggccuggaugcaggauggccugagucccugcuucuucuucacgcucgugcccucgacgcggauggcucuggggacucuggccuuggugcuggcucuucccugcagacgccgggagcggcccgcuggugcugauucgcugucuuggggggccggcccucgcaucucucccuacgugcugcagcugcuucuggccacacuucaggcggcgcugccccuggccggccuggcuggccgggugggcacugcccggggggccccacugccaagcuaucuacuucuggccuccgugcuggagagucuggccggcgccuguggccuguggcugcuugucguggagcggagccaggcacggcagcgucuggcaaugggcaucuggaucaaguucaggcacagcccuggucuccugcuccucuggacuguggcguuugcagcugagaacuuggcccuggugucuuggaacagcccacagugguggugggcaagggcagacuugggccagcag

SEQ ID NO: 1081 - RNA, 75 nt, Homo Sapiens
acagcacaaaugaugaauaacaaagggacuuaauacugaaaccugauguuacauuguagugugcugaugugcugu

SEQ ID NO: 1082 - RNA, 57 nt, Homo Sapiens
gcccgcguguggagccagguguagaggcggagcacagcuggcucuaauuugaggggc

SEQ ID NO: 1083 - RNA, 4219 nt, Homo Sapiens
accaguccaagaagagaaccuacaaacuagacuuguagauuaaaauuaucugaucaaaaaggcagacucuguaaauuuccuuaagaccuaccuuggcauaaaggcugacccagcaaaagaacugagcuuacuaauuuacucuugauuuuagagaaauacagccugagauggacagcaguaauugcaaaguuauugcuccucuccuaagucaaagauaccggaggauggucaccaaggauggccacagcacacuucaaauggauggcgcucaaagaggucuugcauaucuucgagaugcuuggggaauccuaauggacaugcgcuggcguuggaugauguuggucuuuucugcuucuuuuguuguccacuggcuugucuuugcagugcucugguauguucuggcugagaugaauggugaucuggaacuagaucaugaugccccaccugaaaaccacacuaucugugucaaguauaucaccaguuucacagcugcauucuccuucucccuggagacacaacucacaauugguuaugguaccauguuccccaguggugacuguccaagugcaaucgccuuacuugccauacaaaugcuccuaggccucaugcuagaggcuuuuaucacaggugcuuuuguggcgaagauugcccggccaaaaaaucgagcuuuuucaauucgcuuuacugacacagcaguaguagcucacauggauggcaaaccuaaucuuaucuuccaaguggccaacacccgaccuagcccucuaaccaguguccgggucucagcuguacucuaucaggaaagagaaaauggcaaacucuaccagaccaguguggauuuccaccuugauggcaucaguucugacgaauguccauucuucaucuuuccacuaacguacuaucacuccauuacaccaucaaguccucuggcuacucugcuccagcaugaaaauccuucucacuuugaauuaguuguauuccuuucagcaaugcaggagggcacuggagaaauaugccaaaggaggacauccuaccuaccgucugaaaucauguuacaucacuguuuugcaucucuguugacccgagguuccaaaggugaauaucaaaucaagauggagaauuuugacaagacugucccugaauuuccaacuccucugguuucuaaaagcccaaacaggacugaccuggauauccacaucaauggacaaagcauugacaauuuucagaucucugaaacaggacugacagaauaagacuuauccauuuuuuaauguauuaaauacacccagccaguuaugcagcuacuuuuucuuuacuguaucucauguuuucuuuuuucaaugcuaauuauagcucucuacaucacgguaaucaugccuaugccuacauaagaauggcugagcuaacaauacacauucuggaaacauaacacucuacauuacaaaguuuguuaccugcugaaaucaauguaacucaacuugacagacacuuauacagaaauguugcuggugaauuuauaagaaugugguaugauacuaguaaugaaggcaaaauggacagugaaguuuaacacaacugaacucuaagaaaaucaaccauuaaucucucauuuucaucugcaaauugaagcaacaguuuaguuucaaaccuagcucccuggguggaaugacgacuucacuauacuuagugaauauccuuuaagagcugggauuuuuuucaagacaacaaagaucauucauuugguucuuuauacuaugaaacuugaguaaguauuaccuccuuaauuuuuaacaacuaagaacaaaaauuaacgagaaaaacaacaaaguacagauuuauacauaaaccuaaaagcauuugaacaugacacccgaacacauacauauauguucacuuauuuguggcagaaggugaucagauaagcuccagcccaaauggaaccuguggggugguauuuugcauugcaaggagacgcaaaauuuuauuuuaaaacuguccuccauaauaaucaaacggugauucaucuaaaugacuucuagcaaccuaaguaaaaacauuccccuccuauguaugauucauuugaucauauaaaacaucaugauggcucuaauucauaaauacaaaaauauauuuaagucuuuauagauauaaagcuuuacuuagauauaacuugagugaguagggaaaaaaaucuacaguagauaaagcaaaagauaauuaggcaacaaagcauuuucaaacucaaauuccuguuuccaacuucaaauaguuuuuucuauaaacacaaaaucaguguuuauucaccaguaggagguuggacuagaugaacucuauuauuucuuucuaaaucuaauagucuauaaaaauuauguuuccucuguuuuuuauuuuaucuaugcuaaaaugagcccuuucccuuauguccaguuuaagaugaucauuugcaugauuuucauuucaauaaaaaaaagagaaacuguccuuaaaacaaaacaaaaaccaaaaaagucacccuaucagguuucaaacagauuuguggcuguucuuuucugaaauuucccuuauucagguuucugugggaaaaaugaaagauuaaccuuccccacuggugaugaccuaggcaggaaucaucucuugaaauaaauacuagcugaguaaaggcaagcaggugugaagagcagggcucagcagcaagucacauuuuucuacuauuugaccaaaaggaaaagaaaauaaagaagaacucuggaguggucuaagacugauaauagcagaagaauaucaagaacacagaaacuuaauuauugugaacuuuugcuguuugaaaaucuuagacauucauucuuaaguagaaaucagaccaacagauuuucccaacccaagacuauuguaacacauaaagacagcaagaauucuuauuucuauaauaaauuaacaagauucaccuaaccuuugaaaauaaaguaguauugaagacuuacaugguauguuuuuuccuaaaggcacuacaucacuuacacaguucacccucucgcuuguuaagugaagcugcccaaggugacauaagugaaugaguaaaaccugagaucuaagguuccauuuaagucagaugaguuucauauuauacuuacuguuuauaauaaauuuggcauuugaaaacuaaauaugacuuccccuacacaugccaaaaaaaacuauugguaaacuacuguuauuuaauaaacacuuuauaaaucuauaagaaacgugauccaaaacuuuuuugcaggagauagaaaguuucugggaggacuguucauuguuucuuucacuuauuucaaaucacaguuucuagguuaaggauuagguuuucuauagaaagaccauuauccucugaggaaaaggaaguaacaauggaaaaagggcggaaauuacugggagggaggaauggcugcucugccuuucuggaugugcagcucacuaaccuggaucaucugggagcuuggucaugaagucuugcacacaugaucaggaagacuacuucggaacuaacuuuaaacguuccuuuggaaacugauaaagauagcaugacaguuucaacaaacuggaggcaugucguuaccuaaaaaucucaggggccuaguuuuacauauguacaagcccuagagacuucaaauaaccguggaaguuuaaaugcaggaaaugcugcagccccaucuacuggagaggugcagaaagcaaaaaauauaaguuuuauaugccaagaaauuuuuaugccaauauguggauccaguuaccuuuccucccagcucugcgaucuaugcauuucucugccaccuccucgaccaaaaacacccucuacuucaucaaaacuucuuugguagaaaccacauucaccucugccucugccugaaaauaagaaaacagaaaaaaaugauagucagaugucaacauguggcacacauucaccaccauaaauuaauaucuaaaguucuaucucuauacaaggcaggacaucuacauuuaaauacugaacgaggccugaugaucuugacuuaugagaccaacaauggcauugaaguagcuggaccacaagaggcugaaagaaacaaguuaaaaaaacuaacauaauauaaugcaauagacccaguccugaacaagaaaguaucaacuuuaaguucuuuaacgaacaguugaauagugaaauucuaagaaguucaauaaaacacuaccguagauuaaa

SEQ ID NO: 1084 - RNA, 6426 nt, Homo Sapiens
gcucgcgucccuccuucccuccccgacugugcgccgcggcuggcucggguucccgggccgacaugggcgccgccgcgugggcacggccgcugagcgugucuuuccugcugcugcuucugccgcucccggggaugccugcgggcuccugggacccggccgguuaccugcucuacugccccugcauggggcgcuuugggaaccaggccgaucacuucuugggcucucuggcauuugcaaagcugcuaaaccguaccuuggcugucccuccuuggauugaguaccagcaucacaagccuccuuucaccaaccuccauguguccuaccagaaguacuucaagcuggagccccuccaggcuuaccaucgggucaucagcuuggaggauuucauggagaagcuggcacccacccacuggcccccugagaagcggguggcauacugcuuugagguggcagcccagcgaagcccagauaagaagacgugccccaugaaggaaggaaaccccuuuggcccauucugggaucaguuucaugugaguuucaacaagucggagcuuuuuacaggcauuuccuucagugcuuccuacagagaacaauggagccagaggcgugagaaucacuccuguguuaccuuacucuucccaaggugaaacuggaagcagcuucuagagaacagcuucaggugcagaccgagaaaugacgucauccugauaauuauuggacguguuuauuaauugcaccccauuagccccuguuuuuaaaaaauauagguuagcaggacgugggcacaggccgugaaacauuuauagggcgccugucacgugugagacauaguaaucagaggccaauggugaugugugaaaaugaggaugaccagcucugguuuucuaggagcuauggucucauaaugacaauaaucagcauaguguacuuguccuuaauguuauagcauggcaggaaagaccaugggcuuagaaggcagacauugguuaggaggugcagggaacauacuaauucaugugcggucaaagcacuuggcauuuaauagggcaaagguaaacagauguagagaaaugagucucaugccuguaaucccagcacuuugggaggccaagguggguggaucacuugagccuaagagaucaaggcugcagugagccaugaugguaccccugcacuccagcccagguuacagagcaagggccugucucagcaaaacaaaacaagcacaggccaaggagugagauagccagcgcugaugguaucugccucguagugcaugaagugcaugucauacacuaagcagccagccaguguuggcugucaguguuauuacucacaugcuuuauuuuauuuaagacuuugagauaguucaugaaguggguauuauuaucaauuuccauuuuauaggugaggaaacugagcccagugaaguuaaauaacuucccaaggucauugagcuguugaguggacagcucaggucuguuuguaaaucuuuaauaaauaacaacagcuaagauucaauuuucuccaaaggaacauccggugcuugcccugccaggagccccagcccaguuccccguccuagaggaacacaggccacuacagaaguacaugguauggucagacgaaauggugaagacgggagaggcccagauucaugcccaccuuguccggcccuaugugggcauucaucugcgcauuggcucugacuggaagaacgccugugccaugcugaaggacgggacugcaggcucgcacuucauggccucuccgcagugugugggcuacagccgcagcacagcggccccccucacgaugacuaugugccugccugaccugaaggagauccagagggcugugaagcucugggugaggucgcuggaugcccagucggucuacguugcuacugauuccgagaguuaugugccugagcuccaacagcucuucaaagggaagguaugugugggccaagugggagugcaguaggaagggaaugaaaggaggagccaggauggucccacugcccacugcaugcuucacgggcuccccuacaagccuuuugccuggaccuaccauuccucuucaguuccuacccuccuucaaaccccagcucagaggccuccuccguagucuuuccagguuuucauccacuccuggagcucacguaucccugcugggaccuucguggcccuauaucauuucuucucucgggcacuuucuggacuguaugagugaagguggugagccugaagccugagguggcccaggucgaccuguacauccucggccaagccgaccacuuuauuggcaacugugucuccuccuucacugccuuugugaagcgggagcgggaccuccaggggaggccgucuucuuucuucggcauggacaggcccccuaagcugcgggacgaguucugauucuggccggagcaccagacccucugauccuggagggaccagagucugagcugguccuuccagccaggccuggcagccagaggugcuccgggauugcaaacuccucuucucaccugccaaagauggagaagagugccagggaccccucaaggagggagacgcuccauaucccagggcauaggacuugcagguuccuaggagcaggagcaucucccaucgcacgugcuuucugcucuucugggaauuucucacacuggcaaagcaguccagccuccgucuucugguccacucugcucugagcagccugggaugcugaacucuucagagagauuuuuuuauagagagauuucuauaauuuugauacaaggucaugacuauccuagaacucucugugguuuuugaaaaucauugaauucuauuaauguagguaccuaaagugaccuuaacugaauguggaugaggcuggggcuggugugggucuuuuggcugcuuuucaaggugucccccaauguggcccucaagagccauccccacugccuggccagagccauuguuguccccuacuuccuaggccauuucuggggcuugggggaugaaugcuguccugugcuguaaacacuaugcaaauggaaguuaucgguuguggugcugugcagcgcucugugggcgacuaagugccacucacgcagcauguuccuggcaaggagcacauaccaucaagccacacuaucaugguauuguucucacagucuuuuggugguugauggccacugcaaaccuggcaccaucagaucucuucugaucucuugccccaguggggccugguugguagaauguuggcauucgguugauauccaaagccuguucucccagccguccuccugcagcuggagccuucaggccguauucucacgagggaacguuugccaaggcucugaccucacagaagaugcccagggcccagaagccaucagaauuaucaguggagaagcaccuuuugacucuucccuuccaauguaaucucugccaacaccaugaggcuuaaggugcucuaagucaugaguguuuuggucucaaaugcugcaguuuuaauaaucugugacuccugagagcccaugguuuuuugaccuugugguucuaaaauuccuugucugaccccuguagaucuuuuccuugccaugucaccucccuuggccuuugauccuggaaagguggcagagccuccacugagccaggcccagagcuccuugcagugccuucuuccuuguuuaccugugggaggaaacacuuuuuuugucaggggcagccugguucagagcucagaggucacacuguaucaaagaucucaaacagcaaagucagcauuugcuguauagagcugccacccaacucuaagcaggagaaacuguacagaaagggcuuugcuauuuuucccuuuugggaaaacaaugaaguguuuuaaguccuggguggacugagagaugguuugccuguccagacuugcucucaagccucauccagagaaggagcugcagaugagggagcccguacacucccugccaccacuagguuguaagccuguagcuggcuggcugauuucauuuuggaauucauuugccauccacagccuuacacuaggcacacacuuuagagucuggggcuccaguggggcccgccuaauuuuuuuuccccccaagacagggccuugcucugucucccaggcuggagugcaguggcaugaucauggcuuacugcagccuugaucucccaggcucaagcgauccuucugccucagccucucugguagcugagacugcaugcccagcuccaaaucaccuugauucauaucagcaguaauaaucacuuguguucugaaagaaagggcaccagaaguucuagcaaaauucaguuguguucugugagcuagcacuuuuuccucugacccaauuuucuuaccuauaaaauggugauaaaaaccgacagguuguucaaaggcccagaucagcuaaagcauguauauaagagcacguuguaaacuugaaagagacaaaggcacaaauguggcuguugauuaauuugacugcuucucguugcucgucaccuccaugccaggcacugugcuugcuaauugcuuuaugggggcauucucuuauuuauuccccagcccugggaaauaggagcugucauuauccuucucuuucugcacaaggaaaaauuaaugcccugagaauugucauaauuuucccaaggcugcccagcuggugguguuaagccagaauuugaccucccagagccaguuuccauuagcugccaugcucugcugccucuaauucacagaaugcacuuucuacccugugugccauggagaccuccuauggaaaaaugaucagccaccuuaccuucuacuggguaccugcugugagucugccuaugccagaaggauuaaggaggggagguuacccaagaaacaaagccuacaugccgcuuacagcccccguuggaugguugcucaguacaacagucuugcauucagcagguguuuguucaucaccuacuaugugucaggcucuaugcuagguacuggggauacaggagagaaucaagcguaaagucuuuguucucaaggaauuugcauucuagaaaguagaagauguaauaaauguacugugggacauguuaauaagugcuauaaagaaauauaaaggguuugggagcaaaaagagggaguggaucuauuuuagaugagcccagguaagaccucucugaagagcugucaugaaggagggagggagcacauuccuggcagagaaaacagcacgugcaaaggccccgagacuggaguguguuccugaagagcagccaggaggccagcauggcuggagaggcaggcauaggcagggaaccgagcagcaggucagagcaggcgagcugacauucugcagccuggacggccauggcaggaagcuuuuaguuggagagauacaggaagccuccuaggguucugagcagaagaggggcaugagcugauucacauucugaaggaccucucuagcuggccagugcugaggagguuggagagagaaagggugaaagcagagagaccagugcagggcuguuaacaggguugcaggcgagagacuggggugcugggcuccccuagacuaggacuccagugcccuccucucccaagagacaaaggccauugcauugaaggaggugggaaaugauuagauucugaacauauguaauuauuuuucagucuuuuucaaagauacaaauauuuacauaguuuuaaucauguaauauauacaauuuaauguccuaguguuuuacuuaauaguguaucauguuuucccuguugguauguagccuggauaaaugcucuuaauuauaaaaaauucugucgaggaguguuccauaguuuauuguuuuccuauuaugagaauuuaggccaagugugguggcucaugccuguaaucccagcacuuugcgaggccgaggugggcagaucacuugaggugaggaguucaagaccagccuggccaacauggugaauuaucucuacuaaaaauacaaaaaaauaauaauaauagccaggcgugguggcacaugccuguauucccagcugcuugggaggcugaggcaggagaauggcuugaaccugggagguggagguugcagugagccgagauggugccacugcauuccagccugggcaacagagcgagacuccaucucaaaaaaaaggagacuucaugugcccccaauuuuucacuauuguuauuugaaaaaauauuuuuauuuguaagaguuuuucuuuauuuaaaauguucauuaauaaaguuguuggacgggaagcaaaaaaaaaaaguuguuuaagauaaauucccagaagugaauuuguuagaucaaacacuuaaaacuuuuuguuauggaagaauucaaauauaaauaaaaaauugugaguaauaaaaugaacucacaguuucaacaaugacccacauuu

SEQ ID NO: 1085 - RNA, 1762 nt, Homo Sapiens
cagccaccugccacuccugacugcauggaagccaggugcaaggagaaaggauuuugaggaggggacuccauggcuuccgaguugcugacugacccuccaccucagagguaguucugacacugucucaguuuugcagaugaagaugagauucuucaguucuccauguggaaaagcagcuguggacccagauuccccaucaccugucucucuggugagcugcuuccgaucagccuccagguccacgauuucucuucuguuguccuuuucugccuucucaccucauccucugagaccugaauuucgauggcucuacuuuucaauuauauuauucuuuuucaaaccugggcguucauuucuagcauccuguucuauccugugucugacugugccucccgcaccuucucccuucucucgcccuaagccccgugaaggcgccgggccuuuggcuccggcuguuucccacggcgcccagaaccgcgucaguccugacacagacucggugagggcgggaaguggugccguggggcugcagccuggcccgcccgcuccaucggccuagggcggccccaccgcccuccgggccuuaccuugaguucgggcugcgggagaagcucccgcgcugcccaugacgucacgggacugugacgcgcccagaagccccgccccucgcgucccgguccgcggacccaggcucucugcgccgugacgucacggguccgggcgggcggguugugcgucggcccaaugggagcggcgcacuggccuccccuuuaaggaauguugugaccugacgucaccgggcgaguuaccucccgcagccgcagccgccgugcucagcgcgagccccggagcccuugagcgcgaggcgcggagcccccggagcccccaaaccgcagacacauccccgcgccccagagccccggccugcgcgcccagccgggcccgcgcgaugcccucagaccggccuuucaagcagcggcggagcuucgccgaccgcuguaaggagguacagcagauccgcgaccagcaccccagcaaaaucccggugaucaucgagcgcuacaagggugagaagcagcugcccguccuggacaagaccaaguuuuuggucccggaccaugucaacaugagcgaguuggucaagaucauccggcgccgccugcagcugaaccccacgcaggccuucuuccugcuggugaaccagcacagcauggugaguguguccacgcccaucgcggacaucuacgagcaggagaaagacgaggacggcuuccucuauauggucuacgccucccaggaaaccuucggcuucugagccagcaguaggggggcucggccugggagucgggcggccccggucaggcccugcccagagagcuccugguuccugaacugagcugccucuaccguggugggcugggcaggcaugugccccccuagucagagggcaccaacccaccuacucugccccuggguggauccugggccggucguguuaggguugucccucugggugcuggcuggugggaugggggaggguggggagcagcucccagcaccccugcugugugguucaucuuuuuuuuaggccccugccugucugcccaucugccccucacccacccgaggcucugcccaccgccuggaccugcccaccccugaaagacuggccccuggcuccccgccccucggucuccacgugguguauggaucuguggucauugucccucugcagaauaaagauugcucaggccugccuggc

SEQ ID NO: 1086 - RNA, 577 nt, Homo Sapiens
aaagauugguauggccuuagcucuuagccaaacaccuuccugacaccaugagggccagcagcuucuugaucguggugguguuccucaucgcugggacgcugguucuagaggcagcugucacgggaguuccuguuaaaggucaagacacugucaaaggccguguuccauucaauggacaagaucccguuaaaggacaaguuucaguuaaaggucaagauaaagucaaagcgcaagagccagucaaagguccagucuccacuaagccuggcuccugccccauuaucuugauccggugcgccauguugaaucccccuaaccgcugcuugaaagauacugacugcccaggaaucaagaagugcugugaaggcucuugcgggauggccuguuucguuccccagugagagggagccgguccuugcugcaccugugccguccccagagcuacaggccccaucugguccuaagucccugcugcccuuccccuucccacacuguccauucuuccucccauucaggaugcccacggcuggagcugccucucucauccacuuuccaauaaagaguuccuucugcucca

SEQ ID NO: 1087 - RNA, 2558 nt, Homo Sapiens
agacaccucugcccucaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagaauggccccgccccagccacuaagguucggccuuuucugcccagcuggccgccucuuccuuggucuggugucccaggcaccgcccacgggucuagccucuucucaggagugcucuacagcgcccccuaggccaccaagauuguuuagcucccugucgggucggccccugacuccuuauuggacucauccaucuggcucauccaaggccuugggucucuccagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggcucccguccugcuuuggcagugccauguaaauccccacugggaccaacccuggggaaggagccaguuugccggauacaaacugguauucuguucuggaggaaagggaggaguggaggugggcugggcccucucuucucaccuuuguuuuuuguuggaguguuucuaauaaacuuggauucucuaaccuuua

SEQ ID NO: 1088 - RNA, 1068 nt, Homo Sapiens
uuuuuuuuuuuuuuggauauggaguuucacucuugucgcccagacuggggugcaauggcacgaucucagcucacugcaaccuuugccuccuggguucaacugauucucccaccucagccuccugaguagcugggauuacaggcauguaccaccacgcccggcuaauuuuuguauuuuuaguagagacgggggucacaccguauuggccaggcuggucucgaacuccugaccucagguaaucugcccaccucagcuucccaaagugcugggauuacaggcgugagcuacgacgcccagcuucuucccaaauuuuaaaagguuuuaggaugcaauuuaaaaugaccccacauuuugauaauuuccuauauucugacaccuaaagccuacauauaaaaaacacuugccuauuuggcaagauagaauucaccuuucaggacaauuaaaugaaagucagagccugggccggcuccggagaaguuagacccucggagcuggucucggacugcuggggcgucaccccuucagcaacccccgcugaccauggcaguauuucaugacgagguggaaaucgaggacuuccaauaugacgaggacucggagacauauuucugucccugcccaugcggagauaacuucuccaucaccaaggaagagcuggagaauggggaagguguggcaauguguccaggcugcucucucauuauaaaagugauuuaugacaaagaucaguuugcguguggagaaacagugccagugccuucagucaacaaagaaugaguuaaaugcuaaggaagccuucaggaauccgaacccugaacagcuggaaaugagcccagauagaaacuucaaaugcaaagcuccuggcuucguggagacacagccauuugugauuugcuguucuguaggcguguuguggauucuuuccaucaacugcugauuucaucuucaggaagcaaguccauaacaugacguaucuggaguuugugcuuagaaccuuaaauuggaagcauucuuaauuauccaucuaaauuuaaaagacgauaauuuaaaaaaaaagaaggaaggaag

SEQ ID NO: 1089 - RNA, 2244 nt, Homo Sapiens
agagcagggccugacaucuccccagaacagacguuugaacagagcaggcuucugaggucuccaaaaugccugucccagccuccuggccccauccuccugguccuuuccugcuucugacucuacugcugggacuuacagaagcaugauggguuuuacuagaacguuucagugucacuaagucacagaagaggaggacaagaagaggaauuauggcagggaccagcuuuaucacagugguguaccugguuuggcagggugcucacaacuuguuugugggauguggagguaucagaaguggcaggugaggaggagcuacagaugauucagccugagaagcuccuguuggucacaguuggaaagacagccacucugcacugcacugugaccucccugcuucccgugggacccguccugugguucagaggaguuggaccaggccgggaauuaaucuacaaucaaaaagaaggccacuuccccaggguaacaacaguuucagaccucacaaagagaaacaacauggacuuuuccauccgcaucaguagcaucaccccagcagaugucggcacauacuacugugugaaguuucgaaaagggagcccugagaacguggaguuuaagucuggaccaggcacugagauggcuuugggugccaaacccucugcccccgugguauugggcccugcggcgaggaccacaccugagcauacagugaguuucaccugugagucccauggcuucucucccagagacaucacccugaaaugguucaaaaaugggaaugagcucucagacuuccagaccaacguggaccccacaggacagaguguggccuacagcauccgcagcacagccagggugguacuggaccccugggacguucgcucucaggucaucugcgagguggcccaugucaccuugcagggggacccucuucgugggacugccaacuugucugaggccauccgaguuccacccaccuuggagguuacucaacagcccaugaggguggggaaccagguaaacgucaccugccaggugaggaaguucuacccccagagccuacagcugaccuggucggagaauggaaacgugugccagagagaaacagccucgacccuuacagagaacaaggaugguaccuacaacuggacaagcugguuccuggugaacauaucugaccaaagggaugaugugguccucaccugccaggugaagcaugaugggcagcuggcggucagcaaacgccuugcccuagaggucacaguccaccagaaggaccagagcucagaugcuaccccugcucucauugugaagccauccucaagccaccugccuacccuuuuauagucauuaaaaugucccuaggaauuuggacuuguuuuguuccaaaggacauggucucagggaucaaccuaaggaacacuagugaugagcuucuuuaguucccuagcagaauggaaugacaaucccugcucccauaggcuugugagggucaagugaggaaccccguugccacauguaugaauaccugaguacacacccccuccaccucuucccuccaggagaauaagcuggcaaccugggacaggaugagugagaauggggagccucuuucuguggcuucugccuugugcuggagugaagauagccugggcaggaugcagguucaaagggcccggcaucaucccuuacugcgcugcuccucauagcuguccuccugggccccaucuacguccccuggaagcagaagaccugacugcuccuuccuuccuccccugccacgugggacccucaucucugcugccuccuuccuuuccugagaggcucagcuugagagaaugagccagugagaagcuucucuagacuuggcuccaaacaucuccccucccaagacaucugccugcccacaggcuccuguugcuccuucacacagaccuggaugccccagagcaaggucuucauucaugguccugagcaggugccaugggauugggcucugggcacugacuuaacggcaccucccuagaaggcgagaaacaugccaaaucuaaacacaccaggacucccauccaucgccuugagacugaccguaaaccacagacgcucuccagguucucaagaguuauccugccuuccagauuccugccuaucccaacuccccagccuuguugagguucucuauugccucuugaauacaaaugcacucccaaagugguuuuaagaaaauaaaaagauuauccuucc

SEQ ID NO: 1090 - RNA, 192 nt, Homo Sapiens
aaguccucgcagagaauggcugaggcugauugggacgcauuaacuggggcucuggugagccgacugagcugaguccccugcagugccuguaugaccugcaccaacgugggaauugccaucucuccugcuggaaaaucagugcugccugugggaagcccgcccugguuggagcugcaguuuccuaccaguuug

SEQ ID NO: 1091 - RNA, 797 nt, Homo Sapiens
guucuaauucacugcccacagcccugcugauaaaagcaaagcucaucucugccgugcugcagggaacccuauuuccuuccccugcagcucagccaccuccuccucucaggucugccagccaugaaacuucuuuaccuguuucuugccauccuucuggccauagaagaaccagugauaucaguagaguguuggauggauggacacugccgguuguugugcaaagauggugaagacagcaucauacgcugccgaaaucguaaacggugcuguguuccuagucguuauuuaacaauccaaccaguaacaauucauggaauccuuggcuggaccacuccucagauguccacaacagcuccaaaaaugaagacaaauauaacuaauagauagaaaugacuuuguuucagguugcuuaggguccacauuucauuaaaacucacaaauuuggauugcaguaaggaugaaaugacauaauaaugcaaagcucuggugaggacagugggaugcugccuggauacugccaggcaaacgccacauccuucgaugcauggguaacaguggaauuuguagggccucuugcaaaaagaacgaacagcccuaccucuauugcagaaauugucaguccugcugccuccaguccuacaugaggauaagcauuucuggcaaagaggaaaauaccgacuggucuuaugagaagcaguggccaagacuaccuugagugcuggugauuaccauucucaagcucucugggcacagagaccugcugucaaccccccucauuaaaauucaugugccugcua

SEQ ID NO: 1092 - RNA, 873 nt, Homo Sapiens
guuaagccugcagguucuccaaugcauccaguuaugaaucccuucccucuccuugcacaaggccaguucagaaaccugacucugcacuccguagaggagaaaaccuucccauugaucccaaaugaugauugaucucucccauuagagccugcucaccccuuagggaacuuggaaaggagaugagaaagcaagagaaaguaaaagcaagcagagcaucccucuccacccccugcaccugccuuaccacagguuuuaaagaauuuccuccagucuuugaacagcuccagggagacagccugagcucccguucagucuguagaagguucuuucucuagauaaguguuucccaaccuggcuacacaacagaaggacucaaggaauucauuaaaaacaucaguuucuaugccugaccccagagauucugauuuggaacacaugcaguagcuuuggcuuucuugugcuaauuuuuaugaaggacuggagaaagggggagauuuaaaaaaaaagggggaaauauugagaagaaacaaaaaauaaaaggcaaaaaggacaaaagagguaggaagaagggaaggaaagaauaggaagaaaaguaaauauccuuuaggcuggcccacagagauuuagcacacauuuggcagaaauucugaauaagggggacagguggauuaguagguagggccuggcuuccguacuuccucauuacuuuuacuccuaccauuccuuccaucuagaauguucuucccaccaucucugccaacugaacuccugaaucuuuaaggacaagcucaaaugcuaccagcuucuagaagcuuccaagauuucuuccaguuaguucucucucaagaauuccaguaaauuuccagagcacuu

SEQ ID NO: 1093 - RNA, 1854 nt, Homo Sapiens
uaagcccacauucugagguucuggggaggcaugaauuuugggagggacacuaucuuucccagaacagcuucuauuauuuugugugugugugcucagugcuucguagacuugacuuuauccccuccuccuagccaccuuaugaggaagggacaauggcuaccuugccucacaugaggaggcgaggcacagagacuuggaaccucucaggauacacgaucaucuuugcccuugcuuggaauucaucugauuuucaaagaggcggccugcagcagagccucccaaccugacuuuucucuccaaauggcagucccugcacgacaaugaacaaggagaagcugggcuccacagugcccuguguucacaggcuccacagugagacgaaauguccugguuuaaaacggacauugaucagaccugcugggaaggcaagcgggaggcagaaaggcacggcugcuuccaaguuucuguuggcagagagggcagagcugacaacucccagugaaagauguuuucaccguggcgcaagagcagagacagggccagcgcggcaccccagccccgcucacagcucuagguugaugcuucucagagggaagagcucuuucucucucaagaguuucaauaaucguauccuaacuuggcacagaaccucacccuuccugggaacacaggaauguuugcuacuugaugucaauaaaauccaacuccuuaaggucucuccugggguccaugggguggaguucauuccacaccauucugagacagagucagaggaauuugcugggucuucucuggcucggaauaaguccaccaggcaucucuaccuuauccagaagagagucauuuauuuucacaagugcauagcggccgacaccaccagcacuaaccagaguggauucuugcuucacucucggggcccucauucaaggcuggucucuucccgcaggccuucugacaagugccacauuuuguuccucuaacuugggugaagcccccucaaacacuagucucaaagaucccuugcuacaaaggugggugcucgggccucaaauucaaagacccugacucaguagauccagguuggggucccaggacuguaauauaggugguccuggcaccacacuuggccaaaugcuguguagcuugcaagaaagcuccagaagcaaucuagagcuuuauaucaucacucaaaaguaaagauuuguaggaaagguuuaaaccagugucuucccaaguuuccagcuucuucaaccaaacugcugguugaggggaaggugauuugagauuuuagggcaucgauuuauacagugugaaaauuauuccccugugguuagaucaaaggaaaauucuucaucuggcacuaagagucuuuagcaccuccugacacuucuaagcucccuuuugaacaaagagagagaggccucaggcuugaagccaucagcaggcagcaguaucuggcuggaauuuagcaaugcucguuuguggucaagugcuuaggagcuggggcuaaggcaacuuuugucaucaaaaagaaggcccagaucuuggagagaagcagagcauccugagugucugccaagcgccaacuuugcagccacagguucaaguucuucccuaaucccggcagaucugccuucuugguccuauuggucuccaugugugguuggcgcgaucucugggcuuugcugaugugaagccauggggagguggaguuuuaagagcgguguucucagcgggaagagcucuuucuuucucaaacauuucgguaaucucaucccaaccuggcauagaaccucacccuuccuggggacacaggaauauuugcuacuuuacaucaauaaaauccaacuccuu

SEQ ID NO: 1094 - RNA, 89 nt, Homo Sapiens
accagacuuuuccuagucccugagacccuaacuugugagguauuuuaguaacaucacaagucaggcucuugggaccuaggcggagggga

SEQ ID NO: 1095 - RNA, 109 nt, Homo Sapiens
gucuauggccauaccacccugaaugcaccugauacugucuguucucagaagcuaagcaaggucaggccugguuaguacuuggaugggagaaaaaaaguugauguaaaua

SEQ ID NO: 1096 - RNA, 66 nt, Homo Sapiens
acuuguuacauuuacugacucucauggugguggagauggauuuuuuccuagugugccugugugugg

SEQ ID NO: 1097 - RNA, 388 nt, Homo Sapiens
ggccuguugaugccacugcuguugaagucuaugugaauggugcccccugguggaaggaaaaagagaaugggacgccaggaaugucagaugcuuuucagccucuccccugcucucacgccuagaaacaagagcuccacaaaggucucucauuccucaaggcugaugaaaagcccagcagcuaaauggccagaagccugucuuugugagaaagcaagaagucucucgguuugaacucuucggucuagagacagauucuucuaccagugguguaaaacccuaaagaggcucugcauaagaccuaccacugcucugugucucaugacacccugcccccaccacuggaaggccacacuuauucuuuguguucaugcuucucuaugaucugcaa

SEQ ID NO: 1098 - RNA, 734 nt, Homo Sapiens
uuuaagugccuaugggcuaagucuuuuaagacuucaaaauauacucaaaugcuuaaauuaugacagcaaagacuuaaggaagguguugagaacggaguugauacaaaauuaauacguuacuuugauagcuuagcaaaggccugcaacagcuuuuaucaagaguagugugacuuuugcugaaagcagcaguuuucuucauggaaggaauuuuauagcaggggcaaaauauauagaaacaaugaaaagguuuuuagaaaaauucccuuaagauguuaauuauagaauuaucuugaucauuugcacaagaauuuuucaaacacuuuucaaaugugucaacugagcaucuugucuuagcagagaaacgugcuuaaaaaugcaacuuguuuuaucuuccuugguuuuucucaacaauuuccaaagaaaauucuggcuucaaauacuggaauauguucauccgacugaggucugagaaagaagaaaauuaaaauugaacaacuugcuuuuuucuuccuugauuuuucugaacagcuuccauggaaacuuuugccucauacaguggaauggguucauccaacugagcguaccugaaaacaccaguugauaacuucuccaucacauccuuuaagauacgauauaaagauauuuucccuguuguacauuugacaaauuccaaacuucaucauucaggaaagcuaacguugcucccuugaggaaaaggcaguggcuaucuggag

SEQ ID NO: 1099 - RNA, 98 nt, Homo Sapiens
auauugaaguauugccaagauaugagacuucgaaaauguggcucacaguugcagacagaacaacuguuguuuaacagaacaacgugggcuuucaugau

SEQ ID NO: 1100 - RNA, 4154 nt, Homo Sapiens
cgucuucagaggaaggauagcuguacagcguggugaaggacucaaugagaaggugcauugcccauccuucagagagcucugugugaauccauaaaaggugcuuaaagcuuuucacuccaugaagccucaucugucucaugaaagcaauaaauagguguuuggagagcccggacuggaugcccacuagaauccugugcugacucucucucucugucucucacuuucucuccuuuccucccucccucccucccucccuccuucccuaucccucccuccucugcccaaugucucccaaucucuuuccuuucucucuucaguuccuccagguaauucuuacucaaacuuguaccaacuuguuuuugacugacagugaacagugagagaguuuucuucauuuugaggaacccuaaacaccuaucuuucccaaggcaaccugucuggacugagcauuucucugacuugacauaacuucccauccagccaggagucugcacucuucagucuuugcaggagauguuggaaacagagacuggaucccugaggagaugcuguuagaccaggcugagcucaaggcuugucccuaaggcagcuggugaaggaaagguucgacuuggugguagaagcccuggacuggaguccccaccuaugggcugagggauccuccacaagugauucaacuucuuaguuucucaccuacaaaagcugucuuucacccauaaaaacugaagccaugugccagaagcccucguggcucaagggcucuguccuuggacacggaugagggcagcugggcggugggaccgaggcucugccugaaugcucagcuucugcaagcugggguggagaguguguuccugccuaccggcucagccagcacaggagcacguagccugcagguguggguuguacacaggcuucccccugcugagucaguuccccagaucucuucaucacuuccccagaucucugggaucuucagcugagauugggccccagcaccuggacucaaggacaggugggaguuaaccaagaaagggagaaaaugaagaaccuucaggaaggaauucaugugccagaugugggcugagagggcacccagcugcucaggaagggauaacuuuuaaguggugaagaguauaaaucgugguuuuccaaguguagucuaaggucuaacagcaucggggauaucugggaaauuaucagaacuacagacccucuggcugcaccccaaaccugcugaaucggaaauucugagaaaauauucuagacucuucccuuccagcgcucacuguuuacuuccucugcacuuccccuuccugccuccccgugugccggcaguagcagaaucccaugguagccaggugggugaaggggagcgaggacguucuaccugccuugaagaagacaccugaccugcggagugagugaccaggaaugugggggaaauuuaugucagucaucaggcagguacuagaagaugcuaggggccucacagacagcuuguucccggcuguuaacauggagcagagcguucccuggggcugagcaugggagcccagcacuucuuauaguguuuccagagccuggcaauggaugccauucacaucggcauguccagcaccccccuggugaagcacacugcuggggcugggcucaaggccaacagaccccgcgucauguccaagagugggcacagcaacgugagaauugacaaaguggauggcauauaccuacucuaccugcaagaccuguggaccacaguuaucgacaugaaguggagauacaaacucacccuguucgcugccacuuuugugaugaccugguuccuuuuuggagucaucuacuaugccaucgcguuuauucauggggacuuagaacccggugagcccauuucaaaucauacccccugcaucaugaaaguggacucucucacuggggcguuucucuuuucccuggaaucccagacaaccauuggcuauggaguccguuccaucacagaggaauguccucaugccaucuuccuguugguugcucaguuggucaucacgaccuugauugagaucuucaucaccggaaccuuccuggccaaaaucgccagacccaaaaagcgggcugagaccaucaaguucagccacugugcagucaucaccaagcagaaugggaagcugugcuuggugauucagguagccaauaugaggaagagccucuugauucagugccagcucucuggcaagcuccugcagacccacgucaccaaggagggggagcggauucuccucaaccaagccacugucaaauuccacguggacuccuccucugagagccccuuccucauucugcccaugacauucuaccaugugcuggaugagacgagcccccugagagaccucacaccccaaaaccuaaaggagaaggaguuugagcuugugguccuccucaaugccacuguggaauccaccagcgcugucugccagagccgaacaucuuauaucccagaggaaaucuacugggguuuugaguuugugccugugguaucucucuccaaaaauggaaaauauguggcugauuucagucaguuugaacagauucggaaaagcccagauugcacauuuuacugugcagauucugagaaacagcaacucgaggagaaguacaggcaggaggaucagagggaaagagaacugaggacacuuuuauuacaacagagcaaugucugaucacaggggcgccauccagguuuaacccugcaagcuguuuccacaucagaacucccuucaaacacaaagauugcugugaaaacgaaaauguguagacgcacucucaaaaacugcacggacauacaaaaucaaucuuuuccuuugaucuuguggcuaaaccagcauuucuguguuugagagauuuccuguuaggugcuucgucugaaagugaacucucauaauucaaauuguauaaaauaaagcuacauuucuaagagcuugguguagggcaauuggaauaauguccuguuagauaaacagacauuuagcaauccugacauuaaaaggaaauguauuucuauacaagauuauuagcuguaauacaagauauuuauuuaaccaaugaccuuauggcugagaguugaauugugguucaguauucauugaucucacugcuuuaaaacaugcucuuuuuguucaagcaggaaaaauauuauaucuaauuaugucuaugugguaauaccuaaaaagagguagagagacucuauguucacaaaauauaguaauuucauuuuuaccuuucuucaguggacugaauuguauggaaggaaauugaucagaucuguaauucacaacuguggaaaccuacacaaauggggcugaugccauuguuuccucuauuuuauuuuauuuauuuuugaauccacuaucucuuuccauucaaaauauuuccauucaaaaugugguucacagacccgccacaucagcaccauccgagagcuuauuaguaauguguagauucucaugucccagccagacuuacagaauuggggucuguaucuuaacaagaaccccagaugauuuguguacaaaugaaaguucgaaagcugugcucuggacaguguucucaaagcaacuuucugaagccguguggaaaacugacucugugugggucccguaucccuguggcauccagaccuggccucucuucauuucauuauuauuggccaauauuucuuucagccauuucauuucuuaucuauuaaaauggcuugcccauaaaggaacugcauaggauuauccccugacauuccaagagcaaaauaaagcucuugagaguaauuguugucucagucaugcuugcugauuacaguuagcacaaaagaaaaauucagcugccugacaauacaggaaauguucucagaugcugauguuuguaagguccgguggggccaugaggaagaagaggagcugaagguaagaaacucauaaacaagaugacucuuugaugcaugaacaagauuugaaaaucucaagccuguaaagaauaccccugcuauuuaaauaaagcucauaccaagagguaacauuuugccccgggccaaauucaggggucuagugcccugcauuccuuugaggcaaaaaauaaaugggcuaugacugguuaaauguccaaaa

SEQ ID NO: 1101 - RNA, 463 nt, Homo Sapiens
cccagaguggagcucagcuacagaggaaugcuucacugaaagaaaucuuuucuauggaccucugguuuuagagacaacaucuaguucucuuacaucccuugccacuuccccugaugcuguaggacagacaggucugucccacccacggugacucagucauuguuguucauggccgcugcccguucuucacgaucaaggaggagaauucuuuggaggaaacagagcuuucauacgugaaucgacugggaagcgagucaaaaguacugcaacuggaaguguggcauggggagggggccguggccagucuccucacugggcuccuguaggacugggaacgccuacuccuucacaccuaauuauguuugcuggauuggguuauaguucuucaguguguggacucuugucaguuuuauauccguaggccgagcacaaugccuggaauacagagcaugcuuaauaauca

SEQ ID NO: 1102 - RNA, 355 nt, Homo Sapiens
cuuauuaggugauuuucaauggaagaauauguuugaguucuuaaauagaaaccuaagaaaauacuuauucuagaaauuagaauguggcuaagaauaaaaggggaaaccaaaaauagcagggacggaagaagcuaaguagacugcagcauaaggaacgcagaaauuccaacuguguuaggaacuuugaaugucaauuauucaagcaagacaauaaccaccacccuuggucacaaagugcugggauuacaggcaugagccaccacacccagcuuuuaguuacuuuuuaaaaucaaugugcacuuagguucuaaaauuaugcuuaaugccuuuaauucagucugaaauuacucucaau

SEQ ID NO: 1103 - RNA, 424 nt, Homo Sapiens
uaauuauauagcccugggaaauggaucuucaacugaauuaaggaaaagaggccuccuuccuuguccugagaaggacuucccugucaguaucccugcaacccccuccucucaacugugauccaacugcugaaacaaagccaaauugcugccgaggcccagcaggcagaggcuggaagcuuucugagacguuucaggcgcugccaccuuccgggaagaaagagaagcauuguguucaauggggaaaagauccugaaauuauguaagggaacaccaaauaggacccagcaaguaaaaaagugaaggaaacuacuuccaauauggcaaaguugauccucaaauucagaacuauucuuucccagcccugcagacaaguucaacaucuuaagcaugggaaaacaaaccagauaaacaaaaccacaaaaca

SEQ ID NO: 1104 - RNA, 849 nt, Homo Sapiens
cagcugaacucacaucucccgucaacauguccuacaacugcugcucuggaaacuucuccucccgcuccuguggugacuaccugcgcuacccagcauccucacguggcuuuuccuaccccagcaaucuggucuacagcacugaccucugcucucccagcaccugccagcuggguuccucucucuauaggggcugucaggagaucugcugggagcccaccagcugccagacguccuauguggaguccagccccugccagaccuccugcuaccgccccagaaccuccuugcucugcaguccuugcaagacgacuuacucugggucucuaggcuuuggauccagcagcugccgcucccugggcuauggaucgaggagcugcuacucagugggcuguggguccaguggugucagaucccuggguuauggaagcuguggcuucccuucccucggcuauggaucuggauucugccgcccaaccuacuuggcuucuaggagcugccagucuccuuguuacagaccagccuauggaucaaccuucugcagaucaacuugcugaauuuccagaccuuuuaagcaaagugucucagucucuacguagagcuguuaucauaggcauuuccagcaaugugagcuaaccccucuuacuacuagcucuucauccuuucucuggcaucaaguacuggcuggacaggcuaguucuuucagacugugaaauuaaugaaugagcaaaauauagagucaaaugucuauaauuuugaaacaagugauucguuaucacguaaguucaucuuauaaaguauauggaaguucaguuuuguuucacguaauaaauucauuuacuguugauucca

SEQ ID NO: 1105 - RNA, 1601 nt, Homo Sapiens
cagcaaagggcaacacauucugcgggcucaaagucaagcagaugaucugcuugauccagaccaucaguuacuggaucagucacaguccuccagagaagcagaacccauagguuacauauuuaaggaacugacucaugagauugacaggucugaaauccgcagggcaggcagcaggccagagaccccggcaagagcugauuggaugaggccuacccacauucuccaggauaaucuccuuuccuuaaaguccacuggcuggaguuguuauccacaucuacacaaugccuucccagccgcaccucagugcguguucuguugaaucuccgggugcugcagccagguugacacagcgacaccucacagguguugcucguggaggugggcagaccgguacauuccauaugggguuacugcccagcagacaagagugugcuccugucucagccuugacccucacaaccaccauggggcggcuauuuagugugcacuggcaaaucugggggcccuguucucccugcaucguuuaccccaaaggugauagugaacaaucugcuuccaagucgaaacaggcuuucccauugcuauugagaaagggaauggaauggccucuguccgcauggcuggaauccuccuccccugcccccugcaugccucucuggagacgcaacucauucugggaaucccgcccgaguccuugcaggauuagggggcuuugcuccaugagaccccacgggcuuugauguauccacacucuccggagucuccuccccaggggccacagacuugcccauuuuucuagacaccuggcuggccacuucucagacgcuguccuuagcagcauggaagagcagggccugggaacauggacuucagagccagaaagcgcaaugucacacacccgucccauuagugugcgaccccagccagccaccucuccaaaccuuagcuuccucauuugucccuacagagucuagcaaacauaaauagcuaauugaggaaucugucuuaaaauccuauagguaggaaaacagugaccaaaagcaacccuaaaaaugguagggaucaggccuccuuccucagaggcggcuggggaauauaauugaggguccagucuacagaacugcaaaccucaguccccacccgcacaugacugugcccuguucgagaaguugaugccaucccccuagaagcugugacaaauuaucagguuaggggaaagugugcaagucacacaaacgauuucaggaagauuugcacacgggcacauaugaccauaaucugguuucuggcauugauguugaacuaugaaauucaacaaaacaggccaggagccguggcucacaccuguaaucccagcacuuugggaggccgaggugggcggaucacgaggucaggaguucgagaccagccugaccaauauggugaaacccugucucuacuaaaaauacaaaauuaucgaggcauggugaugugcaccuguaaucccagcugcuugggaggcugaggcagaagagucgcuugagccugggaggcggagguugcagugagcugagauagcaccacugcacuccagccugggcgacagagcgagacuccgucuc

SEQ ID NO: 1106 - RNA, 349 nt, Homo Sapiens
accucccuuagggaucugucagcaugaagguggggauggauguccaaggcugugaauguggcuccugggggcgggcccagcagaugccagaaucaaggcagagucuuuagaggaagaaucacaaagagccuggggcuggcuggaauuuucucccgugcagucguccagccucccguggcagggagcggcaucucagugugcgaagcccuuuguauacuucccuggaauguggcuuuuauuuuguaacaaagcaaauguuuuacugcugguuuuccuuuaacaaauaaauauuggcuccaacacaugucagagaaagucgacaacaauaaacccaagugucugugauuaa

SEQ ID NO: 1107 - RNA, 2183 nt, Homo Sapiens
uguaauccgaugcuucaaguucaauauauauagccagcagcaucuagagccaaccauggccguggcuccuacagcugggccaagcugcugagacaucuaggggauuuggagccgauuggcaauugaucugcuguaggacaggggcaggauuuaugguggccuugcagggcugguccuucugcauacuaaacaguccagaggacagcaaggggagggcagccgccuggagcccagggcaaguggcugcuuguggguugcuggggcagagccuuuagcaaagggguauccaccuugaggaccugccccuguaaaaacccagcuuccuuggagacucagcugcggugggagccaugcagaaaguggcccuguggcugugugcccugcccuucaagaggcaccauugccuccugaagccuguuuccuugucugcaagaugucccaggaugguuuguugcccaagagguggcccagcagagcuccuugcagaaggugcuggcauuauugcuugcucaggacacccgcauccucuugcccugggcuucacacuccaggaaugccuuucucaugucugugcugcauauacuuauuguaaguaaaggagaaccucauggccgaugauaguuuguucauuuccucccagucuuauugugugcaccuauucuuucuuccaaguucacagucucucugggcuuguauggcgugcauuucacucaccacagaugucucuucggggcugguccaugguguuacucucccagcauugacuuaaacauuuccccacuguuggauaguguagcuguuuccaccucuuugugguuauaaauaugcuguggucauuaucugagcuggcagagugaaguccgccccucuacguguuuaauuagcauagacuccaagagggggcauucauggguuaagcaucucaugacuugggacaccccuuguccgaugacaaaaaccuggcccugugaucccugcccucaguggaggagggagggccuuccguggugcccggccggaggggcugggauguguucacugugagucuggugggucucacauguaggcagaguggggacaaggcagccugcucuguggcgugucccauggcguccggguugccuugucugcaguucacucacauugcccuugguguugcugcuucagauaaguuccugccguguuaaugcuauuaauuuuuugucauguuagugucaaaaauuuacccgccucauuucuugucuuuuagcuugauguuuuccuuugagccaccugagaauuuagcuuccacacagucaaagugaacucauccuucccuuuauucuuggaaaguuccuucucaccagggauucgguaaauauuugcuucuguuuacuuccuguuccuuucaaugguuuaaguuauuuucugucagcaucaacuuauuccccagcccauauccgcaggccucacacucuaauuaagaggaugcccuauggccgggcgcgguggcucacgccuguaaucccagcacuuuaggagcccgaggcaggcugaucacuugaggucaggaguuggagaccagccuggccaacauggugaaaccccgucucuacuaaaaauacaaaaauuagccgggcaugguggugugugccugugaucccagcuacucaggaggcugagguaggagaauugcuugaaccugggagguggagauugcagggagccgagaucaugccaucgcacuccagccugggcaacagagugagacccuggacccuccaagacaucagauuguccaacugcucaguuuucauuggggcaagugccucgcugagggugaagggggcugugagugcccaucagggagccuggacaggucccgccucucacagcugucccacucucuggagcugccuugguggcagauggcacuguccugacaugcuccucagcugucuugccccgcagaagcuguguggucuccccugugaguagagucgggcuccaugauccuccggagcagcgccagggacucuccccaggcacaauuuuaaagggggcccuaggaccugccagguccacggaagugguccuuguaacucucucccugguggcagccucuggugcauuccggcaggggcagccccuccucaucacagggacccugugugccaggccccagcugcguugccgcugaauua

SEQ ID NO: 1108 - RNA, 82 nt, Homo Sapiens
ggccugcccgacacucuuucccuguugcacuacuauaggccgcugggaagcagugcaaugaugaaagggcaucggucagguc

SEQ ID NO: 1109 - RNA, 414 nt, Homo Sapiens
gaggaaaacaaaccccagcugggaagccugagaacacuuagccuucaugaguguccccaccauggccuggaugaugcuucuccucggacuccuugcuuauggaucaggaguggauucucagacuguggugacccaggagccaucguucucaguguccccuggagggacagucacacucacuuguggcuugagcucuggcucagucucuacuaguuacuaccccagcugguaccagcagaccccaggccaggcuccacgcacgcucaucuacagcacaaacacucgcucuucuggggucccugaucgcuucucuggcuccauccuugggaacaaagcugcccucaccaucacgggggcccaggcagaugaugaaucugauuauuacugugugcuguauauggguaguggcauuuc

SEQ ID NO: 1110 - RNA, 472 nt, Homo Sapiens
acugcggggguaagagguuguguccaccauggccuggacuccucuccuccuccuguuccucucucacugcacagguucccucucgcaggcugugcugacucagccgucuucccucucugcaucuccuggagcaucagccagucucaccugcaccuugcgcaguggcaucaauguugguaccuacaggauauacugguaccagcagaagccagggaguccuccccaguaucuccugagguacaaaucagacucagauaagcagcagggcucuggaguccccagccgcuucucuggauccaaagaugcuucggccaaugcagggauuuuacucaucucugggcuccagucugaggaugaggcugacuauuacuguaugauuuggcacagcagcgcuucucacauccaggugucaagguucugggcccagucugugcugacucaguggugugaagaguuccugugggugggguaa

SEQ ID NO: 1111 - RNA, 407 nt, Homo Sapiens
gcucugcuucagcugugggcacaagaggcagcacucaggacaaucuccagcauggccuggucuccucuccuccucacucuccucgcucacugcacaggguccugggcccagucugugcugacgcagccgcccucagugucuggggccccagggcagagggucaccaucuccugcacugggagcagcuccaacaucggggcagguuaugauguacacugguaccagcagcuuccaggaacagcccccaaacuccucaucuaugguaacagcaaucggcccucaggggucccugaccgauucucuggcuccaagucuggcaccucagccucccuggccaucacugggcuccaggcugaggaugaggcugauuauuacugccaguccuaugacagcagccugagugguuc

SEQ ID NO: 1112 - RNA, 96 nt, Homo Sapiens
cagugcuugagucucaggaggcagcgcucucgggacgucuccaccauggccugggcucugcuccuccucacccuccucacucagggcacaggugau

SEQ ID NO: 1113 - RNA, 374 nt, Homo Sapiens
gaauaucuccaccauggccugggcucugcuccuccucacccuccucacucagggcacaggauccugggcucagucugcccugacucagccucccuccguguccgggucuccuggacagucagucaccaucuccugcacuggaaccagcagugacguugguaguuauaaccgugucuccugguaccagcagcccccaggcacagcccccaaacucaugauuuaugaggucaguaaucggcccucaggggucccugaucgcuucucuggguccaagucuggcaacacggccucccugaccaucucugggcuccaggcugaggacgaggcugauuauuacugcagcuuauauacaagcagcagcacuuuccacagag

SEQ ID NO: 1114 - RNA, 407 nt, Homo Sapiens
cagugcuggggucucaggaggcagcacucucgggacgucuccaccauggccugggcucugcuccuccucagccuccucacucagggcacaggugagauccugggcucagucugcccugacucagccucgcucaguguccgggucuccuggacagucagucaccaucuccugcacuggaaccagcagugauguuggugguuauaacuaugucuccugguaccaacagcacccaggcaaagcccccaaacucaugauuuaugaugucaguaagcggcccucaggggucccugaucgcuucucuggcuccaagucuggcaacacggccucccugaccaucucugggcuccaggcugaggaugaggcugauuauuacugcugcucauaugcaggcagcuacacuuuccaca

SEQ ID NO: 1115 - RNA, 386 nt, Homo Sapiens
gugggcucaggaggcagagcucugggaaucucaccauggccuggaccccucuccugcucccccuccucacuuucugcacagucucugaggccuccuaugagcugacacagccacccucggugucaguguccccaggacaaacggccaggaucaccugcucuggagaugcauugccaaaaaaauaugcuuauugguaccagcagaagucaggccaggccccugugcuggucaucuaugaggacagcaaacgacccuccgggaucccugagagauucucuggcuccagcucagggacaauggccaccuugacuaucaguggggcccagguggaggaugaagcugacuacuacuguuacucaacagacagcagugguaaucauagcaca

SEQ ID NO: 1116 - RNA, 398 nt, Homo Sapiens
aagaaccugcccagccugggccucaggaagcagcaucggaggugccucagccauggcauggaucccucucuuccucggcguccuugcuuacugcacaggauccguggccuccuaugagcugacucagccacccucaguguccguguccccaggacagacagccagcaucaccugcucuggagauaaauugggggauaaauaugcuugcugguaucagcagaagccaggccaguccccugugcuggucaucuaucaagauagcaagcggcccucagggaucccugagcgauucucuggcuccaacucugggaacacagccacucugaccaucagcgggacccaggcuauggaugaggcugacuauuacugucaggcgugggacagcagcacugcacaca

SEQ ID NO: 1117 - RNA, 462 nt, Homo Sapiens
gucagcccaaggcugcccccucggucacucuguucccgcccuccucugaggagcuucaagccaacaaggccacacuggugugucucauaagugacuucuacccgggagccgugacaguggccuggaaggcagauagcagccccgucaaggcgggaguggagaccaccacacccuccaaacaaagcaacaacaaguacgcggccagcagcuaucugagccugacgccugagcaguggaagucccacagaagcuacagcugccaggucacgcaugaagggagcaccguggagaagacaguggccccuacagaauguucauagguucucaacccucaccccccaccacgggagacuagagcugcaggaucccaggggaggggucucuccucccaccccaaggcaucaagcccuucucccugcacucaauaaacccucaauaaauauucucauugucaaucagaaa

SEQ ID NO: 1118 - RNA, 462 nt, Homo Sapiens
gucagcccaaggcugcccccucggucacucuguucccgcccuccucugaggagcuucaagccaacaaggccacacuggugugucucauaagugacuucuacccgggagccgugacaguggccuggaaggcagauagcagccccgucaaggcgggaguggagaccaccacacccuccaaacaaagcaacaacaaguacgcggccagcagcuaccugagccugacgccugagcaguggaagucccacagaagcuacagcugccaggucacgcaugaagggagcaccguggagaagacaguggccccuacagaauguucauagguucucaacccucaccccccaccacgggagacuagagcugcaggaucccaggggaggggucucuccucccaccccaaggcaucaagcccuucucccugcacucaauaaacccucaauaaauauucucauugucaaucagaaa

SEQ ID NO: 1119 - RNA, 321 nt, Homo Sapiens
ggucagcccaaggcugcccccucggucacucuguucccacccuccucugaggagcuucaagccaacaaggccacacuggugugucucguaagugacuucuacccgggagccgugacaguggccuggaaggcagauggcagccccgucaaggugggaguggagaccaccaaacccuccaaacaaagcaacaacaaguaugcggccagcagcuaccugagccugacgcccgagcaguggaagucccacagaagcuacagcugccgggucacgcaugaagggagcaccguggagaagacaguggccccugcagaaugcucuuag

SEQ ID NO: 1120 - RNA, 563 nt, Homo Sapiens
guuuccguuccucugcccgccaugccguuccuagagcugcacacgaauuuccccgccaaccgagugcccgcggggcuggagaaacggcugugcgccgucgcugccuccaucuugggcaaaccugcagaccuugugaacgugacgguacggccgggccuggccagggcgcugagcggguccaccgagcccugcgcgcagcuguccaucuccuccaucggcguagugggcaccgccgaggacaaccgcagccacagugcccacuucuuugaguuucucaccaaggagcuagcccugggccaggaccggugcgcagggguaguaggcccggaauauuauucuaaaacacaaucagaguacuccauuccugcuaacaguuuaaagccaaacaccuaggcaggccauuuaggcuucugaaugacugggucuugaccaggagagcugcugucuagguuuucucuuccugaccaguuccucaagagaaaugcaaaacuagugauuaacaguaagagucaggcagggcgcgguggcucacgccuguaaucccagcacuuugggaggccgag

SEQ ID NO: 1121 - RNA, 5224 nt, Homo Sapiens
aagcaaccgacgguuccccacugcucccaggagcgguuaccugggcacucugugccccuccuuccuguucgggcccaggccgaggaccugccaguagggcucaguugccuggagcccguucagcccaucccccaguucacuuugccugugggaucuccccguugcuccugcccguggacugaguggcaggccauccuacaagcacccggacacuugacaucaguggugucaagacaacucuaagaagguuuuccgugauccugcaagcccugcguuccuuccugggauccugccuucaauuugauugcacagguaccacagcaagccagugcugugugcuccgaguuccagggcguccuccagcucagccacugcacugagaacauggacucucuguggggcccaggagccgggagucaccccuuugggguccacaacacccggcuguccccagacuuguguccagggaagauaguguugagggcccucaaggagagcggggcagggaugccugagcaggacaaggacccuagaguccaagagaauccuggugaucagagaaggguccccgaggucaccggggaugcaccgucugcauuucggccccugcgggacaauggaggccucucucccuuugugcccgggcccgggccucugcagacagaccuccaugcccagaggucagaaaucagauauaacccgacaucccagaccuccuggacgagcuccugcaccaaccgaaaugccaucuccagcuccuacagcuccacgggaggcuugccggggcuaaagcggaggagggggccagccucaucccacugccagcugacccucaguuccucaaagacagugagugaggacaggccucaggcugucucuucaggucacacccagugugaaaaggcagcagauauagcaccagggcagacacucacccucaggaaugacuccuccacauccgaggccucuaggcccaguacacacaaguuuccccugcugccacgcaggcgaggggagccuuugaugcugccaccucccuuagagcugggguaccgggucacuguugaagaccuggaccgggagaaggaggcggccuuccagcgcaucaacagugcacugcagguugaggacaaggccaucucggacugcagacccucacggccuucccacacuuuguccucacuugcaacaggggcuucuggucugccugccguuucuaaagcacccaguauggaugcacagcaggagacacacaagucccaagacugccugggccuacuggaccccuuagcaucugcugcagggguccccucuacagcucccaugucugggaagaagcacagaccaccaggcccccuguucuccuccucagauccccuuccugccaccucuucugauucccaggacucagcccaggucaccucgcugauuccugcccccuucccagcugcaagcauggaugcgggcaugagaagaacaaggcauggcacuucugcuccugcagcugccgcagcagccccuccccgcuccacauugaaccccacguuggggucacuacuggaguggauggaggcccuucacauuucugggccucagccacagcugcagcaggugcccagaggucagaaccagagaucccagaccuccuggaccagcucgugccccaaaugaaaugccaucucgagccccuacagcucuacgggaggccucccggaacaaaagcggaagaggggccagccucaucccacugccagcugacccucaguuccucaaacacagacccagggugcaugcccaucuccagcccagggcagcuccccuguaagcugggugagcuacugaagccaaggugggaggcagcugacaacaccacccacggcccaugcagaggugguagaaaggcuggacucagcaggaacaccaaaucccggaccaggcagaaaccacccaagacugaggggcucgugccagagcgguggccacagggcugaauggucgcugagacagagauggaagccaggacaagggagcccaccgggcccagauagagacuucagaacccacuccugagaacagcggagccaggcgcuuagaggaagaccaaaugcugccaggacacggauuguccagggauuacauuccagcaucuuauuagaggacggaagcagagggugcuguuucaacgccaccaccaggagagaggcagaggggcugugccgugcuagaguccucagggagggagugaccucgacccuggcugugcugcaagcugacuccagccuugggcucagcagcacccggugaacagcagcaggaggagccgcuagagcagcugcucaugggcagagcagcccuugggcaacuccugccaccacccccuccccagggagcccaaggcaggggaggcucagcauggaaugaaacaggggagugagggacacaaggaggugggaagugggagggucccagccccaccaaguacgcagagacccccuugucguccuggacaccacaggggcaccugcaggcugggagaccagguccucugugcaugggcccgggaggcagaccugccccaagggugaugcagaggccacaggugcugcacgcuccagcgcccacucuagacaucagccuccagguugacuaagggucaggucauguuugaaaccaugcuuggcuggaccgggacccauggcaagagcaccugggcaccaguguuuagcccuggucugcaggaaggaggacagcagacuuuaggaccccacagcauggcagugcugaccauuucacccacuuggccuccuugaggaauagggauggggagcccucuggggaugagcaaggccuuccaggacaggcucgguucugguccccugcuuuuugagguuggguuaaaaugccgaccauggcagaggggucacagcucagguucccacaccucacuuuucacagccuccaagggcagcagugcacauggaggagacgucucccacgaggccaaggccuccaaugcucaccgaugcccucugcgaagcugggguagaacucgucagugaagaggggcucaggcagcucacggaaguacagcuucagcgugccugcgauggcguucauguccgucucgcucaucaucaccgacauguccuucuuaucuggaaagagcacggaaaugcagcggccuccuugaagauccugauaaaugaagaaaagacacagagaaggaugugacaugccugggccauggagcacucugagaucucaucgcggacaccacugcccacaccuccaucccguccugcgcaggccaacacucacugacaucgaaggcugccuucagugccuggaugucugcggccacaccggccggacacgugguagaugcccaccuccuccaugccucggcgcucgaucuccuccacgcacuggcgcacgauguagggcaccuuggaccucucucuccugugggaggggggaauguucucaguguccuaacagcccugcuugggccauaacacaggagaccugcucccuaucugcgcacccggagguggggugaggacggugacgaagguacccaggucuggggcugcacacagagccuucugcaugccuguccucccucugcaagcucugucuucacggcaugugcuuucucaggaaccuuucaagcggccagaaccccugcgaaucacacaugaccuuugcgggaaggucaggaggccugucuaagucaagucagcacgggaagggcaucugacagauuccaggccugggguuagcagccugugcccccggcugggagaucagacccgguguugguccugccacccacgugcugugugagaggagaaucccugaccccugcccugggccuuaacacacauccgacgaaugaaugaaggguugccucaguaccggugcuccaaguccugcgaugcuaagugcuuuucuccucugagucuuagcaauggacaauuccaauaccuccacacaggacacuagaguaagaaaccuucacaguuagaacgcagugcugugcggaggccuuaacuugaguucuguuuugcaccuggauuuaccagcacaucaaagcugcuucgcaagcccccucauuagcagggcuuaucugggggagcugcugauggaguccucgcugcucaugcccacagcccucccagagugcuaugcgaguggcugccgugcaguuggggguggggcgugguguuuagacacagauaggaguccaggguaugacugauggaggccccggcccacgugaccagcaaggucagaggcccagccagauuccauccuggggaagcaaaugaauucucagaggaaguggucugugucugcaugaacugcucucaaaccaacaaacaggcuucucuuggcaacagacucaugacaaaggauucaagauuguuugaaaaaaaaaaaaggggagcagggaggcagaaaguccuggaaaaguaaauuguuuauuuuacaauaagaaagugauuacauauuuuuuuuuuuacaaugguggaaaauuagaagucauugugaaaaugaugucuaccugccuugcugaugaguaggaugugauuuggcucuuuaggaaacugaauuugcagaacuuaagaauauugauuuauaaagggcauggccauugacccaguccaucuuaugcaaaucuggaugccauaaauaauauuuaaaaaugaaaguauugggguggagguugcagugagcagagauugcccccgcuacacuccagccuggucgacagagugaacucugucucaaaaaaaaaaaaaaaagaaaagaaagaagaagccauucccaacguugcucaucaaauuaugaccauaaauuuccaggaucagacuaacggcuaaagagacugaugcaucaacaccaggcagagaauaaagcagauuuuuuuguuguuguucuggagagcuucuaggaacuugaaaaauacauaugccacacucuuaagacccggugguucuuaaucagggauguucauuaaaaugcuggaaaacuguaaagacuuccaggucccauccaaggagauuuugcuucugauugacuggcuaguggccuggccauugguauuuugaaaaaucccuccaagugauucuuuuacaucccagauagaaaacccuaaauuaaaggugaaaaaaccagacaccaaguggcauuuaaauaaaugucaacuuuaacuccacaa

SEQ ID NO: 1122 - RNA, 60 nt, Homo Sapiens
ugugaaugacccccuuccagagccaaaaucaccagggauggaggaggggucuuggguacu

SEQ ID NO: 1123 - RNA, 3894 nt, Homo Sapiens
cucauccuggcugcucucaccguggccuguccagaugcaggagcuccucucugaaucuggggcuacuggcagaaccaguaaacacggaguuacuccuguacugagcugaguaaaauaaucugacugagaggaugcgcugaccucaguuucgacaacugcguuugguaccaagcccugcaagggcuccacggagcagcuuugggggagaccugccugcaggaacauguaccccacggagcagcuuugggggagaccugccugcaggaacauguaccccacggagcagcuuugggggagaccugccugcaggaacauguaccccacggagcagcuuugggggagaccugccugcaggaacauguaccccacggagcagcuuugggggagaccugccugcaggaacauguaccucacggagcagcuuugggggagaccugccugcaggaacauguaccccacggagcagcuuugggggagaccugccugcaggaacauguaccccacccgacacguccugggagccucgucugagguacaaacaacaggaaagcacugaugcauuuuucaaaauccagcaggagggaacggugggcuguggaugcuggcugggaaagcuccucgggcacagcccugugggcagggaggggaggagggcucagcccccacacaggccgccuggcaccaggagucacaggccucagccgugggauguccccagaguuccaaccgccacucuugcagaagcagcccagcagggugaggguggggccacauggggcucagcugcaggagggacgccagguccugcacuucucacccgcagugaccuugggcagggcauucauuccuugggagaaauuuccucguuggugaaaugaaaucacugcuuggcuucagccacauaauguuaggcacgcuaacugcagccuaggcaaccucagacccucaggaaaucaacagaggggugccagcucccugcacaggucccggccuaacucgggaugccacucagggcccucgucuucccauccuguggcucugucuucacaaggccccagaggugcucuugucccuucccuuucagucccucagccagugggcagcacacggccacccaaacacaagaggccaggaccauggacagcagggagcacagagcccaggccuccgugauccuaggaacacgcagcauccgggaacacggaaaguaaagauggagacauggggcgggaggaagcuaagcagggacacaguacccccuugcaucacggaaaugccuggccagagcgaccugccgcaagaagccagcccagcugcuccugucccugaaauguccggagagagggccagcagggaggcuggcgccugggccaagagaggggcuacucaguucuuccagaacauuccaguguggcccauggacaccggccuucugauguccagagaggggcuacucaguuccuccagaacauuccaguguggcccauggacgccggccuucugggguccauucuguccugugucacuucaguugaugagcugcuugagaccagaacugcccaaauccagaaccgcccacuaccuucugugaggcuguggccagaaagcaagccagacuucugaagcugccugggccugucgggacccaggagaaucuggccgugaaggagaauaaaggaggaagccaggccuggcacagggacaggguggggacccagugagaucuccaaggaggaagccagggcuccuacacuggggcugcuguucucccggaggaacuccacccaaggagagucugggauuaucaugagagacaggaccgcaucugugcacagugcaguacgucaggugcuggccaggggccgggggccucagggaggagagucacccaccaggccaacuaggacagacgaaacgugagugccccuacgggagaaagcaaagcugagacagcaucgcgagcugagggagaaacugacagacggcaguucaccaaaacccaaaaacuggucauucucuggccuuuaacaaaccaaaguauauuucucccucugaaauaagaaacacaggacaauuauuaaguuccaaaaguacguuucauuuuggaggcauguuguugguccccuuuggaaucaugaaccccugugagcgaaacaccucccaccauugauucugacaggguacggcgggcaguucccggcccagguagaggcagacaggugcagagccacagggccaccacugcagagucuggccuucucuccagccccgggugcacccacgguuaucagggacccagcacugccucccugcacgcacauggcucuccaggccaccacugcagaguccggccuucucuccagccccgggugcacccacggugaucagggacccggugcugccucccugcacccacccggcucuccacagcagcaaacgggguacauuaggguggacgggauguggggccagggcccugcuagggcugggguggacugcggagggccggcaccaagcaguuccagguguggagggcggcccuaugucagcuguuagacacgcaggggaggcaccucagauggcuacagguuugauuguguccccacaaaaauccauauguugaaguccuaacccccaacacugccgaagaugaccuuauuuggaaauagagucaucaaagacaucauuggcuacauuaagauaagguuauacuagaguagggggacaccuagcuuauuaugacugguguccuuauaaaaagaaggaaacuggacacauaaagggagaaugccauaggaggacggaggcggagaucggggugaagcuucucuaagccacggagagcggccuagaaccgacccuucccucacagcccucagaggacagccuggaaccgacccuucccucacagcccucggaggacggccuggaauccacucuucccucacagcccucggagggcagccuggaaccgacccuucccucacagcccucggagggcggccuggaaccgacccuucccucacagcccucggagugcgaccuggaaccaacccuucccucacagcucuuggagggaacccacccugcccacaccuugaccucggacagguggccucuagagaccugugcagugaguuccugcucccagccugugguccuuccauguggaagcaaagcaaacuccuccaggcacauucaccgccauuggcaugggccuccgacacugaccagggccucccgucaccucugccccugcccaccacuccccagcccagguaccaugcuguaaaaacagccucaaaaagaacaugagguccacagcuccuccaggagacugggccagccccaagcacauccagagagguggcuccucugacuggaggcucacgccaaagccacacagagacagcugccauucucgcucgcucaugcuucccccgagccuaaacccugaccagccagcucuauacauuuacaucuuuuucuggccucacacacugucuagaauguccagucgaauguugagaagucguggucaaagcagaaagcccagcuuuauccccagucuuaguggguacguguuugcuguuucacguuaagauacuggcuggcaguggggcacagugacucacgccuguaaucccagcacuuugggaggccaagguggguggaucacaaggucaaaggauugagaccguccuggccaacauggugaaaccccaucucuacuaaaaauacagaaauuagcugcgugugguggcggacaccuguagucccagcuacucgggaggcugagaccggagaaucgcuugaacgugggagcagagguugcagugagccgagaucgcaccauugcacuccagccugggugacagaacgagacucuaucuc

SEQ ID NO: 1124 - RNA, 129 nt, Homo Sapiens
gucuauggccauacaacccuuaacacacccgaugucaucugaucuuggaagcuaagcaggguugggccugguuaguacuugaaugggagacauuuaccucucuugacaagugacaugucgugcuaaguu

SEQ ID NO: 1125 - RNA, 1050 nt, Homo Sapiens
accagcccagccuuucagugcaggcuccagcccuccacccccacccgagaggcugagguaggaguggagagagaaagggagcagggccuaggagguccugaggugcaggcuggccgcugaagguucaggaucuucccccacgcggcaggacauccgccaagguucccagaucugagacggcgcaccuccugcguguccuugacggcagacuugcucugcccgcucaaacaguugcaggaugucgaugacagacuugcugaacgcugaggacaucaagaaggcggugggagccuuuagcgccgggcucccucagcccuccaauggagcuaccgacuccuucgaccacaaaaaguucuuccaaauggucggccugaagaaaaagagugcggaugaugugaagaagguguuucacaugcuggacaaggacaaaaguggcuucaucgaggaggaugagcugggauucauccuaaaaggcuucuccccagaugccagagaccugucugcuaaagaaaccaagaugcugauggcugcuggagacaaagauggggacggcaaaauugggguugacgguggguagccgugaccuggggucugggcauauuguggaucuugggguguuggaugcgaaaaguuugaagcuaugucugucacaaggaagggaugauaugggggucccucacucccccagauuagaagacaaaaagcaguccauuaggucugagagcucugccacauacuccagacaaaggaaaacugguguauuuuauccagcagauguugacugaguagcaacucugugcccggcaauggaagagaauucuccacucugguggcugaaagcuaagaagcacugacugccccuggucuuccaccucucugcccugaacacccaaucucggccccucucgccacccuccugcauuucuguucaguucguuuauguuauuuuuuacucccccauccccuguggcccucuaaugacaccauucuucuggaaaaugcuggagaagcaauaaagguuguaccagucagacucugcuugcucaggaa

SEQ ID NO: 1126 - RNA, 828 nt, Homo Sapiens
acuuucuaguugcgugaguccugggaucccuaauuccccaccugaaaaauggggugagaacagagguucccuugagaauguacuaugagcuuauaacgaugagggcugaagaaagugguuugcaaagugcagaaugcccuucagaagguagccauuguuaagaggacaagguuacagaugcaaggaagcugggcuaagugagggaggcugggagagcugucaagcggcugcauugcgugcuggguacugggagaugcaggcggggagacacaagguagaaggggcaaaguccucaccuaggaccuugagggaguuaauguguaauauucuaggauauaagcuugaccacgaguugagacccugagcacaggccuccaggagccgcugggagcugccgccaggagcugucaccaugacgggggaacuugagguuaagaacauggacaugaagccggggucaacccugaagaucacaggcagcaucgccgauggcacugauggcuuuguaauuaaucugggccaggggacagacaagcugaaccugcauuucaacccucgcuucagcgaauccaccauugucugcaacucauuggacggcagcaacugggggcaagaacaacgggaagaucaccugugcuucagcccagggucagaggucaaguucacagugaccuuugagagugacaaauucaaggugaagcugccagaugggcacgagcugacuuuucccaacaggcugggucacagccaccugagcuaccugagcguaaggggcggguucaacauguccucuuucaaguuaaaagaauaaaagacuuccagccgaga

SEQ ID NO: 1127 - RNA, 5604 nt, Homo Sapiens
aaugcagugaaaccagaggaagaaaaaaauuacuuccuuuccuguuggaaaccuaauaaguaguuagucugacccaguuuucaauaagagagauuuucugaugacccgacaggagugacuaucuccagucaaagaaagaggagggugaauuuaaucuuucauggcccuggaauggcagcugcucucagcucucucugauucugugaagguugaugaagauagagcuggcuuucaauguagaaagaauuuuccuuuugaauauuccaaacgagagcuuugcacaugugccucaagaacugauugucuggcuccgacaggaaugcagcaggagaggagcguauuucaugcuuaagaccagagaagagccacgcaauacucaguggauaaaaggcuugcagucccagcugggaaaaagagucccauuaucucccagcugcauagacauuccauacggcuugguucugccuggacgcacagcaugccuggcugagagcuugaaacagaguucugcagaaaaacuguaaagaucccgagacauuucccugguaagaucuaaugccuacucugaggccuuaauucucacaucugaugauacccugaggaugacaugugaggccaagagggagugaagccucauccccacuuugugcuucuuuauuaaccagacucuugagauacugacuggaagauagacuguuuuguuccaccugauuguaugggagaaauuuuugaccuuagaaaguggaaaugagguugcuauggaaacugguaauucugcugccacucauaaacucuucugcagguaaaguguucuauuaaaaguuuauaucaguccaauucugcugcuaacuggacuucgucucuggcuucuucauuuggaaaucuaccucuuaugcuaagugcccuuauaucaccuggcgguuugcaaagaggugauggucuuuuaagccguccuauuuuuacucaggagccacaugaugucauuuuuccuuuggauuuaucaaaaucugaggucauccugaauugugcugcuaaugguuacccuucgccucauuauagguggaagcaaaauggcacagacauugauuuuacuaugaguuaucacuacagguuggauggaggcagucuugcaaucaauagcccccacacagaucaagauauuggcauguaccagugccuggccaccaaucuucuggggacaauucugagucggaaggcaaagcuccaauuugcauauauugaagacuuugaaacuaaaacaagaagcacaguaucuguccgagaaggucaagguguggugcuucucuguggcccaccgccacauuuuggagauuuaucuuaugcauggaccuucaaugauaaccccuuauacguccaagaggacaauaggcgauuuguaucucaagagacgggaaacuuguacauugccaaaguggaaccaucagaugugggcaacuacacuugcuuuauaacuaacaaagaggcccagagaaguguucaagguccacccacuccauuagugcagcgcacugauggugugaugggggaauaugaaccaaagauugaagugcguuuuccugaaacuauacaagcugcaaaggauucaucuguaaaacuggaauguuuugcccuuggaaaguaagguuuuuguuuuuguuuuuguuuuccugguugcauuaauuuuuuuuuauuaaaaaccuuuuuguuauucauauauugcucuaagguaaauuaccaaguagauuucaaaugcugggcaacaguggaacuuucugauuugaauuuaaacaaacaugucuaauacugagacaaugaccaggccuguaacugaaaaugaucagggcugcaauucuucccuacaggugcugauauuuccuuaguuuaagcauaaugagacccauuuaggcagcacauugcaagggaauaagugcacucguauaagaugaugggcaagucacuaaaccuuccacauauccuucacuccaucuuguccuacauccagaaauacauugccuguccaguccccgauauuaguuggagaagguuggacgggagcccguugccagggaaagucaaguacagcaaaucccaagcuauccuugaaaucccgaacuuccaacaagaagaugaaggcuuuuaugagugcauugcaagcaaccuucgaggaagaaaccuugcaaagggucaacucauuuuuuaugcuccuccagaaugggaacagaaaauccaaaauacacaccucucuaucuaugacaacuugcucugggaauguaaagcuaguggaaagccaaacccuugguauacaugguuaaaaaauggugaacgacucaacccagaggagagaauucaaauagaaaaugggacacucaucauaacgaugcugaaugugucagauucugguguguaccaaugugcugcagaaaacaaauaucagauaauuuaugcaaaugcugaauugagaguuuuagccucagcuccagauuucuccaaaaguccaguuaaaaaaaagucuuuuguucaaguugguggggauauuguuaucggaugcaaaccaaaugcuuuucccagggcagcuaucucuuggaaaagaggaacggagacccuuagacaaagcaaaagaauauuucucuuggaggauggcagccucaagauauauaauauuaccaggucagaugcuggaucauauacaugcauagccacaaaucaguuuggcacugcaaagaacacuggcagccucauuguaaaagagagaacugucauuaccgucccaccuuccaaaauggauguuacaguuggcgagaguauagugcuaccaugccaggugucccaugaccccuccauugaagugguauuuguaugguuuuucaauggagaugucauagacuuaaaaaaaggaguggcucauuuugaaaggauuggaggagaaucuguuggggauuugaugauaaggaauauucaguuacaucauucaggaaaauaucucugcacaguacaaacaacccuagaaaguuuaucugcaguagccgauaucauuguuagagguccaccagguccuccugaggaugugcaaguggaagacauuuccaguacuacuucucaacuaaguuggagagcaggcccagauaauaacagucccauucaaauauuuacuauucagacucggacaccauuuucuguggguuggcaggcuguugcuacaguuccagaaauucucaaugguaagacauacaaugcaacagugguugguuugaguccuuggguggaauaugaauuucguguuguugccggcaacagcauugggauuggagaaccaagugaaccaucagaauuguuaagaacuaaagcaucagucccuguuguggcaccaguaaacauccauggagguggaggaagucggucugaacucgucauuacgugggagucaauuccagaagaacugcagaauggggagggauuuggauauaucaucauguuccggccagugggcucgacaaccugguccaaggagaaagugucaucuguggaaucaucaagguuugucuacagaaaugaaagcaucaucccacugucucccuuugaagucaaaguggguguguauaauaaugaaggagaaggaucccugaguacugugaccauugucuacucuggggaagaugaaccucaacuggccccaaggggaacuucucuccagaguuuuucugcuucugaaauggagguuucauggaaugcuauugccuggaauagaaacacuggaagagugcugggcuaugaggucuuauacuggacagaugacuccaaagaauccaugauagguaaaauuagagucaguggaaaugucacaaccaaaaacaucacggggcugaaagcuaauaccaucuacuuugcuuccguaagagcuuacaacacugcugggacagggcccucaagccccccagucaauguuaccaccaaaaagucucaauuaauauauuucaaaugacacugaagacauuuuagcuccuucuaugcaaaucaucgaagacuuauuuuuucuuuucauguugaugcaucauacuuugaccaugagcuaauuaacauucauuuggaucuuugauuaucucuuuaaagcuccaagccaaccaccagcaaacauugccuggaagcugacaaacucuaaauuaugcuugaacugggagcauguaaaaaccauggaaaaugagucugaaguuuugggguacaagauucuguaccggcaaaacagacagaguaaaacucauauuuuggaaacaaacaauacaucagcugagcuucugguuccauuugaagaagacuacuuaauugaaauaagaacagucagugaugguggagauggaagcagcagugaggaaauuaggauuccaaaaaugucaaguaaguugagucaccauugcuguaguagauucugaaccuagacagcugcagcaugaaauucagcuccaugaaaccuuccaguuauggcuuaaauguugggugauaagauaaauuuucaauugugagcaaaaggugaugagccauuuuuuuaaguuauucuccaaaauuauaacauacacuauaaaugguuuuaugcuuccucauuugaaaaccaaaaagagaacaggaaaaaaaaucuuugugucauuagagcauaauuguaucacucauucuauuaucacaaaaaucagaaagauuuuucauagauucuuucggguuugaguuccagaggaauucaauucuuagaaccuagcacccauuuucuuuccauugucauugugauuuuucacuguuuugcuauucagccacuuaucugaugaauaaaaccauaaaucuuugagaguuuuuugaaagcaaaucauucuguauauaugcucuccagccucugacacaagaugcguucuuaauacagacuuguuugcaaagaaaaaaaaaaguauauuauuaaaauccuguaaauaucuaugguauauuaauaaaacaauuuuaaacacuuuugaauuuuaaaauccgcacaugauuacaugaauuccuaggugccacauuaaccuggggaguuguaacugcugugucuuuuaaguuacuuauauggagaaaauaaauaacuccccucaaugaugcugaugaugaauacaaacuuggcuccuaguuaccauaacucacauguacauuuuuauguauuccagacaaucacuucaguauuuaaaauuuccacccuacuucaaaauaaaauacaauuauuuguuuauaguugggauucuuuaaaaauacaaacuauuccaaagcauggggugcuuuuaucucugaaucaaguuggaauaagaaaucuuuuuacucaagaauauuucaauauacaugauguucuucucagcccacuuuucagaagauucagucacaauaaaggcagaaaaaguauuuuauggcaaagaaaaauaaaugaugggaaaugagcacccaccuaaaauaaucuucuaacaacucugguauauauuaagcaauugcucauggcaaaguugaacauuugaacugcugcaugaacaaaucucagguaauuaugacaaguugauugcaauguauguggccuuauuuuuauaauaaaacaauguggaaacagaa

SEQ ID NO: 1128 - RNA, 2887 nt, Homo Sapiens
uuuucuuuugauagaaugucaaacuuacgaaaaaaguuacaagaagagaacaaagagcuauuagaggguguugcugacacaaugcuuuaucacucuugaauauuuucguguguaauuccuacaaauaaggacauucucccacauagccacaauacaaccaucaaaaucaggaaguuaacgcugauguguuucuaccauguaauccucagauccaauucaagugucaccagcugucccaauaaugucuuuuauaacaaaaacauucagucuaagaucacucauucuauuuaguuaucuugucuauucuucaauuuggaaguguucuuuguucuuuccugaauguucaugaccuugacaucuuagaagauuaaagguuauuuaaaguuguugaguuaaauauccauuaaauuagguuugucagauauuuccucgaaauuagauucagcuuaugcauuuuuuggaaggaauaccacagaagugauguuguuuucuuucuguugcauccaaucagaugauacaggauuuugauuuguuccauuacuguugacaugaauuuugaacauuugauaaugccaguaucagccagauuuuuccauuguaaagucauuccuuuguccuuuguauuuaauaaguauguuuagggacuuugagacuaugucaauguccuguucuucaucaaaauuccacucacucauucuuaguauucauugacguuuacugaucgaacuaauuauuauuaugauaguugccaaauguugguuuuucuaauucaaucauuucuuuaguguuuauuagcauucuacuauaaggaaaagcacuaucuucuccccauuuauuaauucacauauuuacaucagcuuggaguuauugauuucuauuuuauuaaauaguuuauaauugauuaccauccuuauuuauuuuaaugcucaaauugucccaaauuauggccaaagaaagcuccuucaaacugguugcuauguccuuuugacauggcccaucauucuuuaaacacauuuuacaucuggcacaauaacgugcuacauacccaucuuguauuuuuccugccccaucuuugaaaucagccauucucaagggguuccuucuuaaucuggcuguuguuguguuggaacuccugguaccaucuuagaaccuuaaggagacaagcgaaccaagccaauaagcuuuccaugaugcugcuuagaguuaaacagagcccagguacuaaguuaugucauggagacagugaacuaaccucuggacugcuugcuacaugagacaauugauuuucuuauuuucuauguagggugguacauuuccucauuuugagauauuucuucaacauauagcuuuucauuaguggggauuuugucaauuauaaccaaaaacaaugugacggauacccaagauguuucauguuguagcuugggugaauuacacauuucugaagccauuacacuuccuaguuuauuuggauuuaaguugacaaauaaaaauugcauauguuuauggucuauaacaugguguuucgauauauguauacaucguggaauggcuaaaucaagcuaacauauccauuaccucacauaguuauuuuuuguggugagaacauuuuaaaaauauugucuuagcaauuuucaaucaagccugucccauggagacacaagcaauagugacaugagcacuugacucgcuggguuaucaggcuuuggcuccaaauguuuggcuucaaauaugaaaaaguuacaugaaagaugaaacuaugcaauggcauggcuguuggucauucacaucucucucugccaagaauggggaugacgcuguugaaggaagaaauguguuuucuccuuuuucucaagugauauuugccuuaggucagauucuacuaguuuaaagcaaaacgaucuccuggucugauuccuuugggucucuaauaauggaaacugcaaggaucagcauaaaguguuccuuuguucugacguugguauaacauugcuucuugaaaaaugaaaguauuuggacauacagacagaagcaauauuauucaggucuuccuuguugcaagugagggaaauccaauuaaaacugguuuaaaccuaaaaaaaaaaaaaagaagaaaagaaaagaaaaaauaugagagggguuuugcuuucuggaaucugcuuucuagucagaaagugcagaagaagggcuagcuucaggaacaauuggaugcaguaguucaaaucacaaguuaagucucugcuucuuuucuccaucucucuucugucuuccuccacacuggcuuuauucuuagguaggcuuacccagauagucauaaacacagccaccaguggcagcugggcucacuuuuguccuuggagccagugagcccaugaaaaaggagcuucucuuucuggagcuucccagggguaacuuugaucagccaacaagggucaguccuaugcuuaucccuugaccaaucucugugcccagagggcaggguacucugauuggcaauaccuucaucgugggccaaccacuguggggaagggggagggauuagaaaagacagccacacccaaaucucaugaagcaguccccuuuauuuuaaaaaagucccugugagagcaacaggagcaaagcauggagaagaagcaaucuuggagaagcuggaagagaacugacccaaagaauccaagagacuaagacugugcaggguuggggaacggaagcucacacaggaggccuggacagagcugcagcagagccaggagagaagccaaguggcacagcucaucuugaaguaauuauaaugccacuaaaauucucauuuguauuaauuuuuuuuaauuacuggcaagauaaggcaaauguuuuuaaaggccuaaauaaaaugauauucccugaa

SEQ ID NO: 1129 - RNA, 77 nt, Homo Sapiens
guggccucguucaaguaauccaggauaggcugugcaggucccaaugggccuauucuugguuacuugcacggggacgc

SEQ ID NO: 1130 - RNA, 3273 nt, Homo Sapiens
accauucuuccgguuucagaaguuaaggcugguguccuggccccaguccaccucugggagcgccugcgccgcuccgcggagaguccguggaucucacagugaaaaauguuugcugacccuugacauugacaaacugcugacagcucagaugauccaugauuggaaggauguggucaucaccaagaugucuuucuuucuccgguucccaguuuuccagaccugaaguguuuuccaaucaaagcgaagagacgaucuguggauguugaauaugcaaggagcugaagagagagacauuagaagagagacuuguccaggcuggguaaacaagaacaagccugcucuggagcaggaugucuguaaaauugacucaucagggauaguaguaaagagguuccaagaggaugaauaccaagauucuacauuugaagaaaaauaugcaugugagggcaugaaggaaaacucuccuagggagauugcugaaucaugccuuuuccaggaaggagguuuugggagaauaacuuucauccacaaagaagcacccccugaaauuauuagucaaggauauaauuuugagaaaagcuugcuuuugaccucaagccuuguuacacgucucaggguuucuacagaagagagucugcaucagugggaaacaaguaauauacaaaccaaugauauuucagaccaaaguaaauguccaacucucugcacacagaaaaaaucuuggaaauguaaugaauguggaaaaaccuuuacucagagcucaucccuuacccaacaucagagaacucauacuggagagagacccuacacaugugaggaaugugggaaagccuuuagucguaguucauuccuuguucaacaucaaagaauucacacuggagugaaaccauauggaugugagcagugugggaaaacauuucgaugucgaucauuucuuacucagcaucaaagaauucacacuggagagaaaccuuauaaaugcaaugaaugugggaauuccuuccgcaaucacucacaucucacugaacaccagagaauucacacuggagagaaaccuuauaaaugcaauaggugugggaaggcauucaaucagaauacacaccuuauucaucaucagagaauucacacuggugagaagccuuacauaugcagugaauguggcucuucuuuucgaaaacacucaaaucuuacgcaacaucagagaauucacacuggggaaaaaccccauaaaugugacgaaugugggaaaacuuuccaaacaaaggcaaaccucucucagcaucagagaauucauaguggagagaaacccuauaaauguaaagaauguggcaaagccuuuugucagagcccaucucuuauuaaacaccagcgaauucauacuggagaaaaaccauauaaguguaaagaauguggcaaagcguuuacucagagcaccccacucacuaaacaucagagaauacauacaggggagagacccuacaaaugcagugaaugugguaaagccuucauucagagcauuugccuuauucggcaccagagaagucacacuggagaaaaacccuauaaaugcaaugaauguggaaagggcuuuaaucagaacaccugccucacucagcauaugagaauucauacuggagagaagcccuauaaauguaaagaaugugggaaagccuuugcucauagcucaucucuuacugaacaucauagaacucacacuggugagaagcucuauaaauguagugagugugagaaaaccuuccgcaaguaugcacaccuuagugaacauuacagaauucacacuggugagaagccuuaugaguguauugaguguggaaaguucuucagacauaguucaguccuuuucagacaucagaaacuucacaguggugacuaaugcugccauuuagguuaugacaguuucucuagcgaggaugacuacgaaucugacugggaguagaggggcagguagaguuccuggagggaaggaugaaggagccuuggcuacuguacucugagaggaauguuuccagaaauggaggugggagcuuagggaaugcagagccuacuugaggugggcaucugggaauacaggguagaaagaaauuccugcuuuucagauaaagccuacacauugccacugucuccccaugugacucuuacagcuugaggaggcauuuguuagcacuucuguucacuuuacuacauccugccccacauucugacuugucacccauuuucguuggcuggcagguugagauguuuuucuuaaacacugccugucagugugaaguggcacagcucugauguagugcuaagucuagccuccagauuugaggcagcccugaccaugcuaccaugggggaggcucccaaccuguggaagugguccugugaaaaggagacagaaacaaguaagagccaaaaaaaaaaaaaaaaaaaauccauauccauucauuaaaaaaaugagauauaaagcaacaacugggcugaccucuauagaucugccaguaaagaaggcuuucuuucauuaucagggugaaggucuuuccugauucuuccaagcuuugaggugacucagagcuaagaaugaaauaggagaccaaguuagaauucaugauacugguuuauggggaggcagucauaccuguucagagaaccaggaagacucaauaucuaucucagaggaaauaugguuacccaggaaagaaauggucugcuagagugauaagacucagaacaggaagccugcaugugacugagcaagucaccuacauaacccugccuguacuaagguguacaccugucuauuguaaguuugccuaggcuguugguguacagagaccagaggagagagacacacuaggacuaacaauguccuaacaaaaugguacuuaguuuguuggucuuuaggagaaagcauuaguaaugaaagaagaaagaauuuucacuugguuggacauuggggcucuuaagaaaguugacauuugucguggaaugacuuuggaaagacuucuaaaagaaucuuuuucaaaucccugaaaaucaggauagcacauuuugcuacugacugugacaguguuuuauucuuuugagagaaaugacauaguuuucccuuuauuucccaaauuccuuucauguucuuaacugcuacccagaaauugagcuucagaagauugaggauagccuuugauugguauuuaaaauaauuucuaagcugugaagcuuauagcauuuuuaaaguauggcuauuaaaaacacuaaguugauucuggaa

SEQ ID NO: 1131 - RNA, 119 nt, Homo Sapiens
aucuauggcuguaccgcucugaacgugcacuaucucuucugaucucaaaagcuaagcagggucaggccugguuaguacuggaaugggagaccacaugggaaaacugggugcuguaggcu

SEQ ID NO: 1132 - RNA, 1554 nt, Homo Sapiens
uagcccacaccuugacaguacauucagucacuggaugauuuuguauugaagucuguaaguucaagaacuaaaacaauccaaaacggcuacuacaggugaaguugagagcaauggcccaaccucagcuguaucuaccagaacccuuuaagauugccuacagaaaaguuggacagugccgaagauuccagcaacucaagaagaaaaauggcucauucaaaaggaaggggauagaaagauggcauagagcugugucuaccaacuuacuaaaacaaaauguauuggucccuaaagaggaaucauccagugauagugacaugggauuucaugaaagccagcaaaaucagaaaaguaauuugaagacgaaagugaagacugcuuuugggaggaugcuguccuacaaguauagaagcaagccagcaugugccagccaagagggcuccacugaccauaaagaagcccuccugucaaacacgcagagccuucucccuaggauugucaaggaguuuucaucucccaaguuauuuacagcaaaaaugagaaagcucucagagaaugcgacuauacaacuugauguuguagaggcagagacagaggagauaacccagggaaacacacuccuucgggccaggagaaccaccaagcgguuaucugugacaucucuuccuucaggacugcaaaaggggccauauucaccaaaaaagagaccacacuuuccagcacuuaaaaaaaagaagcguggcauggaaaacauccuucgaaaaucagauuugacaguaggaaagcuucaaaugcagguggaugaccucauagaaacagugacugauaaauccaugaagcuacuggcccaaagacaugcugagcuucaacagugugaguuucugggggaugaaauucuucagucuucuaaacaguuccagaggauauccaagagaaccaugaggaaguauaaauuaaaaaauguguguuucccauguaccugcugcugcuucugacuuuguuccugauucuuuaaaaguuaucuucccuaggcuggccgugguggcucacgccuguaaucucagcacuuugggaggccgagcgaguggaucacuugaugucuggaguucaaaaccagccuggccaacauggugaaacccugucucuacuaaaaauacaaaaauuauccaggagugguggcgggcgccucuaaucccagcuacucgggaggcugaggcaggagaaaugaccacaaaaggaccuggagacagcugaccugagacuccuugaggaacacaggaaaaggucuucagacaauaacuuaaccaauuaccaaucagaaaaucgacuccaccuaugagcuggaaguccuucccaccccccaccuucaagcuguccugcuuuucuguacugaaccaauauacaucuuacguguauucauugaugucugccuguaacuucugucccccuaaaaugcauaaaaucagcuguaauucaaccaccuucggcacaucucaggaccuccugaugcuguggcaugucuuuaaccuuggcaaaauaaacuccuaaauugauuaa

SEQ ID NO: 1133 - RNA, 1221 nt, Homo Sapiens
aacaaaagcaccauuugauuggcuaaaaggcacugagaaaguucucacucuggucaugaacuccacccagaacuggccgcucaguuuucagguuuuaaacugccguugacuugaagguugaguuucacuggggaccuaccucuaucugccuaguaaucugugucuccuguagcuaucaucaucacugauuuucuacguacagauuucaauuccaaacaaaaauauaugagaacguucauuucuccauacaacugcucgacguccagccacuucugugccugccugccugucuugggguuuuuacaggcacaggauaggggacguggcaggccagguggucuuggaaaaugcaaacuugggcaugaaaacaggagcgcuuguccuccccuauaugcgugugcacaggaccugaggugaagcccuagccagggaccugcccuucucuacccagcgcuuuccuucucucaucccgagucaguacugaaaugcucacuaguucuuacguuucacuuaaaaaugauacgugccauauuaagucacauuucacuggcuccaggaagucacucugcugccccugacuucaagauaguugagaagugagauccaauccuguguccagaagugaacauuugaaaacaguguugcugccgauuucagcaucauggauggagauggagcccauuauuugaagcaaacuaacacaggaacagcaaagcaaauaccauauauucucacuuauaaauggcagcugaacaacgaggacacauggacacaaacagcagaacaacagacaccaggagcuacuugaagggaccggcgugagaguauggaggcugaagccauagaaaggagaaauuauuccagcugaggccaaaacaugaaccaaggcucuuugacccaucaagccauaaauuuaggcugggucauuggccuuaucccgcaccgaaguugaaacuuacaccaucuguucacaucaucaguucuucugguucucaugcuuuugaacuucaacuggcacaauuccacuggcucuccuuagucuccagguugcagauggcagauuauaaaucuccuuagccuccaccuuuauaauccuaacuauuacugacaccucuuugaggacaaaggaaguagcuuucugcaagccaaaaagaccucagaaaaacaacaaaucuuccaaacucuugauuuugacuuuuugccuccagaauugugaagaaa

SEQ ID NO: 1134 - RNA, 5105 nt, Homo Sapiens
ggguagagggcagcaaccgacuugugcgaaaggagggaacgugugggucugccaggguccugcaggggggaugagacccucgcuccgcuccggcgaucccuucgcucuccacccucggccagccccuccuguccuccaucaggccucgcugaggauaccuccuggguuccaaagcgcgaguugaaccugagcuugacauucauuccgucucguacaaaagccaugccugcggggagagggagaaaauuuccuacaggagccucaagacugcguuucaggaagcccuaggacccacugauccugcagcugcgccucucacucgccucaggcuuugguaucaggaugaugcuggccucauaaaaugagauagagaggauucccuguuuuucuguugauuggaauaguuucagaaggaaagguaucagcuguuccuuguaucucugguauaauucggcugugaauccaucugguccuggacucuuuuugguugguaagcuauugauuauugccacaauuucagcuccuguuauuggucuauucagagauucaacuucuuccugguuuagucuugggaaguguaugugucgaggaauuuauccauuucuucuagauuuucuaguuuauuugcauagagguguuuauaguauucucugaugguaguuuguauuucugugggaucgguggugauauccccuuuaucauuuuuuauugcaucuauuugauucuucucuuuuuucuucuuuauuagucuugcuagcagucuaucaauuuuguugaucuuuucaagaaaaccagcucuuggauucauugauuuuuugaagguucuuugugucucuaucuccuucaguuuugcucugaucuuuguuauuucuugccuucugcuagcuuuugaauguguuugcucuugcuugucuaguucuuuuaauugugauguuagggugucaauuuuagaucuuucccgcuaccucuugugggcauuuagugcuguaaauuucccucuacacacugcuuugaaugugucccagagauucugguauguugugucuuugcucucauugguuucaaagaacaucuuuauuucugccuucauuuuguuauuacccaguagucauucaggagcagguuguucaguuuccauguaguugagcgguuuugagugaguuucuuaauccugaguucuaguuugauugcacuguggucugagagacaguuuguuauaauuucucuucuuuuacauuugcugaggagugcuuuacuuccaacuauguggucaauuuuggaauagguguaguguggugcugaaaagaauguguauucugcugauuucggguggagaguucuguagauaucuauuaggucugcuuggugcagagcugaguucaauuccuggauauccuuguuaacuuucugucucauugaucugucuaauguugacagugggguguuaaaaucucccguuauuauugugugggagucuaagucucuuuguaggucucucaggacuugcuuuaugaaucugggugcuccuguauugugugcauauguauuuaggauaguuagcucuucuuguugaauugaucccuuuaccauuauguaauggccuucuucgucucuuuugauuuuguugguuuaaagucuguuuuaucagagacuaagauugcagccccugccuuuuuuuguuuuccauuugcuugguagaucuuccuccaucccuuuauuuugagccuaugugugucuuugcacgugagauggguuuccugaauacagcacaccgaugggucuugacucuuuauccaauuugccagucugugucuuuuaauuggagcauuuagcccauuuacauugaaggugaauauuguuaugugugaauuugauccugucauuaugauguuagcugguuauuuugcucauuaguugaugcaguuucuuccuagccucgauggucuuuacaauuuggcauguuuuugcaguggcugguacugguuguucuuuuccauguuuagugcuuccuucaggagcucuuguagggcaggccugguggugacaaaaucucucagcauuugcuugucuguaaaggauuuuauuucuccuucacuuaugaagcuuaguuuggcuggauaugaaauucuggguuaaaaauucuuuucuuuacgaauguugaauauugguccccacucucuucugacuuguagaguuucugccgagagaucagcuguuagucugaugggcuucccuuuguggguaacccgaccuuucucucuggcugcccuuaacauuuuuuccuucauuucaacuuuggugaaucugacaauuaugugucuuggaguugcuguucucagggaguaucuuuguggcguucucuguauuuccugaauuugaauguuggccugccuugccagauuggggaaguucuccuggauaauauccuuuagaguguuuuccaacuugauuccauucucuucgucacuuucagguacaccaauuagauguagauuuggucuuuucacguagucccauauuucuuggaggcuuuguucauuucuuuuuauucuuuuuucuuuaaacuucucuucucacuucauuucauucauuugaucuuccaucacugauacccuuucuuccaguugaucgaaucagcuacugaggcuugugcauucgccacguaguucucgugccuuaguuuucagcuccaucagguccuuuaaggacuucuccacauugguuauucuaguuagccauucgucuacuuuuuuucaagguuuuuaacuucuuuuccauggguuugaacuuccuccuuuagcucagauuaguuugaucaucugaagccuucuucucucaacucgucaaagucauucuccauccagcuuuguuccauugcuggugaggagcuguguuccuuuggaggaggagaggcacucugauuuuuaaaguuuccaguuuuucugcucuguuuuuuccccaucuuugugguuuaaucuaccuuuggucuuugaugauggugacgugcagaugggguuuuggugugaauguccuuucuguuuguuaguuuuucuucuaacagucaggacccucagcugcaggucuguuggaguuugcuggagguccacuccagacccuguuugccuggguaucagcagcggaggcugcagaacaguggauauuggugaacagcaauuguugcugccugauuuuuccucuggaaauuuugucucagaggaguaccccgccgugugaggugucagucugccccuacuggggggugccucccaguuaagcuacuugggggucagggacccccuugaggaggcagucugucuguucucagaucuccagcugggugcugggagaaccacuacucucuucaaagcugucagacagggauauucaagucuucagagguuucugcugccuuuuguuugccuaugcccugcucccagagguggagucuacagaggcaggcaguccuccuugagcugcagucagcuccacccaguucgagcuucucggccgcuuuguuuaccuacucaagccucggcaauagcgggcgccccucccccagccuugcugccaccuugcaguuugaucucagucugcugugcuagcaaugagcaaggcuccgugggcuaggacccucugagccaggcaccggauauaaucuccuggugugccauuugcuaagaccauugcaaaagcacaguauuagggugggagugacccgauuuuucaagugccgucugucaccccuuucuuugacuaggaaagggaauucccugacccccugcaauucccaggugaggugaugccucacccugcuuuggcucacacucggugcacugcacccacuguccugcacccacugucugacacuccccagugagaugaaccugguaccucagucggaaaugcagaaaucacccaucuucuccgucgcucacgcugggagcuguagacuggagcugcuccuauucgaccaucuuggcuccacccucacugccaccuaacuuuucaacuggaaaugauuacucuguaaagcaaugacauaauaaaauacaaauauuaagaaaauagucugacagaauucuaucugccuuuuaagggauaaauuuguacaauugaaauuauaugcuaauggauugauaucaguauuuggcaguucucuuaaaugugaaaagcuauuucaaagacaaaaucuguaaaaucucguuucagaucagcauuaacagaugagcaauuauuuaugaugagcacaacuuugaacacugauuacauaaaauguuaauaaaauaauuaucaaauuguguccugagcuggaacgauggaaucuagcagaaguugccuuuccagauucaaacggcuucuaugguggauucacacaaaagaaauuaguagaagaaagaauuuugcuaaauuucuuuucagaaagacuuuacucauuuaucagcaauaaauaguaucuguuaugaguuaaauugugucuccaaaaagauaugcugggguaauagccacugggaacuuugaauguaaucuuauuuggaaauagggucuuugcuaauauuaucaaauuaagaugaagucauaucaaauuaaguaugacuguccuuauaagaggagaagagacacagacacagaggaaagacugccauaugaagauggggcaaggauuggaguuacauugcuacaagccaaggaaugccuggcacuaccagaagcuggaggagacaagggaggauuaauguccuuuaggagcuucaaaggaaauaugucccucucaacaacuugacuucuaauguugugaugguuaauacugagugucaacuugauuggguugaaggauacaaaguauugauccugggugugucugugccaaaggagauuaacauuugagucagugggauggaaaggcagacgcacccuuaaucugggugggcaaaaucuaagcugcuagcaugacuagaauauaagcaggcagaaaaaugugaaaaagagagacuggccuagacucccagccuacgucuuuauccugugcuagaugcauccuguccuugaacaucagacucuuaaguccuucaauuuuggaacucacacuggcucuccuugcuccucag

SEQ ID NO: 1135 - RNA, 947 nt, Homo Sapiens
auggaagaggaaaaugcaacauugcugacagaguuuguucucacaggauuuuuauaucaaccacaguggaaaauaccccuguucuuggcauucuugguaauauaucucaucaccaucauggggaaucuuggucugauugcugucaucuggaaagacccucaccuucauaucccaauguacuuacuccuugggaauuuagcuuuuguggaugcuuggauaucauccacagugaccccaaagaugcugaauaacuucuuagcuaagaguaagaugauaucucucucugaaugcaagauacaauuuuuuuccauugcaauuggcguaaccacagaauguuuucucuuggcaacaauggcauaugaucgcuauguagccauaugcaaaccuuuacuuuauccagccauuaugaccaauggacugugcauccggcuauuaaucuugucauauauagcugguauucuucaugcuuuaauccaugaaggauuuuuauucagacuaaccuucuguaacuccaacauaguacaucacauuuacugugacacuaucccauugucuaagauuucuuguacugauucuucuauuaauuuucuaaugguuuuuauuuucucagguucaauucagguauucagcauugugacuauucuuauaucuuacacauuuguucucuucacagucuuagaaaagaaaucugauaaggguguaaggaaagccuuuuccaccuguggagcccaucucuucucugucuguuuauacuauggcccccuucucuuaauguaugugggcccugcaucuccgcaagcagauggucaaaauaugguggagccucuauucuacacugucaucauuccuuuguuaaauccuaucaucuacagucugagaaauaagcaagucauaguuucauucauaaaaauguuaaaaagaaauguuaagguuucauacuaaguaua

SEQ ID NO: 1136 - RNA, 2528 nt, Homo Sapiens
aagacaacuccuucaccacauuuccuguuuguaacugaaacaaaguacacacaaaagauuuuaagaaacagaagagaaaagaauccgaggcacagauaaagauaaguuuuacugucaugcugcuuuuaacauaacagagcaacaucaccuaggaaaaaaguuuguaggaggauuuuuaauccauauauuugucuuauggcuagauaaagauuucucugaaaaaaagaagcaugucaggaaucucugggugccccuuuuuccucuggggacuucuagcauuguugggcuuggcuuugguuauaucacugaucuucaauauuucccacuauguggaaaagcaacgacaagauaaaauguacagcuacuccagugaccacaccagguauguugugauucagucauggaucaugauucccaacuaauaagcaaaaguaacaaugcuauauuguuuaaagauuuggcucauggauauuguacuuagguuaaaaugaaaugaaaagugaguuuuaauuacuuuuacucucaucuaaagaucagaagcuauaacauuauuaucuguccuaguuauuugcacacugugagucaacaagaaagcugguugaaggauaaaaugagauucuaaccugauaacuauagaauuaucauuaauuucagagguagauagccuagauuaugauccagcuuagauacagaauugugcuacacuucaaaauccauaguagaaaacaaucuggcaaccugguugaugaguauuauauugaagacacaccaauuuaugguaacuuagaugauaugauuucagguaaguuuuccauaaguuaaauuuauaaauaaguaaaucccaguugguuucacaaaauaauuuaaguggcgcuuuaaaaaaaucaaaucacacuuagcuaucccagugauaaccaucaauucaagaacuuuuaguauauuaauuaggcuacauuuccaaagcugcauauuguaaguuguauuacaauagccacucuaaaucaacauccuguuuuucuauauucucuucauuucacucuaguaguaaugagaaaccaauggaugaaaauugcuaugaacaaaugaaagcccgaccagagaaaucuguaaauaagaugcaggaagccaccccaucugcacaggcaaccaaugaaacacagaugugcuacgccucacuugaucacagcguuaaggggaagcguagaaagcccaggaaacagaauacucauuucucagacaaggauggagaugagcaacuacaugcaauagaugccagcguuucuaagaccaccuuaguagacaguuucuccccagaaagccaggcaguagaggaaaacauucaugaugaucccaucagacuguuuggauugauccgugcuaagagagaaccuauaaacuagcuggaccaugaucuaguucaaugauuuggcuccuauugaagauggcuucuaagaaaacaagaugcacagaggacacagaaggacuuggcagcagggugaugaccugaucauuuguugaugggaugguggcuuaccucuuauucacagcuuacacuuaugcaugccaaauguaaggccaugaaaaucaguauuucaaauaacuuaaaaaaugcuuuacuacuaaaauguaaaaaauuaaugugcucaccucggcagcacauauacuaaaaauuaauaagacccagcuugaaaauugagccugauaacaagauuacaaauucacaauaccuaauacuuagggaaauauaaaaauuuaagcaugaauguguucuggaacacguuagaagaaaaauaaaagccaaugaguuuuuuuuuaauucuccuuucucaccaaugggcaauagcccauaauugaaauaaauuucugauugaaagguauaggaaacauuaaaaugcauuacuaagagaaguaauauaauuuucuuacaaaguauuuuucccaaagauagcuuuacuauuucaaaaauugucaaauuaaugcaugcuccuuacaacaaacaaauaucaaaaagaguuuaggaauucuacuagccagagauagucacuuggagaaacuuucuauauauccuucuaaauauuuuucugggcaugcuuauguauguacaucaguuguuucuuuuuauuuugaaccaaaaaugugguuucuuuuguacacauuacuuaaacuuucuuuccagucaacaauauauuguggauuuauuuucacuguuauauuuaacuauauauaaauacgcauauauuguaauuuuaaugucugcuuagcaccccacugauaaccaaaucacaguuuauuuaaauaauuuuaaugacuuuucaaaaacaauuuauugaugcaaaaagcaagguugagaugacaauguuucuuucaauaauuaaaaaauacugcuucacugucuucucucuguuucaucagaaacacauacuauaauacuugucucuguccuuaagugugauacacgcuauuuuucugauuguuaagacuuuccuuauuacugguucuaauuugauuauaauaugccaagguauggu

SEQ ID NO: 1137 - RNA, 70 nt, Homo Sapiens
uuccugcagauuguuucuuuugccgugcaaguuuaaguuuuugcacggcaaaagaaacaauccagagggu

SEQ ID NO: 1138 - RNA, 385 nt, Homo Sapiens
aacccugccugagcagcuccugcauugcuacaaggaugaagcagaaacaucuggucgguuuuagauuccccuuggauuuccaacuucaaagggaauuauaaagaauaacaaauucauguaccggcacuaaaaaaaaauuagagcagcaggagagaaugguaaaauuguccuuauuugacugcuagugacaggcgccacaggcagaacuaugagaaaagacaaaggcaagaucaccaguugacaaccagaguuccugcaagagacugaaucuuuggcuacaugcaaauaugcacagggcccuuaacaauccauagggagauuuacuugcuuaaggaaaauaaauagguaaauaaauaaaaggaguugaaagguaaaaaaaaaaaaa

SEQ ID NO: 1139 - RNA, 78 nt, Homo Sapiens
ggaauuuuguuaaaaugcagaauccauuucuguagcucugagacuagaccugagguugugcauuucuaacaaagugcc

SEQ ID NO: 1140 - RNA, 5104 nt, Homo Sapiens
acuuuuuguaaacgccccgcacagccuggaccggccugcccccgcccagcgagccucaggggcccagccgacagccaggcucacgcgcccuugaaaucugccgguacucgcucugcgggcugggcugggagaugacgaggaccccgguggggucugcccgcacccggccaaagcccaggaagcucgggccccagcgaggaaaggcgcuccaagccuccucgcggcuuucagagaaacgggugugacuguacgaagaagccucggccuggccugucccucgcgcucucagagugacugggcuggaauggggcaggggagaggaucucuggaaauagucgucaggggcgccgccugaaucaccucugccucucccugcguuaccaguggaucuaggaaccaggaauccguguacuaauccuacgggguuggagugaagguuggaugugugcuuuaacagcaccaaguagaugccccucagcuauugcacuaacacaggcggggcuguugcccgggacuuugcgggacuguguaugugugugcacaggggucacauauggaagucauggagaggagcuguccuugagaugggugagauaccaggugcaugugugcugcucagaaacacagaggaacagaauccccagcccuggugaagaagaggaugccugaugcgugcacccugggaagggcuggaaucggucuccccaagaugugccuucacauggcuguccggcauucgaaggcucagaaaacaggcaagaaaaugcgggcgggaaagcuggcagaaugauuacuuucagguccccuccaggcuucugcggaaaagccaggggcuucgggcuggagauagaggaaucuagggagagaacagaauccucuccuugccggcccagccagaggugggugaaccgggcgcuccaggaaacggugcggggcgcccugauuuacuucucaaccuucggagguaggcugguugcuggcgaggucgggauccucucugaacagggcauacugugccuagguuuuguggacgccagggccgguuccuuuucuccccgcggcauuggggcgacgcagggcccccggcuuagugaccuuggggcggcgcucaccuccaaaggccaggguggugggcugggcagaacucacugccucuuugccccaguuuuccagggucccgcagcugcaauucagcagccaccggcgccuccugaccguggucccaccguagcgccgccugcggauacgguuccagugaaccgccgauugagcgcagucucagcucccgcgccuccucgcagccuggccccgcgccucggaggucccgacagccggcgcgagcaaucuacacggcucugauacagacgcuuuucuccccagggccgggaauccugcaacagcggcagaagccgcccgcgccucgggcuuccggcggcccagcucuacuagggaagcgucgcggcugcucugaggcaggcagcgcuucgcuagaaccacucagcucgucccgcgccgccgccggcugccugaaccagguuccgcuguccccuuuccuagcgggaccccgaaacacccggcggcuucccgcuccugagcgggagagaauagagcuugcugcaacccucugcuuggagggauggccucugcggugcuuggcuagcaaagggaagcuucacugugucuauuaguacauccccauacacuccacgccucaacaacugucagcacucacucccucccggccccucacagggcccuuugcacccacaccucagggacucggugucccuccacucaggucacguuacuccauccacuucucucuccuucucccucugucaacuccaaauccccucuaguucucccuccccuccuacuucucucacacucaccagcuacacguacuaauucagauuuugcacauguugguggaaaacaugucaagccaaugugcagacccuaaggcuuuucacacgcugcucacuuucgcaucucacggugcagaaggaccaaugggcuccagguuuacaagccugacuccgagaagccuguugauucucugauguccuuggccugugauucgggugacugggcugccaccuggguguuuucaugaugggacugccgcacagaccacagagaagcucagguacugagcacguuccagauacacuuuaacaugcacaggccacucacacaggcuuuaucucugucucgaaacucugcugaguuugcugcucagaccaacaaggugcagcagcagacacccacauagcaccaggucugaagccaguggguauuagucugccugguugggauuagcaaagucaguuacucacauaugugcuugggagagaauaggggaguggagagagagagagagauauugaggaagaggaaagagaagcgaccuccuacucugggaagaacucacacaugagagcuguuuccuguuguuaagugucucacugagcuccccucuuucucccccaggaagggcuugagaggcaguagaccagagcucugggcuccucuuuaccuugcugauguugggguaugaguccuccaacaccauuuugucccaaggaguaugugccccaucgucaaucaggcagaaugcagggcaguugucggccuuuuucaugguggaggccaacugggaaaaaggcagaagggucuggguccugggccaagugaggcccucuucccuccaaagacccgugggaugcucucagaggcggauucuaggguggugggagcugcugacaaguuuccucugauaucccucaugacaucuauggcccaaagccauuuuguucagcucugaacagugagugccuugccaguaggccucaggcuugcuggggaacaugauguguucuuaaaaguugccuuguugccuuucuccacacccagacuguaagcgcugaugggcagagacucugcccuccacuucucacucagugcuccccaccaggaugggcuuaaugccuuuuaauagaauuagaaaaugguucugcuggacagaauugggaaaugccacuuuccuuauaaugaaguuauaaugaaguuagaauuuccaagaaagggacuguagcugaggaaaagcgguuugaucauugacagccagcucaggaucugagaguucuuugccauuugggguuauuauagcugcauggccauggugcugaaccuuaggcaagggcaaggacaccucccuaguucccagucauggugaggaccugucugaaacauucaaacuagacuuuacuggaaacagagaagucucugcauucagggcagcuggcuugcaagguaaggccugcagucuccacccgcacgcuaacccaugaggggaugccagagagagcccuucccccuugguccucauuccuggcucaauuuucucccacaaagcgggcacuuucuaaagaugauaggcaacugccauggaggaaggcaguuuuagaugccuagcuggcacaaaguccagaggaagggagggagaagggcugaguuuuguauuacuguucuaccuuuggagauuuuccucaugccaagauaggguguguguguguguguguguguauguguguguguaugugugcacuauaacuuuaugaaacacuuuuuuuuuuuuugagacagggucucacucuguugcccaagcuggagugcaguggugcaaucuuggcuuaccgcagucuccaccucccaggcucaagugauccucccaucucagccucagccucccaaguagcugggacuaugggugugagccaacacacucagcuaauuuuuuuuuuuuuuuuuugguauuuuugguagagacaggguuuuaccaugugggcccaacuggucuugagcuccugagcucagggugauuugccugcuucaacuucccaaaguguugggauuacaggugugagccaccaugcccagucaguuuuuuauuuuuuauuuaaacaguuuugggggaacaggugguuuuugcuuacauggauaaguucuuuaaugguaauuucugagauuuuggugcacuugucacccgagcauuguacacgguacccaguguguaaucuuuuaucccucaucccccuccuacgcuuccccccccgaguccccauuauauaauucuuuuuuucuucuuuuugagacagagucucacucuguugcccaggcuggagugcaguggcaugaacuuggcuuacugcagccuccugaguucaagugauucuccugccugaaccuccuguguagcugggacuacaggcaugcaccaccaugcccagcuaauuuuuguauuuuuuguagagaugggguuucaccauguuggccaggcuagucuugaacuccuaaccucaagugaucugccuauuuuggccucccaaaguguugggauuacaggcgugcgccacugcgccugguccauuaugucauucuuaugccuuugcaucuucauagcuuagcucccacuuauaaaugaaaacacaggauauuugguuuuccauacuugaguuacuucacuuaguauaauggucuccagcuccauccagguugcugugaaugccauuauuuuguuccuuuuuauggcugaguaguauuccaugguguauauauaucacauuuucuuuauccacucauugguugaugggcauuuagccuuguuccauauuuuuguaugcaguauaacuuacagaugguaaacaauauacagcuugauguauucugacauguaaugcaguauguaaccaccaccuggaucaagauauggagcauuucuggcacuucagaagguuccuucauaucuuuuuccaaucaauauugccucaaaagggaaaccauauuuggauuucuaucaccauaaauaaccuuugccugccuugagccucguauaaauggagcauauagcauguaugccuuuaugucuaguuuuuucugugcaacauauuuuuaauauucacuggucuuguugcaugugucagacauuuauuucuuuuuauugcuguguaauauucuaguauuugcuuauccauccauauguugagggacauuuguuuccaguuuuuggauaucauaaauaaagcugcugugcacauuguug

SEQ ID NO: 1141 - RNA, 3557 nt, Homo Sapiens
agcaggggcgccggugagccgcagccgcagcggcagccuagccccgagggagggaggaggagccgagggagacgcgggacccggagccccgcgggccaccgccccugccggccgcgcagcugggaggaugcggacggcagcgagagcgugcgcggccacgugacggccgcuauaagagcgcacggggcagacgcucgguuccccgccgugccuccucgcuggccgcgcucccucccggugccggcuucucugagucaccaaccugaggcugccccggccgccugcgcacccggcagcaccaugacaggccacaaagauugcagguguaacccagaguucagccgucuuuaggaagauuaaacuccuacccagcugucauuggucuuucuuggucauuuguaauguuggcuagucugguguucuaaccuguguucuaucccuuauuuaaucuuggaaaucauccauauccuugcuuccagaaauccuugaauccugcucaccuuauuacauuuuucuccaugaucgccuggaaccuggacuucauuugaguuagaugaucauucauuuugccuagcuuaaguauuuuugguacagauugacagcgauguuacccauguuauaaugggcugaagauaauagaagcaaguacaggcggauguugaugggccugucaagggacaggugccacuguucagagcuuuccuagaguaucaggccuuugugacacuaaccacaaacgaugccuacgccaaaggugcccugguccugggaucaucucugaaacagcacaggaccaccaggaggcuggucgugcucgccaccccucaggucucagacuccaugagaaaaguuuuagagacagucuuugaugaagucaucaugguagaugucuuggacaguggcgauucugcucaucuaaccuuaaugaagaggccagaguugggugucacgcugacaaagcuccacugcuggucgcuuacacaguauucaaaauguguauucauggaugcagauacucugguccuagcaaauauugaugaucuuuuugacagagaagaauugucagcagcaccagacccaggguggccugacugcuucaauuccggagucuucguuuaucagccuucaguugaaacauacaaucagcuguugcaucuugcuucugagcaagguaguuuugaugauugagucccauaagcagaguacaguaauguuuuaaaauaauguuuaacagaaaugauuuggugcuacauuguauuaaaguguaaaauugaccccagagcuagauuuuaaaaucuuuguaguuaauuaggcuucauguuggaccugcccaaaaaaagaaugaaggacugagauauuucaagaugguacuuguccaaaccaaaugagcugagagauuuuggugugcuucacuugguucccugacuugauagccaccugucuccagcuuuguaacugucagagaucaugaacccugugagaaauagaggaggaggaagggacuaauguguuauauguaugcaggcuuguaugcuggucauuuuaccuacuuuuucacuuauuucucaacaguccugugaggaaacaaauaggcccaguuucugauaaaugcauccaugguuaccagguaugugacccugcucagaagaccuagaaaguaccaagucuguaguugcaagauaugaaguccaggagccccaagggcugagcagacacuuugcuguaucauuguagcugacgcuggccacaguggugacugagcaggaucugcccagagacuuuuggggaaagucugaaaucuuuaacuggggcgugauggcucacguugguaguccuugcacuuugggaggccaaggcagguguaucacuugagaucagggguucgaguccagccuggccaacacggugaaaccccaucucuacuaaaaauaacaaaaaauugccugacgugguggcaugcaccuguagucccagcuacucgggaggcuuagacaggagaauugcuugaacccaggaggcagagguugcagugagcugagaucgugccacugcacuccagcuugggugacagagcgagacuccgucucaaaaaaaaaaaaaaaauggaauuagugucuauuuuuaaagguccaguuaugugcuccuauaaaauuauuaaacugucuagagaucuguuaacuaauuuauauauuuuuuucuuuuagguggggaccaaggcauacugaacacauuuuuuagcagcugggcaacaacagauaucagaaaacaccugccguuuauuuauaaccuaagcagcaucucuauauacuccuaccucccggcauuuaaagucaaguaauucuccugcaucagccucccaaguagcugggacuacagguuuggugcaagugccaaaguugugcauuuccugggacgagucaaaccauggaauuauacuuaugaucccaaaacaaaaagugucaaaagugaggcccaugaucccaacaugacucauccagaguuucucauccugugguggaacaucuuuaccaccaacguuuuaccucugcuucaacaauuuggccuugucaaagacaccugcucauauguaaaugugcuuucagacuuggucuauacacuggcuuucucuuguggcuucuguagaaaggaagaugucucaggagccauaucacaucugucccuuggggagaucccagcuauggcacagccguuuguauccucggaagaacggaaggaacgaugggaacagggccaggcugauuauaugggagcagauuccuuugacaacaucaagaggaaacuugacacuuaccuccaguagaaacacugcauuuuucugugaacacauccacuucacaagccuuguuucugauacuuaguaucuagagcuggguugagaaaagucuguuacaguugcuagagguuuucauuaaaacuuaucagaugagaggcuuuuuuaggauaagaggugagaacugggcaaaaguugugaagcagcaauucuguuauauggacaguguucugcuuuuuaauccuauuuagcuuguuucagaaauucucacuuuuguugacugccaacauacaaaguaagggaaacucaagauauuaagauggcuguaucaguucuuaaaaucugcagagccugguucaaaaucagucacucccuucagaagcagacauggcaucuguuccuugcuugcuuguugguuguguaccuuucacgagaccugaauuuuagaauugcccagugcugccagagugagugaguguaauucuccuuucagguaaagauaggcuaucucaacacugcugagugauucauaaacauaucaaccaauagcauuaacccauuuuauuuccuguccuuagugucugaagaugcucaccaguuuucuguguacaguaaggcagcaugcuaaaaugcuuuuguucaguucuguauauuugaaaauagcaguguguucucugaugguuaccugcaguggcacccuguacaaaaaauaaaagacuuauugcuguaucuugguuguuuaauuaaauuaaggaauuucaccaua

SEQ ID NO: 1142 - RNA, 3110 nt, Homo Sapiens
ucggcggagaccugcuccccagaagacgccuccugcuucccacugcgcccuggaggacgcgggcuggcugcugggcgagcucggcggaggcacgccccucgccuccccgcggagugcggacucgccccggugcccaaacuccgcccacccucuagggagcuccgcucucccgccuaaccccggcacuccggacagagcugggccuggggaagggguuccugaacuacgcggacgccgaacgggacgcgcugcagaagcgcacgagucugcggccacgcgcgcuccgauggcugccaggagcugagcucagggugggcggaggaagcgguuagacgccccgaaacugagcugcacguuucuaagguagggaggaggaagaugcccccaauuaaguugaucuuugagccaaggaggcuggggagcagccuccccaagcuagagcccugcagagcgaguuucccuugaccucgcugcgccucuggcgcgcucugcagcgcggacccgcggccccucgggaaagcgcagucggaaaguuauccgcggcgguucccugcgcgcccuguuguguaagcucggcguugccagcggacggagaaguugcuggcuugcccgauagcccaguucgguggcggcccggggcggauuucauggcccgcggcgaacgcggggccagagcuggcgugggcgagccccugcgcgcccccucccgcggggauccaguucgccugcucccuuccgcucgcuggcuuuuccgaugcuugcugcgccccuggccgccgcugcccucucgccgccuccuaccccucggagccgccgccuaagucgaggaggagagaaugaccgaggugcuguggccggcuguccccaacgggacggacgcugccuuccuggccgguccggguucguccugggggaacagcacggucgccuccacugccgccgucuccucgucguucaaaugcgccuugaccaagacgggcuuccaguuuuacuaccugccggcugucuacaucuugguauucaucaucggcuuccugggcaacagcguggccaucuggauguucgucuuccacaugaagcccuggagcggcaucuccguguacauguucaauuuggcucuggccgacuucuuguacgugcugacucugccagcccugaucuucuacuacuucaauaaaacagacuggaucuucggggaugccauguguaaacugcagagguucaucuuucaugugaaccucuauggcagcaucuuguuucugacaugcaucagugcccaccgguacagcggugugguguacccccucaagucccugggccggcucaaaaagaagaaugcgaucuguaucagcgugcugguguggcucauuguggugguggcgaucucccccauccucuucuacucagguaccgggguccgcaaaaacaaaaccaucaccuguuacgacaccaccucagacgaguaccugcgaaguuauuucaucuacagcaugugcacgaccguggccauguucuguguccccuuggugcugauucugggcuguuacggauuaauugugagagcuuugauuuacaaagaucuggacaacucuccucugaggagaaaaucgauuuaccugguaaucauuguacugacuguuuuugcugugucuuacaucccuuuccaugugaugaaaacgaugaacuugagggcccggcuugauuuucagaccccagcaaugugugcuuucaaugacaggguuuaugccacguaucaggugacaagaggucuagcaagucucaacaguuguguggaccccauucucuauuucuuggcgggagauacuuucagaaggagacucucccgagccacaaggaaagcuucuagaagaagugaggcaaauuugcaauccaagagugaagacaugacccucaauauuuuaccugaguucaagcagaauggagauacaagccugugaaggcacaagaaucuccaaacaccucucuguuguaauaugguaggaugcuuaacagaaucaaguacuuuuccccucuuuaacuuucuaguuuagaaaaaaaucaaaccaagaaaauagugaguuaaaaaaauaauagaaguagaaaugcccacauccacacuuagcuuguuuggguuugcuuucacagucucucuuccuucugacuagaaguauguauaauaaaacaauacuaccuaguuaaacauuuacuuucucuuuugccuuuaaaaugugcaggcuuuucuguuuaaagugugugugcacaugaguacuggggcuguuuuugauauuaguaauuucucuaagaaaacuagcccccugcaacuugaguuugugguuuaucuagccuuuauuguuuuuuuaaaauccacaguaggaauaaaaaaucuauauucucagaaauaucuagcaugguauauaacaaaacacuaaacucaucaguucauccggcaucagaucaauggaucucugagcgggguguuuuuuucagugucuuauaagcauagaugauaguugacugaguuucuuuagggcauugaauagacaaguaaagcuaaugaauuuaaaagccugaaaagugauuguuuuccaguuauuucuggaaaaggucucauuauauauugggugcuaaauguuugauggggaaagccugcauauauuaucguacugguaaaaugcauucaaaauaauuaaagugcauguauuuuccuuguaaacaccaugagcucucuuagacaucuugugauaaagagcauuuacuugccccacugcugugcaaugccuuaggacuuuguuuguguuccaggacaaguguucacucacaucuguaaaaacaauuuuaagaauugcaaauaaauuacagaccaaagauugaguaaagucaaauaacuguuaguaaguugaaggauauuggacaggaggacaguauuucagaaaaggagagguugacagucauccacaaggcauagccuccaaguauacucucaaauguaugaagcaacuggggugggcagaagacauuuuagaaugagggcuuuaguuuaaauuaaagucaugguggagaagacucuugcuuccuccaaguguuugaaaacacaaaaugcgauaugaaaa

SEQ ID NO: 1143 - RNA, 2435 nt, Homo Sapiens
gaggggccugugguggggauccuggggcugucgggcugaguaugccguguggguggagaggaagccucggggaaaucgcccaggaaggauaggcugagccggggcucccagcagagacgccuggguggggcaggaggccgcuccaggugugagccacagaggaggggagagggacccccacgggaguggaaguggcagagcagcugcagaagugcagggagcggaaagguaccagggcagcugcuuuccgcugccuccgguccgggcagcugcagaaacagcagggggaggagcaacagcugccaaauucgccaacuagaggagggagaggcggagcuugggucccuguagaagccagaggcgcagucuggacuguaguuucccgggagagacgaaagcaggaacgagagcggagcggagcacaguccgccgagcacaagcuccagcaucccgucagggguugcaggugugugggagguaagcguggguccuucuucggggcgucugcacugcccuggagaaaacgucuuccaauaggaauuacaucaagacacagcuaaaagaguccgcguuggguuaggaaaccggugcaaaaccucucgggugaaagauuuacauuuuucgacuuuaagggcaaaaaagcaaaaggaagcuugacucuggguauaaagggcgugguuaguguuuuugguuugaguugcaccaguaaaacuguucugggagaucugaagauugagaaaaauccugcuaauugaggacgagguggauguuaucugguggauguuauaggcuugaaacuguuacaauauggcuuuccuuggacucuucucuuugcugguucugcaaaguauggcuacaggggccacuuucccugaggaagccauugcugacuugucagugaauauguauaaucgucuuagagccacuggugaagaugaaaauauucucuucucuccauugaguauugcucuugcaaugggaaugauggaacuuggggcccaaggaucuacccagaaagaaauccgccacucaaugggauaugacagccuaaaaaauggugaagaauuuucuuucuugaaggaguuuucaaacaugguaacugcuaaagagagccaauaugugaugaaaauugccaauuccuuguuugugcaaaauggauuucaugucaaugaggaguuuuugcaaaugaugaaaaaauauuuuaaugcagcaguaaaucauguggacuucagucaaaauguagccguggccaacuacaucaauaaguggguggagaauaacacaaacaaucuggugaaagauuugguauccccaagggauuuugaugcugccacuuaucuggcccucauuaaugcugucuauuucaaggggaacuggaagucgcaguuuaggccugaaaauacuagaaccuuuucuuucacuaaagaugaugaaagugaaguccaaauuccaaugauguaucagcaaggagaauuuuauuaugguucggacuagcuugggggaauuuagugauggcuccaaugaagcuggugguaucuaccaaguccuagaaauaccauaugaaggagaugaaauaagcaugaugcuggugcuguccagacaggaaguuccucuugcuacucuggagccauuagucaaagcacagcugguugaagaaugggcaaacucugugaagaagcaaaaaguagaaguauaccugcccagcaguaaguucuacagaaauuauaugcugaauugaaauuguauuuuuauccaaaauauaagaaucuauucaagaaaagcuccagguucacaguggaacaggaaauugauuuaaaagauguuuugaaggcucuuggaauaacugaaauuuucaucaaagaugcaaauuugacaggccucucuguuuuccuaucucugaaugaaaaaaaaaaauuucugauucucuuuuugcagauaauaaggagauuuuucuuuccaaagcaauucacaaguccuuccuagagguuaaugaagaaggcucagaagcugcugcugucucaggaaugauugcaauuaguaggauggcugugcuguauccucaaguuauugucgaccauccauuuuucuuucuuaucagaaacaggagaacugguacaauucuauucaugggacgagucaugcauccugaaacaaugaacacaaguggacaugauuucgaagaacuuuaaguuacuuuauuugaauaacaaggaaaacaguaacuaagcacauuauguuugcaacugguauauauuuaggauuuguguuuuacaguauaucuuaagauaauauuuaaaauaguuccagauaaaaacaauauauguaaauuauaaguaacuugucaaggaauguuaucaguauuaagcuaaugguccuguuaugucauuguguuugugugcuguuguuuaaaauaaaaguaccuauugaacauguga

SEQ ID NO: 1144 - RNA, 571 nt, Homo Sapiens
auacaaccuuagagauaaugaagucuauugcacagaaagaaacuggaaucaggcuguuuauugacugcagagaaguagcgucucuugaaugguuaauggcaauuguuaauuagauugcuuuuccuacacugcccuguguggugguggauggcauacgugguaaucugagugugguaagcaugaaaagcacagaaugugugaaagcagcaacaaacuucacauccaucaaauucuuaacaugaaccagguucuuugcuuacauucgcauaggcauaucggucugguuuuacuugucaggagggacugaagaaagcacaggacguaaguuccuccaagagcauucuuggagcagcaucucaucgcuguccuuggguguagccucccuuuugugagguucacucccucagcuggaggaugaaccacagugcugcugcagaccuagcugaugucacaguuguucaaaagguuccucuugaagaaugaaauccuugggcugccauuaggaacugcaugcaguuaagccguauaaccucucugauuuuuaguuucuccaucuauuuuauaaaauaaa

SEQ ID NO: 1145 - RNA, 1554 nt, Homo Sapiens
guccauacacagaaacagaaacugaaccgaacaccgaaacugaaacuguuugucucuuccugagaaacgagcaaaccugaaagcuacucucucagcuucagagggaaaaaaugguuguagauuucuggacuugggagcagacauuucaagaacuaauccaagaggcaaaaccccgggccacauggacgcugaaguuggauggcaaccuucagcuagacugccuggcucaaggguggaagcaauaccaacagagagcauuuggcugguuccgguguuccuccugccagcgaaguugggcuuccgcccaagugcagauucugugccacacguacugggagcacuggacaucccagggucaggugcguaugaggcucuuuggccaaaggugccagaagugcuccuggucccaauaugagaugccugaguucuccucggauagcaccaugaggauucugagcaaccuggugcagcauauacugaagaaauacuauggaaauggcacgaggaagucuccagaaaugccaguaauccuggaagugucccuggaaggaucccaugacacagccaauugugaggcaugcacuuugggcaucuguggacagggcuuaaaaagcugcaugacaaagccguccaaaucccuacucccccaccuaaagacugggaauuccucaccuggaauuggugcuguguaccucgcaaaccaagccaagaaccagucagcugaggcaaaagaggcuaaggggaguggguaugagaaauuagggcccagucgagacccagauccacugaacaucugugucuuuauuuugcugcuuguauuuauuguagucaaaugcuuuacaucagaaugaugaaaauaggcuugccacuuucucuuauuuuaauuccaugguagucaaugaacuggcugccacuuuaauauaacugaaaauucauuuugagaccaagcaggaucaaguuuguagaauaaacacugguuuccuagccauccucugaaaacaguaugaaacaugaccaaguacauaauggauuuaguaauaaauauugucgaauugcuaaaaagucuucaaucauucauucacuaagucacucagugauaucaauauacuuagcucagaaagugugggaggcugaauaauggugucucccaacauaugcaugacuuaauccccagaaccuguaaacauguuacuuuacaugguagaauggacuuugcggauguaauuaaggaccuugaaaugguuagauuauuucauauuguccggguggauaagaaccaggauuuuguaacagggaggcaacaagcucaaaaucagaaaaaagagauuugucaauggaacaagagguugaagugcuuugaaguuggaggaagaggucacaggcaaaaaaguacaggcagccuuuagaaacccaaaaggacaaaggaacagauucuccccuggagucugcagaaggaaccagcccugccugcacauggcuuuagcccagugacacugauuuuggacaucugaccuucagaacugcuugcucauaaacuugucuuguuuuaaugca

SEQ ID NO: 1146 - RNA, 88 nt, Homo Sapiens
guuccagacacaucucaucugauauacaauauuuucuuaaauuguauaaagagaaauuauuguacaucggaugagcugugucugggau

SEQ ID NO: 1147 - RNA, 1140 nt, Homo Sapiens
gagacuccgagagccgcucucccaggcuccccgcugcagcggcggggcugccaggggcggcacacuccagcgccagccagagagcuagcgccgcuugaggccggccggggacgaggcgcuuuacacugccugauggguacuagcagcccaccccagccagauggaggacaaggccucuccaagucucaaggaaaugcacaauccuuccuuaccucuggccucagaacucucagcaucucauugauuagcaaccucaucuguggcaaaucuaagguucagaggaaaaagaacagauuugcgaccgggcacguuggcucaugccuguaaucccagcacuuugggaggccgagguggguggaucaccugaggucaggaguucgagaccagccugaccaacauggagaaaccccgucucuacuaaaaauacaaaaaaaauuagccaggcgugguggcgcaugccuguaaucccagcuacucgggaggcugaggcaggagaauugcuugaaccugggagguggagguugugguaccagccugggcaacaagagcaaaacuucaucucaaaaacacaaacaaacaaacaaaaaagaacagauuugcuuuuuucuuaauaaagaaaaauguuuugaauucacucuguagaaauuuaaaacugcuugauguuuuagugaucaaaauaaaaugaacaccuucuacuuaaaauugaagucuucugggcugggugugguggcucauuccuguaaucccagcacuuugggaggccaaggagugcggaucacgaagucaggaguucgagaccagccuggccaacauaguggaacccugucucuacuaaaaauacaaaaauuagccgggugugguggcacaugccuguagucccagcuacucgggaggcugaggccucugagcccaagcuaagccaucauauccccugugaccugcacguacacauccagauggccgguuccugccuuaacugaugacauuccaccacaaaagaagugaaaauggucuguuccugccuuaacugaugacauugucuugugaaauuccuucuccuggcucauccuggcucaaaagcucccccacugaguaccuugugauccccacuccugcccaccagaaaacaacccccuuuga

SEQ ID NO: 1148 - RNA, 4181 nt, Homo Sapiens
acaaugucacagugguuauacaagugaguccuguucagcgugggaggaaauaacacaagaggcaaagaucacucgggaccaccuuguauauuggcuaccacagaacccaacacaagcaguaaguuaaaaucaugaagcuccugacgucagaggacauggcucugccauuuguuagguagggauccuguuaaaggcucagcuuccucaucuggaaauggaaauauaggccuugccugguuugcuguaaugggucgugaugaggaccaaacuacaaagagugguacagauguuaauuacaaugauuuuuccuaugccacccauggaaacaaaaauagcaagauagagaaggcuaaaucccaguuuuuuuugacugcuauucagcaaagccuaggagacuuucaugacaccuggagaggcggccguaguguauguguaagaguaccgguuccagaguggggcuccccgagcucagccccaccacuuaccaacagcggaccuugggccagaugcugaagcccuuugugccuugguuuccugaccuauuacuguggaaaugaugacaguacccuccucauggcaucgugagaauuaaauuagcuaauucaggugaagcauuuagaagaggaccuccugacacuuaauaacugcuugauauaaauaauagcuucugcuacagaguggccaugaagucuggacauguagauauuauauuaucaugcaucauaagguaguugaucuggugugagauuccaaccucgugugagagaggagaagaccuucauuacacuaauucaugcuggcccagccuccaggccaccccagaugugaggugcuguuaacacugcucucaguagggacgggguuucgccauguuggccagccuggucucgaacuccugaccucaggugauccauccgcuucggccucccaaaguggugggaucacaggugcaagccaccgugcccaggcugcuaucuuauuuucaagaauuugacucacgucuuucugaagaacaucuaucacuuaguugugagugaggaauggaugccauuguuaguggcuuccguugugcucaguggaaacacgcaucuacagguagaauguagaggaacagcccaauucagcugucuuguggauuucaggcuguggucucucugccucucucuggaacacaggaggaacuuugcuacugccuugaccaacagaauaugggggaagcgacauugugugaauuacaagugguccacggugaccccaaggaggacaugaucccccuugucugggagaacaagaguagaugguucgguguaugcaaauaucacaguuccagguaacuugaaggagcaguuuggauuuagaugcagucugaccugagccaugaagaagugcagaguccccaagaggccagagagcucacgucugguuagagucgggguguuugaugggaagaugaaaggaggagcuggcaucugaggaaaucaacauucaaggggagacccaaugaagaagauagugccagaacuuaauggaggcagcccaagaggaacguguaccuggggaagucaagagcuauuucuuggacauuugugccucuauuccaaacucuucucucagaguagaugacaacucaggaaggagccagagaucuuccucaguugacuuguucagaaauaugauuugggauucagucuggcccgaagccaugcuuccagccucaucuccacugugcacuuuccauggcguucugucuugguccacuuggcuuguguagcugccuggccuggguuguccuccccacccuugucugcuugguggcacuuggcccuguucuaauugcuucugcucgggcagcuucucuccucccuccucugugcucugagcacacuggacagauuccuguuagagcugucacugucuuccugcugucugcccacugaccuuggagcuccaggaggacaggagccuuaucuuaccccaugacauggccuaugcccagccuggugccaacguggucuggagguaucuguaggcugaaugaaauucuucccucugggaugcccuuuaaaguuguuuucuuucuggaaccuggggcagugacuggaaugguuggaauguggccuugguuugccauuggguguuuuguuccuccgagcauuggcuggacucucuggugauuucuggucuugaaggacuuccuguuuuaaaugucugugggguugugguucccgagcugcugcacugucucccauaaccuuucucucuauccuggccuggucucucuuccacaccagaacuuuccucuagaucaaugguccaggaccaucagaaccagugaaccacacuccugaccauucuccaaauagucauuuggccaaauacgagguacguggcagcucuuucuuuucuggaccccacuucaccucugagcagcuuccuucucccaggagcugaagcucccccacgaugucucaaugccaggcagaugcgcuugaccuucugccucuuggggcccucaccaagcuaagggauuuuaaaucauucaacuaauguauuacagugggaaagacaccccacuaaggggcuccacuaaauauccuuuccaguugauaagaucauuuuuuuuuaauccagcuacaaacucuugaguuuuaaaccccaugaguuauuuaccauacgcuuguauccccuacagugauuuuuaaagugccauggcuguuucuccacuggcuguggagugagcugauguuacugcagguugagguugagccacuuugcuucaccgacaguuccaggaguccuuuugggcacugacuguggguccaguccugagcugagugcacagaggacgggggagguugagggagucaacacaacuccgagguguccuuguucuccaggggcucuagguucugaccugcacccagccacaagcugacuugagucaaaaagucacaaagugugacuugggguuuccuaucccaggaucuuggccagagcuucauuuggaagccccagagaccuggaccagacuugcagguagacauucaccaaugcgugauuugagggcugcucaaagggaccuccccacuucccacauggagcacucucgggauuagccaucaccggaaacuccuuucccgcaggacagagcccagacaacucauucugucuucaaaagccaccacugucuggcaccaacccacuuuuccaaacuccaccuccugcgacuucagccacauggaacaagcauggacugauguucucuauaccuuuccaacuccagcucuuggcuucugcucuuuucucugccaaugaggcugugcugucuauuacugaguaacaauauuaccauauacuuagcaccuuuaaacaauacacacuuauuaucucauaauuucugugggucaagaauucagguguggcuuagcuggguccucugaaaggcugcaaugaagaugucagccaggacuguggucucaauccaagcuucagcuagagaaggaucugcuucccaacuucgcauauguugguaagauucaggcucuugcaagugaucggaccaaggcccccaguuuguuguuggcuguuggcuggaggcugcccucaguuucuagcugguugugggcaguugccuugaguuccuugccacaugagccuccucaacaugaaugcuugcuucuucaaagcuggugagagagaggcucuucuaauaagauggacuguacaagcucacauuauguaaucacagaagcaacagcugucaccuuuguuauacuuuauugcuuagcaucaagucacaauuccugcugauacucaaaagguagggauuacaucagggcgugggcaccaagagguggggaucauggggccacuuuagccucugucuccacccaucuccuucucccaaccucccuguccacucuagaaacagcaaccuaguaaaauucaugaaagcuucccuuagucaccucaaccacagggcuuugcuuacaucguucuuuaguacuucauucauuuauucaacaaaauacauauugagcaucugccguaugccuggagcuagagguaguauaguauaaugguuaaggcuucaaguucuggaaucagagucucuuguuccaaauccugggucuccacuucaugcugggucucaauaaacucaucucuaaauaacacuagga

SEQ ID NO: 1149 - RNA, 168 nt, Homo Sapiens
uuauacaaaaauuaacucaagaugcauuaaagauuuaaacgugagaccuaaaaccagaaaaauccuagaagaaaaccuaggcaacaccauugaggacguaagcaugggcaaagacuucaugacuaaaacaccaaaagaaauggcaacaaaagccaaaauugacaaaag

SEQ ID NO: 1150 - RNA, 2910 nt, Homo Sapiens
ccugugcugagucgccgagcagcccgcucuccaugugacuucaguuuccguccguuccuuccgcuggugcuaaaauaaucugaugccccacagcaaggagguagcccagccccgcguucggcugcucucgaggaggccggagcccccggagacgaugcgccccgcgcagccgccugcgccugcgggagccggcugcccuugagauggaguugcugccucuuuggcucugccuggguuuucacuuccugaccgugggcuggaggaacagaagcggaacagccacagcagccucccaaggagucugcaaguuggugaguuucccuugaacccugaucugucggcugcuccuguccugacaaggcuugguccauuuggaaagcugacagauuguccaucaggaagggcagagaaugaaggagccugcaucacucugugccugccuagcacaggggcaugugcagcugcccuuuaaccacaggauuuuaagaugcuuccugggaagagccaggcagucccugccccgccguucucacgccugcugaggauaggaggcauccgagaccagccuagggcauccucccggaacaagaacaacuuguuaaaaaucuggaugauucaggccgggugcaguggcucaggccuguaaucccagcacuuguggguggagccgcugacugccgagggcagagccucgcuucggugcccagcagccucccgccccacgcccggaugcucacccuggaugccaacccucucaagacccuguggaaucacucccuccagccuuacccucuccuggagagccucagccugcacagcugccaccuggagcgcaucagccgcggcgccuuccaggagcaaggucaccugcgcagccugguccugggggacaacugccucucagagaacuacgaagagacggcagccgcccuccacgcccugccgggccugcggaggcuggacuugucaggaaacgcccugacggaggacauggcagcccucaugcuccagaaccucuccucgcugcgguccgugucccuggcggggaacaccaucaugcggcuggacgacuccgucuucgagggccuggagcgucuccgggagcuggaucugcagaggaacuacaucuucgagaucgagggcggcgcuuucgacggccuggcugagcugaggcaccucaaccuggccuucaacaaccuccccugcaucguggacuucgggcucacgcggcugcggguccucaacgucagcuacaacguccuggagugguuccucgcgaccgggggagaggcugccuucgagcuggagacgcuggaccugucucacaaccagcugcuguucuucccgcugcugccccaguacagcaaguugcggacccuccugcugcgcgacaacaacaugggcuucuaccgggaccuguacaacaccucgucgccgagggagaugguggcccaguuccuccucguggacggcaacgugaccaacaucaccaccgucagccucugggaagaauucuccuccagcgaccucgcagaucuccgcuuccuggacaugagccagaaccaguuccaguaccugccagacggcuuccugaggaaaaugccuucccucucccaccugaaccuccaccagaauugccugaugacgcuucacauucgggagcacgagccccccggagcgcucaccgagcuggaccugagccacaaccagcugucggagcugcaccuggcuccggggcuggccagcugccugggcagccugcgcuuguucaaccugagcuccaaccagcuccugggcguccccccuggccucuucgccaaugcuaggaacaucacuacacuugacaugagccacaaucagaucucacuuuguccccugccagcugccucggaccgggugggccccccuagcuguguggauuucaggaauauggcaucuuuaaggagccugucucuggagggcuguggccugggggcauugccagacugcccauuccaagggaccucccugaccuacuuagaccucucaagcaacugggggguucugaaugggagccucgccccacuccaggauguugcccccauguuacagguccugucucucaggaacaugggccuccacuccagcuuuauggcguuggacuucucuggguuugggaaucucagggacuuagaucugucggggaauugcuugaccaccuucccaagguuugggggcagccuggcccuggagacccuggaucuccguagaaacucgcucacagcccuuccccagaaggcugugucugagcagcucucgagaggucugcggaccaucuaccucagucagaauccauaugacugcugugggguggauggcuggggggcccugcagcaugggcagacgguggccgacugggccauggucaccugcaaccucuccuccaagaucauccgcgugacggagcugcccggaggugugccucgggacugcaagugggagcggcuggaccugggccugcucuaccucgugcucauccuccccagcugccucacccugcugguggccugcacugucaucguccucacuuuuaagaagccucugcuucaggucaucaagagccgcugccacugguccuccguuuacugaccuggcugugugccaagacucgaaauucgguccgcacacaacaggacacuuucucugccagcuuucaagaugugaugcagaggccaagucugacgaauugaaguuucaauuaaaauuuaauauguuuccauuccucaucgcccaccccacccccgcccccaccaccgcccaaguucuuuuuccaucauuauaauucauccucauuaucuugguaaaauauuuauuaagugacuuuuucagaaauaaaaggcaacgugucucauaaauauuuuuuaaauuaaa

SEQ ID NO: 1151 - RNA, 6659 nt, Homo Sapiens
uuugcaaaacgagacuguuaauaaaaccuaccccaggguaggacggacuguucgaaacaaaacagaaaugcaacgcuuuagaguacccacggaaaacuuguuuaccuugucaccaugaguaaaaguuaauucccacuccugaagagagcaaaccaacucugaaagagagugaaaaugcagacaagacaguuaucagauaauggcuaucuggacgagagauucuuucguuugacagcaguuugguuguugggaguuccaguucagcuccugcacaguugcucuguacaaauccuccuccauauuugcuuagagaaaacguguugccaucccaucaugaaggaagcugccugagaguuuuuaaccauuacagccgugaugaugaaagagugaagaaccgccucuaaguuaaaaagugcacccagagauaagguucguucucaaugcccugccgcugcuucucaucgcauggccaccgcauuucucaguaagugggaaucaaaugcuucacucaccacagaggccaggcacauugagcauugguccugugccugacgcuaugcuagaugcugggguugcagccacgagcauagacacgacagacacgguccucgccaucuucuguugaguacuggucggaacaagaggaucgucuguagacaggcuacagauuguuuuagauugaaguuuccugucauguucacucaucuuuaaauccucauagugaaaaaggauaugaucaucguggcgcauguauuacucauccuuuugggggccacugagauacugcaagcugacuuacuuccugaugaaaagauuucacuucucccaccugucaauuucaccauuaaaguuacugguuuggcucaaguucuuuuacaauggaaaccaaauccugaucaagagcaaaggaauguuaaucuagaauaucaagugaaaauaaacgcuccaaaagaagaugacuaugaaaccagaaucacugaaagcaaauguguaaccauccuccacaaaggcuuuucagcaagugugcggaccauccugcagaacgaccacucacuacuggccagcagcugggcuucugcugaacuucaugccccaccagggucuccuggaaccucaauugugaauuuaacuugcaccacaaacacuacagaagacaauuauucacguuuaaggucauaccaaguuucccuucacugcaccuggcuuguuggcacagaugccccugaggacacgcaguauuuucucuacuauagguauggcucuuggacugaagaaugccaagaauacagcaaagacacacuggggagaaauaucgcaugcugguuucccaggacuuuuauccucagcaaagggcgugacuggcuugcggugcuuguuaacggcuccagcaagcacucugcuaucaggcccuuugaucagcuguuugcccuucacgccauugaucaaauaaauccuccacugaaugucacagcagagauugaaggaacucgucucucuauccaaugggagaaaccagugucugcuuuuccaauccauugcuuugauuaugaaguaaaaauacacaauacaaggaauggauauuugcagauagaaaaauugaugaccaaugcauucaucucaauaauugaugaucuuucuaaguacgauguucaagugagagcagcagugagcuccaugugcagagaggcagggcucuggagugaguggagccaaccuauuuauguggguaaguagcuuauguuuauuuuacauuggcagccuuccuugugaucaaaaaagguaaucccagaaacguacccguucacucgugggucuuaaaaugguuucauaucucuauugugacuaauuuucucucggucuacugccuuuucaaucaggaauagauuugccaugaagccagugaaguuuuuaagugucuaggcuucucauuagcgccaacucuccuagaccuggugccuguuuuuuuuccaaguuuuguuucuacuucuauccauuuuuuaaauuaaacuuuuuauuuugaaauaauuaucacacucacaagcugugggaagaaauaauagagauccugugucucuuucauccaguuuuccucaaggguaacaucuuacaaaacuauaguacaauaguggaauagaauauugguguugguucucaagauaaaggagauaacauccagcuuuccugccccacaccguaucugaaauaaaaacaacagcagggauagcagauuacauguguuuuuuaauuuuuauuuauuuugccaagcacuaugcuaaauacauaaucuuaguccuaucaaaaaacuuguuuggaaaguuuagguaauuggcuuaacucuguucugcauggccaacaaguggcagggauggggcucuaaccccagauuaacugacucuagcacuugaucucuggacacucuggcauggugggacgaaaugaugaacacaagcccuugagagagugguuugucauugugauuauggcaaccaucugcuucaucuuguuaauucucucgcuuaucuguaaaauaugucauuuauggaucaaguuguuuccaccaauuccagcaccaaaaaguaauaucaaagaucucuuuguaaccacuaacuaugagguccucugcauuuucauauacaucuuagauucagcugacaauuuucuacaaaaaaagaaagcuggguccagugagacggaaauugaagucaucuguuauauagagaagccuggaguugagacccuggaggauucuguguuuugacugucacuuuggcauccucugaugaacucacacaugccucagugccucagugaaaagaacagggaugcuggcucuuggcuaagagguguucagaauuuaggcaacacucaauuuaccugcgaagcaauacacccagacacaccagucuuguaucucuuaaaaguauggaugcuucauccaaaucgccucaccuacagcagggaaguugacucauccaagcauuuugccauguuuuuucuccccaugccguacaggguagcaccuccucaccugccaaucuuugcaauuugcuugacucaccucagacuuuucauucacaacagacagcuuuuaaggcuaacguccagcuguauuuacuucuggcugugcccguuuggcuguuuaagcugccaauuguagcacucagcuaccaucugaggaagaaagcauuuugcaucagccuggagugaaccaugaacuuggauucaagacugucuuuucuauagcaagugagagccacaaauuccucaccccccuacauucuagaaugaucuuuuucuagguagauuguguauguguguguaugagagagagagagagagagagagagagagaaauuaucucaagcuccagaggccugauccaggauacaucauuugaaaccaacuaauuuaaaagcauaauagagcuaauauaucaccccauaucaaaagagacgacagauuuuguucaaauauuauauucuugaaggaagccuuaauauucuggaaaugugcugaggaagucauugagcauaauucaaucaugaaagggaccacugaaucaagaaugaacuuucugaagagauguuugcugccaaagacuucagaacaacuuguuggucaaguaaugccagaucaauccuagucucucaaguuuggaaaaguuucuacaaggccauuccaucaaauaucccaauauacacagaaauucuucuuccuaacaucuucauauaugagucugcauccagauuggaggccuuuguggugggugguggacugcagguggaaccaagcacaggugugcccugggcagaggugggcaagaggaaggaacccaaacagugcugauuccacauggcccuuggucaagaagcugaaggccuagaaaggagguaacagugcccagaauccccaccuggcacacucuuuaaaugcuuucuggagguguuuuagucaguuuugauccaucgguggggacacacugacuaccauauauuuccagguuuguuuguuuucuuaacuaaccuguaauuauccacuguaacuagcagaggguugaacccuggguaauaggcacagaaacaucuugaaucuugacaagccugcacugucuuauaguaaucuguauuacugucccauuuuauaguugcaguuacuaagguucagagaaguugauaggaaauggcauagugaggaguugaauaccaggcucagguaaaagugaccccagaaaugugcagaggagugucagggaaagcugaggccugcuuagggguguggcugagaaggcaacacccauggaggugcugcaauaguuggcaaaauguuuaaaauguuuggucacucaaaugauucauaaucucaaaccuguuuuuguuuuuuuuuuuuuuuuuuuuuguggggugggugguggagacagucuuguucugucucccaggcuagaguguagugaugugaucuuagcucacuacaaccucccuguccugggcucaagccauccuccucccucacccucccaaguagcugggacuacaggugcauaacaccauucccagcucuuuuuuguauuuuuuuuuguaaagcugggguuuugccaugcugucuagguucaucucgaacuccugggcucaagcgauacaccggccucagccuuccaaaguacugggauuacaggcaugaaccaccauuccuggccaggaaacuguauuuguaaugaacaccuuaggucagaaucagaggcgccuggagggcuccuuaagacacagaggagugggcuccauucuuagagucucuaacugaauaggucugggugaggucugaaaagcugcguuucuaacaaguucucaggugaugcucaugcugcuggucuccaggacacacucggagaacugcugcuccaggagagucuuaugaauaccaaaauuugaaaaucagccgcugaaggaagaugugacagaaaaguccuguccccagaaaacuguccuuuuggggcggcuuggagcacccugucugaucucuuucaaaccacaacccagacaguuggcauuguggaaacugccucugcuuaggaggcaggaacagaagcagggagcucccccuccacaaauguggccagcucuucagugcuugguguggugcccacuucagacuccucccuccacucagcagccauagaucaccugggcucuguggagcuccuugccacacuucccugagcugguaccguuaucuggcccuugguauauguguuucaggagcaacacaaaguagcccauuggccuccuugguggauugggaacuccuuccucccuucuugcccugugcaacucauagucauucuuugggaacccguaaccaucaucacuuccuccaugaagccuucaaaagcagaguugguugaucccgccucuggauucucauucugggccucauacccguguuagagcuacugcauuguagaauauaccauuaacagcugggaggccuccccucuagacugcggcuuccaggaggauggagcuugugugaaauacgucuuuuuaucugcagugucuaggacaguaucugacuuaagaaaauauaaauguuucuuaaacccucugucagcccugauacggcaccuuguauauagguuagacugaacaguauuuggcagagauccucaaggccuacaauaaugacagggggaggaagcuggguaucuaaugagaaugcgguuaguuagaagcaaccaggagacacaugugccuaacaacugggcuacugcaaccuggauguuuuugcugccaaagugucuaaaugguuauguauaaauugcuguguaagaggcauuucagaaguggcucacugugaguggucuauacuguucucaccagccuugucauagcaagucaaagaguuugaaauucacuuaacaguaaacaccaucagcagcagguugauguaagguaaagucaugauauuggcucccaucucuugccaucucucacuaggacgaguguagagagucacuuuucuccuagagccuccacagccacgggaucagaacaaacaugcuuuuccaagauauccguuccaauagggauuuuuagcccaauuucuuuccuuggcauuuggaauucacugcgugcagcaugggggagugcuggggagacuggagggugaaggucacauuugccaacagcccgaccaccugagccucauugaaaugccucagaccucaagcuauucaugcaggcuggggaagaauccacgugggcaaagaacauccugauuaaaaauccaaacguuuucauggugagacuucuaugugucaggaccaucugcugguggaauuaagaagccugaggugcuaauuuguuaaagaaaaaguagauaucuggaagugagaacagagaacugaaaacaaucucugauggcacaaguaaaggugaaaaaccuaauuagaauaggacuuggugcuagccuaaggacuguagcuauuccugcuucuacauccuucaaauugaguaccagggugcaaauuuuuucaaaaccauuccuuccuuuggaauuuuguauuguacuauaagacaaucaugcuuaucuccuguuuuguagguaauagaugugaauauaaauauguuucagaaugagaaauauuaaacauaaaugacagugaa

SEQ ID NO: 1152 - RNA, 3469 nt, Homo Sapiens
aaaacuccagcccgaagggaucuggaagcaguuuuuaagacuguguguguaugagacaggucgcguccuagagcaaacgguuuuuuuuguaaacagacggcauccuaacaggggcggugcuacccagucugcggggagucgcucgggaucgaagcaccucagagcuccuucgagcguaucccuucgggaaagccccacgccuuccccgaggcgccuccuccggccugcagcacgcccucguccugcacuuccuccucggaaucugcaagagagcgucaugggacauguaguuccggcaucgcgccugguggcggaguucugccgaguggggcgccgcggccgcuauugucccgcccccugcuccgcaagauucgagccugagcggccugggcgucucgagaggugagagaguuggcggcgaggucucggcggcuaagcgagcgucggcgacugucucuccgcgagaggaggcaaguugggguccaggcuccaaagccgguggccgcguaccgcgguggagccgcugucuuugaggucugaggagagaacaggucccucucuggccaccgcacgacgggcgcagaaaucugggccccagagcugcgcugagagaucccccgacgcuuccccagccucccagggaggccuucgcggagucggggcgucgcgggucggggcgcucgcugugucccuucagcuccagacugcgugaagcuccuccagcaggccccagcgcccagggauuuuguccuaaaaaagggucauggaguggguggauugcgggcggcccggcgcuuuuucugcauacggauuucgucccaaauuugcuaacaugagaaccacaguuuuucagaagagcagaauguuuauuugccaagaccuguuuggcaggugugaauguuuuagagaagaaaugccgagaaaaugcuggcauuuugcguugcggguuuuuuuuuaaauugagaaauagguuacuggcuuacuuuguuucuccagaauauuuucacuuggcuuuaauuuaagucauguggcuuuaauuuccuuccagauuaugcguucagauguggcaaaggcuuaagagaaucauuaucucuuaaucguagcgguuuugauuaucuuuuuucccacaucauauuuuucuuucuuucuuuuuaaaucacagcuuuacguuuuuaagagucucuaucugguucauugauugauucaacaaauauuuauuaagugucuaauaugugccaggcauaguugcuggggaugcagcaggaaacaacgcagaauuuuuggccuucuuggaaaugggcaguaagcagaaacagagucuagcucuuucacccaggcuggagugaaguggugcaaucucagcucagugcaaccuccgcccccuggguucaagugauucuccugccucagccuccccaguagcugggauuacagugauauccugagagaagaugggaaagggcugcaagguugugguuuguggauuguuaucuguggggaaaacugcaauuuuggagcagcuccuuuauggaaaucauacuauuggaauggaagauugcgaaacaauggaagauguauacauggcuucaguagaaacagaccgaggaguaaaagaacaguuacaucuuuaugacaccagaggucuacaggaaggcguggagcugccaaagcauuauuuuucauuugcugauggcuucguucuuguguacagugugaauaaccuugaauccuuucaaagaguggagcuucugaagaaagaaaucgauaaguucaaagacaaaaaagaggcaaguagcaauugugguauuaggaaacaaaaucgaccuuucugagcagagacaaguggacgcugaaguggcacagcagugggcaaaaagugagaaaguaagacugugggaggugacuguuacagaucggaaaacucugauugaaccauucacuuuauuagccaguaaacuuucucaaccccagagcaaaucaagcuuuccuuugccugggaggaaaaacaaagggaacucuaauucugagaacuaaaaaucaguaauuuccacaauuguauguugaauagugauugccuuuaagugucugugaacauggaguaauauuacuauuuaaaauaggccauuuguaucuaccuuugguccuuaggaaaauuccuaaggaagucaauuaaugcacuuuagauguuaaaaguauuugggcuaagguuauuauugccugauaugaaauaauauauucuuauucucauuguuugaaaccugucuuugaaauuagcaccuuuguuauuuauguuguacuugugaaaacaguaaaauaguuuggauaguuaugcaaaugcaccuauguguaacuuccccccaaccccaagcuguuucggaagauaucauaaucauucuguguaacauuaugcaaacuucuaagcccaaacaugacuuuguuuuuaaaaaguucauuaaucuaaugucuaggauuauaaaacauuuuuuugugucuaaauuggacccaaaacauugaacaguuugggguaguaagcuaaauuucaucuuguggagauuuugcuaaacagacuaagacccaugauuuagcuuugcucaaauuagaauguuuagcaugaguugagguaccagguaguguuaaguagguucaucacgcucuaaggccguuuuuuccuuagccagaccccuguugauagaccagauacuugagggcaaacuguuugcuccuccucuugaaaaugauuaggcacuuaaggacaguaaagcuguauuuucuggaaggaagacuguaucuucuggaauaguuuucuagaaaacuagucauauacaauaaaaguaucaaaaauauugggcucuaauuugaucugacuuagaugucugaguuuguguuguuucucuaaagauuuuggcaagacucaagcaauguggcugacuguaacuuuauuaauuuaaaagguaggaaguaagcuacuuagugguuucaccugugaaauaacuauuuugacugaaauguaaaauaagcuauucaacaaagaacauauuaaaacaucaaguaauuuguaacaucuuaaauggaauacuuuuuucaugagcucuagugaagaacuacuacauauaaaagacgauacuuacaaaucagcuauugcugcuacaguauaauucuucaaaauuucucaucauaaauucauuuuuugguaaaaaaaaauuaccagacacuaacucacccccuuacccuuuucccccgguuauugaauauuaaucuagcuucccacccaugcauguuacauagauggacaaaugcuuucauaaugauuuuuaaauaaguaccuuccaguuugcuuuguuuccuacuaaugcaacuuagucuauauuaguacaaacaguuaccaauucuuuuuaaauucuguaaugaauguauguguauccagauaaguuucucugaaagagacauacagaaacagaacugcuggguc

SEQ ID NO: 1153 - RNA, 1859 nt, Homo Sapiens
ggggaauccugcucugggauagcacccggccccgcagagcagcgcggcagcccaagggccccggcgccgggggcggcggggaaccccaaacgcaaccgggucuggagggauccccgcgccgagccagccgccgucaccgccuccgcgccgccccugcgggcuuggcaggcgcccggcgcgcccgcacugcgcccggccgccggcucccgcggucccaccgugagcucgccggcccgucgcccgcucgccaugcaaccgccgccggccucgcgcgcguaggcgcccgccgcaggccaugcugccccugcucgccgcgcuccuggccgccgccugcccgcugccgcccguccgcggcggggccgcggacgcgcccggccuccucggggugcccuccaaugcuucagucaacgcguccuccgcggacgagcccaucgccccgcggcugcuggccucggcggcccccgggccccccgagcgcccgggcccggaggaggcggcggcggcggcggcgccgugcaacaucagcgugcagcggcagaugcugagcucgcugcucgugcgcuggggccgcccgcggggcuuccagugcgaccuacugcucuucuccaccaacgcgcacggccgcgcuuucuucgccgccgccuuccaccgcgucgggccgccgcugcucaucgagcaccuggggcuggcggcgggcggcgcgcagcaggaccugcgccucugcgugggcugcggcugggugcgcggucgccgcaccggccgccuccggcccgccgccgcccccagcgccgccgccgccaccgccggggcgcccaccgcgcugccagccuaccccgcggccgagccgcccgggccgcuguggcugcagggcgagccgcugcauuucugcugccuagacuucagccuggaggagcugcagggcgagccgggcuggcggcugaaccguaagcccauugaguccacgcugguggccugcuucaugacccuggucaucgugguguggagcguggccgcccucaucuggccggugcccaucaucgccggcuuccugcccaacggcauggaacagcgccggaccaccgccagcaccaccgcagccacccccgccgcagugcccgcagggaccaccgcagccgccgccgccgccgccgcugccgccgccgccgcggccgucacuucggggguggcgaccaagugacccgcuccgcuccucccuguguccguccuguguccgcgcgcgcgggugccuuucccgccggagacucggccggugugcuucgugcuguaguuaucguuaguuccucuucccgagauggggccgccgagagaccccagcgccuuugaaaagcaagguuugugcugcgcuuccaguuccgaaaagcagauguuuaagcccuuggacugagggugggaucgcagcuccgaagacggagaggagggaaauggggcccuuuccccucuauugcaucccccugcccgacuccuuccccgcacccacgugcccuagauucauggcagaaaaugaccaaauccuguguauuuguuuuauauauuuaauaacuguuuuaaaugaaaguuuuaguaaaaaaaauacaaaacaaaaagauuaaauugcuauugcuguaguaagagaagcucuuuguaucugaacauaguuguauuugaaauuugugguuuuuuaauuuauuuaaaauuggggggagggcaugggaaggauuuaacaccgauauauuguuaccgcugaaaaugaacuuuaugaaccuuuuccaaguugaucuauccagugacguggccuggugggcguuucuucuuguacuuaugugguuuuuuggcuuuuaauacagacauuuuccuccaga

SEQ ID NO: 1154 - RNA, 4449 nt, Homo Sapiens
uuuggaaacgucacacuguggaggaaaagcagcaacuagggagcuggugaagaaggaugucucagcaguguuuacuaggccuccaacacuagagcccaucccccagcuccgaaaagcuuccuggaaauguccuuguuaucacuuccccucucgggcugggcgcugggagcgggcggucuccuccgcccccggcuguuccgccgaggcucgcugggucgcuggcgccgccgcgcagcacggcucagaccgaggcgcacaggcucgcagcuccgcggcgccuagcgcuccgguccccgccgcgacgcgccaccgucccugccggcgccuccgcgcgcuucgaaaugaggguccugggugggcgcugcggggcgcugcuggcgugucuccuccuagugcuucccgucucagaggcaaacuagcauugucgacugaacugcgugcccugguugguaggauuuucuucucuagagcugcagccuccuagaaaguuuccagaaugaggaagacgcaaaagcagaaaccccugauaaaaccaucagacuucaugagacuuauucaccaccaugagaacaguaugggggaaaccaccccagugauucaauuuucucccaccaguugccucccacaacauguggcaauuaugggaguucaauuaaagaugagauuuggauggggacacagagccaaaccauaucaaguacaaagaaaagagucucauaagaugcaagugaggaagaguuuguuuauauuuuagaaaugauuuuauauacaaccgugcaugcauuucuguauuggucggcuuaucuggaugcaauuuuuucuauucuauaugcuuuuugucaaagcaacaggcuucacaaguccugguuaggaagcgucgugcaaauucuuuacuugaagaaaccaaacaggguaaucuugaaagagaaugcaucgaagaacugugcaauaaagaagaagccagggaggucuuugaaaaugacccggaaacggauuauuuuuauccaaaauacuuagaacaugagaagaauuggaaguagccuauagcaaguagaaacacgaacugauucuauugacuuaauuacauauacuuuauaaaucagacucuggucaguagauuugagggcaacaucuuguuucugcuguggaauuaaaaacauagacuuauaugacaauaaauuucuaugcuaaaucaagguuuuuuucacuucugacuuuaagguucuucuccagagagaagaagcugucacagacuuauuuuuuauguuucuguaucuguugccaucuugcuuguagauuuuuaauuuuucagaaagguagauggaaacauuuaguguugcauuuugaagacugaaucuugugaaucuacaggagcauaaauguccuaccucuugggacaguuccuaccaugaauucagaucaaguaugugugucuacucuaagaagauuauguuuguuuuuauuuucaguuugucuucgcucuuuucaaacuggguuauucacugcugcacgucagucaacuaaugcuuauccugaccuaagaagcugugucaaugccauuccagaccaguguaguccucugccaugcaaugaagauggauauaugagcugcaaagauggaaaagcuucuuuuacuugcacuuguaaaccagguuggcaaggagaaaagugugaauuugacauaaaugaaugcaaagaucccucaaauauaaauggagguugcagucaaauuugugauaauacaccuggaaguuaccacuguuccuguaaaaaugguuuuguuaugcuuucaaauaagaaagauuguaaagauguggaugaaugcucuuugaagccaagcauuuguggcacagcugugugcaagaacaucccaggagauuuugaaugugaaugccccgaaggcuacagauauaaucucaaaucaaagucuugugaagauauagaugaaugcucugagaacaugugugcucagcuuugugucaauuacccuggagguuacacuugcuauugugaugggaagaaaggauucaaacuugcccaagaucagaagaguugugagguuguuucagugugccuucccuugaaccuugacacaaaguaugaauuacuuuacuuggcggagcaguuugcagggguuguuuuauauuuaaaauuucguuugccagaaaucagcagauuuucagcagaauuugauuuccggacauaugauucagaaggcgugauacuguacgcagaaucuaucgaucacucagcguggcuccugauugcacuucgugguggaaagauugaaguucagcuuaagaaugaacauacauccaaaaucacaacuggaggugauguuauuaauaauggucuauggaauauggugucuguggaagaauuagaacauaguauuagcauuaaaauagcuaaagaagcugugauggauauaaauaaaccuggaccccuuuuuaagccggaaaauggauugcuggaaaccaaaguauacuuugcaggauucccucggaaaguggaaagugaacucauuaaaccgauuaacccucgucuagauggauguauacgaagcuggaauuugaugaagcaaggagcuucuggaauaaaggaaauuauucaagaaaaacaaaauaagcauugccugguuacuguggagaagggcuccuacuauccugguucuggaauugcucaauuucacauagauuauaauaauguauccagugcugaggguuggcauguaaaugugaccuugaauauucguccauccacgggcacugguguuaugcuugccuugguuucugguaacaacacagugcccuuugcuguguccuugguggacuccaccucugaaaaaucacaggauauucuguuaucuguugaaaauacuguaauauaucggauacaggcccuaagucuauguuccgaucaacaaucucaucuggaauuuagagucaacagaaacaaucuggaguugucgacaccacuuaaaauagaaaccaucucccaugaagaccuucaaagacaacuugccgucuuggacaaagcaaugaaagcaaaaguggccacauaccuggguggccuuccagauguuccauucagugccacaccagugaaugccuuuuauaauggcugcauggaagugaauauuaaugguguacaguuggaucuggaugaagccauuucuaaacauaaugauauuagagcucacucauguccaucaguuuggaaaaagacaaagaauucuuaaggcaucuuuucucugcuuauaauaccuuuuccuuguguguaauuauacuuauguuucaauaacagcugaaggguuuuauuuacaaugugcagucuuugauuauuuugugguccuuuccugggauuuuuaaaagguccuuugucaaggaaaaaaauucuguugugauauaaaucacaguaaagaaauucuuacuucucuugcuaucuaagaauagugaaaaauaacaauuuuaaauuugaauuuuuuuccuacaaaugacaguuucaauuuuuguuuguaaaacuaaauuuuaauuuuaucaucaugaacuagugucuaaauaccuauguuuuuuucagaaagcaaggaaguaaacucaaacaaaagugcguguaauuaaauacuauuaaucauaggcagauacuauuuuguuuauguuuuuguuuuuuuccugaugaaggcagaagagaugguggucuauuaaauaugaauugaauggaggguccuaaugccuuauuucaaaacaauuccucagggggaacagcuuuggcuucaucuuucucuuguguggcuucacauuuaaaccaguaucuuuauugaauuagaaaacaagugggacauauuuuccugagagcagcacaggaaucuucuucuuggcagcugcagucugucaggaugagauaucagauuagguuggauagguggggaaaucugaaguggguacauuuuuuaaauuuugcugugugggucacacaaggucuacauuacaaaagacagaauucagggauggaaaggagaaugaacaaaugugggaguucauaguuuuccuugaauccaacuuuuaauuaccagaguaaguugccaaaaugugauuguugaaguacaaaaggaacuaugaaaaccagaacaaauuuuaacaaaaggacaaccacagagggauauagugaauaucguaucauuguaaucaaagaaguaaggagguaagauugccacgugccugcugguacugugaugcauuucaaguggcaguuuuaucacguuugaaucuaccauucauagccagauguguaucagauguuucacugacaguuuuuaacaauaaauucuuuucacuguauuuuauaucacuuauaauaaaucgguguauaauuuuaaaaugcaugugaauaucuuuauuauaucaacuguuugaauaaaacaaaauuacauaauagacauuuaacucuuca

SEQ ID NO: 1155 - RNA, 4250 nt, Homo Sapiens
aagagaugaugggccugaagcuaaccggugcagacuaggggcgaguuuggagcaaguaacugucagugagguugcaguuggucugggcuguuuggcugugagcgaaauagcugccccccacuucucacuugcacaccacgggauacuccuccugaggcuccggauggauucagauggacugugaaaaacaacaagauggaugaucauauggagauugcuucuaacauaaaucugcauaaaaauuuuucugaaacauggcuggaauauuuaaggaguuuuuuuucaguacugaggaccucccugaagucauucuaacauugucuuugaucagcuccauuggagcauuuuugaaccggcacuuggaagacuuuccaauuccugucccugugauauuauuuuuacuuggaugcaguuuugaaguauuaagcuuuacaucuucacagauuuaggagcaccuagcauguauucuauucuaauagugaugaauaaaugagaagaugauauauuuguauaauauuagguccaaagauacgcaaacgccauacaauggaugaguccagacuuauuuuuucguauauuuacaccaguaguuuucuuuacuacugcauuugacauggauacguacaugcuucaaaaguuauuuuggcagauacuuuuaauuucaauucccggcuuuuugguuaauuauaucuuaguucuuuggcaucuggcaucuguaaaucaauuacuuuugaagccuacccaaugguuauuauuuucagcuauccuugugaguucagaucccaugcuaaccgcagcugcuauaagagaccuugggcuuucuagaagccucaucaguuuaauuaauggagaaagucugaugaccucuguuauaucauuaauuacauuuacuaguauuauggauuuugaccaaagacuacaaaguaaaagaaaccauaccuuagcugaagagaucguggguggaauuuguucauauauuauagcaaguuucuuguuuggaauucuaaguucaaaacugauucaauuuuggaugucaacuguuuuuggugaugaugucaaucauauaagucucaucuuuucaauucuguaucucaucuuuuauauuugugaguuaguuggaaugucaggaauauuuacucuggccauugugggacuucuuuuaaauucuacaaguuuuaaagcagcaauugaagaaacacuucuucuugaauucuggacuuuucuaucacguauugcuuuucucaugguguuuacuuucuuuggacuucuaauuccugcacauacauauuuguauauagaauuuguugauauauacuauucauuaaauaucuacuuaacauugauuguuuuaagauuucugacccuucuuuuaauaagcccuguuuugucucgaguuggucaugaguucaguuggcgcuggauauucauaauggucuguagugaaaugaaggggaugccuaauauaaacauggcccuucugcuugccuacucugaucuuuauuuuggaucugacaaagaaaaaucucaaauauuauuucauggaguguuaguaugccuaauaacccuuguugucaauagauuuauuuugccaguggcaguuacuauacuaggucuucgugaugccacaucaacaaaauauaaaucgguuuguugcacauuucaacacuuucaagagcuaaccaagucugcagccucugcccuuaaauuugacaaagaucuugcuaaugcugauuggaacaugauugagaaagcaauuacacuugaaaacccauacauguugaacgaagaagaaacaacagaacaucagaaggugaaauguccacacuguaacaaggaaauagaugagaucuuuaacacugaagcaauggagcuggccaacaggcgucucuugucagcacaaauagcaagcuaccagagacaauacaggaaugagauucugucccagagugcuguccagguguugguuggugcagcagaaaguuuuggugagaagaagggaaaauguaugagucuugauacaauaaagaauuauucugaaagccaaaaaacaguuaccuuugcuagaaaacuacuacuuaauuggguguauaauaccagaaaggaaaaagagggcccaucaaaauacuucuuuuuucguauaugccauacaauaguauuuacugaggaauuugaacauguuggauaccuugugauauuaaugaauauauuucccuuuauaaucucuuggauaucccaguuaaauguaaucuaccacagcgaauuaaaacacacuaacuacuguuuucuuacacuuuauauucuagaggcacuacuuaagauagcagcaaugaggaaggacuuuuuuucacaugccuggaacauauucgaguuagcaauuacauuaauuggcaucuuacauguaauacuuauugaaauagacaccauuaaguauauuuuuaaugagacugaaguaauagucuuuauaaaaguuguucaauuuuuucguauacuacgcauuuucaagcucauagcaccaaaguugcugcaaauaauagauaaaagaaugagucaucagaagaccuuuugguauggaauacuaaaaggcuauguccaaggcgaagcagacauaaugaccauaauugaucagauuacaaguucuaaacagauuaaacagauguuauuaaagcaagugauaaggaauauggaacaugcuauaaaagagcuaggcuacuuagaguaugaucacccagaaauugcugucacugugaaaacaaaggaagaaauuaauguuaugcucaauauggcuacagaaauucuuaaggcuuuuggcuuaaaaggaauuauuaguaaaacugaaggugcuggaauuaauaaguuaaucauggccaaaaagaaagaggugcuugauucucaaucuauuaucaggccucuuacuguugaagaaguucuauaucauauuccguggcuagauaaaaacaaagauuauauaaacuucauucaggaaaaagccaaaguuguaacauuugauuguggaaaugauauauuugaagaaggugaugagcccaaaggaaucuauaucauuauuucaggcaugguaaagcuugaaaaaucaaagccagguuuagggauugaucaaaugguggagucaaaggagaaagauuuuccgauaauugacacagacuauaugcucaguggagaaauaauaggagagauaaacugcuuaacuaaugaaccuaugaaauauucugccaccugcaaaacuguaguggagacauguuuuauucccaaaacucacuuguaugaugcuuuugagcaaugcucuccucucauuaaacaaaaaauguggcuaaaacuuggacucgcuauuacagccagaaaaaucagagaacacuuaucuuaugaggauuggaacuacaauaugcaacuaaagcucucuaauauuuauguaguagauauaccaaugaguaccaaaacugauauuuaugaugaaaaucuaaucuauguuauccucauacauggagcuguagaagauugucuguuacgaaaaacuuauagagcaccuuucuuaauuccuauaacaugccaucagauacaaaguauugaagauuucacaaaaguagugauuauucaaacuccgauuaacaugaaaacauucagaaggaauauuagaaaguuuguuccuaaacauaaaaguuaucuuacaccaggauuaauagguucaguuggaacauuggaagaaggcauucaagaagaaagaaauguuaaggaggauggagcacacagugccgccacugccaggaguccccagccuugcucccugcuggggacaaaguucaacuguaaggaguccccuagaauaaaccuaaggaaagucaggaaagaguaagacuguuaagaagaccgaagcauguauuaaugcuguggcuaugagaggccuccugcugcagaaacacacuucccuacaucaagaaggaguaacuucagguuggauccuguguggaugaucuuggugcuaagcagaaaagaaauuuggaccuugaaaccagcaguucaacauauauacuuuuugcaaaauuuccuugauuuaaaauauuuguuauuuuaaauauacaaaacauuuuagaaaaucuuagaguaaauuuuagucuuaaagccagaaaauaaguuuauagccaucuagauauuuugcauauugcucuuacagcaauaaugguuugguucacuuuaugaaaaauaaaauguauuaaaauauaguuuaaaugcuguucuug

SEQ ID NO: 1156 - RNA, 7941 nt, Homo Sapiens
aggcaacagcccggaagccgcuggcuggguuaaccuguggcgcgcuccgcgguuccggcgccugaaguuuuagcugcgguggcggcggcagucgggaccgacugcaaggcagguugagaugauggaucugaggcuugcagcucgcagucccaacgagccuuagggaccagggcuaccaaaaggguggggagaacggugguggcaucugucuguugccugggauccaggcgcccgguuggggaauccuuacuucaggaagcgcagccgcggcucuguguuuugagagugcaaguacgugucagggugcgugucuggguauguuugugcguggcgccagagcaccucgaguaugcgcgugcgcaccgcuuucgggagcuuuugcacagagcugguaauugggggugcucgauuguagcguugggggaguucaccguguagcaggagagaggcaaacuauccagggugcuuugggaccgggagcgucauuuaaaucgauggaugucagaggggcuucucagaaggcuccuccugugaguuuugaggaguccguggaaguuaacccaguagagaagagagugagccuaaugaguguuccaagcagagggaaaagaaugguugcaacugugugugaggcgagagcuugguuuuaggauuugcgggagaugugagagaacacuggaaagaaaagucagccgggccauaugggggagagggucugaaugccaagcugaguuggauugcuuuugacaguggggagccauccgaaucuagaggaaguagaugucauuugucagagugaaccgcugugguccccgaguugguguaagaaagacaccgaaaguaaagaagaagaaaacuucagugaaacaagaaugggauaauaccgugacugaucuaaccguucaucgggcaacucccgaagaucugguacgccgucaugaaauacacaaaucgaagaauagagcauuaguacacugggaacuccaagaaaaagcuuugaagagaaaauggaggaagcagaaaccagaaacuuuaaaucuugagaaaagaagauugucuaucaugaaggagguaaugcuaaacugcauuagaguuagaaagaaaaaaaggagauaaauaggguucuuuguuuuucuucaauuugauucacguuggagagacucuaguaaucacugcauucuuauucaauaaucuacauguggacuucaaaaaaagcaacagaguggugacuggagucugguuuggugguuugaauuccuguucuacuacuuaccagcugugugacccuaaguaaauuauuuaacuuuucagccugaauuuucucauauuuaaaauuauuauuugcuuguauugcuaugagauuucagugauauaauacuuacaaagugaauagcacaaucuuugcuuauuccucuuuuuguauauaagcugcuauaauaauuuuucucaguaaagugauuagcacaaucuuuucuuauuccucuuuuuauauauaagcugcuauaauuauuuuucucaguuuaacagcagugcuguuagguuacuuugaaaaaaaaaugauguuguaugcuuguauucuuucugaucaauaccagaugcaagauguguuggagaaaucugaucaucuaauagcugcagcaaaagagcuguuuccucguaggcgcacaggguuuccaaauguaacaguggcuccugauuccucucagggucccauugugguaaaucaagacccuaucacccaaucuaucuuuaaugagucugucauagaaccucaggcucuuaaugauguagauggugaagaagaaggaacuguuaauagccagucaggagaaagugagaaugagaaugaguuggauaacucucuaaacucucagucuaacacgaauacagacagguuucuccaacaacuaacagaagagaauuuugaguuaauuaguaaguuguggacugacauucagcagaaaauagcaacccagucacaaauaacuccuccaggaacgccaucaucugcucuuucaucaggggagcaaagagcugcucugaaugcuaccaaugcugucaagagacuccaaaccaggcuucagccugaagaaucuacugagacucuagacucaagcuacguugugggacacgugcugaacucaaggaagcaaaaacagcuguuaaauaaagugaaaaggaaaccgaauuugcaugcucuuuccaagccgaagaaaaacauaucaucagguagcacaaccucugcagacuuaccaaauaggacuaauuccaaccuggauguccucaaacacaugauacaugaaguggaacaugaaauggaagaauaugagcgguggacaggucgcgaggucaagggucugcagagcagucagggucuuacaggcuucacuuugucgcuggugagcucccucugucgccugguucgguaccuuaaagagagugagauccagcuacguaaagaaguagagacaaggcaacaacuggaacaaguauuaggugaucaucgagagcucauugaugcucugacagcugaaauucuucgucuuagagaagaaaacgcugcuacacaggcaagacuucagcaguacauggucacaacagaugagcaacugauaucacucacacaugcuauuaagaacuguccugugauaaauaacagacaagaaauucaggcaucagaaagcggagccacagguagaagaguuauggacaguccagagcguccaguuguaaaugccaaugucucagugccauugauguucagagaggaaguggcugaauucccacaggaagaguugcccguuaaacugucucaggugccagacccuccagauaacaugaaucuggccaagaauuuuccagcacauauuuuugagccagcuguguuguuaacaccacccaggcagaagagcaacuuaaaauucucuccucuucaggacguauugagaaggacuguucaaacucguccugcuccacgacuuccuccaacuguggaaauaauugagaaggaacaaaauugggaagagaagaccuuaccuauugauacagacauucagaauucaagugaagagaaucgucucuucacucagagauggagagucucucacaugggagaagauuuggagaacaaaacucaggcuccuuuuguuaaccucucacagccccucugcaauucccauuccaacacucaacagucaagaagccccacauucucagaagagcucccaguacugggagaugggcagcagcugagaacaaaugagucauuaauacaaagaaaggacauaaugacacgaauugcugauuugacauugcagaauucagcuaucaaggcacauaugaauaauauuauugagcccagaggagagcaaggggauggacuccgggaguugaacaaacaagaaagugcaagugacaugacuucuacuuuuccaguagcacagucucuaacaccagguaguauggaggaacggauugcagaauugaaucgacaaaguauggaggcucguggaaaacuacugcaguugauagagcagcagaaacuuguugguuugaaucuuucuccaccaaugucaccuguucaguuaccucucagagcauggacugguuggucacaaauucaugauuuaaaaacuagaaauaugaagguuuucaguuuucuugauuuugcaaguuuauauuaagccaaaagaaguaucagagcauauauuuuggugccuucaauuuugcacagaaagaaauagcccuaacucacaggauaagugacagaaaugggauuagaaggcagaucuccugauuauuucuauccuaugaugccuauaguuaaucuuuggugucugaguuccuaaauuaucguacaucuaaaugggauucauuauaguguacgguucacuuaggucauaugcugcaacuaagcaugaaauaucugaauguucauuuagaauuucaucagcaaugaauuacaaguuauuauucuguaaaacacuuaaaacauuuucacucaauuaaauuuuuuguuacauuuaggaaugugaaaagcuagaggggauucugaauaauaaaauaguaacugaaaaaauugucauaguauucacauucaaaaagauacugaugaaacgaaguauguaucaaguugcuuuuuaucagaaauugcauuauuaaggcccucaagggacagcuacaugaagaguacugagagauugauuuuggcccaguaaaagagaaggcucuaauugucaggaauagaaaaagcuccauguaccaguaauugauguguucucugagauguucaaacauugguguuugaaggggacucauaugucuuauuucugguugaaguagguuaccuuuaagauaccuuccaauaagacuuuuccccucagaaauuauuuccuuuuugaaauacagacccagaaagcagacucuuuuggaaauugcuggaaaaagaugguaaugcauuuccccagggcucucuguuuauucuaggcuuccucaaaugacaguuuugucuacuguucuucauaguuaugaagccuagagacaacuucugauuagaauaaauaaaucaauuaacuauauaugaacauguacuaugugcgaacauguacuaugugcgaacauguacuaugugcgaacauguacuaugugccugccaugugugggcuugaauacucuagcauuugaguaggggagcaggcaacaaacaaaucaauauuugggauaauaucaguuagugcuaagugcaaggaagaaaaauaaagcagaucagccuuaagaauaauuuuguguuuaaauauacaucuuccauuucaguauuuguguaugguuaaaauaugcuuuuauuuauguuauguaauuuaguccucaacauacuuuaagaggagacagggcuaauauuauaccuauuugaugaauaaguaaacugagguacaaagagguuaugugauuuaucaaguuacaaagcaaguuguggauuugcaacugcguucuuuccuguccagugauuuaucucuaaaguauucuuuuuauaaguaaaauucuuauauuuguuuaaaaaaaagcugcuguggacuauaaugauaaaaauaaaaauaaaccauauaucaugaaggagcaaagaggacaauugagguaucuauuccaggagcagaagccccagaaagcucaaaauguaguacugucucucccgucagcgggauaaauacaagaagaucuuccggggcuacugguaauucuuguucuccacuaaaugccaccucaggaagugggagauucacaccucuuaauccaagagcaaagauugagaaacagaaugaagaaggcugguuugcucuuucuacccauguaucauaagugaagucaagucucacugaguuuguucuuaauaauuuauuacuucccuuucccugcucugacuuuuaaguuuuuauauccuucuuucagauaaaaccuacaaagauccugugaauuaguacuaaugaaacagagaaauaaagcaauuauuuuuugacuuucucaaauaaguuuucaacaaccaacugaccuacagcucccugugaaugaaacuuugacuguagagaaguuaaaguuuuguauuuuaauacuuucuuaaguauuuuaaggguuuuuuuuauuaauacauuuuuaccuuuaucuuuauucaggguuuuuugagguuuaguauaucuuaguugauccauuuauuuauuuauuuuccugaagaacuaauuugcuuugcauguaacuuacaauaaaauuccucugugugauuagagucuggcuuucaggaauauguaacacccacuuuucuuucuuuuuucuugggaagucauugcuguucaucacuuuuuccaucaagugaaauauacagccuuaaaaacaauaggccugggaguguuuguuuauauuugcuuaagcagguaagagugguugcauuuauuauaaaaucuuauguaguuuuuaaaugugaaaaugucaucaauaaugguaaugcaaaucaaauaaauaugauucuagagcucaaaugccuaaaugugguaacauugauuuaaugguauauuuaaugcuucaaacaauuaaauagaaaaaguugcuauuaauuuucccagcccugaauuuaagcagaucuuucaggguagauuucucuuuuuuuuuuuuuuuugagacagagucuugcuuuauugcccaggcuggagugcaguuguauaaucugguucacugccaccucagucuccuggguucaagcaauccucuuaccucagccuccugaguagcuaggauuauagguucaugccaccacgcccagcuaauuuguguauuuucaguagagacgggguuucaccauguuggccaggcugaucucgaacuccugaccucaaaugauccaccugccuugguuucccaaagugccgggauuacaggugugagccacugcacccggcucaggauagauuuuucaggguacccuuuugguucugagauguuuauuucuauuuuaaacuuguuuuuugaaugaucucugcucccuggcucuaugauaggaauucucaaccugagugaacaauucaaacugagauuacuuguguuuagacucauauauuuugauaacauaugacuucuccaguaugccccagaaagcugcuaauaacuugcucaaccugaaauuuacaguuuuccaaauuacagguuggcagagauacuggauugauaacaacauccacaguuaucauauaaucauucuuaugcuguaaacaaaauuauuuugguuagcagaauuuaauaauuaacuguuaacuacauacuaggcaauauuguagccacuuuaugugcuucaugacaccuuaugggauagguacuauuauccucauuuugcagaugaggaaacugagguacaaggagguauuuucucaaggucacacaacuagggagugguggcauuagaaugggaacauaggcagucuuucuccaaagccuaugcugugcugccucuuguuggagaguaaaccuguuuuacaguguguguaguauggaagcagcauaauaauaagaauagcuguuccuuauugagccauuacuguggcagacaccguacuauaagcugugguaucaccauuaucucauuugaaucucauaguagaccuaucaguuagagguauguaaaugcuuccuccucucccagcaccuuuacagaugaggaugcugagcccuagaggugaagaaaguugucuaaugacagagugcuuguaagagguaaagccaagacuugaagcucuuucuugcaguuacuggauuucuccuaauuuacgggaacuaauacaguacaguagcuaaggaugcaaguacugaaaccagaaaucuugccucaaaugccauuucugccacuugagcuguguacuuuggacaaauuaaucuaaucuuucccauuugaaagucagacauaaugucuucccuagaggcuugugaggauuaagugaggcaaguguauguaaaugggcugagaucagagcuuggcucacaacacucaguaaugaucacugccaauuuuuuuugguauauaaauaaauaaauacacuauuucccccauguuuccaauuuuuaagacauuguauagugaauuuauuguaucuuucucagauuaacaauugcacacagugcuugaaauuuagagguauuucaccugaaaagaugucuagagauugaaagaaaacaugcugggcauaugauuugaaaauauaaauaacaugcuauuuaaaaauaaguuuacccuauguuuucuaucuuuucuggcaccuagauauaccauuuaauaaguaauagcaaggauaaucauuuuuuuaagcccuggaaaaucuugauuaaagaggacauuucaguauugcaaauaaaugcaugguauuuguguaacauuguggaaacuaauaaacacaaauuguauuauagcaa

SEQ ID NO: 1157 - RNA, 5989 nt, Homo Sapiens
gggcgucuacgucccaucucaggccgccggcagugaggcuuugggaggaugaggcgguaccggcacgacccccguaccugcucucccucucgcagucuagcaaccgccuuuggcccaaguaaucucggcucgccuaauacagcgugccccgccccuuucccguggcgacgggcggcuaagcaacgggagcgggcucuacucagugguuucgagccccccacgccccaagcggagccagccccuccccuacccggagcagcccgcuggggccgucccgagcggcgacacacuaggagucccggccggccagccagggcagccgcggucccgggacucggccgugagugcugcgggacggaugguggcggcggggcgcgggccagcgcgggcgccgugagccggagcugcgcgcggggcaugcggcugcggcccccggcccucggcccccgcgcuccggccccagccccggccgccggcccccgcggagugcagcgaccgcgccgccgcugagggaggcgccccaccaugccgcgggccccggcgccgcuguacgccugccuccuggggcucugcgcgcuccugccccggcucgcaggucucaacauaugcacuaguggaagugccaccucaugugaagaaugucugcuaauccacccaaaaugugccuggugcuccaaagaggacuucggaagcccacgguccaucaccucucggugugaucugagggcaaaccuugucaaaaauggcuguggaggugagauagagagcccagccagcagcuuccauguccugaggagccugccccucagcagcaaggguucgggcucugcaggcugggacgucauucagaugacaccacaggagauugccgugaaccuccggcccgagcaguggccgaggguaccagauggagguuugaccagggaugcucagugccuuggaaauggauuaacacagugcugcauguggugacaagaccaccuuccagcuacagguucgccagguggaggacuauccuguggaccuguacuaccugauggaccucucccuguccaugaaggaugacuuggacaauauccggagccugggcaccaaacucgcggaggagaugaggaagcucaccagcaacuuccgguugggauuugggucuuuuguugauaaggacaucucuccuuucuccuacacggcaccgagguaccagaccaauccgugcauugguuacaaguuguuuccaaauugcguccccuccuuuggguuccgccaucugcugccucucacagacagaguggacagcuucaaugaggaaguucggaaacagagggugucccggaaccgagaugccccugaggggggcuuugaugcaguacuccaggcagccgucugcaagagggauggaaauaugccugaaugucaacaugauucgggaaaccaaucacagagacccucuaaccuuguuuucccuuaugugcuguggagacuccucuguccccaagcucagaucuacugugggagcugcccacuggcugcccaggagaagauuggcuggcgaaaggaugcacugcauuugcugguguucacaacagaugaugugccccacaucgcauuggauggaaaauugggaggccuggugcagccacacgauggccagugccaccugaacgaggccaacgaguacacugcauccaaccagauggacuauccaucccuugccuugcuuggagagaaauuggcagagaacaacaucaaccucaucuuugcagugacaaaaaaccauuauaugcuguacaagaauuuuacagcccugauaccuggaacaacgguggagauuuuagauggagacuccaaaaauauuauucaacugauuauuaaugcauacaauccacuaucaacuucuccaaacucacagagggagaccucaggcugggucuagcaagauguuguaguauccggucuaaaguggaguugucagucugggaucagccugaggaucuuaaucucuucuuuacugcuaccugccaagaugggguauccuauccuggucagaggaagugugagggucugaagauuggggacacggcaucuuuugaaguaucauuggaggcccgaagcugucccagcagacacacggagcauguguuugcccugcggccggugggauuccgggacagccuggaggugggggucaccuacaacugcacgugcggcugcagcguggggcuggaacccaacagcgccaggugcaacgggagcgggaccuaugucugcggccugugugagugcagccccggcuaccugggcaccaggugcgagugccaggauggggagaaccagagcguguaccagaaccugugccgggaggcagagggcaagccacugugcagcgggcguggggacugcagcugcaaccagugcuccugcuucgagagcgaguuuggcaagaucuaugggccuuucugugagugcgacaacuucuccugugccaggaacaagggaguccucugcucagaaggcagaacugagaugagacgaugagaggaggccauggcgagugucacugcggggaaugcaagugccaugcagguuacaucggggacaacuguaacugcucgacagacaucagcacaugccggggcagagauggccagaucugcagcgagcgugggcacugucucugugggcagugccaaugcacggagccgggggccuuuggggagaugugugagaagugccccaccugcccggaugcaugcagcaccaagagcuuauagccccaucccccagccaccagaggagccugggaccucuccccuugaacaucagcuuuacagcccggcagccagagcuuagcuccccacccugugaccucaggaauccuguucucccagaugucuccgaagacagacaaagaaugugugcaacuugguuuugaugauauaaaguauaauaaugaccauuuaauugaacguuguaguuaagcauuuucacccacuaucugagccaccaccugcuguuagccugaggugggaggagagaggcucaaggugucacuuuuuggcugcucauccauuuucuagaggaggccccuguuaaagaacaaggguucccugggaggagccaucacccuagagccugugccagagccuaguguagacugauucguggguaagugggcagcaggccacgggggaccuggcagaugggcucuaucugagagggagaagggggcuggagcccgagauucuccgggacaguggaucucagcccucgacaugcaucagaauugcccaggaagcccaguccccggaggugugguugggcccagguacugggaguuucucuugaaagcucccuggagaguugaacgugcaggaggguugagauccccgcccugggugaugaccagggcgugauguggggaacuaggacaauguuggggcauugagcucugaccaugggagugugaggagcucugggaggccaggaauacuguuuuaucacccagaaaccucuggcuuggagcagacuccucaccaggcauuagauggaccagagugcagauggauuugucuccuggugucagaauuugaaaggucugcaaccugacauguagacaagacaugccacuaaacucacacaggcuccuccaagaacccuugggcuuccucccauaacaagaagaaaggcagagcagaaacauucccugaggcugaacaucugcagcuggaaagaagugaaagccuucccagguccugcacugucaggagcucagggacaggugugggacuguucuacauuaucugacacccaccuuuaucuccucuuuuccaaagagauugcgucgagugccugcugcuccacucugggaaaccugacaaccagaccugccacagccuaugcagggaugaggugaucacauggguggacaccaucgugaaagaugaccaggaggcugugcuauguuucuacaaaaccgccaaggacugcgucaugauguucaccuauguggagcuccccagugggaaguccaaccugaccguccucagggagccagaguguggaaacacccccaacgccaugaccauccuccuggcuguggucgguagcauccuccuuguugggcuugcacuccuggcuaucuggaagcugcuugucaccauccacgaccggagggaguuugcaaaguuucagagcgagcgauccagggcccgcuaugaaauggcuucaaauccauuauacagaaagccuaucuccacgcacacuguggacuucaccuucaacaaguucaacaaauccuacaauggcacuguggacugauguuuccuucuccgaggggcuggagcggggaucugaugaaaaggucagacugaaacgccuugcacggcugcucggcuugaucacagcucccuagguaggcaccacagagaagaccuucuagugagccugggccaggagcccacagugccuguacaggaaggugccuggccaugucaccuggcugcuaggccagagccaugccaggcugcgucccuccgagcuugggauaaagcaaggggaccuuggcgcucucagcuuucccugccacauccagcuuguugucccaaugaaauacugagaugcugggcugucucucccuuccaggaaugcugggcccccagccuggccagacaagaagacugucaggaagggucggagucuguaaaaccagcauacaguuuggcuuuuuucacauugaucauuuuuauaugaaauaaaaagauccugcauuuaugguguaguucugaguccugagacuuuucugcgugauggcuaugccuugcacacagguguuggugauggggcuguugagaugccuguugaagguacaucguuugcaaaugucaguuuccucuccuguccguguuuguuuaguacuuuuauaaugaaaagaaacaagauuguuugggauuggaaguaaagauuaaaaccaaaagaauuuguguuugucugauacucucuguguguuucuuucuuucugagcggacuuaaaauggugcccccaguggggauugaagcggccguguacuuccucagggaugggacacaggcuggucugauacuccagacugcagcuugucaaguaagcaugaggugcucggggcagugagggcugugcaagggggaacacugagcagauaccuuuggccccuuccagcuuuuacugacagagaguuccaggcuagacaccauaaaaaccaccccuuguucugaggggcugaggcuggaaauagauuguacagacaagcaaggguugaguggugguucccacacgaagucaucucuuaaucaucauuagcaauagcaguucccuuccaaggccuccccucacucccgaaacacuuacgucccaugcaggcccaaugcaaaaaaacacauuugagcuuuuuucccgcagggccaugaaguccccuuaaguucccauaucuaagaugguugacugacccucuccccuuauguacagaagaggaaacugauucucagagaggggaaguggcuugcccgaguguuuguuaggagguuacugaaugacaaacuguuccuaagaccccaucucaugcuggccagagggccagccuccucauuccugcuugcucuuagaaaaucuuucacugaucauuuuuugucacuggaauaacuucaagguuauuaugcuuucauuccaaauggaucuguccucagcucuggacccaauuccccuuacuucauuuuggcaaacacuaagucaaauagugaaaugccugucacuacauagaaccuauuaccuggggcaaauacgaacagauugaguuuccuucaucuuguguaaauaugaugaaacagagaccugguaacuuggugacacuguuaaacccuuuuugggauaaagccaaauguaaaugaaaacauuaaacagauaaauugugguguugagacuuuucugaauugagaaaaauaaauguaauuuuggaagaaa

SEQ ID NO: 1158 - RNA, 7974 nt, Homo Sapiens
aaggaauagaugaagagagaacaugaagggaaaaaaugacaagauuuggaguccggcucuacaccgcccucccgccagacucccggcggcuccuccucccucucccaaacccacucccaaagcuaagugcaggcuuccccguuccagccagaagcgcugcgugagccuccacacguagccgcaggcagcuccuuaaauagcguccgcgcugagcaaacaguccagacguggggcccaggagggcgagcugaggcgaccgcaccgggcgcgcagcggcggcgggucagccggcggccaauagccagggcgcggcccgccccgucgccuccccucggggagccuauaaggccuccgcagcgccccgggcgccugcugcuccgugccuccaccgacgaccucacucagcugcguuacgcgccgcuccggcugccggccgcgcgccuugcccgccggcucccgcccgcaaucggcggcucagggcggacccgggucucugcguucucgcgagaagcgcggcgcugcggggccgugggcgccugagcccgcgcggcccucgagggccgaauauggggggaugcacggugaagccucagcugcugcuccuggcgcucguccuccaccccuggaaucccugucugggugcggacucggagaagcccucgagcauccccacaggugagcaccccgcgguccgccgcugucccgcgaggcucggccggcgggggggcaguucauucauccaccagcccuuccgcggggcuggccagauaaauuauuagucauaacuguagcaacaaaagaaagugauggauuccaucgauuuaugcagucagccaaauauuucaauuauacugugaagaaagaaggaucugucagccaagucuuuucuacaaauaagaggagaacaaggagauaccuagguccuuggucaaggagaagaauggagagguggugauggaauuaauaguauuggagggggccagaaagugagauuaaugaaagaagucauggaacacuaugcugaucaagaugaucugguugucauguuuacugaaugcuuugaugucauauuugcuggugguccagaagaaguucuaaaaaaauuccaaaaggcaaaccacaaaguggucuuugcagcagauggaauuuuguggccagauaaaagacuagcagacaaguauccuguugugcacauugggaaacgcuaucugaauucaggaggauuuauuggcuaugcuccauaugucaaccguauaguucaacaauggaaucuccaggauaaugaugaugaucagcucuuuuacacuaaaguuuacauugauccacugaaaagggaagcuauuaacaucacauuggaucacaaaugcaaaauuuuccagaccuuaaauggagcuguagaugaaguuguuuuaaaauuugaaaauggcaaagccagagcuaagaauacauuuuaugaaacauuaccaguggcaauuaauggaaauggacccaccaagauucuccugaauuauuuuggaaacuauguacccaauucauggacacaggauaauggcugcacucuuugugaauucgauacagucgacuugucugcaguagaugauauucuaguauuuuuuaugucaugcugauuaacauuugaauaaaauuuaaaacaaaaccauacuaaugauaauuuuauuuuuauguuugguguaaaacaaagguccauccaaacguaucaauagguguuuuuauugagcaaccaaccccuuuucuaccucgguuucuggacauauuguugacacuggauuacccaaaagaagcacuuaaacuuuuuauucauaacaaagaaguuuaucaugaaaaggacaucaagguauuuuuugauaaagcuaagcaugaaaucaaaacuauaaaaauaguaggaccagaagaaaaucuaagucaagcggaagccagaaacaugggaauuaagaaaaaauaaacuuuuaaauuaaaauuguuaugccaaauuugggugucucaaacuauuuguuugcguaugcaguagccaacuuagacugugucuauguuuguacguauuuauacauaaagggcuguagaaguuacuuauguuuuucuuuuaauggcuacgaguccacauauuuaaucaaaugaugaaucaagguaagaucaauuuuuuuuaaaugcagauaaaugaauaguaugacuuucauagcagugacuuaaauuuaaauguacacucugaagguugugugugguaaaaguguguuuauuuagacugugggggaaacaggugcucuuacucuccaguuagucacugagcuagauaauacuguaaucccaagaaacgggcauuguaggccuuuuguuuagcccuguuaaugcuucauucuacuaauaaaacucuaguaauaguaaaaaaaaucguguauucaaugaauauuaauugaauaugccaggaacuguguuaagaguaggugauaaaaaggugaagacaugauccauucucaucaggaaauaaucuuaucuacuacgaacccucaugccugugcugcagaagcugaggucccagagggauggauucugacuagauuaggggucuagggauagacagaaaagaggccucugaaaaaccaaacugauguuauuacuaaugauuccauaauuuauucauuggagaauccucuggguccacauucagaacauauuuucuuuaauauuuuucaugauuguaccuagugcuucugucugguauuuuguuugauaguugcuucgaacaaauaugguguggagacacacacugacaacagcaaaaagugcugacugggaccgacagugagggaggggagcccagagggaaguugauaacccaaaugucaucugguaucuccaguuguucauuccuugauauugcugaugauaauguuacaaacuguaccagggaaagcaaacauagucacugccccugguaagaaggcaggggaauaacuaucuuagaaaauuugaugaaaaucaaguuuguaaaauauuaauaccugaaaagucauauacuuacaucuccaacauucauuuaaaacugaguugugggauauguaaguugcauuugugugcauguguauguauguauguauguaugcagaaacauuuugauuuguggauguuuuaugccuuaaaauauuuacuggcuugaaaauauauuuuaacuggcuuaaaauuuuagaggugagcucccugugaauauccguguuaaauugaccauuuugaaauuuaagacaauauauauaucguuucagauauuguuccacuauuuugaucagaaaaguaugcuagagaaccauauuuuacauaaaagaauauauauauuaacauuuuucagucagcagauauuuauuuuaugucaugcccauuucauuuucuuuuucacuguuagggacuuuugccgucaggaugaaaagugugauuauuacuuuaguguggaugcagauguuguuuugacaaauccaaggacuuuaaaaauuuugauugaacaaaacagaaagaucauugcuccucuuguaacucgucauggaaagcugugguccaauuucuggggagcauugaguccugauggauacuaugcacgaucugaagauuauguggauauuguucaagggaauagaguaggaguauggaaugucccauauauggcuaauguguacuuaauuaaaggaaagacacuccgaucagagaugaaugaaaggaacuauuuuguucgugauaaacuggauccugauauggcucuuugccgaaaugcuagagaaaugacuuuacaaagggaaaaagacuccccuacuccggaaacauuccaaaugcucagccccccaaagguguuauuuuuacuuauuuuauuuauuuuuguuuauuuaauauuugauauaguauauugccuaguaguaaaguuucuuuaagggccuuauuugcauuuagcuugguaaaauguugauuuucaucagucaucuguguguuugcguguuuugugugacuugggcaugggucuugugugauagucaacucuugguucuuugagcugauuuauauuuuauggcugacaggugacaaaguuaaaccuaagucccuuucauucuuuuuuuagguuuuuauuucuuuuuaaagggagagaagaggguagaaguagguauaaaauagaauuugauuacaguaagguuuaggugcaccuuauugaguuauuaaucacuaacucuuuuacuauuaaaacagguccaaaaagaaacacauuaccuagugguguuugccacauuugucugguuuggggcaagaauaugagacugguuuucuuuaucugccuuuauaauguaugacucauuugcguguuagccuuuaaacauuagaaaaagaaaggaaugaaacagacuggugaaauauaacuggcagugaauucuugauuaaaaaugugaugcuuucuuugaaagagaaagaagccaaaagagguauaauucauugcacugugucucaaaaauauuucugcuuucaaacaggaauuuuuuccccgaugucuacaucuaggaucaaugagaaagggacaaaaacaguccauucuucuuuuuuucaguugagugucagugcuaucuacuaguuuuguguggugucugaauucauaaucaaaauuugaguuuuuuauuuuaaacuaugcacauuuuauaugaauacuaaaaaugcauguucauaaaugaaauauaaagauagaaauuaauaucuucuauauauuuuuccuaugauuaaauuuacuuuuguaccuaccucuaagauuaauacuguuauuuucuggcauauaggguguauuuauguacauuucuaauagacaugaauuuggaaggcuauuauccacugcuaauuacaauacuucccauuauaacaaugaccucuggcagauuuuugaaaauccugugguauguauuucauacucaacuuuauuauuuuucuauaacuguaagugguuauaaaucaguugguuaauaauaugaaaugugguuagaggcuuuuuaaaaugacauaaggugaaaugcacaucaaaaccacaaugagauacugucucacaccagucagaauggcuauuauuaaaaagucaaaaacaacagauaugggugaggcuacggagaaaagggaaugcuuguacguuguuggucggaaugaauuuggaaagcaguuugaagauuucucaaagaucuuaaaacagagcuaccauuugacccagcaauuccauuacuggguauauagccaaaagaaaguaagucauuugaccaaaaacacacaugaaccuguaucuguucguugcagcacuauucacaguagcaaagacauggacuuaaacuagguguucauuaaugguggauuggauaaagaaaauguguuacauacacaccauagaauacuauacagccauaaaaaagaacaauauuaugucauuuucagcaacauggagagaacuggaggccauuacccuaagugaauuaauggcacagaaaaccaaauacugcauguucucacuuaugagugggagcuaaacauuggguacuugugaacauaaauauaggaacaguagacccuggggaucacuagaggagugagggaguagggagggggacaaggguugaaaaaccaacuaauggguacugugcucacuaccuuggugaugggaucagucauacccuaaaccuuagcaucaugcauuauacacuuguaacaaaccugcacauauacucccugaauccaaaagcugaaauuguuuuuaaaaaguaaauaaaaauaaccccaucgugagucaaggagcaucuguaaaauguguaaaucuauucacuguaagauuacuuaaguuuuaaaauccugagguacaauauuucauaaauaaaaauuuuguauuucauagaaugacauaagcauauucagaaccaggcaaagauuaggcuauauacugugauuucugaaaauuacuauuuuguccacuauacauaaucauuuauaaguugaauaauuucuaaaaugcauaugcuuuauacuuuucagugaaguauuuauaaagauauuuguuuuaauauguacuucuuuuuauaggacuggaaggaaaaguauauaaaccgugauuauucaaagauuuucacugaaaauauaguugaacagcccuguccagaugucuuuugguuccccauauuuucugaaaaagccugugaugaauugguagaagaaauggaacauuacggcaaauggucugggggaaaacaucauguaagauagccguauaucuggugguuaugaaaaugucccaacugaugauauccacaugaagcaaguugaucuggagaauguauggcuucauuuuauccgggaguucauugcaccaguuacacugaaggucuuugcaggcuauuauacgaagcagggauuugcacuacugaauuuuguaguaaaauacuccccugaacgacagcguucucuucguccucaucaugaugcuucuacauuuaccauaaacauugcacuuaauaacgugggagaagacuuucagggaggugguugcaaauuucuaagguacaauugcucuauugagucaccacgaaaaggcuggagcuucaugcauccugggagacucacacauuugcaugaaggacuuccuguuaaaaauggaacaagauacauugcagugucauuuauagaucccuaaguuauuuacuuuucauugaauugaaauuuauuuuggaugaaugacuggcaugaacacgucuuugaaguuguggcugagaagaugagaggaauauuuaaauaacaucaacagaacaacuucacuuugggccaaacauuugaaaaacuuuuuauaaaaaauuguuugauauuucuuaaugucugcucugagccuuaaaacacagauugaagaagaaaagaaagaaaaaacuuaaauauuuauuucuaugcuuuguugccucugagaauaaugacaauuuaugaauuuguguuucaaauugauaaaauauuuagguacaaauaacaagacuaauaauauuuucuuauuuaaaaaaagcaugggaagauuuuuauuuaucaaaauauagaggaaauguagacaaaauggauauaaaugaaaauuaccauguuguaaaaccuugaaaaucagauucuaacuggauuuguaugcaacuaaguauuuuucugaacaccuaugcaggucuuauuuacaguaguuacuaagggaacacacaaagaauuacacaacguuuuccucaagaaaaugguacaaaacacaaccgaggagcguauacaguugaaaacauuuuuguuuugauuggaaggcagauuauuuuauauuaguauuaaaaaucaaacccuauguuucuuucagaugaaucuuccaaaguggauuauauuaagcagguauuagauuuaggaaaaccuuuccauuucuuaaaguauuaucaagugucaagaucagcaaguguccuuaagucaaacagguuuuuuuuguuguuguuuuugcuuuguuuccuuuuuuagaaaguucuagaaaauaggaaaacgaaaaauuucauugagaugaguagugcauuuaauuauuuuuuaaaaaacuuuuuaaguacuugaauuuuauaucaggaaaacaaaguuguugagccuugcuucuuccguuuugcccuuugucucgcuccuuauucuuuuuuuggggggaggguuauuugcuuuuuuaucuuccuggcauaauuuccauuuuauucuucugagugucuauguuaacuucccucuaucccgcuuauaaaaaaauucuccaacaaaaauacuuguugacuugauguuuuaucacuucucuaaguaagguugaaauauccuuauuguagcuacuguuuuuaauguaaagguuaaacuugaaaagaaauucuuaaucacggugccaaaauucauuuucuaacaccauguguuagaaaauuauaaaaaauaaaauaauuuuagaaa

SEQ ID NO: 1159 - RNA, 493 nt, Homo Sapiens
uggacaagaaagcccaauagaaaauuuucuaaacccccaugaagcuagaaaacauggauuaguaugagaugagaaaaccaagacuaagagaggacaggaguaucucuucucuacacaaagccacuugagcccauuugaaauguaacuuuugccauggaagaauucuaccaacacuuuugucgucauuuaaacuacccacuaaauaccuuuucuauuuuuuauacuauuuuuuguuacuguguguguguguguuuuauuuacuuuucuuaauaucauaacaaaacaaaauuaaacaaaaaaauuggguuuuaccaguguugccauccaaaauauagaauacccaguuuaacuugaauuucacguaaacaaaauuauuuaacuggauaucucaucuuuuguuugccaaucuagcaaacuuaguuuuugcaaucaguaauguguugguuccuaaugcugcuauaauaaauuacuauaaacguugugucuuaaaaca

SEQ ID NO: 1160 - RNA, 2911 nt, Homo Sapiens
aauucuaucugacaacagcagcagagggacccacuaucuugugguuucugucaaguuccugauuuucauccguaguugaagaugagcaagaacucuguaacaguguuaccuuggagccuacaaugagagguauuucaaaaugagugaagcaugacucucacagaugaaggccuagacgcaggaauuaccuagcaagccauggccaccaucccucuuacccuccacaauuccagucucccuuuucacagcugguuucauacuauuuacuauuuggucaagccgugcuaaucuguaacccuaagcaaauccaaaucagguccaacuuaugcaagcauauauuagagcugggcuccaaagaauacuggacaucuguaguaccugacauucaagcauuuggcgagaugucaauauuucagagagcacuuuaaauguuuugauuugaaagcuaaugcaguguuucccacuggucaacacgagcaguccagcagagagcaaaaucuauuucccucaacaucaaaugcuacacucaguugcugauccuaucuugccuacagagaaccuaaaagacuggaaaaauuggaucuuuaaugaaaaaacacuugggccacuucaagacgacaaacgcucacugggcaaaacaccuucacugaaaagagaccucauauuaugcaaaaaaaaucuuaaaaggccucugccuucagaaguuacaagaugaucaauucaaccuccacacagccuccagaugaauccugcucucagaaccuccugaucacucagcagaucauuccugugcuguacuguauggucuucauugcaggaauccuacucaauggagugucaggauggauauucuuuuacgugcccagcucuaagaguuucaucaucuaucucaagaacauuguuauugcugacuuugugaugagccugacuuuuccuuucaagauccuuggugacucaggccuuggucccuggcagcugaacguguuugugugcagggucucugccgugcucuucuacgucaacauguacgucagcauuguguucuuugggcucaucagcuuugacagauauuauaaaauuguaaagccucuuuggacuucuuucauccagucagugaguuacagcaaacuucugucagugauaguauggaugcucaugcuccuccuugcuguuccaaauauuauucucaccaaccagaguguuagggagguuacacaaauaaaauguauagaacugaaaagugaacugggacggaaguggcacaaagcaucaaacuacaucuucguggccaucuucuggauuguguuucuuuuguuaaucguuuucuauacugcuaucacaaagaaaaucuuuaagucccaccuuaagucaagucggaauuccacuucggucaaaaagaaaucuagccgcaacauauucagcaucguguuuguguuuuuugucuguuuuguaccuuaccauauugccagaauccccuacacaaagagucagaccgaagcucauuacagcugccagucaaaagaaaucuugcgguauaugaaagaauucacucugcuacuaucugcugcaaauguaugcuuggacccuauuauuuauuucuuucuaugccagccguuuagggaaaucuuauguaagaaauugcacauuccauuaaaagcucagaaugaccuagacauuuccagaaucaaaagaggaaauacaacacuugaaagcacagauacuuugugaguuccuacccucuuccaaagaaagaccacgugugcauguugucaucuucaauuacauaacagaaaucaauaagauaugugcccucaucauaaauaucaucucuagcacugccauccaauuuaguucaauaaaauucaaauauaaguuuccaugcuuuuuuguaacaucaaagaaaacauacccaucaguaauuucucuaauacugaccuuucuauucucuauuaauaaaaaauuaauacauacaauuauucaauucuauuauauuaaaauaaguuaaaguuuauaaccacuagucuggucaguuaauguagaaauuuaaauaguaaauaaaacacaacauaaucaaagacaacucacucaggcaucuucuuucucuaaauaccagaaucuaguauguaauuguuuucaacacuguccuuaaagacuaacuugaaagcaggcacaguuugaugaagggcuagagagcuguuugcaauaaaaagucagguuuuuuuccugauuugaagaagcaggaaaagcugacacccagacaaucacuuaagaaaccccuuauugauguauuucauggcacugcaaaggaagaggaauauuaauuguauacuuagcaagaaaauuuuuuuuuucugauagcacuuugaggauauuagauacaugcuaaauauguuuucuacaaagacuuacgucauuuaaugagccugggguucugguguuagaauauuuuuaaguaggcuuuacugagagaaacuaaauauuggcauacguuaucagcaacuuccccuguucaauaguaugggaaaaauaagaugacugggaaaaagacacacccacaccguagaacauauauuaaucuacuggcgaaugggaaaggagaccauuuucuuagaaagcaaauaaacuugauuuuuuuaaaucuaaaauuuacauuaaugagugcaaaauaacacauaaaaugaaaauucacacaucacauuuuucuggaaaacagacggauuuuacuucuggagacauggcauacgguuacugacuuaugagcuaccaaaacuaaauucuuucucugcuauuaacuggcuagaagacauucaucuauuuuucaaauguucuuucaaaacauuuuuauaaguaauguuuguaucuauuucaugcuuuacugucuauauacuaauaaagaaauguuuuaauacug

SEQ ID NO: 1161 - RNA, 2751 nt, Homo Sapiens
uacuugguaaauauaguuuauuacucuaaauuaauauaauuccccaccugaaacaauaaauguagcaugcaauauauuguucccuguuugaggacagauacugcugcuuauugauauuugcauugcucauacuacccaauaagugaugaugguugaaugaaucaauuaaugaaugagcaugagagaaaagccauaagaacuaaccucccauucuaaucccuaggcccucccuguuucucuuacugaaugccuuuccagauuauugaugcuuugcaugagcaauaaggaaaaaggaagcaauccagaugggagcguagcuguggucagaugucucugaaaugaacaaaguauuugcagauguuucaacaaguggagggguugggcugagucuaggucacaggaaacaacuuccacacguuggggcuacuacaauaaagguaucaucacuuaccagcacaggauucuguuggaaacuugaaaaggcacucaggguuggaaugcuacaugaauccagacuugucucaggaaugccacaagugaucagaacuaaguauagaaauuaaugugguuuguaaaaauagcaauaaggaucauguuuaucugggaaucaaauccuuuaaucacuuuagacagaacuaaugaaacuagaauaaaccaucauugauugugagagucuccuucuaaauuaguuggccuuuggcuuuuagagagcaaaguucaaauuccaguuccugucugacaggaaaguaagucagacacaaaguagauagucuuuuagacuucaaacugaaacagcagggcauaaaggagaucugagucuugaagaaccuuugcuuucagaguugcugaguucaguauugcuaaugcaguauuuuucauugugccuuuugaggcuguucauuuuagauuuaugauauuugccuuuguugguaaauauguucaaauauaaauaaaaauuuuauauuuccuaaugaaaaaauucuaacuucuacucuuuugugcaugcccuguucugaagcauguuaacuuucuagcugcaugguggauaauagggcccauguuuauagaucccaacuguaaagauaauaagacacaaaggcaucuuaaaaagugaucugagcagcuucucguucucgccugccugcccgcucgcucccuugcuugcucgcgcuuucccucacccucuccucgaggauggaggggacucugaccacagccugugacugggaagggagacagaggcagcggcggcucaggggaaacgagauugcaguggugguaguaggaagaugucgggcaaggaugagcagcaggagcaaacuaucgcugaggaccuggucgugaccaaguauaagauggagggugacaucgccaacagggguacuucgguccuugguggaagcaucuagcucaggugugucgguacugagccugugugagaaaggugaugccgugauuauggaagaaacagggaaaaucuucaagaaagaaaaggaaaugaagaaagguauugcuuuucccaccagcauuucaguaaauaacuguguaugucacuucuccccuuugaagagcaaccaggauuauauucucaaggaaggugacuugguaaaaauugaacuugggguccauguggauggcuucaucgcuaauguagcucauacuuuugugguugauguagcucaggggaccaaguaacagggaggaaggcagauguuauuaaggcagcucaccuuugugcugaagcugcccuacgccuggucaaaccuggaaaucagaacacacaagugacacaagccuggaacaaaguugcccacucauuuaacugcacgccaguagaagguaugcugucacaccaguugaagcagcaugucauugauggagaaaaaaccauuauccagaaucccacagaccagcagaagaaggaccaugaaaaagcugaauuugacauacauaaaguguaugcuguggauguucuugucagcucaggagagggcaagcccaaggaugcaggacagagaaccacuauuuacaaacaagacccuucuaaacaguauggacugaaaaugaaaacuucacgugccuucuucagugagguggaaacgcguuuugaugccaugccguuuacuuuaagagcauuugaagaugagaagaaggcucagaugggugugguggagugcgccaaacaugaacugcugcaaccauuuaauguucucuaugagaaggagggugaauuuguugcccaguuuaaauuuacaguucugcucaugcccaguggccccaugcggauaaccaguggucccuucgagccugaccucugcaagucugagauggagguccaggaugcagagcuaaaggcccuccuccagaguucuacaagucgaaaaacccagaaaaagaaaacaaagaaggccuccaagacugcagagaaugucgccaguggggaaacauuagaagaaaaugaagcuggggacaggugggucccaucuccccagcuugcugcuccugccucauccccuucccaccacaccccggacucugugaagcgcaguucuucuucuccaccuaggaccgccagcagagcaggggucucccugcccccaccccaguuccccaacccacucccuuccaacaacaaccagcuccaacugacucuggucuugggaggcgaggcuucccaaccacagaagacuacuuuaaaugaaaaaaagaaauugaauaauaaagucaagagucaaaaaaaaaaaaagugau

SEQ ID NO: 1162 - RNA, 346 nt, Homo Sapiens
agucaucaaccucuuaacauacgagaaguaauuucuaagguaaauaaauuccaaagaucuuuccuucaguaguagugguucuucuggcgcuagaaaaugauuauaggauaacuauaaauucuauaaagcacuuaaguaaauuuguauguucuuacauacacuuaaaaauuuguuugacugggcuugguggcucacgccuauaaucccagcacuuuggaggccaaggcgggcagaucacuugaggucaggaguucaagacaagccuggccaacauggugaaacccugccucuacuaaaaauacaaaaauuagccagguguguagagaugggguuucgcuauguuggc

SEQ ID NO: 1163 - RNA, 697 nt, Homo Sapiens
augaucgcguugcucgagcugccguuggaagcuuagaagcaggugcuaccgugcuagauacaaagcgaucuauuuaaaagcccucugucacgcacgcacacuuacugacgaauccucuggcucucuccuaccaccgcccgguggcggauuccggaauugguucaaaaggccuugaucccgaacacccaggacagagacagaguacuuuuccuaccucuuucgccugcauccuuagaaaacucccguggaugagaagauccccaggccuuuacaagcuguuguuuuacaaaaggagaaacugaggcaggaagaggcgguggaugugcaccagagcacguggugcgucggugcaauagcugagggcacauggaacauucaccaagauaaaccauaugcuggaacauaaaauuuauggaugucacccaugaagcagaguccuucagacccucaaucaaaaacaagucucauuuuacauuaaauuggaggacuaucuggagucucugaccaccgugugacagaaaagagagcagaauuguugcaugauggguaacacucaucaguaaucgcuguuugccaagccaucugggaggagaccaaagagcuauaaaauaaguucaggcacgguggcucaugccuguaaucccagcacuuugggaggccgaggugggugaaucaccugaggucaggaguucgagac

SEQ ID NO: 1164 - RNA, 2201 nt, Homo Sapiens
gggcgggcgaggagcugcgcacgcgcggggacgcgcgcccggccugucgcuguggaaaccgcuaggccagcgcucgccgggaccuggaaucccuguacgccgaggugggagccgguggaccggucccccagccggcccccaccuccgcuucccgguguuugaggguucgggccucccgccggggaguucaccccucgggcucgucaguagggcuguggcugucgccucuuccugcagcgccaggcuccgcccggucucacagucggcuuaggggcuuugcgugcacugcgguuggguggaaaaacccacuccugguuguuuagacguuggccugcagacgaugucauuucuguauuccucuaaggcaggaagucauuaugcaacuuacacauauucaucagauuuccucugacuuacccggacauguacaugggaaugaugugcacugccaagaaaugugggauuagguuucagccuccagcuauuaucuuaaucuaugagagugaaaucaaggggaaaauucgccagcgcauuaugccaguucgaaacuuuucaaaguuuucagauugcaccagagcugcugaacaauuaaagaauaauccgcgacacaagaguuaccuagaacaaguaucccugaggcagcuagagaagcuauucaguuuuuuacgagguuacuugucggggcagagucuggcagaaacaauggaacaaauucaacgggaaacaaccauugauccugaggaagaccugaacaaacuagaugacaaggagcuugccaaaagaaagagcaucauggaugaacuuuuugagaaaaaucagaagaagaaggaugauccaaauuuuguuuaugacauugagguugaauuuccacaggacgaucaacugcaguccuguggcugggacacagagucagcugaugaguucugauaccaaacacucaaaacaugcauugggcuagcagaauauccauguuuauuaccagacugguucuggaagaagcuguaaagaauacuaaauauguuggguuauaggggauugaccauguuacuuuucaaaaccaggacauuuaaagcaucuacuauguaggugcaugaggaguaugggaaaaacagaauaaaggaaucugccuuuaaggagcuuacaaucaugccgggugcgguggcucacgccuguaaucccagcacuuugggaggcugaggcggguggaucaccuaaggucaggaguucgagaccagccuagccaacauggugaaaccucgccucuacuaaaaauacaaaaauuagccaggcgugguggcgggugccuguaaucccggcuacucaggaggcugaggcaggagauucgcuugaaccugggaggcugagguugcagugagccgagaucgcgccauuguacuccagccugggcgaugagcaaaacuccaucucaaaaaaaaaaaaaaaaaaaagcuuacaaucugacuggaagaugucaaaaccugugaaaagcuaauuagcaguauuaagcaacacaaacauuagugccaaaugcaugauaaaggcuaaagaaggccagagcauauauuacuguagaguagaauaguaagggaagacuuuguccuuuaguaaagagauaggagguggccuggcccuugaaauaguaguguuuagguagaugcuuguguaggauuccugauaagagcaacugaaaagaaggagaggggaaguaguaaagggacaagaaacaauuuuuuuuuugaggaaccauaagcaaauuauaguuugacaagacaagauugggggacauauaugguuaccagggaauuaccucuuauguguuauaucuuuauauuauuuaucucuggaaaagaguacccugcaaaauucccuacagcugcaagcagaugucacuugauggacagagggggaauucugccccuccgguaucgggaaauacauacuaaagacauugcgaaacgcugaaccucuucccauaaauaaaagguuuguuuguaaaaugggaaauccacccauaauaaaugaacaauaggcacugccaguuuaggccuguucaugaauggaucugcaagacagcaucuucguuuaacaacauuaucugugauuugauacauuuauccuuauuacaauauuguuuaguugguagaaauucuauguuuucuacaaggaaauugauguuuauuaaauaaaacugaaaauaauua

SEQ ID NO: 1165 - RNA, 71 nt, Homo Sapiens
gacucagaagacagagugccacuuacugaaagguuuuuucucucaguaaguggcacucugucuucugaguu

SEQ ID NO: 1166 - RNA, 125 nt, Homo Sapiens
gcgcucacuaaggcucgguccucuccacgugguccugaccuguccucugugagcaagagaaacaggacugguuuggggguguccugucucaguggacacaggacaccacgguuuucaguacaaca

SEQ ID NO: 1167 - RNA, 651 nt, Homo Sapiens
auguaucuggucacggugcugaggaaccuccucaguauccuggcugucagcucugacuccccccuccacacccccauguacuucuuccucuccaaccugugcugggcugacaucgguuucaccucggccaugguucccaagaugauuguggacaugcagucgcauagcagagucaucucucaugagggcugccugacacagauguuuuucuugguccuuuuugcauguauagaaggcaugauccugacugugauggccuaugacugcuuuguagccaucugucgcccucugaauuacccagucaucgugaauccucaccucugugucuucuucauuuugauguccuuuuuccuuagccuguuggauucccagcugcacaguuggauuguguuacaauucacaaucaucaagaauguggaaaucucuaauuuugucugugaccccucucaacuucucaaacuugccuguucugacagcgucaucaauagcauauucacauauuuccauaguacuauguuugcuuuucuucccauuucagcaauccuuuuaucuuacuauaaaaucgucaccuccauucucaggauuucaucuucagaugggaaguauaaagccuucuccaccugugacucucaccuagcaguuguuugcuga

SEQ ID NO: 1168 - RNA, 551 nt, Homo Sapiens
auggaggacgacucacucuacuugggaggugaguggcaguucaaccacuuuucaaaacucacaucuucucggcccgaugcagcuuuugcugaaauccagcggacuucucucccugagaagucaccacucucaugugagacccgugucgaccucugugaugauuuggcuccuguggcaagacagcuugcucccagggagaagcuuccucugaguagcaggagaccugcugcggugggggcugggcuccagaauaugggaaauaccugcuacgugaacgcuuccuugcagugccugacauacacaccgccccuugccaacuacaugcugucccgggagcacucucaaacgugucaucgucacaagggcugcaugcucuguacgaugcaagcucacaucacacgggcccuccacaauccuggccacgucauccagcccucacaggcauuggcugcuggcuuccauagaggcaagcaggaagaugcccaugaauuucucauguucacuguggaugccauggaaaaggcaugccuucccgggcacaagcagguaga

SEQ ID NO: 1169 - RNA, 757 nt, Homo Sapiens
acaagacaggugaaugccuucaucaugacugccagagagggaggaggccaaccuggcaccaccauggagguccucaaaucuaccacccuggcagaggcgagcugugagauggcccuggcuuuugugggaccaccuucugaaggucaucuggaacuggaugagaagugcucaaggauauaagaugagaaacagccuuaaaaaggugaaguaauuugaccaagguauaggcaaaacaguggagccaauauuugaacacgagucugucuaaaguggccguauaugaaaagcagguuccccugaucugccugggcaguuucaucccugcagagcugggaugaaugacaaauucaaaaccucucuuuacacguggauuugaacaagaaaucuccaggaagcagguuugaagagaugggauccagacaccuccuaagccucuuguuuucaaauuugucugcauguuggaaucaccuggccaucuuuuuaaaacugcugaugccuguaugugcccccuccucccaagauucugauuucauuggcucagggugaagccucagcaucauaauuuuuuuuuuuuaauagagucuugcccuguugcccaggcuggagugcaguggugcaaucucggcucacugcaaccucugccucccagguucaggcaauucucaugccccagccuccugaguagcuggaaaugcaggugcacaccaccacacccagcuaauuuuuuguauuuuuaguggagauaggguuucaccau

SEQ ID NO: 1170 - RNA, 2787 nt, Homo Sapiens
cuggaucugcgggucggucucggcgggcggauuacuccucgcccacaaccucgaggccccggggucaaccgcgcccuccgggccggcaacccaggguuuagucagauuccuccugacccaccgcuucugggaaagaggcgccucccgucaggaggaugcugaguuccucaugacuggaccagugaguguccacucccuggucccuggcgagagaggcgggacccccacgcccuccuggcgcucuuugcagagauguuccucaggcccaauccgggauuugggaugucugugcgugcuguggagcagagaguuugcaacauggucucacuuugucacccaggcuggaaugcauuggcaugaacacgucucacugcagccucaaccucccaggcugaagugacccuccaacucugcuuucacaguagcugugauaugguuuggcuguguccccacccacaucucaucuuaaaacccagugggaggagggauguucucccuuggaaccaggccaccauucuaugaggaagccaagcagccacaugaaaaggccguauguagacauucuaacugacaauacuagcuaagguuccagcuacucaccagcaucaacuaucagacaaauuccuaucauuaauagaagaaacuauaugccaagugacagccagugaagcagaacaacaggagaagacggcgaagccagaagcaaauuauuucaauggaagaaaaauccccucuccagguuguuuucauugaaaagagagaagaaucaaauagacgcaauaaaaaaugauaaaggggauaucaccaccaaucccacagaaauacaaacuaucaucagagaauacuacaaacgccucuacgcaaagaaacuagaaaaucuagaagaaaugguuaaauuccucgacacauacacccucccaagacuaaaccaggaagaaguugacucucugaauagaccaauaacaggcucugaaauuguggcaauaauuaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauauccuugaugaacauugaugcaaaaauccucaauaaaauacuggcaaaccaaauccagcagcacaucaaaaagcuuauccaccaugaccaagugggcuucauuccugggauguaaggcugguucaauauaugcaaaucaauaaauguaauccagcauauaaacagaaccaaagacaaaaaccacaugauuaucucaauagaugcagaaaaggccuuugacaaaauucgacaacccuucaugcuaaaaacuuucaauaaauuagguauugaugggacguaucucaaaauaauaagagcuaucuaugacaaacccacagccaauaucauacugaaugggcaaaaacuggaagcauucccuuugaaaacuggcacaagacaaggaugccuucucucaccacuccuauucaacauaguguuggaaguucuggccagggcaauuaggcaggagaaggaaauaaaggguauucaauuaggaagaggaagucaaauugucccuguuugcagaucacaugauuguauaucuagaaaaccccauugucucagcccaaaaucuccuuaagcugauaagcaacuucagcaaagucucaggauacaaaaucaauguacaaaaaucacaagcauucuuauacaccaauaacagacaaacagagagccaaaucaugagugaacucccauucacaguugcuucaaagagaauaaaauaccuaggaauccaacuuacaagggaugugaaggaccucgucaaggagaacuacaaaccacugcucaaugaaauaaaagaggauacaaacaaauggaagaauauuccaugcucauggguaggaagaaucaauaucaugaaaauggccauacugcccaagguaauuuauagauucaaugccauccccaucaagcuaccaaugacuuucuucauagaauuggaaaaaacuacuuuaaaguucauauggaaccaaaaaagagcccgcauugccaagucaaucccaagccaaaagaacaaagcuggaggcaucacgguaccugacuucaaacuauacuacaaggcuacaguaaccaagacaguaugguacugguaccaaaacagagauauagaucaauggaacagaacagagcccucggaaauaacgccgcauaucuacaacugucugaucuuugacaaaccugagaaaaacaagcaauggggaaaggauucccuauuuaauaaauggugcugggaaaacuggcuagccauauguagaaagcugaaacuggaucauuuccuuacaccuuacacaaaaauuaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuuugcaaccuacucaucugacaaagggcuaauauccagaaucuacaaugaacucaaacaaauuuacaag

SEQ ID NO: 1171 - RNA, 62 nt, Homo Sapiens
caguguuacagcucuuuuagaauuugucuagcaggcuuuccgguuuuugcuggaaagcuccc

SEQ ID NO: 1172 - RNA, 836 nt, Homo Sapiens
auuuuucuugggucuucucuacagcugacaggccaacucaaccuacugccaaccaagaccugacuggcacgaggaaaggugcaauaaugaagaguuuucuucuaguugucaaugcccuggcauuaacccugccuuuuuuggcuguggagguucaaaaccagaaacaaccagcaugccaugagaaugaugaaagaccauucuaucagaaaacagcuccauaugucccaauguauuaugugccaaauagcuauccuuauuauggaaccaauuuguaccaacguagaccagcuauagcaauuaauaauccauaugugccucgcacauauuaugcaaacccagcuguaguuaggccacaugcccaaauuccucagcggcaauaccugccaaauagccacccacccacugugguacgucgcccaaaccugcauccaucauuuauugccauccccccaaagaaaauucaggauaaaauaaucaucccuaccaucaauaccauugcuacuguugaaccuacaccagcuccugccacugaaccaacgguggacaguguagucacuccagaagcuuuuucagaguccaucaucacgagcaccccugagacaaccacaguugcaguuacuccaccuacggcauaaaaacaccaaggaaauaucaaagaacacaacgcaggacuugcugaaaccaaauuacuacuucacacucuccuucagccauuugucugccuucagucaacagaaaaugugauuuucacagauucagcucuucucuccuuacauuuuacauucaugccacauucaauauuuugauucuugcacaauaaagccaacugauugcaa

SEQ ID NO: 1173 - RNA, 126 nt, Homo Sapiens
guguuguacaaaaggagagaagguuagcacuccccuugacaaggauggaagaggcccuugggccugacaacaugcauaugguuaaggcauugccaccuacuucguggcauccaaccaucguuuuua

SEQ ID NO: 1174 - RNA, 2274 nt, Homo Sapiens
gagggugcauaaguucucuaguagggugaugauauaaaaagccaccggagcacuccauaaggcacaaacuuucagagacagcagagcacacaagcuucuaggacaagagccaggaagaaaccaccggaaggaaccaucucacuguguguaaacaugacuuccaagcuggccguggcucucuuggcagccuuccugauuucugcagcucugugugaaggugcaguuuugccaaggagugcuaaagaacuuagaugucagugcauaaagacauacuccaaaccuuuccaccccaaauuuaucaaagaacugagagugauugagaguggaccacacugcgccaacacagaaauuauguaaguacuuuaaaaaagauuagauauuuuguuuuagcaaacuuaaaauuaaggaagguggaaauauuuaggaaaguuccagguguuaggauuacaguaguaaaugaaacaaaacaaaauaaaaauauuugucuacaugacauuuaaauaugguagcuuccacaacuacuauaaauguuauuuuggacuuagacuuuaugccugacuuaaggaaucaugauuugaaugcaaaaacuaaauauuaaucugaaccauuucuuucuuauuucaguguaaagcuuucugauggaagagagcucugucuggaccccaaggaaaacugggugcagaggguuguggagaaguuuuugaagagguaaguuauauauuuuuuaauuuaaauuuuucauuuauccugagacauauaauccaaagucagccuauaaauuucuuucuguugcuaaaaaucgucauuagguaucugccuuuuugguuaaaaaaaaaaggaauagcaucaauagugaguuuguuguacucaugaccagaaagaccauacauaguuugcccaggaaauucuggguuuaagcuuguguccuauacucuuaguaaaguucuuugucacucccaguaguguccuauuuuagaugauaauuucuuugaucucccuauuuauaggcugagaauucauaaaaaaauucauucucugugguauccaagaaucagugaagaugccagugaaacuucaagcaaaucuacuucaacacuucauguauugugugggucuguuguaggguugccagaugcaauacaagauuccugguuaaauuugaauuucaguaaacaaugaauaguuuuucauuguaccaugaaauauccagaacauacuuauauguaaaguauuauuuauuugaaucuacaaaaaacaacaaauaauuuuuaaauauaaggauuuuccuagauauugcacgggagaauauacaaauagcaaaauugaggccaagggccaagagaauauccgaacuuuaauuucaggaauugaauggguuugcuagaaugugauauuugaagcaucacauaaaaaugaugggacaauaaauuuugccauaaagucaaauuuagcuggaaauccuggauuuuuuucuguuaaaucuggcaacccuagucugcuagccaggauccacaaguccuuguuccacugugccuugguuucuccuuuauuucuaaguggaaaaaguauuagccaccaucuuaccucacagugauguugugaggacauguggaagcacuuuaaguuuuuucaucauaacauaaauuauuuucaaguguaacuuauuaaccuauuuauuauuuauguauuuauuuaagcaucaaauauuugugcaagaauuuggaaaaauagaagaugaaucauugauugaauaguuauaaagauguuauaguaaauuuauuuuauuuuagauauuaaaugauguuuuauuagauaaauuucaaucaggguuuuuagauuaaacaaacaaacaauuggguacccaguuaaauuuucauuucagauaaacaacaaauaauuuuuuaguauaaguacauuauuguuuaucugaaauuuuaauugaacuaacaauccuaguuugauacucccagucuugucauugccagcuguguugguagugcuguguugaauuacggaauaaugaguuagaacuauuaaaacagccaaaacuccacagucaauauuaguaauuucuugcugguugaaacuuguuuauuauguacaaauagauucuuauaauauuauuuaaaugacugcauuuuuaaauacaaggcuuuauauuuuuaacuuuaagauguuuuuaugugcucuccaaauuuuuuuuacuguuucugauuguauggaaauauaaaaguaaauaugaaacauuuaaaauauaauuuguugucaaaguaa

SEQ ID NO: 1175 - RNA, 848 nt, Homo Sapiens
ucuuagcuccugcaccacaguuccucgcuguccaccccaggcuuccggacuggaaggacagugggacagugacgggggauaaaagaagccuggugaggccaggagucacugccugcagaaccccagcccgacuuucccugcgcacugggauccugcuggaaccucagcugcaacaugagcuccgcagccaggucccgccucacccgcgccacccgccaggagaugcuguucuuggcguugcugcuccugccaguuguggucgccuucgccagagcugaagcugaagaagauggggaccugcagugccugugugugaagaccaccucccagguccgucccaggcacaucaccagccuggaggugaucaaggccggaccccacugccccacugcccaacucauagccacgcugaagaaugggaggaaaauuugcuuggaucugcaagcccugcuguacaagaaaaucauuaaggaacauuuggagaguuagcuacuagcugccuaagugugcacuuucaaucuaacugugaaagaaucuucugauguuuguauuauccuucuuauauuauauuaacgaaauaaaucaaguugugguauagucaaucuauuucuuaauaauacugcaaaaauaaugcugacacaucacaauuucauauuuuaaaauuuccagaauuuuaagcaaaaagcauuaugaaggaaggcuugguuuaauaaagacugauuuuguucaguguuauauguuagcugauacauauuuguucauuuaugugauugcaguacuuuauagcuacauauuuaccuugaauguuacaauuagcuugccaauaaauauuaguagcucuuaagcau

SEQ ID NO: 1176 - RNA, 3996 nt, Homo Sapiens
gcugccuugcacuuagggaagguucacaugccucaaggaucucucucucucagauuucuugacuuucccucagucuucaguauaguccuccucugugccuggugaagaccugugguaaagugcuggcagagaggaagcuaaaucacguaaaaauuaagaaacagcucagcguuucacagcuaugggaauaaugucaccaauagcauaagaauuaaugucuacuaugaugcugaaauaaauaaacugguaaaacuacucugcugucuaaauccccaaguuacaaauuuacagagcugccggcuuccccuugaaggaauaggaguagaccugcugaacuaucacaugagagaagaggcccaaaagcuugcacacuacagucaagcuggcccuuaaagagauggaccuagaagaugcugagccagauguacucaauuacuucuccaaaauucaucaauuagagaacugcuucuugcugccgccauaugaagaaggacguguucgcuuccccuuccuccaugauuguaaguuuccugagaccucgccagccaugcugaacugagccaugcuauugcuuuagagaagcuucuccuugucaucugcucccuagccuggauaacacauggaacacuugaaacagaauaucuagcugagccccagaccuagaaggcaaagggagcagacagcuggcaagcucugucccaauaugcuucccugaaagaggcgaggaaauuucagaagaugcaaugccugaauggcucacuuugcaggaaaacagaagaaccaagagugaacaggaaaccuacagaauaggagaaaauuuuugcaaucuacucaucugacaaaaggcuaauauccagaaucuacaaagaacucaaacaaauuuacaagcacaaaacgaacaaccccaucaacaagugggcaaaggacaugaacagacacuucucaaaagaagacauuuaugcagccaacagacacaugaaaaaaugcucaucaucacugcccagcuaaaucuugacuucuauugaagaagugaaggauggauuuuguaagccuaccagcagccaaaggagacuaagaggagucauucaggaauaugaggguuaugaagacaguggugucccagaaaccaaggagaagaggauguugcaugaagaaggagaugaugguuucacuuugguuacauuuauccaaaugccccguccaacucuucagugucccuaguaaaaucugguauagagauggacacuguuuuuuaggugaggccugcugaguguggagaguugugaaaaauuuuucccuuaaauugagaauguuuuaaauaaugcagccuauguuuucuuuaaguaacaaggccaucccacugacucacacugaucuuguucucagcaaaaaacucccugcucuuccucauauuaauugccauaaaaacaagucacuucuaucaugcauuuggcucauugaguuaugaaaauauguagguauuucguuucuuuuuauguaaauuuaugcugguuuuaguccaucauuugagcaggacuguacugccgcaaucucggcucacugcagccucccugccugauucuccugccucagccugccgagugccugggauugcaggcgcccaccgccacgccugacugguuuuuguauuuuuugguggagacgggguuucgcgguguuggcugggcuggucucagcuccugaccucgagugaucugcccgccucggccucccgaggugccgggauugcagacgggagucucgcuuacucagugcucaauguugcccagguuggagugcaguggcgugaucucggcucgcuaaaaccuccaccucccagccaccugcccuggccucccaaagugcugagauugcagccucugcccggcugccaccccgucuaggaagugaggagcaucucugccuggccgccuauugucugggaugugaggagccccucugcccggugcccagucugggaagugaggagcgccucuucccggccgccaucccgucuaggaagugaggaacaucucugccuggccgcccaucaucugggaugcgaggagccccucugccuggcugcccagucugggaagugaggagcgccucuucccgggccaucaucccgucuaggaagugaggaacgucucugccuggccacccaucaucugggauguggggagcgccucugcccggccgcccugucugggagaugaggagcaucucuacccagccaccacccagucugggaagugaggagcgccucugcccggccgccaccccgucugggaggugaggagcgucucuacccggccgccaccccaucugggaggugaggagcgucucuaccuggccgccaccccgucugggaggugaaggccacccacggcuacccauggaccaaucagcacauacuuucucuccucugaggcccauaaaagcccugcgcucagccagaacuaagcagauaucuggaugaccagcugcagaaaggagcuacucauuccagggccuccucucugcugagagcagcagacaucaggaugaccagcugcagagaggagcuacccacuccagggccuccucuuugaugagagcugcagagacagugggacaaccugucugcagagaaaagguuauaaacaucuugagagcaaggacuaaaucuuacuuaucuuuauuaagaacuaacaguggaacacacagaaaauccauggauauacugucagacugucaccaaauauacauucaacauuuuucuuacuugugagacugauuuugagaaaauuugcuaucacagaaucacuaaacuuuagagcagguaaagacuccugcaaugauuuuauuuacuugcuauauuuuaccaauaagaaaaccgaggcauagagaaguugagacuuucuacacaccagugccuagucuucaugaugcuuaugcccaacccugaguccuuuccucuauauaauccugccucauuacauuucugaaagacggagaaguuuuauaacaacaagaugaaagacuuuggaaguuuacagaggcuaucaggcuaucuucucauagacccaucauuuguccagcagaaagagacuaaaaaggcuuauaagaauaucaagaccccaauguuguacuuaugguuugacuuuauaucucugacuaauuacagaauuugauuauuaaaaaagguuuuuuauaucaaauagagaaugcugccgggacugacccaugucuuuucugaaucaccucugacauaugaccaggaauacaacauguuuaagaccacagaacaucugcauagauaaaucccaguugacagaacuguuuaagagaugaaugugcucccaacugggauuacggucacaguauuuaucuauaucaacuuucauguuacuucacuggcaaauugggagcuuuggaggauaagaggauaacauaugaucgggagaaucuauuuucugcucugaaggcuguaaauuucguugaaugauggaugcaaagauggaagacagauggauagaggaaaagacagaaucagauacuggaugaguuaguacugcugccugugcuucagagcugucuuauuaccacaaggccggcaagcaucaauguccccacaucccccucugccucccccugaaauguaccgauuuauaugaaaauuaagauuacaaauuaaagccuggcuauccuggaguuuuccaguucaucagccauccaauaaaaaugaugucaagccuguaugcauaauucccggaagauuacuuucguccuuacagcuaagcccugucccugauaugaaagaucucuauccacuuuuauugaaauaaagaacuaacaucauaaucccaauauugagguauaaucuucauuaucuccugacccucuugagguucccccaaucuauauuacuucagauuugguuuauguguaauccuuauguauuuacuuuuauugagauaggauuaaaaacuaaaaaaaaagcuucaaaaaauc

SEQ ID NO: 1177 - RNA, 66 nt, Homo Sapiens
ucuguaccucagcuuugcucccaaccaaccacuuccacauguuuugcugguagagcugaggacagc

SEQ ID NO: 1178 - RNA, 4766 nt, Homo Sapiens
ucaguagcugaggcugcgguuccccgacgccacgcagcugcgcgcagcugguucccgcucugcagcgcaacgccugaggcagugggcgcgcucagucccgggaccaggcguucucuccucucgccucugggccugggaccccgcaaagcggcgauggagcggaggucgcggaggaagucgcggcgcaacgggcgcucgaccgcgggcaaggccgccgcgacccagcccgcgaagucuccgggcgcacagcucuggcucuuucccagcgccgcgggccuccaccgcgcgcugcuccggaggguggaggugacgcgccaacucugcugcucgccggggcgccucgcggucuuggaacgcggcggggcgggcguccagguucaccagcugcucgccgggagcggcggcgcccggacgccgagagaaaguagucacugcuccaacuuugggagucguucucagugaugggauuuuaccuuggccuucaguugcacuucucccacauucucaucgaagugggggaaauaguugcccgcguucuuuaaaauuuugcccaucuguggagugaagaaauugguaucuugcugcgaguuuauuuugcguuuaacuacuggacguuugcguuccuuuuucgaaugcauuaaauuaggaaaaaacaugaagauacauuccguggaccaaggagcagagcacaugcugauucucucaucagauggaaaaccauuugaguaugacaacuauagcaugaaacaucuaagguuugaaagcauuuuacaagaaaaaaaaauaauucagaucacauguggagauuaccauucucuugcacucucaaaagguggugagcuuuuugccuggggacagaaccugcaugggcagcuuggaguuggaaggaaauuucccucaaccaccacaccacagauuguggagcaccucgcaggaguacccuuggcucagauuucugccggagaagcccacagcauggccuuauccaugucuggcaacauuuauucauggggaaaaaaugaauguggacaacuaggccugggccacacugagaguaaagaugauccaucccuuauugaaggacuagacaaucagaaaguugaauuugucgcuugugguggcucucacagugcccuacucacacaggaugggcugcuguuuacuuucggugcuggaaaacaugggcaacuuggucauaauucaacacagaaugagcuaagacccuguuugguggcugagcuuguuggguauagagugacucagauagcauguggaagguggcacacacuugccuauguuucugauuugggaaaggucuuuuccuuugguucuggaaaagauggacaacugggaaaugguggaacacgugaccagcugaugccgcuuccagugaaaguaucaucaagugaagaacucaaacuugaaagcuuaguggugaccucaaguaacaaaaucuacucauuucuuguaggaaaacgaacagaguuauuuccuuaagcagcauaaagccauaccucagaaaaggaguuaauaaugauugcuggagggaaucaaagcauuuugcucuggauaaagaaagagaauucauauguuaaucugaagaggacaauuccuacucugaaugaagggacuguaaagagauggauugcugauguggagacuaaacgguggcagagcacaaaaagggaaauccaagagauauuuucaucuccugcuugucuaacuggaaguuuuuuaaggaaaagaagaacuacagaaaugaugccuguuuauuuggacuuaaauaaagcaagaaacaucuucaaggaguuaacccaaaaggacuggauuacuaacaugguuacugcuaucuuuagguuuucuuuuugcaggugcuccaaacaugcuuccuuuauuuuuauuuuuauuuuuuuggaaacggagucucgcuuuguugcccaggcuggaguccaguggugcgaucucggcuuacugcaugcuucguuuauuaauuuaguuuuucuuaauguaguuuuuauuauuucccuauuuuauuuuacugguugauauggggauacuacuuucuguucuacucuccauuuuuuucucucugggucgcacuguaguuccuucuuucuuucucucuccuucccuccuccccuccuuccucccucuagccucaccccauuuuuuaaucucucucuguguucauaucccucuucucuuucccucucaaucuuugaucucucacccuuccuccuuucagcucccgcacuugcucuguuugccacaacuagcauuuucuauuucagcugcaaguuuucucauucgcuccuuucuuucaaggaaagauggaaaguucaguucucuuaacuuuggcagaaccacagccccacuggggguccgaggugaaaugguucccuaauuauguaccuuuauugggacccuacaacacuuagugcugccuguaucaacaacccagaaacuacucaguggacuauuucaucaacauuuguuagagcucauuuucuuuuguuuucuaaaauccuccugugggggccaguuuaacuuucuuucuguaagauucugagucauugcuacuaaauacaaccauggaaagauuaccaaaaauagaagcccuuuugugcgucugugaagggaagggauuggaucaguucaucauuaagggcuccuucuguuuacuaauuauaccuugauugugccacaaaaagaacauaugauaaccaccugccucaaagauaaucugcucaaaagacuuccauuucauucuccaccccaagaagcuuuagaaauuuucuuccuucucccagaauguccuaugaugcauauuuccaacaacugggagagccuugugguuccauuugcaaagguuguuuguaaaaugagugaccagucuucacugguucuggaagaguauugggcaacucugcaagaauccacuuucagcaaacugguccagauguuuaaaacagccgucauaugccaguuggauuacugggaugaaagugcugaggagaaugguaauguucaagcucuccuagaaauguugaagaagcugcacaggguaaaccaggugaaaugucaacuaccugaaaguauuuuccaaguagacgaacucuugcaccgucucaauuuuuuuguagaaguaugcagaagguacuuguggaaaaugacuguggacgcuucagaaaauguacaaugcugcgucauauucagucacuuuccauuuaucuuuaauaaucugucgaaaauuaaacuacuacauacagacacacuuuuaaaaauagagaguaaaaaacauaaagcuuaucuuaggucggcagcaauugaggaagaaagagagucugaauucgcuuugaggcccacguuugaucuaacagucagaaggaaucacuugauugaggauguuuugaaucagcuaagucaauuugagaaugaagaccugaggaaagaguuauggguuucauuuaguggagaaauuggguaugaccucggaggagucaagaaagaguucuucuacugucuguuugcagagaugauccagccggaauaugggauguucauguauccugaaggggcuuccugcaugugguuuccugucaagccuaaauuugagaagaaaagauacuucuuuuuugggguucuauguggacuuucccuguucaauugcaauguugccaaccuuccuuucccacuggcacuguuuaagaaacuuuuggaccaaaugccaucauuggaagacuugaaagaacucaguccugauuugggaaagaauuugcaaacacuucuggaugaugaaggugauaacuuugaggaaguauuuuacauccauuuuaaugugcacugggacagaaacgacacaaacuuaauuccuaauggaaguagcauaacugucaaccagacuaacaagagagacuauguuucuaaguauaucaauuacauuuucaacgacucuguaaaggcgguuuaugaagaauuucggagaggauuuuauaaaaugugcgacgaagacauuaucaaauuauuccaccccgaagaacugaaggaugugauuguuggaaauacagauuaugauuggaaaacauuugaaaagguacaucaucaagucuaaguugauuaaauucaguuuuccuuccuauuuccucaauaacuuuuuuuuguauuuucucuagaaugcacguuaugaaccaggauauaacaguucacaucccaccauagugauguuuuggaaggcuuuccacaaauugacucuggaagaaaagaaaaaauuccuuguauuucuuacaggaacugacagacuacaaaugaaagauuuaaauaauaugaaaauaacauuuugcuguccugaaaguuggaaugaaagagacccuauaagagcacugacauguuucaguguccucuuccucccuaaauauucuacaauggaaacaguugaagaagcgcuucaagaagccaucaacaacaacagaggauuuggcugaccagcuugcuuguccaacagccuuauuuuguuguuguuaucguuguuguuguuguuguuguuguuguuucucuacuuuguuuuguuuuaggcuuuuagcagccugaagccaugguuuuucauuucugucucuagugauaagcaggaaagagggaugaagaagaggguuuacuggccgguuagaacccgugacuguauucucucccuuggauaccccuaugccuacaucauauuccuuaccucuuuugggaaauauuuuucaaaaauaaaauaaccgaaaaauuaa

SEQ ID NO: 1179 - RNA, 74 nt, Homo Sapiens
aaucuaaaggaccuguacuagguuuaacauguugagcauuacucauguuagaccuaguacacguccuuuagauu

SEQ ID NO: 1180 - RNA, 6823 nt, Homo Sapiens
aaaaagagaaacuguugggagaggaaucguaucuccauauuucuucuuucagccccaauccaaggguuguagcuggaacuuuccaucaguucuuccuuucuuuuuccucucuaagccuuugccuugcucugucacagugaagucagccagagcagggcuguuaaacucugugaaauuugucauaagggugucagguauuucuuacuggcuuccaaagaaacauagauaaagaaaucuuuccuguggcuucccuuggcaggcugcauucagaaggucucucaguugaagaaagagcuuggaggacaacagcacaacaggagaguaaaagaugccccagggcugaggccuccgcucaggcagccgcaucuggggucaaucauacucaccuugcccgggccaugcuccagcaaaaucaagcuguuuucuuuugaaaguucaaacucaucaagauuaugcugcucacucuuaucauucuguugccaguaguuucaaaauuuaguuuuguuagucucucagcaccgcagcacuggagcuguccugaagguacucucgcaggaaaugggaauucuacuugugugggugugaauaucuacaggaacucuuuauugucuauaaauagacuuuauuuuaaacagaaaaccaguaauuaaaaauuauuucugcuuguguugguugucauugggaaguauuuuguuuaaaugagauaaaauauuaaaaguauacaguuuggucucuuucuucccacccagguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccuggagaaaaaagugggcuucgggaugcuggggaaucugggcucuggcuaaguuugccuccgugagagaugcagcuguagacguuguagggagguaagaccucuuaagaaucaggaaaagauuuagcaguguccucugucaaaacacggccccacuccaaauaaagcaucuucucuuuuagagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaaggguuacacguaucugggaagcagccuaguucgaauuuaguugcaggugugccuaucuccaaagucaagcucuuaacacccuguacaaccuaaagacuagugccauuuguauauauuccacauuaguuuuaaaaaaaaaucagaaaugccuguguucucuuuuguagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggaagaagcuaaccaacuaauaaucuguauaagauaccuauuuugcccauucucuuuggcuuaagauaaguauaauuuaaaauuuuauguauuuauaagauucucuaaaaauuaaagauauacuucacaauaagugauaugcuuaugcacaaccuuagacuuuaucauccuuuuacuucagggguauuuauugacacauuacaggaacugaagauacaguggaggguaaaacaaauaugauaucugcaaagccaaggaaucuagugcagaacacauacauuacugucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccagaucuuagaaucaguggcuccuugggggaacucuucugaaauagcuauugauauacccucuauuuagauacacugcauuucucucccuaaaagcuauagcucccuaaaagcaagcuguagacuugcauuaauggcauccuuuucaucuucaaacccacuugugaauuuguuucuuuucucuacuaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacagcacacaaacacacacacacccucuaccucacagaaccuuggaaagagugaaacacugucuggaaagcauuuugaguucugcagaaaagacugccuuaaacaucuaaaguuauguuccuaguuaucuucauauuucuucucucccacacaaguacuuaaauuuuaguagcaaaagcaguuaguugucccugaucaucacugagugggcugaguauuuuguuuuguugugagauugucucaaauuuuggcuuuaucacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaaaacuggaauuaaaaggaaagucaagaagaaugaacuaugucgaugcacaguaucuuuucuuucaaaaguagagcaaaacuauagguuuugguuccacaaucucuacgacuaaucaccuacucaaugccuggagacagauacguaguugugcuuuuguuugcucuuuuaagcagucucacugcagucuuauuuccaaguaagaguacugggagaaucacuagguaacuuauuagaaacccaaauugggacaacagugcuuuguaaauuguguugucuucagcagucaauacaaauagauuuuuguuuuuguuguuccugcagccccagaagaaauuagggguuaaagcagacagucacacugguuuggucaguuacaaaguaauuucuuugaucuggacagaacauuuauaucaguuucaugaaaugauuggaauauuacaauaccguuaagauacaguguaggcauuuaacuccucauuggcgugguccaugcugaugauuuugcaaaaugaguugugaugaaucaaugaaaaauguaauuuagaaacugauuucuucagaauuagauggcuuauuuuuuaaaauauuugaaugaaaacauuuuauuuuuaaaauauuacacaggaggcuucggaguuucuuagucauuacuguccuuuuccccuacagaauuuucccucuuggugugauugcacagaauuuguauguauuuucaguuacaagauuguaaguaaauugccugauuuguuuucauuauagacaacgaugaauuucuucuaauuauuuaaauaaaaucaccaaaaacauaaacauuuuauuguaugccugauuaaguaguuaauuauagucuaaggcaguacuagaguugaaccaaaaugauuugucaagcuugcugauguuucuguuuuucguuuuuuuuuuuuuuccggagagaggauaggaucucacucuguuauccaggcuggagugugcaauggcacaaucauagcucagugcagccucaaacuccugggcucaagcaauccuccugccucagccucccgaguaacuaggaccacaggcacaggccaccaugccuggcuaagguuuuuauuuuuauuuuuuguagacauggggaucacacaauguugcccaggcuggucuugaacuccuggccucaagcaaggucgugcugguaauuuugcaaaaugaauugugauugacuuucagccucccaacguauuagauuauaggcauuagccauggugcccagccuuguaacuuuuaaaaaaauuuuuuaaucuacaacucuguagauuaaaauuucacaugguguucuaauuaaauauuuuucuugcagccaagauauuguuacuacagauaacacaaccugauaugguaacuuuaaauuuugggggcuuugaaucauucaguuuaugcauuaacuagucccuuuguuuaucuuucauuucucaaccccuuguacuuuggugauaccagacaucagaauaaaaagaaauugaagua

SEQ ID NO: 1181 - RNA, 1121 nt, Homo Sapiens
caguggcuugaaaccaauaaauagaacauuaaugaagaauaugagaugaagcaaguuccagcaccaucacaggcaaccaaaauccucguguaggaguuugauagguggcagauucugaaagcugagauaauguuugugcucgaaguauaucccaaacgacugcagaaaaguaaaauuuauuuaaggaaagccuaaaauacuacaaauuuuagcaguuuugagauaauuugccuauguaagcugauaugaaauuaauccauuauucaagagaaucucuauuuaaaccaacacaaaugcccaacaacgauacacuggauuaagaaaacauggcacauauacaccauggaauacuaugcagccauaaaaaaugaagaguucacguccuuuguagggacauggaugaaacugggaaccaucauuuucagcaaacuaucgcaaggacaaaaacccaaacacugcauguucucacucauaagugggaauugaacaaugagaacacauggacacaggaaggggaacaucacacucuggggacuguugugggaggggggaggggggagggauagcauuaggagauauaccuaaugcuaaaugacgaguuaaugggugcagcacaccaacauggccgauguauacauauguaacaaaccugcacauugugcacaugcacccuaaaacuuaaaguauaauaauaauuacauuuuucagaaauuaacugugaagaugaaauuuucugcuauaaauauggcagcaaaugaaguaaugaugacacuguugagaaaauuugguuaugaaauagccacaugcuuguucugacauucuacaaauauuccaugagguuguuuuccauauuggcucccuggaaagccuuagaaauucucaagaagucuuggcuacugauuccagauauccgugucaagguggagcaaagucucuuccucuuguugacuggaacacagaaaauuacuaucaucugcaccaccccacccuaccuuuaucuguaaaauaauugcuauauuuuuaugaugccauuguaaucaaccaacuguaucacuuuuuaaaauuguaucugaggcuaaauauaauuuacugccuaaaauuuaaauauauuaauaaacuua

SEQ ID NO: 1182 - RNA, 512 nt, Homo Sapiens
uucacaaagagauccauuuaaagacuuuacaacguacguacacucauauguguuagaggcacuuucaguuuggccuucauucaguucacaaagagauccauuuaaagacuuuacagaagaaaaaugacaggaugaaaacugugccucgaggagauuaaacuggaagcagaagguaucaacccaggccauggagcugaauggagaagaaaugccuuccaucccuuccaaccauuuggcuucuccagucccucaccucaagcaaaccucaucaagguuuuccgauuuccagacccagguccugagcaacuauguaaaugcaaacaaacacuggugaugacuguaaggccaucaaacuccaaacagucaugcaaccagagccucugaagauggccccuucugccgggaacccuuagaucagccucugagggaguucugccauuuccccaaaacagcgcccccugucagcaggaagcgguuaagaucagucuucauccuuauccuuaaucuaacca

SEQ ID NO: 1183 - RNA, 1513 nt, Homo Sapiens
agucggcgccaaaaucaaacgcguccuggccugucccgccccucuccccaagcgcgggcccggccagcggaagccccugcgcccgcgccauggucgauuucugugaaaacgccccgguuucugccaaagggcaggagucgcugcucuugugccgggugcugcugguuguguagggcgcuguugcuuuuuuaaggacgcucugcacugaauuaggcuuccucgugggucaugaucaguuaaguccuggucaaagaaaaaaggacugagugcagaagaaaagagaacucgcaugauggaaauauuuucugaaacaaaagauguauuucaauuaaaagacuuggagaagauugcucccaaagagaaaggcauuaguaaguaccaaaguuauacuggaauguuuugggaaauauacugggauguuuugggaaauaucuuaauauucauuaagucaucuuuucugcaacagucucugcuaugucaguaaaagaaguccuucaaagcuuaguugaugaugguaugguugacugugagaggaucggaacuucuaauuauuauugggcuuuuccaaguaaagcucuucaugcaaggaaacauaaguuggagguucuggaaucucaggacccuggcugcugcuuccaugaaauaauuaaagucuccuauuauagaaaauucuggcugggcgcaguggcucacgccuguaaucccagcacuuugggaggcugaggcgggcagaucacgaggugacuuucccccacccccacaugaagugcaagauggaguugucugagggaagucaaaagcaugcaagccuacagaaaagcauugagaaagcuaaaauuggccgaugugaaacgggaagagcgaaccaggcuagcaaaagagcuuucuucacuucgagaccaaagggaacagcuaaaggcagaaguagaaaaauacaaagacugugauccgcaaguuguggaagaaauacgccaagcaaauaaaguagccaaagaagcugcuaacagauggacugguauguacuauaauaaugcugauaaacuauagcuaaauucccuucacacuuacugcgacgugaaauucagauaccuugugcuagcuuuguucaagaaaggacguuaaugaaaaauguaugcauuacucaaauaacauauucgcaauaaaaucuugggccaaaagaaaauuuggguuugaagaaaauaaaauugauagaacuuuuggaauuccagaagacuuugacuacauagacuaaaauauuccaugguggugaaggauguacaagcuugugaauauguaaauuuuaaacuauuaucuaacuaaguguacugaauugucguuugccuguaacuguguuuaucauuuuauuaauguuaaauaaaguguaaaaugcagauguucuucaccccuuuugguagaacaaaagcaggaugauaaccauauccccccagugcucaucaaaguaggacaauaaaaauccauccaucucaguccaggcagauuuacaaaugauuuu

SEQ ID NO: 1184 - RNA, 14787 nt, Homo Sapiens
guagauccuaauguugcucucccuggagcugggcugcaggaagucugggcccccggcucgcacucccggaccccgcaccaaccuccagggucgcucuccaaucuuaaccagguuugcucccugagcguacccaggugcuacagcaucagcuucccuugccgcuuccugcggcugaagggaugguccgaccaaagccuccugcccuggggcagccgaugccacugcaugcuuuuuccugcgcuugggcuucacggugccacggauauuggccggcuugcugcgcuuggagcguaggguaauguacaccacauugggcugcagaguggacccauugcccugggacucuggaggggccaggguaccauccagggguaucucagggaaggauggcucggcggugucgcggcugcgauguggccccuucucagccgccuguccaugcuggagagaggcccuccccaccuggcucaccaggaagcccaaguagauggcacacgcagugcccagcagaagguuucuccggguccuuggacgccggcugcuccagagcuuacgcacccgcgggacgcacagggagcagaugaaccaguuuaugagcugccccggcuugucuggacaggucauuucucugccgcauccacauguugaacggaguuuaaagucugcaguuggcuccugcuaaugugaugcaugguuuccugacuucagcugccgcguccgcuucgggauucagcugaaagaaaauaaaagcaucucuaguucuguuuuuucacuauuaaaaagaaaaagaagaaacucguaagcaaccuuacuuacacagcuggccccaugcuuggcuccaggaagaauguaauccuugacucuaaugcaaagaacuuuuaaaggcugaggcauaaaauaaacuuuaauuuuaaauucggaaaaaagaaaugccguagagaaucaguuuucauucaaauaaauuuccacuuauuuuuaaccccugggagcccucuaguguccuguucgcaaacagacucagaaaugucagucucaugaaguucaaaagaucgagaauguuugcuaucuugguggagcagccgcagccaagcaaguaacuuguaaaaugaggaaugccaucaccccucgaguguccaucccacauaacuugggguuagagcacaagcguucccaggaacuacucaccuuaccaucuuggccguuucauuugucuuccaccaguucuggaaagagaaggccuagaaguucagaaaaaaaggugugucacuugcugugacuguguggcagcuugcccaucuccugagagcccuugggaaagugaaggacaauauauaaggacuccaaucacuuaaaagcuaaguauuaaguuuuuccuugccacugcugacccagguuuguugcauagauugcagaccuggagauggauaccuuguucuugguucagugcugcacagacuccuccacugggggacccuaucccuugcuccucauaguccugauuucuaggacccauaacccuauuauaauuaaaaucccagcauuagcauagguuccuggcuacaaccuuuguccuacuuauuguauggaauuugcuaauaccuuugcuauccauuccaacaccaggccuggacagcaccaagcugcccugccugcagcugaaaaacuuuuaacuuaauagucuuugaaguuuugucauagaaguguuaaauaguacucuauacuguaucugucuuuugaacuguauguaaaagaaguuacauugaauauauuuuauagaaauaugugcacuuuuuaucuggcacuuuauugcucaccccuaaggacaucauuccuguugaccuaaacuaguacaucuauuugcaguaggaaaagugcuuuuggagaaaaucaccugucuccucagaacuggucuuacaagucugugaaguaacacuaugugccagccuaaucacucauauaugaccucaagagaacaccaaauaagcauauuuccagcaggaaaugaccagugcuuugguuaagaaugcacauuauacugcaguucuuuggggaaugaagccacccuugacugagguaaucaucaguucaaaggcaacuccuuguuuuaucuuugcacuaauugcuuagagaaauaaccagacaauauaauuuaugacaacaaaucugcauuuaacugaguuaacgaauuuguaaacaaaaagauuccuaucucagguaggugcuuuuggcaagauauuuaauuuugcccaguuuccucaucugaaguauuaugccaacucucacccugugaauccacugacuggggaacauuguuuaagaaaaucacauggcugugccaacaagcaaggagacacggcacagaagacagaggcagaagcagcuuuauugaaaaacagagcaugaguagaacgacuucaaaucccauauggcaccacagugagaaguaacuuccucugagcuucuuagagaauccaacaauguccugcuuccuuggggagcugcagccaugggcacaugggaauagggcuuccaccaagagucccgucagucacagcaacaggaggucuuccucagacaacuuugaugauagugguuguuagccagagcaagcuagaaccagaaagaaaaacuaugaagaugccacagugggagucugagcaccuugaggccuccuguuggaaacuggcaaaccuaacugugggacacuuggaugcugaguucugguaaacaugcugucggaggcacgguaauuuagucauuaacauuuaaaaacgaucuaauucuauauacauacucuguugaagacuucuuccaaccaccuuguauuauaaauuuaaaauaugaaauacaaacucuuuaugugucuugacucagauuaccuaggaagggacagugaccuauucaucaauguuuagaauuagaguaaguuauagaauauagucugagaaaauuacuuggaccaagaaagcaaugucccugacauucaucaaucuagaaccagagcugcagauuaagcuaggugcaaauuuaucagaaaacaauauuuuucccaaauacauauugcagccauaaaaugcccuaaaaacccaguucuuagagggacuauugcuuacuuacugagaaauuguauucucugaaaucauagacuaugagaugcauugcuguuuaaaauuauugcaauaagaaugaaacaucucacucuuaucuggaggaguuaagucauugugaucagugaagccuugauuuaagcuccugugcaaagcuucagagaaugggucucaggacacaacauuugacaucuauuuugacuucauuuccaagaaaauaggacugcuaugguuugaauguuugucucccucaaaccaaggugucggagguggggccuaaugggagacguuuggguuaucagggagggucccucaugaauagauuaaugcucucccuggggguagggaacaguuagugaguucuugcuuuauucauucucaagagagcugguuguuaaauagagccuggcgccucccuccucccuccuugcuuucucucucaccguaugaucuuagcacauuacaccuccccucaccuucugccaugaguggaagcagccugagccucucaccaggagcagaugcuggugccaugcuucuuguacagcccacagagcagugagccaaauaaaccucuuuuccuuagagauugcgcagccucagauguuccucuagagcaacacaaaauggacuaagacaagaaccauagguccauuucacaguacagagcugagguugaccccuuuuauacacaaccauacuuucuuagagcccauagaauaucauuucauuuacaucacaccuaaauuccacucuuuagcaaaaucuuauguuaacccuauauuuuccuuuguuugaugagauaccccacaauugcucuguugugcaguccccacacugcaaugagucaguaaacucaauugguuuguuuacagguugucccuggugguuuuaggcugauugggcuaagacaaaccacaucuuauuuuuuaaaugucuccuuuaagcaaauguuauuaucuguauuuuacucuauuccauaagcagaagugacaaaguagucuaauuuuaccaaaagaugcuuauagcauaaaacuuucuaugcuguaaacauagaaaguacuugccucuaggauggacccccaugauccccaccuccugguauccgcgccaugaugcaaucugcuuacagccuaaaucaggaugaaccauaugacucauagaacacugcagaaggcaugaugugugacuucagaugugaagucauagaggacaaggacacagccaccuucuuggauuucucacucuguggaagggcagugacauuccaugagacaagcaguccuguggugaggcccaugucaagaaggccugagaucucccaccaucagcuacagccaauuugucagucacgugaguaaaccaccugggacgugaauccucucgacuuaaccaccucuucagguggccagagcccuagcccaggucugacugcaaccugaugagaaacccugaguaggaagaccugcuugagcugcucccaaauuauugauccacagacacuaugagagauaauacguacuuaguguucuuuuaacccacuacauuuugguuggcuguauuuauuacccuguaacagaugacuaauacaucuccugugaucaaaacacuucagagguuccccauuucucucagagaaauauccaaaguccauaaggccugugaggccccucacauucuucccacccccauuaccucucuaacuccauuuucuaccacucuccuucuuuccaccucaaccacagcuacagugacuucuuugcccuuucucaaaucugccucagggccucuguacuggacacucucuccccacucccacucccuccuccaggccuucacugaaaugucucccucucagugaggacuuccuuuccuaaacugcaguacccccaaccuacacacacacacacacacacacacacacacacacacagagucucuagucuuccuagcuccuuaauuuuuuuuuccuuagcacauaucacuauuucauauaccauauuugucaucuauuuucugguuucccuuucucagauguaagcuaaguuggugcagggguuuuugucuguucccaaugucuagaagagugucugauuuacaguagacacuccaugaaauuugucaaaugaauacaccaguguuaagaguauaagaguguaauaguaccuuuaaaaaugccucaaagauaaaucuuuugauuuaucuuuauuuuuagaucucuacccccacuuuagccacuucugaaauuuacuacuagaaaaaccuuuucuuucgugaagaacugucucacaaaaauagcaguuaaauaggaagcuauccuaacccacuguuugccuuuucccuugugaaacucagaccaaaauugaaagucaucuauuguaacuauguguucuuggcaucuaaacucuguuuuguuucaucuugacuuucuuaauuuccuagguuuuuuccuuuguuccuauuauuuuauuguuuuuauucuauauugcuucaaagacuuuaugaaauuaaguaaauuauaaauacaaauauucaucauuucucauuauacacagagauccucaaaaugagcagcagauacacucagucuguaggaucauuuagcaacucggggaaggagguuuugagccaccugacaauucaguccagcacagcaacugaaggaaggcguuccccaaccugcuguccuaugaaggccucuaggucaccggugcuaaagcccuccuuucuccacccuccuuaaguggagguaaacgucccagcaggaagucaaggcuggauuggcgcucuucgcgagcacccugggaacgggagucugggucacgggugcuagagcccuccccucuccucccggccgguguaugggaaauuguccccgcagaaaguaaaggcuggccaggccgcccccagcacguagagggaaugagucaggcuccggcuccacacuggcacguagugggcggaucgcgccggcgcugaguaggaaggagcuucagccgccagcccggaacgcagugaguacagccacucaaaggaaagccaagucgcuuugcaggggagcgucucaugauuuuucagaaacgugcucaugguuaaaaagaaaaaucaaggcucggaauaaauacauucaagcacuguuaauuuuagcccaaagacaggcgguacuugccuggagauuugggaaaaucaacaugaaacuaaaaaugaaauuuuaguuggaguggagcaagcaguauugaucagaacauaccaaauacgaauuuuuucaaagucugcguagaaguuuaaauuacuaggaaaaauguaaaggagaaguauuuacuaauaaaugaaacaaaaguaauaaaauaaaaaugaauuaauauaguuugacaaaauaucagcgaacgcugaaaagaaaacauuaaaauaauguuugagacuuuuuagguuuugugcaggaagaauugggaaaaaugugcuggauggagugauacugcuuuucuuuuccacaaaaauuucauuauuuuagagagcgguagagccuuuuuaaagacaguaaguuauugccaauucacaaugaaauaagaucacaugcucugaaauguacaagagcugcaugcaauaaacuucauuuaucuauagguaauaacugauugauguuuauucaguagucgaaaugcaccucaugcacucuaauuagcacgucaaauuagucucuccguuucagagguguagggccuuuguggagccuucucaauaaaauaauuugccacucuugaagguuagacauucucuucuaucaauguacacauaaagguuuuguuuugcuuugcuuguugugaauuaaaauggggagaaaaugauguguuagcuaucacccagucaugugucuuuuuagucauagguuagcuuuucaagacacuuccugcaucucugaccuguugcaccucuguuaucuuggcaccucuguuaucuuagcagcaagcaccugccucagcugacccuugagccauaacccauguaagucacugcagggcugaaccucucuuugagccuaacaguagaauaauaauuauuuuuauugaauaguguuaaugugucaauguugaaaugugccucagugugucuuccucaaccacaucccuauagaggauguuuucuuaauagcaauguguuuuuguuuuaagaaaguccacacaauuucaaauacacauuuucuuuacuaaaguuuauugaccaguuuugaagugauccuuguuuucaguuaaacuaucuuuaauaaugguaaauaacauauuuuguagguuguuguauauuuaauauucucugcaagaacacauaaggaacaauacauggaccuuuaaauauuugucauugugaaauaaaauaacaaggaaaggugauuucagguguacuuuauucaauacauauauacaagaaguuauuacuauaacauuaaauuugcaggaaaaaagaaaccacuggauuauucugcuucuauuccagagggcuuauuccaaagggccagugugcaaaauaugaauccaagauggcauuguggaaagacgcuguaccuccugugauaaaauuacuuugguggugcuuuuuucucauguaucucgggaaacuaaaaaucugaauuguauucaguggccuuuuccaaaugaagcuccugaaaaguacaucaagucuaaagugaaccagcuaacucauuaagacuggaaucaugagcaacaauggagcagaccuaaccuuugguuacaucuccuguuuuguagcuauccuuuuguuuggcucaaauuuugugccacuuaaaaaauuugauacuggugaugguaauuauuuuuccuugauuguuaacguuauauuauuuuuaaaaaugaaguuccuuuuuuggucuuuuaaaaguauagcuacaaaaauaaaucauguugaucuugauaccuagugaauagagcuuaaaauuagucauuugacagugcucauaccaguuugucugaaagucagaauaggagaaccauuaagguuguuucaugguaaaguuagggaggguacagucaggaaaucucuugggccauuauaugaauggaagaaauuuauagucaguucuacuauaacaccuguuuugaaaacaugaaucuucaacaugauugauauauuagagaacaauguaagcauaacagauuuuuggcuugcuuaugugcaauuuugucccugagaaaccucuagauaggcacagaagacugcaccuagaugaauaaagaugugugauaauacacauaaugcacgcagacacacguacaaucuucaaauaucgaccagcucccuuaguucaucacaugugguuaugauguauuccacccaaccacaucuccugucccaacuccucacccaauaccuucacaguaacucguaagcugcaacccuuuggaugcucacuuccaggagcaaacuucugguguuuuucaauuaaaaugcccuauuuauuacagcaucauguaauuaaccaguuaaccaguuaaaacuguacuacuauuuuaauuagguugaguguuguucuccuagccccauuuucccauuaugcucuguaguuuuuacugcaugauuuugcauagugcagugauuucaaggaaugcacauguuacauuauagcagaacugacuaaugugaauuuuggggaaggagaagcaagaguuauuuguauuugccugacuuccauauuaaagccaggagaaggaauugagauuuauggugaacacauguugggaauuacuuccuugguaguauuuaucaccugacagcaguuguguuauuuccccaauucuuugucuucgugcacuuagaaaauaggauuaccuccuauuuuccuccagggccuuucuucucuuuuccucuggaguuaggacaagaaugggaacuacccgaagaacaaaaaaauggguagaggaucuagcuuuuuuagucuuccacaauuagcuuugugauccugggcaaauauuaccagcucugcuguuuucaguuucucauuuguaaagugaacaacuuauaaaaugaaguuucuuuucaucucugugagaauguuucuccaguggguucuuugugcugccauaugguugguugccuugguugucaaucugauauuacauuguccaaaguuuuggccuuuugcaaugcuugggggcugcauuugggcaacagggaacauugcuguugucccaauuaucaaaaccauugguuuaggccuuggaaucuuaaucuggggaucauuuaaugccuuaacuggcugggcaagcucaagguuuggcugguuuggauuggaugcagaagaaguaucaaauccgcugcuaaauuacauuggagcugggcuaucaguaguaagugcuuucauauuuuuguucaucaaaagugaaauaccaaauaacacguguuccauggauaccacuccauuaauaacagagcaugugaguauaguaugagagacaacuugauuugaaacauaaaauuaagauaaauggauaauacauaaauuuuaaacacagaugaaaaagugguguuugcucaucacuccuggcuauguaaaauaucuuagcuuauuuauuauggguaggucuauguagcaaucaaucaauauuuccgcaguugagcuucucagcaagcacacggguuuauuuauuuugauuaacagaucucuacuaggugauauauauauaaccccauuuuuguaaugauuuaaagauuccuacaauagaggaacccuaaauacuguagaggaaugugaaaauaacuuuagaaagucagaggaaggagguuuugaaguugguccaggggagaauagaccauaggaggccaagaaagguaagugaaguccuaugagaauaggaacugguaucccauucuacccgaagugaaaaacagaaaauaugauaggagucacuguuuugaucuugaagaaucuaaaucagucuggaauaguaaaucugaaugaaacaggagcaacuuuuaaaagggaccugauaaagcgcaagugucaguagcuacauauacaaaagugacuucagggcaaagccucauugucaugaacccaggcucuaauccuucucaucucaagaaaucucuccugucugcccugggccagugcuauccagcugcccucugaauccagcgcuccucacccccagugggguauugccccuuggcagggugcuuauuuaccccuuacuucaaaauuaaucuuuucuccuuuccuucuuccccuauccaaacuuuuaucaacuaaaaccuuaguuaaauugacacuaaaguugaauaguaauuagcuuaaguguaaagagaagagguuuauuaauccacaggcaucucuaaucagggaaauguuucagggagaagggaggaguuggcuuugggaaaggguuccuugccugcuucagggauccagacaccuccugcccaaccauccuccaaaacaauggaacaaaauaauaaaauaaaugcagcuugguaaaagauacacaguaggcuaacugccugagauuuuucuaggcaauaaguuuaaagauccauaaacagcaugauugauggguacagaaccaugcaucaugagcuccuuaugaugaaagaaaccguuauugccaaaggaaaacuugacuuagcacaugacaaagaauucaaaucuacuuucuugucucuuacaaaaauaauaggauuauaacaucaagaacacuucaguuggccaggcgugauggcucaugcccguaaucccagcacugugggaggucaaggugggcagaucaccugaguucaggaguucaagaccagccuguccaacauggugaaacucuaucucuacuaagaauacaaaaaaaaaaaaaaugagcugggugugguggcacacaccuguaaucccagcuacuugggaggcugaggcaggagaaucacuugaaccugggaggaggagguugcagugaaucaagaucacaccacugcacuccagccuggacaacaagaaugaaacuccaucucaaaaaaaaaaaaccaaaaaaacacuucggcuauaguauuauaauauaccccccuuauccacagggaauauguuccaagacacccaaggaaugccugaaaccacagauaguaccaaaccuauauauaguaugucuuuguaucugaucacuaagacagcuacuaagugacucgggggcaggcaguguauacgauaugaauaggcuggacauagggaucauucacguuccaggugagauggagaaggacgaugcaggguuucaucacacuauucagaacagugugaaauugaaaacuuaugaauuauucauuuccagaauuuuucauuuaaugucuuuggacuacuguugacagugaguaacugaaaccacagaaagugaaaguacagauaagggagggguacuguaauuccauaguagaaauaugaauuugcucauaauuuuuccuggcuuagaauaucagccuaauauugaaacauggcuuggaauguuuuauuaacuaauuuaguaaaaaaaacaaaucaguauaagaaaugcucauugaucuuaagcauuccauaggaggagagucuaauuuccuuacagauuaugcagaccauuaaaauaugcaaaugaaacaugagauaauaaguuuuauuaguuuuuauagguguaucacaauagccacauauuaaaugugagaauuugaaauggaagacuugccaacugccaagucauccuaaaugaaagaggaaacaauuagaaacaguugaguuuagagauaucagaaugcauaggugacauguuuauuauauuuuaaagcauguuugaaagagaagagaaaagcacuagaaauauugucaccagugugauuaucaauugaauguucuuuuguuuuaauuugggccaauguuuucaauaggugaucaacacaacccaagaccccuguuccuggguggauaaacuuucuacaguacaccaccgcauaguguaaggagagguuacuucuuugcucuauuacucuguuucauauuugguuaaagcagggauuaccagcaugaaguaauguucaucugaguucaagaagaaaauuguaaugcaagcuuugacuucuaucuccaugcggcgagguuuuuuuguccccagcugaauuuuaguaguccugaugccacuuuaauacugcaggguauuucugugacuuccgccagucacagagcuugagauaaauggaugguuuuugcuuguuugugauuugccuuuugaagcauguuuaugauuccauuugugcguuugucagaaauacugcuuugagccaagauuaauagugauuuauuuguuuuguaaggggcugcagucuugcagugauaucuggaguacucuauggaucuacauuugugccaaucaucuacaucaaggaccacagcaaaagaaaugauaguauauaugcaggggcaagccaauaugauuuagacuauguguuugcgcacuucaguggcaucuuucuuacaaguacugucuacuuucuggccuacugcauagccaugaaaaauaguccuaaacuauauccugaagcaguccuaccaggauuccugucaggaguacuuugggcuauagcuaccugcuguugguucauagcaaaucacucucugagugcuguggucaguuuuccaauaaucacugcugguccaggauuuauagcugcaaugugggguaucuucauguuuaaggaaauaaagggucuacaaaacuaccuauuaaugauacuugcauuuugcaucaucuugacuggagccuuaugcacugcuuuuucuaaaaucuaacaaugacaaaaccagcagguggcagcaguaguuaagagaacgcgucuaucggacagcggagagaucaugcugagaaaagagugcauuuucauauagcaaauggaucucagccacuguuggaguggguaaaugauuuuuuuccccaaaaaugugagaaugaaggaagauugaguuucauucaaguauaaaaaugaaaauuucuucugaugaacuguuuaugaagguaguacuuuacugggugacuaaaaugucuacauuauuauagcauuacauacgaggaugcucuuuuuaccacaguauguaccuaguguugcauaaucuagaacacaguauagaguccauauacaaagaaguuacaguccauauuucucaccuauuaccccagugaagugaggcagaaauaccuugggcgaggagggagagccuuaccuucuaauggaauuagauuccaaagauauuuggauccuuuguuucauaaaguaaaugcauaguugguaacuaaauguuaaaaaggccauuuuauuauuguuagccaaaacuucuguuuauuucaaguuaauaucgcccaacucuacaucaucuacccauuuuagcucauaaugcuuuugauuaucgccagauaaaguccauucucagagaacaaaaauuuuucaucauugagaaaaugugcauaacauaauacauacauacacaaguauauucacguacauaaauacacacagauauguugcuaaagugagauuguagguuaucaguaacaauuuaaaggaaacaaccacucuuuugaauguacaacuuuuuuuucugaaauacacuuuucuaaaacccucuuaacuggagguuuccuguuuucuucuuguuuuaacuggugguuuccaguaggcaaaauaaaaugacaggcaugcuaguuuuuuuuuuuuuuuuuuuuuuuuaagaaaacugaaauuaagccaggcaggguggcgcacuacuauaaucccagcugcuggggcggcugaaguaggagggucacuuagcccaagagugcaaaucugccagccuaggcaacauagcaaggucccaucucuaaaaaagaaauuuaauuuaaauuuguaagaaaaaagaaaacugaaacagaacugccaguacaauguuuguugcaauuguuuccaaaacuuugagauaacgaaaccccuauucaaauguaaauuuuacccauucccaccugauaguacuguuuauuacuuugcuaugcaggagaaacaaaacagcuuuuuauuuguguguauacucugaagucaaugugcauggguuaaaucccaccucugcuucauuuuauuuguguggcuuuggacaaguuccuaagcccucugugucaggccccucauuaacaaaauggaguuuaugauggcaucuaccucacaugguuauugugugguugaaauuaguucaaaucuguaaaguauguugaugaguaucugguacuuggcaaacacuauauaauuguuagcuuuauuauuauguguuguuugaaggggaaaaaaguuuuuguagauuggagaacaccauguaagagcuacuaagcucaccaccuucccauccaaacaauuauuacuccucuaaaugaauacuacuuaaaagugauggagcuucuguuuguuuauugaauugcuaauacaaauaaauauuugacuauaacuucuuauacucauuuuaauuuuaaccugaaaugucauuaaauuaugcugauaaacuuugaauaaauugugauacaaaagcuauuuuucucauuuaaauauauuuuagaauuuuauauuggauaacuuuuaauuauucuuuaguugggauuuccaauuuauaugcaaaauuuuaaaugugaaguaaagcaguuucagaagaaaaaug

SEQ ID NO: 1185 - RNA, 12005 nt, Homo Sapiens
gauaacagcuuccgccaggcggugaugaagaauccccccgaaaggaccccccaggaucuggaaauaguauauuccuauuuacaugguauggaagccuuaucaaacuugagggagcaucaacuuagguuaaugugugaaacugugagauaugagagacacgaagcaaaugaaguuuuauacuacccugaugauauugggaccugcugguauauccuucuuucugguuccguguucaucaaggaauccauguuucuuccaagaagcagcggggaaauggggagugcucagugcugcagagaaaagagcuccuauagaaggugacagcacuguugguguuagugguucuucaaagauacugaagacagugcagauuagggacacugauagaagaggcuucuaugcucugugacugccuuucguggaaagcucacacuggcagaaagugcucuugacccaacuugggagaggagaauguggucacagaaacuucggacaauuuggccuuacaacaccugcagcacccugucugguguuucauugccuauggguauuuacgaaaacuaguuuuggcaagcguucugcaggaaguuuuaggcguggcugugaaugcauuguuuuagagccuucugaaaugauugugguggacuauauggaugaaaaugaagaauauuuucagcggcaagcuucccauagacagucucgaaggagauuuagaaaaaucaaccagaaaggugaaagacaaacaauuauugacacuguggauccuuaucccaugggcaaaccuccuuugccuagaggcuaucacacggaaugcacuaaaucucaggauauuauuuggagucagcaaucaauggauuccaucccucugagacuugcuuaaccuacagcugcugauagaauacagagacuacagugucuugcuuucugcaggaagcagcaaugccguuuguuuccuaagaggaauuuuuuauuuagaaaaggaagcuuucuauccaggaaauggcuuuccuugugcguugcuaugccaacugccugcagccaugguccuccaaaguguuaagccuuuuugaggggagucugugugcagucagccauuuuagcuuuuuucuuuuuuuuuuuuuuuuccucuccuuuucuuuugccucuuguucuucaaucucagaaaugaucuuguucucuuggaagacugagagcugugugagguuuucucagucuugucauagccuaggaugguuagaguuucaauguuauaaaaauggagacgaacacuguuguucggauuccuuuucuggucuacaagugugaaggguuuuuaagcuuaccaguagugacacuuuaagcugcagcuugguuuucccuccucccuuuuuuuuuuuccuuuuucuuuuaauuuaaugcuguagagggugacuugccaucgugagagauugguacaugauguguaaauucaguucagcauauguuucuucauuaugaaaccacuagcaaucccagcuaaccauggaguuaugggccagcaggagaaacacucagaacagcaaucugacgucuuuagaggagacaucaguucauuauguggauacaaauucuaugcuuucggcuuuuauacaccaagucuuaauuuaaaucuguuuuucuugccuuuucuaacgaaagagacuacaucaugcuuccugcagauuucacaaaacugcaucuuacugacagucuccacccacaggugacccacguuucuucuagccauucaggauguaguaucacuagugauucugggagcagcagucuuucugauaucuaccaggccacagaaagcgaggcuggugauauggaccugaguggguugccagaaacagcaguggauuccgaagacgacgacgaugaagaagacauugagagagcaucagauccucugaugagcagggacauugugagagacugccuagagaaggacccaauugaccggacagaugaugacauugaacaacucuuggaauuuaugcaccaguugccugcuuuugccaauaugacaaugucagugaggcgagaacucugugcugugaugguguucgcagugguggaaagagcagggaccauaguguuaaaugauggugaagagcuggacuccuggucagugauucucaauggaucuguggaagugacuuauccagauggaaaagcagaaauacugugcaugggaaauaguuuuggugucucuccuaccauggacaaagaauacaugaaaggagugaugagaacaaagguggaugacugccagugugaaaggacaaaguucagagcuugauauacacacccuaugauaccaggcaauugguaaugguuuuccauuacccacauguaccucuuucuuuucuuuuucccuucuccuguugcccuuucuuuauuuccucuuuuacccucuuacucccuuuauucuuuucccuuguuuucuucuccacugccugugucuuaggccugccagugacacccaggcauugcuuagcccugcccuccacccuucaaguggggaaugaacacuuggauacccaugugcacaauuagguaugaauuucccucacagacugcaaagugccaguuuaaauagaucucaccuguuaaagcaaaucuauguuagacucaccucuuccuggaaucauaggcucuaauagcacuuagaauguaagaaacaguuuuggaugagaauacaguuugcuguggauaaauugaaaauugauuacacuauaugugguuugaaguuuaauuuuauuucauucaucaucuguaauguuuuacuuaaauacaaauuauaaugucaugcccaaaggaaaauaauccuaugauauaaacugucauugacuuuuauaagugaauucuuacuugaauuuuuauuuuauacuaggguacugagaucauauaguacuuucaugggcuuacagcaauuugaaacccaugagauuuacagaaacuuaaaaccucaguaaagcaauucagagauuuucugaacagguacgguggcucaugccuguaaucccagcacuugggaggccgaggcaggcggaucaugaggucaggaguucgagaccagccuggugaaaucccgucuguacuaaaaauacaaaaaaauuaccugggcaugguggugcgcaccuguacaaucccagcuacucgggaggcugaagcaggagaaucauuugaacccaggagccagagguugcagugagccaagaucacgccacugcccuccagccugggcgauagagugagauucucucaaaaaaaaaaaaaacucaaagauuuucaacugacuucaucauauuaguuaaaauuaaauguuaccuguggauuucauauuagaucuauaaauuuguuauagcaaaaauaaguugcuuauuuaaaaaagauaaauauuuucaaguaaaauguauuucuuuuaagguaccaguucuauaugaccauauuagaaauucaguuugggauuuuuuuuuuuuuccuuuuuggaugguguuccagcuugcuauagaauaaaugccaaaaugucugucuagacacuaagaauuucaaaucaaauguauucuaauuuaaaaaagucuguagucaagauuaauuuuaguacauuucucuucauaaagcauuuuucccuuauaucuacuuauucaguugaauucagggauguauuucuuuuuuagaagauaaaugagaaaaugaguauuuaauuauguucucuaaaacugagcacaagaaagaacaccuagaauuauuuggaaauaaaaccauucuaaaucucuuauauguauuugggaauaauuuugcugcuguguacaaagaaauaaaauauuuuuuagauaagaaacuaaggaucauguauuuugaaacauuacacaccuguggucaguguuaaggaaauugcucagaaauaauguuaacaguuuauuuauaaaauuaaugugauacuauaagcaauauuuuuaaaaauguaauaucagagcucuaaagguauuuuuaauauaauuaaaguaugcauaauuacuaguacaaaaaaagccuauaucuuuugauuuuuaacuuuuugcuucaaaaugcugaauagaaaaacuagugagauuagccaacucugggagaaauaugauacugcaauaugcuguuccucuuaugaacugcugcuucuacuuaaaaucuauugauuaugcggaaagcaugaaaaauauagaaagauacuaaaaugaaagucgcucauaauuugcauugcucagaaauaauauuaacaguuuauuucccuccaagauuuugaugugcauguauaauuuauuuuaaaauggccagcauguaguuaugagacaucaggcuguuuacucaucuguacaguggggauaauagcaccuuccucaugguuugauuaggaggaugaauugaaaaaguuccauaaggcugccacagugugauggugaugguggugaugaugauguugucauuaugauuaucguaauauuuaguauaguaucuuuuuuaaaaaauuaauaugagcaauauaaaaagaauaauguauuaucagagcucuaaaugcccuaugaaaucaugauuucaggugguugcaucauauuuuaucuuauuuacaauauaauuuaaccaccuccuuuuucaucuucuucacauuaaaggaggaaaagaaauaccaugcuucuuuccauuuccgaaugaucucuugucuccucacugaccucuaguuaauuucuauaauaagugauuucuaucauucauucuuaacuuucuuuaaaacuucuaagaaauguaauuucuuaagugguuugcccuaagcucugaaauuuuuuauauuuggggucagggagaguaaugacuucauaugcagauuuuuagcuuuuucuuuaagagcaaggauuacccuuaauaccaguuauaaggauaauguuuugagcuauaacacauaugugguuuguguuuugaccuucuuugaacaagcuuucuaaaaugguguuucaucaauauaauuagcaaauuaauauaucuacuccauagguaucuuugagugucuguaucuuucauuaaaaucauucucauucaaaaauuguugcuucuucaaauucuuuuaauucacuagaugauaauuaaguuuuuacaucuauucuccuacaauuccacucccccuacugcaguguuuuuuaauugugaaagaagcaugaaaaagcuaucuucuaauuaugucuuuugauuuuuaaaauuauuaggauuuugaauguaaaauacauauaaguauucuaaaaaugaaacuuuucuugaccaaggaagaaauacauuaaaaguagagaagucugauuaagguucauuacagcauuaauuuagaaaguaugggaaagacagggaaaaaugucaguuuuaaauaauuaaaacacugaauuauuaguacugcuaggucuuuugcaagcacuuuaucauuaacaugugacuuauguuuuauuccaguuugucugcauagcccagcaagauuacugccguauucucaaucaaguagaaaagaacaugcaaaaaguugaagaggaaggagagauuguuauggugaaagaacaccgagaacuugaucgaacuggaacaagaaagggacacauugucaucaaggguaccucagaaagguuaacaaugcauuugguggaagagcauucaguaguagauccaacauucauagaagacuuucuguugaccuauaggacuuuucuuucuagcccaauggaagugggcaaaaaguuauuggagugguuuaaugacccgagccucagggauaagguuggaaauauauucuauuuugucucuuaaauaugaaauguaaaccuaaagauacuuuaauguguauauuugucacagcaauuauguccagauuaauguaaugaaauaggagaauguaauucugaagcaaaaaaaaacaaaaaaacaaaaaaaaaguuacacggguaguauuauuguggguaaauaaucacuucaaugacuuugaaggagauccugcaaugacucgauuuuuagaagaauuugaaaacaaucuggaaagagagaaagaaaauggguggacaccuaaggcuguugaauaucgcgugugcugcuaaagcaaaaagaagauugaugacguuaacaaaaccaucccgagaagcuccuuugccuuuuaucuuacuuggaggcucugagaagggauuuggaaucuuuguugacaguguagauucagguagcaaagcaacugaagcaggcuugaaacggggggaucagauauuagaaguaaauggccaaaacuuugaaaacauucagcugucaaaagcuauggaaauucuuagaaauaacacacauuuaucuaucacugugaaaaccaauuuauuuguauuuaaagaacuucuaacaagauugucagaagagaaaagaaauggugccccccaccuuccuaaaauuggugacauuaaaaaggccagucgcuacuccauuccagaucuugcuguagauguagaacaggugauaggacuugaaaaagugaacaaaaaaaguaaagccaacacugugggaggaaggaacaagcugaaaaagauacucgacaagacucggaucaguaucuugccacagaaaccauacaaguaagcaucugcauaugucuucugugcauuauuuuauuuuguuaaaaugauaugcaaagauagugauguaauuaauguuugcaugagucugaaaacuguucuagguuuuuaugacugagcuauuuuggaagcaguauuaaacaaucaaauuuguuuuaaugauauugggauuggucagucucaagaugacagcauaguaggauuaaggcagacaaagcacaucccaacugcauugccugucaguggaaccuuaucauccaguaauccugauuuauugcagucacaucaucgcauuuuagacuucagugcuacuccugacuugccagaucaagugcuaaggguuuuuaaggcugaucagcaaagccgcuacaucaugaucaguaaggacacuacagcaaaggaaguggucauucaggcuaucagggaguuugcuguuacugccaccccggaucaauauucacuaugugaggucucugucacaccugagggaguaaucaaacaaagaagacuuccagaucagcuuuccaaacuugcagacagaauacaacugaguggaagguauuaucugaaaaacaacauggaaacagaaacucuuuguucagaugaagaugcucaggaguuguugagagagagucaaauuucccuccuucagcucagcacuguggaaguugcaacacagcucucuaugcgaaauuuugaacucuuucgcaacauugaaccuacugaauauauagaugauuuauuuaaacucagaucaaaaaccagcugugccaaccugaagagauuugaagaagucauuaaccaggaaacauuuuggguagcaucugaaauucucagagaaacaaaccagcugaagaggaugaagaucauuaagcauuucaucaagauagcacugcacuguagggaaugcaagaauuuuaacucaauguuugcaaucaucaguggccuaaaccuggcaccaguggcaagacugcgaacgaccugggagaaacuucccaauaaauacgaaaaacuauuucaagaucuccaagaccuguuugauccuuccagaaacauggcaaaauaucguaauguucucaauagucaaaaucuacaaccucccauaaucccucuauucccaguuaucaaaaaggaucucaccuuccuucacgaaggaaaugacucaaaaguagacgggcuggucaauuuugagaagcuaaggaugauugcaaaagaaauucgucacguuggccgaauggcuucagugaacauggacccugcccucauguucaggacucggaagaagaaauggcggaguuuggggucucucagccaggguaguacaaaugcaacagugcuagauguugcucagacagguggucauaaaaagcggguacgucguaguuccuuucucaaugccaaaaagcuuuaugaagaugcccaaauggcucgaaaagugaagcaguaccuuuccaauuuggagcuagaaauggacgaggagagucuucagacauuaucucugcagugugagccagcaaccaacacauugccuaagaauccuggugacaaaaagccugucaaauccgagaccucuccaguagcuccaagggcagggucacaacagaaagcucagucccugccacagccccagcagcagccaccaccagcacauaaaaucaaccagggacuacagguucccgccgugucccuuuauccuucacggaagaaagugcccguaaaggaucucccaccuuuuggcauaaacucuccacaagcuuuaaaaaaaauucuuucuuugucugaagaaggaaguuuggaacgucacaagaaacaggcugaagauacaauaucaaaugcaucuucgcagcuuucuucuccuccuacuucuccacagaguucuccaaggaaagguggcaguggcaaucagcugagaucuuuuggcuccgggcaguuggacuuaaccaguuccuccucuucucuuggaagugagaacaguaacaagaauaacaaugcaccacggaccuaugggauagguaggauacuuucuuuuuuccucucuaaacuucgauuaaacaacuuaagcuucauuagaauaaaacauuugucucuuagucauguggucucuacaagugaaaugggguuuuucuccccacuuaagagauaucuaugccugcauuuuauuuuugcuucuauuugguagacuucccuuugauguuauaaaccuagagagucuaauuaauacgguuguauuucucaugcaggcuauacuuuggcucccagugguacuguggauaauuuuucagauucuggucacagugaaauuucuucacgauccaguauuguuagcaauucgucuuuugacucagugccagucucacugcacgaugagaggcgccagaggcauucugucagcaucguggaaacaaaccuagggaugggcaggauggagaggcggaccaugauugaaccugaucaguauagcuugggguccuaugcaccaauguccgagggccgaggcuuauaugcuacagcuacaguaauuucuucuccaagcacagaggaacuuucccaggaucagggggaucgcgcgucacuugaugcugcugacaguggccgugggagcuggacgucaugcucaaguggcucccaugauaauauacagacgauccagcaccagagaagcugggagacucuuccauucgggcauacucacuuugauuauucaggggauccugcagguuuaugggcaucaagcagccauauggaccaaauuauguuuucugaucauagcacaaaguauaacaggcaaaaucaaaguagagagagccuugaacaagcccagucccgagcaagcugggcgucuuccacagguuacuggggagaagacucagaaggugacacaggcacaauaaagcggagggguggaaaggauguuuccauugaagccgaaagcaguagccuaacgucugugacuacggaagaaaccaagccuguccccaugccugcccacauagcuguggcaucaaguacuacaaaggggcucauugcacgaaaggagggcagguaucgagagcccccgcccaccccucccggcuacauuggaauucccauuacugacuuuccagaagggcacucccauccagccaggaaaccgccggacuacaacguggcccuucagagaucgcggauggucgcacgauccuccgacacagcugggccuucauccguacagcagccacaugggcaucccaccagcagcaggccugugaacaaaccucaguggcauaaaccgaacgagucugacccgcgccucgcccccuaucagucccaaggguuuuccaccgaggaggaugaagaugaacaaguuucugcuguuugaggcacagacuuuucuggaagcagagcgagccaccugaaaggagagcacaagaagacguccugagcauuggagccuuggaacucacauucugaggacgguggaccaguuugccuccuucccugccuuaaaagcagcauggggcuucuucuccccuucuuccuuuccccuuugcaugugaaauacugugaagaaauugcccuggcacuuuucagacuuuguugcuugaaaugcacagugcagcaaucuucgagcucccacuguugcugccugccacaucacacaguaucauuccaaauuccaagaucaucacaacaagaugauucacucuggcugcacuucucaaugccuggaaggauuuuuuuuaaucuuccuuuuagauuucaauccaguccuagcacuugaucucauugggauaaugagaaaagcuagccauugaacuacuuggggccuuuaacccaccaaggaagacaaagaaaaacaaugaaauccuuugaguacagugcuuguccacuuguuuacaauguccuccuuuuaaaaaaaaaaaaugaguuuaaagauuuuguucagagaguaaauauauauccauuuaaugauuacaguauuauuuuaaaccuuaaguaggguugccagccugguuucugaaaaaccaaauaugccggacaggguguggccacaccaagaagacgggaagaccuggcuugugacccuggcuucccauguccuucuggucucacccgcgaagugcccuauccuggaaguaugaaauguuagccaauuaauaccaagacaccucaucugcuccuuccccaguggaugggguucuucuguaaaacuguuugcacauggccaggggagggaacuaggacccuuguguccugucugagccuuauggaggcaggacggugucauuggcggauguguccugcuccauugagauggauggcaaaccccauuuuuaaguuauauuucuuugauuuuuguuaauuuagagguguagguuuuguuuuuuguuuuuuuguuuuuuuuuaagagaaacauuuauaacuggauagcauugcagugaaagcagcuugggauguuggagcuaaugccagcuguuuauacugcucuuucaagacagccucccuuuauugaauuggcauuagggaauaaacaagccuuuaaacgugauaaaagaucaaaaaccugguuagacaugccagccuuugcaaggcagguuagucaccaaagacuaaccuccaaguggcuuuauggacgcugcauauagagaaggccuaaguguagcaaccaucugcucacagcugcuauuaacccuauaaugacugaaaugaccccuccacucuauuuuuguguuguuuugcacagacuccggaaaagugaaggcugccaaucugaguaguacucaaaugugaggaacugcuggucuuggauuuuuuuuccauuaaauucagcugaucauauugaucaguagauaaacguaaauagcuucaaauuuuaaaaguggaauugcaguguuuuuucacuguaucaaacaaugucagugcuuuauuuaauaauucucuucuguaucauggcauuugucuacuugcuuauuacauugucaauuaugcauuuguaauuuuacauguaauaugcauuauuugccaguuuuauuauauaggcuauggaccucaugugcauauagaaagacagaaaucuagcucuaccacaaguugcacaaauguuaucuaagcauuaaguaauuguagaacauaggacugcuaaucucaguucgcucugugaugucaagugcagaauguacaauuaacuggugauuuccucauacuuuugauacuacuuguaccuguaugucuuuuagaaagacauugguggagucuguaucccuuuuguauuuuuaauacaauaauuguacauauugguuauauuuuuguugaagaugguagaaauguacuauguuuaugcuucuacauccaguuuguacaagcuggaaaauaaauaaauauaacauaaagccuugccuauauucuuaa

SEQ ID NO: 1186 - RNA, 96 nt, Homo Sapiens
ggcugguccgaugguagcggguuaucagaaccuauuaacaguagugucacuaaaguuaguauacaacccccaacugcuaaauaugaguggcuuuua

SEQ ID NO: 1187 - RNA, 691 nt, Homo Sapiens
gcaagacagaggcaggacugagaagacgagaggugggcuucguuccugagaauauccaggaguccaagagaucuaaauuggaagauggccuuccaauuuaggucaguuuccaauuaagaaggccagguuuuuaugaagcaauauuugucaagaauucaacuaucaacuugcugguccucuacuucccgaaacucuccagccuacauuucuuccucuucuucgguuucuaaacucaaacugacuuuggaaugaaagggagcagcugcugagguaggaaggucggagguggcccuccaaaagccucuuuucuggaagcuccgcugccaagggcucgacuggagucccaggacauauucagaggccgccagaccccugcauggaggccccucccuugcagcuccugguuaccaugauugaaugauguccugcagcuccgagccucagccaccuauguugucaagguuuccucugugaaagcauccaaaaacucugccagcaccuucuucuuuccuuuuuuguuuuccuaccagggccaggccaggcucugcuggccauuuccgauuaagcuccucagaaggcauagagccacucacacucagaauuauuuaaaauaacacuagacugcaaaugcccuaaauauccaucagaaauaaauggaugcauaacauugggugaaagaagccauacacaa

SEQ ID NO: 1188 - RNA, 4567 nt, Homo Sapiens
cugcucccggcugccuagggcggcgcggguaggccccguuguucucgugcguuaauagggaaagcugccuugauuaucuuguaauucucuaccaaaccaagaauaaaaaagaacggcggcuguguguuugugauauuuucuaucagcaaauuucaguucauaccacuaguuaguucuguggaccagaggcugguuucagaauggaaagaccuuugccgagugguaaacgaggcggggcugagcuccguccuguucaggcucagccuguaccugagcugcgcggcggccgccuuccugcuggggauccuguuugcccucgucugccggagcccgcgcgcccagccgcccgacuucgccgccgccuggagccggcuggccgcgaccucagccgcccgccgcccgccggggaguccuguguauggaaacucacaugagucagcucagucuagaaggguaguaauuucucauaauauggauaaagcucugaaagaaguguucgacuacaguuauagagauuacauucuguccugguauggaaaccucagcagagaugagggacaacuuuaccaucugcucuuggaagacuuuugggaaauugccagacagcugcaccacagacugagucacguggaugugguuaaaguugucugcaaugauguugugaggacuuuacucacucauuucugugaccugaaagcugccaaugccagacaugaagaacagccaagaccuuuuguguugcacgcaugcuugaggaacucagaugaugaaguaagauuucuacaaacguguucucggguucugguguuuugucuccuccccucaaaggaugugcagucucucagcuuacguauaaugcuugcagaaauucucacaacaaaagucuugaagccgguaguggaguuacugaguaauccagauuacauuaaccaaaugcugcuugcccagcuggcguacagagagcaaaugaaugagcaucacaagagagccuacaccuaugcccccucuuacgaggacuucaucaagcucauuaacagcaacucugauguggaguucuugaagcaacuaagguaucaaauuguaguggaaauaauccaggcgacuacaauuagcagcuuuccccaacugaagaggcacaaaggaaaaaaugccauguagcagauugggagaaauuaccugauuguuaacucucugaaaccuuaagggguuaaccgcugucucgcuccauuccugcugcuaugacaaaauaccacaaacuggguauuuacuauaaagaagagaaauuuauuucuuacuuaucuggaguuugggaauccaggaucaagccugcggcauucaguggcugguaaagaaacugcggcaaugaaagcugaucuccugagggccaggaacaugaagagguacaucaaccaacugacuguggcaaagaagcagugugagaagagaauccgaauccugggaggcccugccuaugaccagcaagaggauggggcccuggaugagggggaagggccucaaagccagaagauucuucaguuugaagauaucuuggccaauacguucuaccgagagcacuuuggaauguacauggaaaggauggacaaaagagcucugauuaguuuuugggaaucuguggaacauuuaaagaaugcuaacaagaaugaaauuccacaauuaguuggugaaauuuaucagaauuucuuuguggagagcaaagaaauaucuguggaaaaaucacuuuacaaagaaauucagcagugucuuguaggaaauaaagguauugaaguauucuacaaaauccaggaagauguuuaugagacccuaaaggauagguauuacccuucauuuauugucagugaccuguaugagaaauuguugauaaaagaggaagaaaaacaugccucacagaugauuuccaacaaggaugagaugggcccaagagaugaggcuggugaggaagccguggaugaugguaccaaucagaucaaugaacaagccaguuuugcuguaaacaaacugcgagaacuaaaugagaaacuugaauauaaaaggcaagcucuaaauucuauucaaaaugcaccaaaaccugacaagaagauuguuuccaaguugaaggaugaaauaauccuaauagagaaagaacgcacagaccuucagcugcacauggcaagaacggauugguggugugaaaaccuuggcauguggaaagccuccaucaccaguggagagguuacagaagagaauggugagcaauugccauguuacuuugucaugguaagccuacaagaaguuggaggaguugaaacuaagaacuggacgguccccagaaggcucagcgaguuucagaauuuacaccggaaacucagugagugcgucccuucuuuaaaaaaaguccaguugccuucucuuagcaagcugccuuucaaaucuauagaucaaaaguuuauggaaaagucgaagaaucaauuaaauaaguuuuuacagaaucugcuuucagaugaaagacugugucagagugaagcacuuuaugccuucuugagcccuucuccugacuaccucaagguuaucgacgugcaggggaaaaaaaauucuuuuucauuauccucauuuuuggaaagacuuccucgcgacuucuucucccaccaggagagcuuaagucacagcuuuaaaaauaacuaaauuacuuuaaaaugcauguuugaaaaaaagcagugaauuuaaaauuauuuacuuccugcuguuuuaagggagugaaaaauaaaaaauaaguuaaaagccuuaguuuugaaauucaaaaugguuagaaaacuauuuuauugucuauuaauucacugauuauaauacagcgacagauuuuuuuuuaaauuagcuuauuuuaagccuugaauaaggcucgagaaucaagcuuuucugaaucuguccucuguguugaaaaugguaguuucugcaugaaaacuaaagaauuaaggcuaaaauacgagcagauaguuuggaauuuacacuugaagagggagaacaacucuaccaauuuucuuggauaaguuaucugcuuccuaugacuuugcuguauucccaggaggagacagaggaggacagugaccugucagauuauggugaugauguggaugggaggaaagacgccuuggcugaaccauguuucauguugauuggggagauuuuugaacuucgaggaauguuuaaaugggugagaagaacauuaauugcccucguucaggucacuuuuggaagaaccaucaacaaacaaauccgggacacagucagcuggauuuucagugagcaaauguugguuuacuacaucaauauuuuccgggaugcuuuuuggccaaaugggaaguuggcaccaccgaccacaaucagaagcaaagagcaaagucaggaaacaaaacagagagcacagcaaaagcugcuugaaaacauuccagauaugcuucagagccuuguuggacagcaaaaugcccgccacgguauaauaaaaauauucaaugcacugcaagaaacaagagccaacaagcaucuguuauaugcgcugauggaacugcugcuaauugaacuguguccugagcugagaguucauuuagaucaacuuaaagcuggccaaguuugagacuacacaaauaaaccaccagaaaaaugucuguguaauaauagacaugaaacauuuuccucuuuuccacagagggcuuaacugagaaccguauugauuuuuauuuuaguuaccucccucuaguuuuaugugaaauuaguagaaucagggaggacgggacuuaugcugugguaggcaacagaaaaaaacuucuauugauuuuaauuuaauaugaauacuuuaaagaucaacauaccgauugaaauacaaauguuaauaugugagaaccuaggaaguauuuuaaauauuuaugaaaauauuuuguuuuaaaaugaacuaugaauauuguacaguuaauuuccucacugaggacugugaacauucuuauauuauuucauguauauugaagaacauuguuaugcaaugcuuuguguaaaguuauugugaagauuuuauugucuuuauuuuuaccaaagauuucccauaguuugagcauucaaagcaauaaaauauaaaaaugaaucacaggaacuucaacaaauacgcuucugucuccuagagaccaugauugaaauuuucugaaauaaggccugaacuuuggaauuuguaaaagauccucgggugauuuuaacaugcagagaagcuugggaaccacugcuguaauaucagagucagccaagggacucagaagacucccccacucaggcugaacaaucuguguuccacaaacacugcucuaccaagucugcuaugauguaauucugacucguggaugugauggaccuaagaugugcacagcuuuuugguuuuucuuuuuuuaaaaaaaaucuaaacuuaagaguuaguacucauaaugaucucccuuacacccccuccacuaccacaccccuugcuuuuuaguauuuacuuugagaugugaaacgcauuugggaucuaaauaaauugaucacauggauuaaaaua

SEQ ID NO: 1189 - RNA, 825 nt, Homo Sapiens
uccaaaguaggaguugccuccgaccagggaaggggauuccaacgcaaugcuaggugacacugaaguggucauuuauaacuacguuacuauggagacaggaaagauauauauuuauccaaaccuggggaugaauuaaucuuaaaaagaugaguacaaguacuucaacagaugaggacgaucugaagguuagcuguuugcuucaugugaauaggagcaaagcccaaggagaggacaccuucacccuccaacccuucugaguaaaacggagauccuaucccuaaagcaaggcuccaagucaaugggccugugcacaauagaagaacaucuggccucggggacacguuuaccucuaggcaaagagcaggagcgcaguauugaguauuguuguaaacaauaccauuuggaaaccugguuccgcuccugugaguccagcaaacgccucaaagacgcccuuuuaggauuucuuuaaauuaaucugagacaacgugggaauacucucuauauaguaucuagccuacuggauaugugguuuuuguuguuguuguuguuuguuuuauuuuuauuuuuggcacggcacugaagucuguguaaauaaaaggcccagauaaacucggcgaugggccuuucugucaaaaccaggcuggcuuuacauggcaaaaccagggccuuacguguuuggacaccugacuuuccaugucgcccguaaaaucgcugguagggaaacauuuuaauuuaguaggcaccuuauuuuuaccgagaugcuuaaggcugucacgagcuacuacucuugaugguaguaggaaauaaacacgagcgaugaaaaca

(The sequence listing continues in the following parts.)

What is claimed is:

1. A method of promoting bone healing in a subject with a fractured bone, the method comprising
   providing a nonunion-mitigating intervention to the subject when a difference in the level, or a difference in change of the level, of a panel of RNA biomarkers in a subject's sample as compared to the level of the panel of RNA biomarkers in a reference sample is indicative of a nonunion or slow healing of the fractured bone in the subject, wherein the difference in level or the difference in change of level of the panel of RNA biomarkers is determined by:
   (a) comparing the level of a panel of RNA biomarkers in a sample from the subject to a baseline level of the panel of RNA biomarkers in a reference sample, wherein a difference in the level of the panel of RNA biomarkers in the subject's sample as compared to the level in the reference sample is indicative of a nonunion or slow healing of the fractured bone in the subject; or,
      comparing the change of the level of the panel of RNA biomarkers between samples collected from the subject at two or more different times to a baseline change of the level of the panel of RNA biomarkers in corresponding reference samples, wherein a difference in the amount of change of the level of the panel of RNA biomarkers in the subject's samples as compared to the level in the corresponding reference samples is indicative of a nonunion or slow healing of the fractured bone in the subject; and
   wherein the panel of RNA biomarkers is selected from the group consisting of:
   (i) a panel of RNA biomarkers comprising SEQ ID NOs: 1, 2, 3, 4, 5, 6, 7, 30, 31, 53, 64, 75, 78, 89, 104, 106, 109, 126, 132, 134, 189, 191, 194, 228, 233, 239, 270, 279, 283, 290, 291, 293, 299, 344, 347, 349, 371, 388, 400, 401, 408, 413, 442, 449, 453, 459, 471, 497, 512, 513, 515, 518, 519, 520, 521, 522, 523, 525, 527, 528, 529, 531, 533, 539, 540, 541, 543, 548, 549, 550, 551, 552, 554, 556, 618, 654, 677, 702, 1520, 1549 and 1838; and,
   (ii) a panel of RNA biomarkers comprising SEQ ID NOs: 9, 24, 45, 103, 124, 164, 219, 314, 351, 516, 517, 526, 534, 535, 542, 553, 562, 563, 572, 573, 582, 598, 599, 602, 609, 619, 620, 624, 625, 634, 652, 653, 655, 656, 676, 682, 698, 700, 701, 703, 721, 722, 723, 724, 725, 729, 753, 759, 760, 762, 764, 765, 766, 768, 769, 770, 771, 777, 781, 785, 789, 791, 794, 806, 814, 816, 824, 844, 850, 855, 862, 864, 867, 885, 889, 910, 911, 912, 914, 915, 917, 918, 931, 934, 938, 954, 958, 961, 962, 966, 968, 985, 996, 1004, 1024, 1027, 1030, 1032, 1035, 1051, 1054, 1063, 1066, 1068, 1069, 1070, 1071, 1073, 1074, 1075, 1080, 1086, 1087, 1096, 1100, 1109, 1110, 1111, 1114, 1115, 1126, 1141, 1151, 1153, 1154, 1180, 1201, 1216, 1228, 1244, 1245, 1277, 1279, 1281, 1283, 1286, 1288, 1293, 1318, 1337, 1363, 1382, 1405, 1406, 1431, 1437, 1489, 1493, 1499, 1500, 1501, 1502, 1506, 1508, 1512, 1513, 1514, 1515, 1516, 1517, 1522, 1523, 1524, 1526, 1527, 1528, 1529, 1531, 1532, 1533, 1534, 1535, 1536, 1539, 1541, 1542, 1543, 1544, 1546, 1547, 1548, 1551, 1552, 1554, 1555, 1561, 1562, 1565, 1568, 1575, 1576, 1579, 1582, 1584, 1585, 1597, 1598, 1599, 1600, 1601, 1605, 1607, 1608, 1609, 1610, 1626, 1627, 1628, 1637, 1640, 1643, 1645, 1648, 1649, 1652, 1654, 1656, 1657, 1662, 1665, 1677, 1830, 1831, 1832, 1833, 1834, 1835, 1836, and 1837.

2. The method of claim 1, further comprising determining the level of the panel of RNA biomarker molecules in a sample from the subject before performing step (a).

3. The method of claim 1, wherein the level, or change in the level, of the panel of RNA biomarkers is at least 1.1-fold higher or lower than the level, or change in the level, of the panel of RNA biomarkers in the reference sample.

4. The method of claim 1, wherein the bone healing does not occur or initiate for a period selected from the group consisting of: about 9 months or less after injury or after a nonunion-mitigating intervention, about 4 months or less after injury or after a nonunion-mitigating intervention, and about 2 weeks after injury or after a nonunion-mitigating intervention.

5. The method of claim 1, wherein the bone healing is assessed at one or more time periods, and wherein the assessment is done during or before the fourth month of healing.

6. The method of claim 1, wherein the nonunion-mitigating intervention comprises at least one treatment selected from the group consisting of:
   (a) an invasive surgical treatment comprising bone graft, removal of scar tissue, application of therapeutic drugs or biologics, or immobilization of the fracture with metal plates, rods or pins, and
   (b) a non-invasive treatment comprising electrical stimulation, ultrasound, treatment with therapeutic drugs or biologics, or immobilization of the fracture with specialized braces.

7. The method of claim 1, wherein the RNA in the panel of RNA biomarkers is at least one selected from the group consisting of a messenger RNA, a non-coding RNA, and a microRNA.

8. The method of claim 1, wherein when the level of the panel of RNA biomarkers in either (i) or (ii) is at least 1.1-fold higher or lower than the level of the corresponding RNA in the panel of RNA biomarkers in the reference sample, nonunion, slow healing or normal healing after acute injury is indicated, or successful, no or slow healing after a nonunion-mitigating intervention is indicated.

9. The method of claim 1, wherein a change of expression over time of the panel of RNA biomarkers in either (i) or (ii) indicates nonunion, slow healing or normal healing after acute injury, or indicates successful, no or slow healing after a nonunion-mitigating intervention.

10. The method of claim 9, wherein when the change in the level of expression over time of the panel of RNA biomarkers over time is at least 1.1-fold higher or lower than the change in the level of expression over time of the corresponding panel of RNA biomarkers in the reference sample, then nonunion, slow healing or normal healing after acute injury is indicated, or successful, no or slow healing after a nonunion-mitigating intervention is indicated.

11. The method of claim 1, wherein the panel of RNA biomarkers comprises a panel of mRNA or ncRNA biomarkers.

12. The method of claim 1, wherein the panel of RNA biomarkers comprises a panel of miRNA biomarkers.

13. The method of claim 1, wherein at least one of the following applies:
   (a) the subject is a mammal;
   (b) the subject is a human;
   (c) determining the level of the panel of RNA biomarkers comprises at least one technique selected from the group consisting of reverse transcription, PCR, microarray, next generation sequencing, nuclease protection, probe hybridization, pyrosequencing, and primer extension;
   (d) the subject's sample is at least one selected from the group consisting of blood, peripheral blood, serum, plasma, urine, stool samples, saliva, biological fluid gathered from an anatomic area in proximity to the fractured bone, biological fluid from fractured bone, primary cells, and cultured cells;
   (e) the comparison of the level of RNA expression is computed using at least one statistical method selected from the group consisting of pairwise and multi-class ANOVA tests, t-tests, chi-square tests, Bayesian tests, machine learning algorithms, and Extraction of Differential Gene Expression (EDGE) tool analysis;
   (f) the ratios, sums, products or other mathematical combinations of expression level of at least two RNAs as compared to the corresponding expression levels in reference samples are used to calculate a score or composite score that characterizes the bone healing in the subject.

* * * * *